United States Patent 11,446,398 (REGULATED BIOCIRCUIT SYSTEMS) - sequence listing, part 9

SEQ ID NO: 35136 - protein, 223 aa, Homo sapiens
  Payload ID: 6936
  Gene Symbol: ERICH1
  Gene Name: glutamate-rich 1
  ENSP ID: ENSP00000428556
  MOD_RES (1)..(1): Any amino acid
XDGADASEEDLTRARQEEGADASEEDPTPAGEEDVKDAREEDGVDTIEEDLTRAGEEDGKDTREEDGADASEEDPTWAGEEEGADSGEEDGADASEEDDTITNEKAHSILNFLKSTQEMYFYDGVSRDAASAALADAAEELLDRLASHSMLPSDVSILYHMKTLLLLQDTERLKHALEMFPEHCTMPPGKYRTIYSRSCLRYSHRGLPLKDLHATKTAMSWKI

SEQ ID NO: 35137 - protein, 345 aa, Homo sapiens
  Payload ID: 6936
  Gene Symbol: ERICH1
  Gene Name: glutamate-rich 1
  ENSP ID: ENSP00000428635
MAAHRKHDQDPHDQPKRRRIRKHKSKKKFKNPNNVLIEQAELEKQQSLLQEKSQRQHTDGTTISKNKKRKLKKKQQIKRKKAAGLAAKAAGVSFMYQPEDSSNEGEGVGEACEEDGVDTSEEDPTLAGEEDVKDTREEDGADASEEDLTRARQEEGADASEEDPTPAGEEDVKDAREEDGVDTIEEDLTRAGEEDGKDTREEDGADASEEDPTWAGEEEGADSGEEDGADASEEDDTITNEKAHSILNFLKSTQEMYFYDGVSRDAASAALADAAEELLDRLASHSMLPSDVSILYHMKTLLLLQDTERLKHALEMFPEHCTMPPGVLSRLKAKKIRRGKREGLP

SEQ ID NO: 35138 - protein, 124 aa, Homo sapiens
  Payload ID: 6936
  Gene Symbol: ERICH1
  Gene Name: glutamate-rich 1
  ENSP ID: ENSP00000430296
  MOD_RES (1)..(1): Any amino acid
XFLKSTQEMYFYDGVSRDAASAALADAAEELLDRLASHSMLPSDVSILYHMKTLLLLQDTERLKHALEMFPEHCTMPPGGKSEAQRAWANGTGHTAHQWLHVSSDLGLLLSVFPISMTLTDAGV

SEQ ID NO: 35139 - protein, 7 aa, Homo sapiens
  Payload ID: 6936
  Gene Symbol: ERICH1
  Gene Name: glutamate-rich 1
  ENSP ID: ENSP00000488494
MAAHRKH

SEQ ID NO: 35140 - protein, 7 aa, Homo sapiens
  Payload ID: 6936
  Gene Symbol: ERICH1
  Gene Name: glutamate-rich 1
  ENSP ID: ENSP00000488567
MAAHRKH

SEQ ID NO: 35141 - protein, 156 aa, Homo sapiens
  Payload ID: 6937
  Gene Symbol: ERICH2
  Gene Name: glutamate-rich 2
  Uniprot ID: A1L162
  ENSP ID: ENSP00000387298
METVNEPETGEVSKDAVIVKQEKNNEYCLQDIDDKLSESAEDDGEDDTNDEDDDEDSNPKKNTQAPLELMAEFLRAEMAREYQLAKKLCQMILIYEPENPEAKEFFTLIEEMLLMEKTQNHEQDGENSDEDSSGESKGESDEELSDESSDEGEDGS

SEQ ID NO: 35142 - protein, 1530 aa, Homo sapiens
  Payload ID: 6938
  Gene Symbol: ERICH3
  Gene Name: glutamate-rich 3
  Uniprot ID: Q5RHP9
  ENSP ID: ENSP00000322609
MSHSHPAGLLAAYNSLMDKHLAGYFNNTRIRRHLLRSGLITRSGRILSEKEYKLNMMKRDHQKYIRECLAQAIFHKVLDMERYHQLEIKKKLETLARKERIQRFKGEHTRRSVENNMPILSPHPPVGPKSNRGHSVLVDEGHSSPLALTAPRPYTAPGNMQPPIRLQPLPSNPAVETVPKVTSRSRSKTSLLENEALFPIGGKKAVMKFRNSIGNSQRMNSYQLPNINSYMMPIPPPLPPTGKITRENRSETWRRRRFRPTTAPNGLEPLLTKDSRRIHKTSLHSNAAITMIYLGKNVHLSSDNPDFRDEIKVYQQHCGGENLCVYKGKLLEKETFQFISKRHHGFPFSLTFFLNGMQVNRLSSCCEYKHRKGSRLGGKRGYFGFVCVERSSPCYKCIIAMGLDKKPSLPKSRKEKSTEKGEELKKAEGKVRKEREYVIPKRNEIKENKTSVSAKFSAQEIKTGLKEVVTAVEEMTSKGKPGQEVLEDDQENTLKYEYEEDFEVDEEKQGEKSNEEGQADVQMNGIPQSPLDDKKDNLDPEKESETSSQKAPDARDNVKDENDGCSESELEEDKQDMKTASSTSSRSHPYSSDSEDESAVGDREAHTDSSTDESARRSSSQELSENDKPRKSHLPIEESLEIEIEDQEITKADVETKPMPIDESFENVLKEGTEKGTQEIAEGLSEKSGKHVSAEEKEKDKSKLWEESTAQVKDKKAGLPGLEEGGKDSLPLAYVLALGAPTMNFMVDETAAINSNKESQQLVQKTYTLEKKEAMEEDEAPQHRDADIVQGKGEAALWGEAGAVHEAPLRAWKPTAEQPELAEEFTEKREIPPGIERGAEGAAEAEGVRRLGEGGSDPIGQAAAKDAVGLSKDEAPEKQALMLTVLETDKAASEGEQGLEKAVLANEAAALNLEHLHEVAALREAATSEEGEAEGGVAVSDVGESEEEASIDLEDTGPMEDTASKREDGSEEAILGGEEPAKERKEVMRTETRLSPFTGEAEASRMQVSEGSPEEGSLAKEAFLCKEDVEGEEMVTEAEANREDDRKEILPKELDLARERRKAERPKTSLRKTDSEREEVTRANALKDEDAFKEEQKLKAEEGETETEVRAEEETKAPPNEMGSDAENEAPVEASELSDNPGLLGEDSLKETVVPIFEATPGFEKSLENITALRKEGGGERLSEARDTEHKDREELSSRENRALKEGHRQDGEGALAAPEAEPAGKVQAPEGLIPATGQAEELAAKDHDSCAGLEGRAEGQGGVDVVLRTQEAVAEEDPIMAEKFREEAVDEDPEEEEDKECTLETEAMQDRNSEGDGDMEGEGNTQKNEGMGGGRVVAVEVLHGGGETAETAAEEREVLAGSETAEEKTIANKASSFSDVAEEETWHQQDELVGKTAAAGKVVVEELARSGEEVPAAEEMTVTYTTEAGVGTPGALERKTSGLGQEQEEGSEGQEAATGSGDGRQETGAAEKFRLGLSREGERELSPESLQAMATLPVKPDFTETREKQQHMVQGESETADVSPNNVQV

SEQ ID NO: 35143 - protein, 533 aa, Homo sapiens
  Payload ID: 6938
  Gene Symbol: ERICH3
  Gene Name: glutamate-rich 3
  Uniprot ID: Q5RHP9
  ENSP ID: ENSP00000398581
MLAKGKKAVMKFRNSIGNSQRMNSYQLPNINSYMMPIPPPLPPTGKITRENRSETWRRRRFRPTTAPNGLEPLLTKDSRRIHKTSLHSNAAITMIYLGKNVHLSSDNPDFRDEIKVYQQHCGGENLCVYKGKLLEKETFQFISKRHHGFPFSLTFFLNGMQVNRLSSCCEYKHRKGSRLGGKRGYFGFVCVERSSPCYKCIIAMGLDKKPSLPKSRKEKSTEKGEELKKAEGKVRKEREYVIPKRNEIKENKTSVSAKFSAQEIKTGLKEVVTAVEEMTSKGKPGQEVLEDDQENTLKYEYEEDFEVDEEKQGEKSNEEGQADVQMNGIPQSPLDDKKDNLDPEKESETSSQKAPDARDNVKDENDGCSESELEEDKQDMKTASSTSSRSHPYSSDSEDESAVGDREAHTDSSTDESARRSSSQELSENDKPRKSHLPIEESLEIEIEDQEITKADVETKPMPIDESFENVLKEGTEKGTQEIAEGLSEKSGKHVSAEEKEKDKSKLWEESTAQVKDKKAGLPGLEEGGKYGR

SEQ ID NO: 35144 - protein, 110 aa, Homo sapiens
  Payload ID: 6938
  Gene Symbol: ERICH3
  Gene Name: glutamate-rich 3
  ENSP ID: ENSP00000473404
MLAKGKKAVMKFRNSIGNSQRMNSYQLPNINSYMMPIPPPLPPTGKITRENRSETWRRRRFRPTTAPNGLEPLLTKLSCTCLRNLKRNEKESHKQLVKEIRKKSFSYAGA

SEQ ID NO: 35145 - protein, 130 aa, Homo sapiens
  Payload ID: 6939
  Gene Symbol: ERICH4
  Gene Name: glutamate-rich 4
  Uniprot ID: A6NGS2
  ENSP ID: ENSP00000367429
MELWRQLNQAGLVPPGLGPPPQALREVSPVEIPGQTLRTAGADTGGACDSLLWIREELGNLRRVDVQLLGQLCSLGLEMGALREELVTILEEEEESSKEEEEDQEPQRKQEEEHLEACPAPHPPDFEMMI

SEQ ID NO: 35146 - protein, 374 aa, Homo sapiens
  Payload ID: 6940
  Gene Symbol: ERICH5
  Gene Name: glutamate-rich 5
  Uniprot ID: Q6P6B1
  ENSP ID: ENSP00000315614
MGCSSSALNKAGDSSRFPSVTSNEHFSTAEESESCFAQPKPHALGRESTVDGNVQRESRPPLQKLKVSAEPTANGVKPLQEQPLAKDVAPGRDATDQSGSTEKTQPGEGLEESGPPQPGGKEDAPAAEGKKKDAGAGTEAESLKGNAEAQPLGPEAKGQPLQAAVEKDSLRAVEVTENPQTAAEMKPLGTTENVLTLQIAGELQPQGTVGKDEQAPLLETISKENESPEILEGSQFVETAEEQQLQATLGKEEQPQLLERIPKENVTPEVLDRSQLVEKPVMNDPFHKTPEGPGNMEQIQPEGIVGSMEHPARNVEAGAYVEMIRNIHTNEEDQRIEGETGEKVETDMENEKVSEGAETKEEETGEVVDLSAAT

SEQ ID NO: 35147 - protein, 56 aa, Homo sapiens
  Payload ID: 6940
  Gene Symbol: ERICH5
  Gene Name: glutamate-rich 5
  Uniprot ID: Q6P6B1
  ENSP ID: ENSP00000440297
MGCSSSALNKAGDSSRFPSGETGEKVETDMENEKVSEGAETKEEETGEVVDLSAAT

SEQ ID NO: 35148 - protein, 663 aa, Homo sapiens
  Payload ID: 6941
  Gene Symbol: ERICH6
  Gene Name: glutamate-rich 6
  Uniprot ID: Q7L0X2
  ENSP ID: ENSP00000295910
MAHLRSPSGFGDPGKKDQKESEEELEEEEEEEEVEEEEEEVEEEEEEVEEEEEEVVEEELVGEEQELEAPETFSEEYLWKVTDIGDYDDDFPDVRPRLASIVSPSLTSTFVPSQSATSTETPSASPPSSTSSHKSFPKIFQTFRKDMSEMSIDRNIHRNLSPGIPVSVQTEESWLQDLSDKVQSRKKASKEKAEPECLASKLREKWVINPEESKLNILYELEFKEDFITLFEPSLRTLPSIGPPSILAYKEESSNLGINFKDEEEETSPKCEFCGSDLRAFFSNVDVSSEPKGHASCCIAFQNLIDYIYEEQIKTKPPKAELIAIDPHAAHGSEVDRLKAKEKALQRKQEQRMARHFAIISREQTHFSEDDSKRLKTISYQLSVDIPEKQIIDDIVFDFQLRNSNMSIICCDSRIACGKVVRNELLEKHYKHGSKFLTSFPDGTTQIFYPSGNLAIIRVPNKVNGFTCIVQEDMPTNPAILAVLDSSGRSSCYHPNGNVWVYINILGGQYSDQAGNRIRAWNWSNSITSSPFVSFKPVFLALNRYIGVRILEQDKISITFLAMGQQARISVGTKVKLPNPEEIPILRYVSGDDLLLLASLIKIRRLFHKLEGCVNFPSSQVWEKLKQPSYLSSLSLKLIALCHSSGIKQDIMKTIRNIINEEI

SEQ ID NO: 35149 - protein, 135 aa, Homo sapiens
  Payload ID: 6941
  Gene Symbol: ERICH6
  Gene Name: glutamate-rich 6
  ENSP ID: ENSP00000417780
MAHLRSPSGFGDPGKKDQKESEEELEEEEEEEEVEEEEEEVTDIGDYDDDFPDVRPRLASIVSPSLTSTFVPSQSATSTETPSASPPSSTSSHKSFPKIFQTFRKDMSEMSIDRNIHRNLSPGIPVSVQTEESWL

SEQ ID NO: 35150 - protein, 164 aa, Homo sapiens
  Payload ID: 6941
  Gene Symbol: ERICH6
  Gene Name: glutamate-rich 6
  ENSP ID: ENSP00000419304
MAHLRSPSGFGDPGKKDQKESEEELEEEEEEEEVEEEEEEVEEEEEEVEEEEEEVTDIGDYDDDFPDVRPRLASIVSPSLTSTFVPSQSATSTETPSASPPSSTSSHKSFPKIFQTFRKDMSEMSIDRNIHRNLSPGIPVSVQTEESWLQDLSDKVQSRKKASK

SEQ ID NO: 35151 - protein, 517 aa, Homo sapiens
  Payload ID: 6941
  Gene Symbol: ERICH6
  Gene Name: glutamate-rich 6
  Uniprot ID: Q7L0X2
  ENSP ID: ENSP00000419366
MSEMSIDRNIHRNLSPGIPVSVQTEESWLQDLSDKVQSRKKASKEKAEPECLASKLREKWVINPEESKLNILYELEFKEDFITLFEPSLRTLPSIGPPSILAYKEESSNLGINFKDEEEETSPKCEFCGSDLRAFFSNVDVSSEPKGHASCCIAFQNLIDYIYEEQIKTKPPKAELIAIDPHAAHGSEVDRLKAKEKALQRKQEQRMARHFAIISREQTHFSEDDSKRLKTISYQLSVDIPEKQIIDDIVFDFQLRNSNMSIICCDSRIACGKVVRNELLEKHYKHGSKFLTSFPDGTTQIFYPSGNLAIIRVPNKVNGFTCIVQEDMPTNPAILAVLDSSGRSSCYHPNGNVWVYINILGGQYSDQAGNRIRAWNWSNSITSSPFVSFKPVFLALNRYIGVRILEQDKISITFLAMGQQARISVGTKVKLPNPEEIPILRYVSGDDLLLLASLIKIRRLFHKLEGCVNFPSSQVWEKLKQPSYLSSLSLKLIALCHSSGIKQDIMKTIRNIINEEI

SEQ ID NO: 35152 - protein, 696 aa, Homo sapiens
  Payload ID: 6942
  Gene Symbol: ERICH6B
  Gene Name: glutamate-rich 6B
  Uniprot ID: Q5W0A0
  ENSP ID: ENSP00000298738
MSAENNQLSGASPPHPPTTPQYSTQNLPSEKEDTEVELDEESLQDESPFSPEGESLEDKEYLEEEEDLEEEEYLGKEEYLKEEEYLGKEEHLEEEEYLEKAGYLEEEEYIEEEEYLGKEGYLEEEEYLGKEEHLEEEEYLGKEGYLEKEDYIEEVDYLGKKAYLEEEEYLGKKSYLEEEKALEKEENLEEEEALEKEENLDGKENLYKKYLKEPKASYSSQTMLLRDARSPDAGPSQVTTFLTVPLTFATPSPVSESATESSELLLTLYRRSQASQTDWCYDRTAVKSLKSKSETEQETTTKLAPEEHVNTKVQQKKEENVLEFASKENFWDGITDESIDKLEVEDLDENFLNSSYQTVFKTIIKEMAAHNELEEDFDIPLTKLLESENRWKLVIMLKKNYEKFKETILRIKRRREAQKLTEMTSFTFHLMSKPTPEKPETEEIQKPQRVVHHRKKLERDKEWIQKKTVVHQGDGKLILYPNKNVYQILFPDGTGQIHYPSGNLAMLILYAKMKKFTYIILEDSLEGRIRALINNSGNATFYDENSDIWLNLSSNLGYYFPKDKRQKAWNWWNLNIHVHAPPVQPISLKINEYIQVQIRSQDKIIFCFTYEQKQICLNLGTRYKFVIPEVLSEMKKKTILEAEPGPTAQKIRVLLGKMNRLLNYATTPDLENFIEAVSISLMDNKYLKKMLSKLWF

SEQ ID NO: 35153 - protein, 446 aa, Homo sapiens
  Payload ID: 6943
  Gene Symbol: GRWD1
  Gene Name: glutamate-rich WD repeat containing 1
  Uniprot ID: Q9BQ67
  ENSP ID: ENSP00000253237
MAARKGRRRTCETGEPMEAESGDTSSEGPAQVYLPGRGPPLREGEELVMDEEAYVLYHRAQTGAPCLSFDIVRDHLGDNRTELPLTLYLCAGTQAESAQSNRLMMLRMHNLHGTKPPPSEGSDEEEEEEDEEDEEERKPQLELAMVPHYGGINRVRVSWLGEEPVAGVWSEKGQVEVFALRRLLQVVEEPQALAAFLRDEQAQMKPIFSFAGHMGEGFALDWSPRVTGRLLTGDCQKNIHLWTPTDGGSWHVDQRPFVGHTRSVEDLQWSPTENTVFASCSADASIRIWDIRAAPSKACMLTTATAHDGDVNVISWSRREPFLLSGGDDGALKIWDLRQFKSGSPVATFKQHVAPVTSVEWHPQDSGVFAASGADHQITQWDLAVERDPEAGDVEADPGLADLPQQLLFVHQGETELKELHWHPQCPGLLVSTALSGFTIFRTISV

SEQ ID NO: 35154 - protein, 228 aa, Homo sapiens
  Payload ID: 6943
  Gene Symbol: GRWD1
  Gene Name: glutamate-rich WD repeat containing 1
  ENSP ID: ENSP00000468943
MMLRMHNLHGTKPPPSEGSDEEEEEEDEEDEEERKPQLELAMVPHYGGINRVRVSWLGEEPVAGVWSEKGQVEVFALRRLLQVVEEPQALAAFLRDEQAQMKPIFSFAGHMGEGFALDWSPRVTGRLLTGDCQKNIHLWTPTDGGSWHVDQRPFVGHTRSVEDLQWSPTENTVFASCSADASIRIWDIRAAPSKACMLTTATAHDGDVNVISWSRREPFLLSGGDDGA

SEQ ID NO: 35155 - protein, 523 aa, Homo sapiens
  Payload ID: 6944
  Gene Symbol: GPT2
  Gene Name: glutamic pyruvate transaminase (alanine aminotransferase) 2
  Uniprot ID: Q8TD30
  ENSP ID: ENSP00000345282
MQRAAALVRRGCGPRTPSSWGRSQSSAAAEASAVLKVRPERSRRERILTLESMNPQVKAVEYAVRGPIVLKAGEIELELQRGIKKPFTEVIRANIGDAQAMGQQPITFLRQVMALCTYPNLLDSPSFPEDAKKRARRILQACGGNSLGSYSASQGVNCIREDVAAYITRRDGGVPADPDNIYLTTGASDGISTILKILVSGGGKSRTGVMIPIPQYPLYSAVISELDAIQVNYYLDEENCWALNVNELRRAVQEAKDHCDPKVLCIINPGNPTGQVQSRKCIEDVIHFAWEEKLFLLADEVYQDNVYSPDCRFHSFKKVLYEMGPEYSSNVELASFHSTSKGYMGECGYRGGYMEVINLHPEIKGQLVKLLSVRLCPPVSGQAAMDIVVNPPVAGEESFEQFSREKESVLGNLAKKAKLTEDLFNQVPGIHCNPLQGAMYAFPRIFIPAKAVEAAQAHQMAPDMFYCMKLLEETGICVVPGSGFGQREGTYHFRMTILPPVEKLKTVLQKVKDFHINFLEKYA

SEQ ID NO: 35156 - protein, 423 aa, Homo sapiens
  Payload ID: 6944
  Gene Symbol: GPT2
  Gene Name: glutamic pyruvate transaminase (alanine aminotransferase) 2
  Uniprot ID: Q8TD30
  ENSP ID: ENSP00000413804
MGQQPITFLRQVMALCTYPNLLDSPSFPEDAKKRARRILQACGGNSLGSYSASQGVNCIREDVAAYITRRDGGVPADPDNIYLTTGASDGISTILKILVSGGGKSRTGVMIPIPQYPLYSAVISELDAIQVNYYLDEENCWALNVNELRRAVQEAKDHCDPKVLCIINPGNPTGQVQSRKCIEDVIHFAWEEKLFLLADEVYQDNVYSPDCRFHSFKKVLYEMGPEYSSNVELASFHSTSKGYMGECGYRGGYMEVINLHPEIKGQLVKLLSVRLCPPVSGQAAMDIVVNPPVAGEESFEQFSREKESVLGNLAKKAKLTEDLFNQVPGIHCNPLQGAMYAFPRIFIPAKAVEAAQAHQMAPDMFYCMKLLEETGICVVPGSGFGQREGTYHFRMTILPPVEKLKTVLQKVKDFHINFLEKYA

SEQ ID NO: 35157 - protein, 177 aa, Homo sapiens
  Payload ID: 6944
  Gene Symbol: GPT2
  Gene Name: glutamic pyruvate transaminase (alanine aminotransferase) 2
  ENSP ID: ENSP00000457475
MQRGIKKPFTEVIRANIGDAQAMGQQPITFLRQVMALCTYPNLLDSPSFPEDAKKRARRILQACGGNSLGSYSASQGVNCIREDVAAYITRRDGGVPADPDNIYLTTGASDGISTILKILVSGGGKSRTGVMIPIPQYPLYSAVISELDAIQVNYYLDEENCWALNVNELRRAVQEA

SEQ ID NO: 35158 - protein, 413 aa, Homo sapiens
  Payload ID: 6945
  Gene Symbol: GOT1
  Gene Name: glutamic-oxaloacetic transaminase 1, soluble
  Uniprot ID: P17174
  ENSP ID: ENSP00000359539
MAPPSVFAEVPQAQPVLVFKLTADFREDPDPRKVNLGVGAYRTDDCHPWVLPVVKKVEQKIANDNSLNHEYLPILGLAEFRSCASRLALGDDSPALKEKRVGGVQSLGGTGALRIGADFLARWYNGTNNKNTPVYVSSPTWENHNAVFSAAGFKDIRSYRYWDAEKRGLDLQGFLNDLENAPEFSIVVLHACAHNPTGIDPTPEQWKQIASVMKHRFLFPFFDSAYQGFASGNLERDAWAIRYFVSEGFEFFCAQSFSKNFGLYNERVGNLTVVGKEPESILQVLSQMEKIVRITWSNPPAQGARIVASTLSNPELFEEWTGNVKTMADRILTMRSELRARLEALKTPGTWNHITDQIGMFSFTGLNPKQVEYLVNEKHIYLLPSGRINVSGLTTKNLDYVATSIHEAVTKIQ

SEQ ID NO: 35159 - protein, 421 aa, Homo sapiens
  Payload ID: 6946
  Gene Symbol: GOT1L1
  Gene Name: glutamic-oxaloacetic transaminase 1-like 1
  Uniprot ID: Q8NHS2
  ENSP ID: ENSP00000303077
MPTLSVFMDVPLAHKLEGSLLKTYKQDDYPNKIFLAYRVCMTNEGHPWVSLVVQKTRLQISQDPSLNYEYLPTMGLKSFIQASLALLFGKHSQAIVENRVGGVHTVGDSGAFQLGVQFLRAWHKDARIVYIISSQKELHGLVFQDMGFTVYEYSVWDPKKLCMDPDILLNVVEQIPHGCVLVMGNIIDCKLTPSGWAKLMSMIKSKQIFPFFDIPCQGLYTSDLEEDTRILQYFVSQGFEFFCSQSLSKNFGIYDEGVGMLVVVAVNNQQLLCVLSQLEGLAQALWLNPPNTGARVITSILCNPALLGEWKQSLKEVVENIMLTKEKVKEKLQLLGTPGSWGHITEQSGTHGYLGLNSQQVEYLVRKKHIYIPKNGQINFSCINANNINYITEGINEAVLLTESSEMCLPKEKKTLIGIKL

SEQ ID NO: 35160 - protein, 121 aa, Homo sapiens
  Payload ID: 6946
  Gene Symbol: GOT1L1
  Gene Name: glutamic-oxaloacetic transaminase 1-like 1
  ENSP ID: ENSP00000429558
MLVVVAVNNQQLLCVLSQLEGLAQALWLNPPNTGARVITSILCNPALLGEWKQSLKEVVENIMLTKEKVKEKLQLLGTPGSWGHITEQSGTHGYLGLNCKGLGGWCPPFLTFGLYLSIKLH

SEQ ID NO: 35161 - protein, 168 aa, Homo sapiens
  Payload ID: 6946
  Gene Symbol: GOT1L1
  Gene Name: glutamic-oxaloacetic transaminase 1-like 1
  ENSP ID: ENSP00000430453
MDVPLAHKLEGSLLKTYKQDDYPNKIFLAYRGTFPQPHGVQERFVCRLSAELSPGGPNQASGAPSVVFLTVCMTNEGHPWVSLVVQKTRLQISQDPSLNYEYLPTMGLKSFIQASLALLFGKHSQAIVENRVGGVHTVGDSGAFQLGVQFLRAWHKDARIVYIISSQK

SEQ ID NO: 35162 - protein, 430 aa, Homo sapiens
  Payload ID: 6947
  Gene Symbol: GOT2
  Gene Name: glutamic-oxaloacetic transaminase 2, mitochondrial
  Uniprot ID: P00505
  ENSP ID: ENSP00000245206
MALLHSGRVLPGIAAAFHPGLAAAASARASSWWTHVEMGPPDPILGVTEAFKRDTNSKKMNLGVGAYRDDNGKPYVLPSVRKAEAQIAAKNLDKEYLPIGGLAEFCKASAELALGENSEVLKSGRFVTVQTISGTGALRIGASFLQRFFKFSRDVFLPKPTWGNHTPIFRDAGMQLQGYRYYDPKTCGFDFTGAVEDISKIPEQSVLLLHACAHNPTGVDPRPEQWKEIATVVKKRNLFAFFDMAYQGFASGDGDKDAWAVRHFIEQGINVCLCQSYAKNMGLYGERVGAFTMVCKDADEAKRVESQLKILIRPMYSNPPLNGARIAAAILNTPDLRKQWLQEVKVMADRIIGMRTQLVSNLKKEGSTHNWQHITDQIGMFCFTGLKPEQVERLIKEFSIYMTKDGRISVAGVTSSNVGYLAHAIHQVTK

SEQ ID NO: 35163 - protein, 387 aa, Homo sapiens
  Payload ID: 6947
  Gene Symbol: GOT2
  Gene Name: glutamic-oxaloacetic transaminase 2, mitochondrial
  Uniprot ID: P00505
  ENSP ID: ENSP00000394100
MALLHSGRVLPGIAAAFHPGLAAAASARASSWWTHVEMGPPDPILGVTEAFKRDTNSKKMNLGVGAYRDDNGKPYVLPSVRKFVTVQTISGTGALRIGASFLQRFFKFSRDVFLPKPTWGNHTPIFRDAGMQLQGYRYYDPKTCGFDFTGAVEDISKIPEQSVLLLHACAHNPTGVDPRPEQWKEIATVVKKRNLFAFFDMAYQGFASGDGDKDAWAVRHFIEQGINVCLCQSYAKNMGLYGERVGAFTMVCKDADEAKRVESQLKILIRPMYSNPPLNGARIAAAILNTPDLRKQWLQEVKVMADRIIGMRTQLVSNLKKEGSTHNWQHITDQIGMFCFTGLKPEQVERLIKEFSIYMTKDGRISVAGVTSSNVGYLAHAIHQVTK

SEQ ID NO: 35164 - protein, 59 aa, Homo sapiens
  Payload ID: 6947
  Gene Symbol: GOT2
  Gene Name: glutamic-oxaloacetic transaminase 2, mitochondrial
  ENSP ID: ENSP00000456205
MALLHSGRVLPGIAAAFHPGLAAAASARARQRPRLPQKIWTRNTCPLGDWLNFARHLQN

SEQ ID NO: 35165 - protein, 496 aa, Homo sapiens
  Payload ID: 6948
  Gene Symbol: GPT
  Gene Name: glutamic-pyruvate transaminase (alanine aminotransferase)
  Uniprot ID: P24298
  ENSP ID: ENSP00000378408
MASSTGDRSQAVRHGLRAKVLTLDGMNPRVRRVEYAVRGPIVQRALELEQELRQGVKKPFTEVIRANIGDAQAMGQRPITFLRQVLALCVNPDLLSSPNFPDDAKKRAERILQACGGHSLGAYSVSSGIQLIREDVARYIERRDGGIPADPNNVFLSTGASDAIVTVLKLLVAGEGHTRTGVLIPIPQYPLYSATLAELGAVQVDYYLDEERAWALDVAELHRALGQARDHCRPRALCVINPGNPTGQVQTRECIEAVIRFAFEERLFLLADEVYQDNVYAAGSQFHSFKKVLMEMGPPYAGQQELASFHSTSKGYMGECGFRGGYVEVVNMDAAVQQQMLKLMSVRLCPPVPGQALLDLVVSPPAPTDPSFAQFQAEKQAVLAELAAKAKLTEQVFNEAPGISCNPVQGAMYSFPRVQLPPRAVERAQELGLAPDMFFCLRLLEETGICVVPGSGFGQREGTYHFRMTILPPLEKLRLLLEKLSRFHAKFTLEYS

SEQ ID NO: 35166 - protein, 496 aa, Homo sapiens; identical to SEQ ID NO: 35165
  Payload ID: 6948
  Gene Symbol: GPT
  Gene Name: glutamic-pyruvate transaminase (alanine aminotransferase)
  Uniprot ID: P24298
  ENSP ID: ENSP00000433586

SEQ ID NO: 35167 - protein, 669 aa, Homo sapiens
  Payload ID: 6949
  Gene Symbol: GLS
  Gene Name: glutaminase
  Uniprot ID: O94925
  ENSP ID: ENSP00000317379
MMRLRGSGMLRDLLLRSPAGVSATLRRAQPLVTLCRRPRGGGRPAAGPAAAARLHPWWGGGGWPAEPLARGLSSSPSEILQELGKGSTHPQPGVSPPAAPAAPGPKDGPGETDAFGNSEGKELVASGENKIKQGLLPSLEDLLFYTIAEGQEKIPVHKFITALKSTGLRTSDPRLKECMDMLRLTLQTTSDGVMLDKDLFKKCVQSNIVLLTQAFRRKFVIPDFMSFTSHIDELYESAKKQSGGKVADYIPQLAKFSPDLWGVSVCTVDGQRHSTGDTKVPFCLQSCVKPLKYAIAVNDLGTEYVHRYVGKEPSGLRFNKLFLNEDDKPHNPMVNAGAIVVTSLIKQGVNNAEKFDYVMQFLNKMAGNEYVGFSNATFQSERESGDRNFAIGYYLKEKKCFPEGTDMVGILDFYFQLCSIEVTCESASVMAATLANGGFCPITGERVLSPEAVRNTLSLMHSCGMYDFSGQFAFHVGLPAKSGVAGGILLVVPNVMGMMCWSPPLDKMGNSVKGIHFCHDLVSLCNFHNYDNLRHFAKKLDPRREGGDQRVKSVINLLFAAYTGDVSALRRFALSAMDMEQRDYDSRTALHVAAAEGHVEVVKFLLEACKVNPFPKDRWNNTPMDEALHFGHHDVFKILQEYQVQYTPQGDSDNGKENQTVHKNLDGLL

SEQ ID NO: 35168 - protein, 598 aa, Homo sapiens
  Payload ID: 6949
  Gene Symbol: GLS
  Gene Name: glutaminase
  Uniprot ID: O94925
  ENSP ID: ENSP00000340689
MMRLRGSGMLRDLLLRSPAGVSATLRRAQPLVTLCRRPRGGGRPAAGPAAAARLHPWWGGGGWPAEPLARGLSSSPSEILQELGKGSTHPQPGVSPPAAPAAPGPKDGPGETDAFGNSEGKELVASGENKIKQGLLPSLEDLLFYTIAEGQEKIPVHKFITALKSTGLRTSDPRLKECMDMLRLTLQTTSDGVMLDKDLFKKCVQSNIVLLTQAFRRKFVIPDFMSFTSHIDELYESAKKQSGGKVADYIPQLAKFSPDLWGVSVCTVDGQRHSTGDTKVPFCLQSCVKPLKYAIAVNDLGTEYVHRYVGKEPSGLRFNKLFLNEDDKPHNPMVNAGAIVVTSLIKQGVNNAEKFDYVMQFLNKMAGNEYVGFSNATFQSERESGDRNFAIGYYLKEKKCFPEGTDMVGILDFYFQLCSIEVTCESASVMAATLANGGFCPITGERVLSPEAVRNTLSLMHSCGMYDFSGQFAFHVGLPAKSGVAGGILLVVPNVMGMMCWSPPLDKMGNSVKGIHFCHDLVSLCNFHNYDNLRHFAKKLDPRREGGDQRHSFGPLDYESLQQELALKETVWKKVSPESNEDISTTVVYRMESLGEKS

SEQ ID NO: 35169 - protein, 169 aa, Homo sapiens
  Payload ID: 6949
  Gene Symbol: GLS
  Gene Name: glutaminase
  ENSP ID: ENSP00000386417
MAATLANGGFCPITGERVLSPEAVRNTLSLMHSCGMYDFSGQFAFHVGLPAKSGVAGGILLVVPNVMGMMCWSPPLDKMGNSVKGIHFCHDLVSLCNFHNYDNLRHFAKKLDPRREGGDQRHSFGPLDYESLQQELALKETVWKKVSPESNEDISTTVVYRMESLGEKS

SEQ ID NO: 35170 - protein, 103 aa, Homo sapiens
  Payload ID: 6949
  Gene Symbol: GLS
  Gene Name: glutaminase
  ENSP ID: ENSP00000387135
MGMMCWSPPLDKMGNSVKGIHFCHDLVSLCNFHNYDNLRHFAKKLDPRREGGDQRHSFGPLDYESLQQELALKETVWKKVSPESNEDISTTVVYRMESLGEKS

SEQ ID NO: 35171 - protein, 174 aa, Homo sapiens
  Payload ID: 6949
  Gene Symbol: GLS
  Gene Name: glutaminase
  ENSP ID: ENSP00000387177
MGMMCWSPPLDKMGNSVKGIHFCHDLVSLCNFHNYDNLRHFAKKLDPRREGGDQRVKSVINLLFAAYTGDVSALRRFALSAMDMEQRDYDSRTALHVAAAEGHVEVVKFLLEACKVNPFPKDRWNNTPMDEALHFGHHDVFKILQEYQVQYTPQGDSDNGKENQTVHKNLDGLL

SEQ ID NO: 35172 - protein, 114 aa, Homo sapiens
  Payload ID: 6949
  Gene Symbol: GLS
  Gene Name: glutaminase
  ENSP ID: ENSP00000388990
ESAKKQSGGKVADYIPQLAKFSPDLWGVSVCTVDGQRHSTGDTKVPFCLQSCVKPLKYAIAVNDLGTEYVHRYVGKEPSGLRFNKLFLNEDDKPHNPMVNAGAIVVTSLIKDWW

SEQ ID NO: 35173 - protein, 164 aa, Homo sapiens
  Payload ID: 6949
  Gene Symbol: GLS
  Gene Name: glutaminase
  ENSP ID: ENSP00000395596
MAATLANGGFCPITGERVLSPEAVRNTLSLMHSCGMYDFSGQFAFHVGLPAKSGVAGGILLVVPNVMGMMCWSPPLDKMGNSVKGIHFCHDLVSLCNFHNYDNLRHFAKKLDPRREGGDQRVKSVINLLFAAYTGDVSALRRFALSAMDMEQRDYDSRTALHVA

SEQ ID NO: 35174 - protein, 182 aa, Homo sapiens
  Payload ID: 6949
  Gene Symbol: GLS
  Gene Name: glutaminase
  ENSP ID: ENSP00000403329
AKSGVAGGILLVVPNVMGMMCWSPPLDKMGNSVKGIHFCHDLVSLCNFHNYDNLRHFAKKLDPRREGGDQRVKSVINLLFAAYTGDVSALRRFALSAMDMEQRDYDSRTALHVAAAEGGITLPWMKHCTLDTMMYLKFSKNTKSSTHLKEILTTGRKIKPSIRILMDCCNGLKSQDLNHLPI

SEQ ID NO: 35175 - protein, 602 aa, Homo sapiens
  Payload ID: 6950
  Gene Symbol: GLS2
  Gene Name: glutaminase 2 (liver, mitochondrial)
  Uniprot ID: Q9UI32
  ENSP ID: ENSP00000310447
MRSMKALQKALSRAGSHCGRGGWGHPSRSPLLGGGVRHHLSEAAAQGRETPHSHQPQHQDHDSSESGMLSRLGDLLFYTIAEGQERIPIHKFTTALKATGLQTSDPRLRDCMSEMHRVVQESSSGGLLDRDLFRKCVSSNIVLLTQAFRKKFVIPDFEEFTGHVDRIFEDVKELTGGKVAAYIPQLAKSNPDLWGVSLCTVDGQRHSVGHTKIPFCLQSCVKPLTYAISISTLGTDYVHKFVGKEPSGLRYNKLSLNEEGIPHNPMVNAGAIVVSSLIKMDCNKAEKFDFVLQYLNKMAGNEYMGFSNATFQSEKETGDRNYAIGYYLKEKKCFPKGVDMMAALDLYFQLCSVEVTCESGSVMAATLANGGICPITGESVLSAEAVRNTLSLMHSCGMYDFSGQFAFHVGLPAKSAVSGAILLVVPNVMGMMCLSPPLDKLGNSHRGTSFCQKLVSLFNFHNYDNLRHCARKLDPRREGAEIRNKTVVNLLFAAYSGDVSALRRFALSAMDMEQKDYDSRTALHVAAAEGHIEVVKFLIEACKVNPFAKDRWGNIPLDDAVQFNHLEVVKLLQDYQDSYTLSETQAEAAAEALSKENLESMV

SEQ ID NO: 35176 - protein, 177 aa, Homo sapiens
  Payload ID: 6950
  Gene Symbol: GLS2
  Gene Name: glutaminase 2 (liver, mitochondrial)
  ENSP ID: ENSP00000416282
MRSMKALQKALSRAGSHCGRGGWGHPSRSPLLGGGVRHHLSEAAAQGRETPHSHQPQHQDHDSSESGMLSRLGDLLFYTIAEGQERIPIHKFTTALKATGLQTSDPRLRDCMSEMHRVVQESSSGGLLDRDLFRKWQPTSLSWPSQTQTCGVSPCALWMVNGTLWATQRSPSACSPV

SEQ ID NO: 35177 - protein, 184 aa, Homo sapiens
  Payload ID: 6950
  Gene Symbol: GLS2
  Gene Name: glutaminase 2 (liver, mitochondrial)
  ENSP ID: ENSP00000417244
MRSMKALQKALSRAGSHCGRGGWGHPSRSPLLGGGVRHHLSEAAAQGRETPHSHQPQHQDHDSSESGMLSRLGDLLFYTIAEGQERIPIHKFTTALKATGLQTSDPRLRDCMSEMHRVVQESSSGGLLDRDLFRKWTVTKQRSLILCCSISTKWLGMNTWVSAMPHSSQRRKQGIGIMPSAIIS

SEQ ID NO: 35178 - protein, 62 aa, Homo sapiens
  Payload ID: 6950
  Gene Symbol: GLS2
  Gene Name: glutaminase 2 (liver, mitochondrial)
  ENSP ID: ENSP00000417723
MRSMKALQKALSRAGSHCGRGGWGHPSRSPLLGGGVRHHLSEAAAQGRETPHSHQPQHQDQH

SEQ ID NO: 35179 - protein, 157 aa, Homo sapiens
  Payload ID: 6950
  Gene Symbol: GLS2
  Gene Name: glutaminase 2 (liver, mitochondrial)
  ENSP ID: ENSP00000417796
MRSMKALQKALSRAGSHCGRGGWGHPSRSPLLGGGVRHHLSEAAAQGRETPHSHQPQHQDHDSSESGMLSRLGDLLFYTIAEGQERIPIHKFTTALKATGLQTSDPRLRDCMSEMHRVVQESSSGGLLDRDLFRKCCSISTKWLGMNTWVSAMPLLS

SEQ ID NO: 35180 - protein, 209 aa, Homo sapiens
  Payload ID: 6950
  Gene Symbol: GLS2
  Gene Name: glutaminase 2 (liver, mitochondrial)
  Uniprot ID: Q9UI32
  ENSP ID: ENSP00000419661
MRSMKALQKALSRAGSHCGRGGWGHPSRSPLLGGGVRHHLSEAAAQGRETPHSHQPQHQDHDSSESGMLSRLGDLLFYTIAEGQERIPIHKFTTALKATGLQTSDPRLRDCMSEMHRVVQESSSGGLLDRDLFRKHSERSLSFLILRSSRAMWIASLRMSKSSLEAKWQPTSLSWPSQTQTCGVSPCALWMVNGTLWATQRSPSACSPV

SEQ ID NO: 35181 - protein, 103 aa, Homo sapiens
  Payload ID: 6950
  Gene Symbol: GLS2
  Gene Name: glutaminase 2 (liver, mitochondrial)
  ENSP ID: ENSP00000419996
MRSMKALQKALSRAGSHCGRGGWGHPSRSPLLGGGVRHHLSEAAAQGRETPHSHQPQHQDQWQPTSLSWPSQTQTCGVSPCALWMVNGTLWATQRSPSACSPV

SEQ ID NO: 35182 - protein, 327 aa, Homo sapiens
  Payload ID: 6950
  Gene Symbol: GLS2
  Gene Name: glutaminase 2 (liver, mitochondrial)
  ENSP ID: ENSP00000420328
MRSMKALQKALSRAGSHCGRGGWGHPSRSPLLGGGVRHHLSEAAAQGRETPHSHQPQHQDHDSSESGMLSRLGDLLFYTIAEGQERIPIHKFTTALKATGLQTSDPRLRDCMSEMHRVVQESSSGGLLDRDLFRKCVSSNIVLLTQAFRKKFVIPDFEEFTGHVDRIFEDVKELTGGKVAAYIPQLAKSNPDLWGVSLCTVDGQRHSVGHTKIPFCLQSCVKPLTYAISISTLGTDYVHKFVGKEPSGLRYNKLSLNEEGIPHNPMVNAGAIVVSSLIKMDCNKAEKFDFVLQYLNKMAGNEYMGFSNATEGNFSPSPNTHSSNFKY

SEQ ID NO: 35183 - protein, 280 aa, Homo sapiens
  Payload ID: 6950
  Gene Symbol: GLS2
  Gene Name: glutaminase 2 (liver, mitochondrial)
  ENSP ID: ENSP00000441739
MLQKEEQVAVLRPHFPPHSLPPNSDSSESGMLSRLGDLLFYTIAEGQERIPIHKFTTALKATGLQTSDPRLRDCMSEMHRVVQESSSGGLLDRDLFRKCVSSNIVLLTQAFRKKFVIPDFEEFTGHVDRIFEDVKELTGGKVAAYIPQLAKSNPDLWGVSLCTVDGQRHSVGHTKIPFCLQSCVKPLTYAISISTLGTDYVHKFVGKEPSGLRYNKLSLNEEGIPHNPMVNAGAIVVSSLIKMDCNKAEKFDFVLQYLNKMAGNEYMGFSNATAFLRGWT

SEQ ID NO: 35184 - protein, 337 aa, Homo sapiens
  Payload ID: 6950
  Gene Symbol: GLS2
  Gene Name: glutaminase 2 (liver, mitochondrial)
  ENSP ID: ENSP00000483010
MVNAGAIVVSSLIKMDCNKAEKFDFVLQYLNKMAGNEYMGFSNATFQSEKETGDRNYAIGYYLKEKKCFPKGVDMMAALDLYFQLCSVEVTCESGSVMAATLANGGICPITGESVLSAEAVRNTLSLMHSCGMYDFSGQFAFHVGLPAKSAVSGAILLVVPNVMGMMCLSPPLDKLGNSHRGTSFCQKLVSLFNFHNYDNLRHCARKLDPRREGAEIRNKTVVNLLFAAYSGDVSALRRFALSAMDMEQKDYDSRTALHVAAAEGHIEVVKFLIEACKVNPFAKDRWGNIPLDDAVQFNHLEVVKLLQDYQDSYTLSETQAEAAAEALSKENLESMV

SEQ ID NO: 35185 - protein, 337 aa, Homo sapiens; identical to SEQ ID NO: 35184
  Payload ID: 6950
  Gene Symbol: GLS2
  Gene Name: glutaminase 2 (liver, mitochondrial)
  ENSP ID: ENSP00000485315

SEQ ID NO: 35186 - protein, 1735 aa, Homo sapiens
  Payload ID: 6951
  Gene Symbol: QSER1
  Gene Name: glutamine and serine rich 1
  Uniprot ID: Q2KHR3
  ENSP ID: ENSP00000382241
MNFLSTAESRTAQAAASGTTLLPQFRAPSWQTGMHSSAATELFATGPLPSTGTLPPSLSAYQHPTTFSNRNFATTSPLVLQDSTFNTTSNGILSHHDPLLQIKTSQGTVPTALAFERLGSSVLSNSIPPQSSTYRSAQESAPHLLQPQFSLLPSALGGSQQTPQAYSSTLFTSSTASIERALLRECSVIKHHQRPSGTQSIQAQLTGSQHSLHSYLSNSSVVNFQETTRQSSLSCSPIGDSTQVSNGGLQQKTSQVSVELAQSYSSAIPSSGYPPSTTKIKSCSTEQPLTSTKTPKPQSIIPPVQTLSYSKPLHNQSSVISGQAQIYSTAQLPSLLSVSQSQNYGLVQPHNVPSIVHSQVYRSSKVEKLPPLYKTLTFSGSSQTVTPENQTLNYSSNQQEVLSSVTNENYPAQTRDLSSVSQSQSYSSGHSQGLSPVSQTQVSYSSQSQVLSVVSLSESYASGESLTLTAPSLSYSSASRAQNLPDSSPTQNYISMHSSQNVQTQESSSPQSQKFLPAVQSSSFASSTHCQTLQNNITSPDPKSYAERKLDSDVYPSSKQEDGFPMQELQVLQPQASLESSTQRLSDGEINAQESTYKVSKADDRYSQSVIRSNSRLEDQVIGVALQASKKEESVVGSVTQLNQQIGQVNNAATLDLKNSTNLIQTPQIRLNTKDLKQQHPLILKVHESKVQEQHDQIINASSQIQIPNHALGHGHQASLPNTQVLLDSACDLQILQQSILQAGLGQVKASLQAQRVQSPQQIVHPFLQMEGHVIQSNGDHSQQQLHPQNSEVMKMDLSESSKPLQQHLTTKGHFSETNQHDSKNQFVSLGSMCFPEAVLLSDERNILSNVDDILAATAAACGVTPTDFSKSTSNETMQAVEDGDSKSHFQQSLDVRHVTSDFNSMTATVGKPQNINDTSLNGNQVTVNLSPVPALQSKMTLDQQHIETPGQNIPTKVTSAVVGPSHEVQEQSSGPFKKQSATNLESEEDSEAPVDSTLNNNRNQEFVSSSRSISGENATSESEFTLGGDDSGVSMNPARSALALLAMAQSGDAVSVKIEEENQDLMHFNLQKKRAKGKGQVKEEDNSNQKQLKRPAQGKRQNPRGTDIYLPYTPPSSESCHDGYQHQEKMRQKIKEVEEKQPEVKTGFIASFLDFLKSGPKQQFSTLAVRMPNRTRRPGTQMVRTFCPPPLPKPSSTTPTPLVSETGGNSPSDKVDNELKNLEHLSSFSSDEDDPGYSQDAYKSVSTPLTTLDATSDKKKKTEALQVATTSPTANTTGTATTSSTTVGAVKQEPLHSTSYAVNILENISSSESSKPIELDGLPSDQFAKGQDTVAIEGFTDEEDTESGGEGQYRERDEFVVKIEDIETFKEALKTGKEPPAIWKVQKALLQKFVPEIRDGQREFAATNSYLGYFGDAKSKYKRIYVKFIENANKKEYVRVCSKKPRNKPSQTIRTVQAKPSSSSKTSDPLASKTTTTKAPSVKPKVKQPKVKAEPPPKKRKKWKEEFSSSQSDSSPEIHTSSSDDEEFEPPAPFVTRFLNTRAMKETFKSYMELLVSIALDPDTMQALEKSNDELLLPHMKKIDGMLNDNRKRLLLNLHLDQSFKNALESFPELTIITRDSKAKSGGTAISKIKMNGKAYNKKTLRTSKTTTKSAQEFAVDPEKIQLYSLYHSLHHYKYHVYLICKDEISSVQKKNEDLGQEEIVQLCMKNVKWVEDLFEKFGELLNHVQQKCS

SEQ ID NO: 35187 - protein, 780 aa, Homo sapiens
  Payload ID: 6951
  Gene Symbol: QSER1
  Gene Name: glutamine and serine rich 1
  ENSP ID: ENSP00000432136
  MOD_RES (1)..(1): Any amino acid
XSATNLESEEDSEAPVDSTLNNNRNQEFVSSSRSISGENATSESEFTLGGDDSGVSMNPARSALALLAMAQSGDAVSVKIEEENQDLMHFNLQKKRAKGKGQVKEEDNSNQKQLKRPAQGKRQNPRGTDIYLPYTPPSSESCHDGYQHQEKMRQKIKEVEEKQPEVKTGFIASFLDFLKSGPKQQFSTLAVRMPNRTRRPGTQMVRTFCPPPLPKPSSTTPTPLVSETGGNSPSDKVDNELKNLEHLSSFSSDEDDPGYSQDAYKSVSTPLTTLDATSDKKKKTEALQVATTSPTANTTGTATTSSTTVGAVKQEPLHSTSYAVNILENISSSESSKPIELDGLPSDQFAKGQDTVAIEGFTDEEDTESGGEGQYRERDEFVVKIEDIETFKEALKTGKEPPAIWKVQKALLQKFVPEIRDGQREFAATNSYLGYFGDAKSKYKRIYVKFIENANKKEYVRVCSKKPRNKPSQTIRTVQAKPSSSSKTSDPLASKTTTTKAPSVKPKVKQPKVKAEPPPKKRKKWKEEFSSSQSDSSPEIHTSSSDDEEFEPPAPFVTRFLNTRAMKETFKSYMELLVSIALDPDTMQALEKSNDELLLPHMKKIDGMLNDNRKRLLLNLHLDQSFKNALESFPELTIITRDSKAKSGGTAISKIKMNGKAYNKKTLRTSKTTTKSAQEFAVDPEKIQLYSLYHSLHHYKYHVYLICKDEVISSHLLKKNVFQNVKETLAIVFWSVLKRVVKYMCVCILSMYSVNNDLIYCSESLCYVLCSDLPEPHHLL

SEQ ID NO: 35188 - protein, 1529 aa, Homo sapiens
  Payload ID: 6951
  Gene Symbol: QSER1
  Gene Name: glutamine and serine rich 1
  Uniprot ID: Q2KHR3
  ENSP ID: ENSP00000432766
MNFLSTAESRTAQAAASGTTLLPQFRAPSWQTGMHSSAATELFATGPLPSTGTLPPSLSAYQHPTTFSNRNFATTSPLVLQDSTFNTTSNGILSHHDPLLQIKTSQGTVPTALAFERLGSSVLSNSIPPQSSTYRSAQESAPHLLQPQFSLLPSALGGSQQTPQAYSSTLFTSSTASIERALLRECSVIKHHQRPSGTQSIQAQLTGSQHSLHSYLSNSSVVNFQETTRQSSLSCSPIGDSTQNLPDSSPTQNYISMHSSQNVQTQESSSPQSQKFLPAVQSSSFASSTHCQTLQNNITSPDPKSYAERKLDSDVYPSSKQEDGFPMQELQVLQPQASLESSTQRLSDGEINAQESTYKVSKADDRYSQSVIRSNSRLEDQVIGVALQASKKEESVVGSVTQLNQQIGQVNNAATLDLKNSTNLIQTPQIRLNTKDLKQQHPLILKVHESKVQEQHDQIINASSQIQIPNHALGHGHQASLPNTQVLLDSACDLQILQQSILQAGLGQVKASLQAQRVQSPQQIVHPFLQMEGHVIQSNGDHSQQQLHPQNSEVMKMDLSESSKPLQQHLTTKGHFSETNQHDSKNQFVSLGSMCFPEAVLLSDERNILSNVDDILAATAAACGVTPTDFSKSTSNETMQAVEDGDSKSHFQQSLDVRHVTSDFNSMTATVGKPQNINDTSLNGNQVTVNLSPVPALQSKMTLDQQHIETPGQNIPTKVTSAVVGPSHEVQEQSSGPFKKQSATNLESEEDSEAPVDSTLNNNRNQEFVSSSRSISGENATSESEFTLGGDDSGVSMNPARSALALLAMAQSGDAVSVKIEEENQDLMHFNLQKKRAKGKGQVKEEDNSNQKQLKRPAQGKRQNPRGTDIYLPYTPPSSESCHDGYQHQEKMRQKIKEVEEKQPEVKTGFIASFLDFLKSGPKQQFSTLAVRMPNRTRRPGTQMVRTFCPPPLPKPSSTTPTPLVSETGGNSPSDKVDNELKNLEHLSSFSSDEDDPGYSQDAYKSVSTPLTTLDATSDKKKKTEALQVATTSPTANTTGTATTSSTTVGAVKQEPLHSTSYAVNILENISSSESSKPIELDGLPSDQFAKGQDTVAIEGFTDEEDTESGGEGQYRERDEFVVKIEDIETFKEALKTGKEPPAIWKVQKALLQKFVPEIRDGQREFAATNSYLGYFGDAKSKYKRIYVKFIENANKKEYVRVCSKKPRNKPSQTIRTVQAKPSSSSKTSDPLASKTTTTKAPSVKPKVKQPKVKAEPPPKKRKKWKEEFSSSQSDSSPEIHTSSSDDEEFEPPAPFVTRFLNTRAMKETFKSYMELLVSIALDPDTMQALEKSNDELLLPHMKKIDGMLNDNRKRLLLNLHLDQSFKNALESFPELTIITRDSKAKSGGTAISKIKMNGKAYNKKTLRTSKTTTKSAQEFAVDPEKIQLYSLYHSLHHYKYHVYLICKDEISSVQKKNEDLGQEEIVQLCMKNVKWVEDLFEKFGELLNHTGMLGEMQSVSVSSTRRSEQQNILEAGKSKIKVPVSGDC

SEQ ID NO: 35189 - protein, 64 aa, Homo sapiens
  Payload ID: 6951
  Gene Symbol: QSER1
  Gene Name: glutamine and serine rich 1
  ENSP ID: ENSP00000436870
MNFLSTAESRTAQAAASGTTLLPQFRAPSWQTGMHSSAATELFATGPLPSTGTLPPSLSAYQHP

SEQ ID NO: 35190 - protein, 1663 aa, Homo sapiens
  Payload ID: 6952
  Gene Symbol: QRICH2
  Gene Name: glutamine rich 2
  Uniprot ID: Q9H0J4
  ENSP ID: ENSP00000262765
MKDAAEELSFARVLLQRVDELEKLFKDREQFLELVSRKLSLVPGAEEVTMVTWEELEQAITDGWRASQAGSETLMGFSKHGGFTSLTSPEGTLSGDSTKQPSIEQALDSASGLGPDRTASGSGGTAHPSDGVSSREQSKVPSGTGRQQQPRARDEAGVPRLHQSSTFQFKSDSDRHRSREKLTSTQPRRNARPGPVQQDLPLARDQPSSVPASQSQVHLRPDRRGLEPTGMNQPGLVPASTYPHGVVPLSMGQLGVPPPEMDDRELIPFVVDEQRMLPPSVPGRDQQGLELPSTDQHGLVSVSAYQHGMTFPGTDQRSMEPLGMDQRGCVISGMGQQGLVPPGIDQQGLTLPVVDQHGLVLPFTDQHGLVSPGLMPISADQQGFVQPSLEATGFIQPGTEQHDLIQSGRFQRALVQRGAYQPGLVQPGADQRGLVRPGMDQSGLAQPGADQRGLVWPGMDQSGLAQPGRDQHGLIQPGTGQHDLVQSGTGQGVLVQPGVDQPGMVQPGRFQRALVQPGAYQPGLVQPGADQIDVVQPGADQHGLVQSGADQSDLAQPGAVQHGLVQPGVDQRGLAQPRADHQRGLVPPGADQRGLVQPGADQHGLVQPGVDQHGLAQPGEVQRSLVQPGIVQRGLVQPGAVQRGLVQPGAVQRGLVQPGVDQRGLVQPGAVQRGLVQPGAVQHGLVQPGADQRGLVQPGVDQRGLVQPGVDQRGLVQPGMDQRGLIQPGADQPGLVQPGAGQLGMVQPGIGQQGMVQPQADPHGLVQPGAYPLGLVQPGAYLHDLSQSGTYPRGLVQPGMDQYGLRQPGAYQPGLIAPGTKLRGSSTFQADSTGFISVRPYQHGMVPPGREQYGQVSPLLASQGLASPGIDRRSLVPPETYQQGLMHPGTDQHSPIPLSTGLGSTHPDQQHVASPGPGEHDQVYPDAAQHGHAFSLFDSHDSMYPGYRGPGYLSADQHGQEGLDPNRTRASDRHGIPAQKAPGQDVTLFRSPDSVDRVLSEGSEVSSEVLSERRNSLRRMSSSFPTAVETFHLMGELSSLYVGLKESMKDLDEEQAGQTDLEKIQFLLAQMVKRTIPPELQEQLKTVKTLAKEVWQEKAKVERLQRILEGEGNQEAGKELKAGELRLQLGVLRVTVADIEKELAELRESQDRGKAAMENSVSEASLYLQDQLDKLRMIIESMLTSSSTLLSMSMAPHKAHTLAPGQIDPEATCPACSLDVSHQVSTLVRRYEQLQDMVNSLAVSRPSKKAKLQRQDEELLGRVQSAILQVQGDCEKLNITTSNLIEDHRQKQKDIAMLYQGLEKLEKEKANREHLEMEIDVKADKSALATKVSRVQFDATTEQLNHMMQELVAKMSGQEQDWQKMLDRLLTEMDNKLDRLELDPVKQLLEDRWKSLRQQLRERPPLYQADEAAAMRRQLLAHFHCLSCDRPLETPVTGHAIPVTPAGPGLPGHHSIRPYTVFELEQVRQHSRNLKLGSAFPRGDLAQMEQSVGRLRSMHSKMLMNIEKVQIHFGGSTKASSQIIRELLHAQCLGSPCYKRVTDMADYTYSTVPRRCGGSHTLTYPYHRSRPQHLPRGLYPTEEIQIAMKHDEVDILGLDGHIYKGRMDTRLPGILRKDSSGTSKRKSQQPRPHVHRPPSLSSNGQLPSRPQSAQISAGNTSER

SEQ ID NO: 35191 - protein, 495 aa, Homo sapiens
  Payload ID: 6952
  Gene Symbol: QRICH2
  Gene Name: glutamine rich 2
  ENSP ID: ENSP00000394461
DSVDRVLSEGSEVSSEVLSERRNSLRRMSSSFPTAVETFHLMGELSSLYVGLKESMKDLDEEQAGQTDLEKIQFLLAQMVKRTIPPELQEQLKTVKTLAKEVWQEKAKVERLQRILEGEGNQEAGKELKAGELRLQLGVLRVTVADIEKELAELRESQDRGKAAMENSVSEASLYLQDQLDKLRMIIESMLTSSSTLLSMSMAPHKAHTLAPGQIDPEATCPACSLDVSHQVSTLVRRYEQLQDMVNSLAVSRPSKKAKLQRQDEELLGRVQSAILQVQGDCEKLNITTSNLIEDHRQKQKDIAMLYQGLEKLEKEKANREHLEMEIDVKADKSALATKVSRVQFDATTEQLNHMMQELVAKMSGQEQDWQKMLDRLLTEMDNKAARHPPKRQLRDLKAQVPAAQAPRAQAAIPQQQWPAALSATERPDFGWQHLRKIDLPPRAVSPSRTQPTRPAPPRWQTGGWRGTWTCLLGRGSRSPRGGRGPAPLSERRCK

SEQ ID NO: 35192 - protein, 108 aa, Homo sapiens
  Payload ID: 6952
  Gene Symbol: QRICH2
  Gene Name: glutamine rich 2
  ENSP ID: ENSP00000432679
MKDAAEELSFARVLLQRVDELEKLFKDREQFLELVSRKLSLVPGAEEVTMVTWEELEQAITDGWRASQAAGVQWCDLGSLQPSPLGLKQSSCLSLPGSWDHSQKDHTS

SEQ ID NO: 35193 - protein, 280 aa, Homo sapiens
  Payload ID: 6952
  Gene Symbol: QRICH2
  Gene Name: glutamine rich 2
  ENSP ID: ENSP00000433329
  MOD_RES (1)..(1): Any amino acid
XKMSGQEQDWQKMLDRLLTEMDNKLDRLELDPVKQLLEDRWKSLRQQLRERPPLYQADEAAAMRRQLLAHFHCLSCDRPLETPVTGHAIPVTPAGPGLPGHHSIRPYTVFELEQVRQHSRNLKLGSAFPRGDLAQMEQSVGRLRSMHSKMLMNIEKVQIHFGGSTKASSQIIRELLHAQCLGSPCYKRMMRWTSWAWMATFTRDGWTQGCQASSEKTAQGPQSASPSSPGPTCTGRHPSAAMASCPLGHRAPRFRLATPQKDRPSSEGRLSQPNTAHPPS

SEQ ID NO: 35194 - protein, 699 aa, Homo sapiens
  Payload ID: 6953
  Gene Symbol: GFPT1
  Gene Name: glutamine--fructose-6-phosphate transaminase 1
  Uniprot ID: Q06210
  ENSP ID: ENSP00000349860
MCGIFAYLNYHVPRTRREILETLIKGLQRLEYRGYDSAGVGFDGGNDKDWEANACKIQLIKKKGKVKALDEEVHKQQDMDLDIEFDVHLGIAHTRWATHGEPSPVNSHPQRSDKNNEFIVIHNGIITNYKDLKKFLESKGYDFESETDTETIAKLVKYMYDNRESQDTSFTTLVERVIQQLEGAFALVFKSVHFPGQAVGTRRGSPLLIGVRSEHKLSTDHIPILYRTARTQIGSKFTRWGSQGERGKDKKGSCNLSRVDSTTCLFPVEEKAVEYYFASDASAVIEHTNRVIFLEDDDVAAVVDGRLSIHRIKRTAGDHPGRAVQTLQMELQQIMKGNFSSFMQKEIFEQPESVVNTMRGRVNFDDYTVNLGGLKDHIKEIQRCRRLILIACGTSYHAGVATRQVLEELTELPVMVELASDFLDRNTPVFRDDVCFFLSQSGETADTLMGLRYCKERGALTVGITNTVGSSISRETDCGVHINAGPEIGVASTKAYTSQFVSLVMFALMMCDDRISMQERRKEIMLGLKRLPDLIKEVLSMDDEIQKLATELYHQKSVLIMGRGYHYATCLEGALKIKEITYMHSEGILAGELKHGPLALVDKLMPVIMIIMRDHTYAKCQNALQQVVARQGRPVVICDKEDTETIKNTKRTIKVPHSVDCLQGILSVIPLQLLAFHLAVLRGYDVDFPRNLAKSVTVE

SEQ ID NO: 35195 - protein, 681 aa, Homo sapiens
  Payload ID: 6953
  Gene Symbol: GFPT1
  Gene Name: glutamine--fructose-6-phosphate transaminase 1
  Uniprot ID: Q06210
  ENSP ID: ENSP00000354347
MCGIFAYLNYHVPRTRREILETLIKGLQRLEYRGYDSAGVGFDGGNDKDWEANACKIQLIKKKGKVKALDEEVHKQQDMDLDIEFDVHLGIAHTRWATHGEPSPVNSHPQRSDKNNEFIVIHNGIITNYKDLKKFLESKGYDFESETDTETIAKLVKYMYDNRESQDTSFTTLVERVIQQLEGAFALVFKSVHFPGQAVGTRRGSPLLIGVRSEHKLSTDHIPILYRTGKDKKGSCNLSRVDSTTCLFPVEEKAVEYYFASDASAVIEHTNRVIFLEDDDVAAVVDGRLSIHRIKRTAGDHPGRAVQTLQMELQQIMKGNFSSFMQKEIFEQPESVVNTMRGRVNFDDYTVNLGGLKDHIKEIQRCRRLILIACGTSYHAGVATRQVLEELTELPVMVELASDFLDRNTPVFRDDVCFFLSQSGETADTLMGLRYCKERGALTVGITNTVGSSISRETDCGVHINAGPEIGVASTKAYTSQFVSLVMFALMMCDDRISMQERRKEIMLGLKRLPDLIKEVLSMDDEIQKLATELYHQKSVLIMGRGYHYATCLEGALKIKEITYMHSEGILAGELKHGPLALVDKLMPVIMIIMRDHTYAKCQNALQQVVARQGRPVVICDKEDTETIKNTKRTIKVPHSVDCLQGILSVIPLQLLAFHLAVLRGYDVDFPRNLAKSVTVE

SEQ ID NO: 35196 - protein, 682 aa, Homo sapiens
  Payload ID: 6954
  Gene Symbol: GFPT2
  Gene Name: glutamine-fructose-6-phosphate transaminase 2
  Uniprot ID: O94808
  ENSP ID: ENSP00000253778
MCGIFAYMNYRVPRTRKEIFETLIKGLQRLEYRGYDSAGVAIDGNNHEVKERHIQLVKKRGKVKALDEELYKQDSMDLKVEFETHFGIAHTRWATHGVPSAVNSHPQRSDKGNEFVVIHNGIITNYKDLRKFLESKGYEFESETDTETIAKLIKYVFDNRETEDITFSTLVERVIQQLEGAFALVFKSVHYPGEAVATRRGSPLLIGVRSKYKLSTEQIPILYRTCTLENVKNICKTRMKRLDSSACLHAVGDKAVEFFFASDASAIIEHTNRVIFLEDDDIAAVADGKLSIHRVKRSASDDPSRAIQTLQMELQQIMKGNFSAFMQKEIFEQPESVFNTMRGRVNFETNTVLLGGLKDHLKEIRRCRRLIVIGCGTSYHAAVATRQVLEELTELPVMVELASDFLDRNTPVFRDDVCFFISQSGETADTLLALRYCKDRGALTVGVTNTVGSSISRETDCGVHINAGPEIGVASTKAYTSQFISLVMFGLMMSEDRISLQNRRQEIIRGLRSLPELIKEVLSLEEKIHDLALELYTQRSLLVMGRGYNYATCLEGALKIKEITYMHSEGILAGELKHGPLALIDKQMPVIMVIMKDPCFAKCQNALQQVTARQGRPIILCSKDDTESSKFAYKTIELPHTVDCLQGILSVIPLQLLSFHLAVLRGYDVDFPRNLAKSVTVE

SEQ ID NO: 35197 - protein, 178 aa, Homo sapiens
  Payload ID: 6954
  Gene Symbol: GFPT2
  Gene Name: glutamine-fructose-6-phosphate transaminase 2
  ENSP ID: ENSP00000422771
MPTEVALLHVSQSPTKAATRRPAHPECGAPIPTQPAAPTEERRGDPAPPSPQPARSPPLRQCLRQGLRVLLATPKERLVPRRVAAALPPLCAGKRQSLPEPRPEATRGSPGRGAGPGVRFPRRSRAVPRGCGTVGRAAAARSAHLQFFTLLAGPPPLAGREPGTSAGTKGIFAYMNYR

SEQ ID NO: 35198 - protein, 216 aa, Homo sapiens
  Payload ID: 6954
  Gene Symbol: GFPT2
  Gene Name: glutamine-fructose-6-phosphate transaminase 2
  ENSP ID: ENSP00000431125
MNLLLNSISLLTFLSEFVVIHNGIITNYKDLRKFLESKGYEFESETDTETIAKLIKYVFDNRETEDITFSTLVERVIQQLEGAFALVFKSVHYPGEAVATRRGSPLLIGVRSKYKLSTEQIPILYRTCTLENVKNICKTRMKRLDSSACLHAVGDKAVEFFFASDASAIIEHTNRVIFLEDDDIAAVADGKLSIHRVKRSASDDPSRAIQTLQMEL

SEQ ID NO: 35199 - protein, 776 aa, Homo sapiens
  Payload ID: 6955
  Gene Symbol: QRICH1
  Gene Name: glutamine-rich 1
  Uniprot ID: Q2TAL8
  ENSP ID: ENSP00000350094
MNNSLENTISFEEYIRVKARSVPQHRMKEFLDSLASKGPEALQEFQQTATTTMVYQQGGNCIYTDSTEVAGSLLELACPVTTSVQPQTQQEQQIQVQQPQQVQVQVQVQQSPQQVSAQLSPQLTVHQPTEQPIQVQVQIQGQAPQSAAPSIQTPSLQSPSPSQLQAAQIQVQHVQAAQQIQAAEIPEEHIPHQQIQAQLVAGQSLAGGQQIQIQTVGALSPPPSQQGSPREGERRVGTASVLQPVKKRKVDMPITVSYAISGQPVATVLAIPQGQQQSYVSLRPDLLTVDSAHLYSATGTITSPTGETWTIPVYSAQPRGDPQQQSITHIAIPQEAYNAVHVSGSPTALAAVKLEDDKEKMVGTTSVVKNSHEEVVQTLANSLFPAQFMNGNIHIPVAVQAVAGTYQNTAQTVHIWDPQQQPQQQTPQEQTPPPQQQQQQLQVTCSAQTVQVAEVEPQSQPQPSPELLLPNSLKPEEGLEVWKNWAQTKNAELEKDAQNRLAPIGRRQLLRFQEDLISSAVAELNYGLCLMTREARNGEGEPYDPDVLYYIFLCIQKYLFENGRVDDIFSDLYYVRFTEWLHEVLKDVQPRVTPLGYVLPSHVTEEMLWECKQLGAHSPSTLLTTLMFFNTKYFLLKTVDQHMKLAFSKVLRQTKKNPSNPKDKSTSIRYLKALGIHQTGQKVTDDMYAEQTENPENPLRCPIKLYDFYLFKCPQSVKGRNDTFYLTPEPVVAPNSPIWYSVQPISREQMGQMLTRILVIREIQEAIAVANASTMH

SEQ ID NO: 35200 - protein, 776 aa, Homo sapiens; identical to SEQ ID NO: 35199
  Payload ID: 6955
  Gene Symbol: QRICH1
  Gene Name: glutamine-rich 1
  Uniprot ID: Q2TAL8
  ENSP ID: ENSP00000378830

SEQ ID NO: 35201 - protein, 48 aa, Homo sapiens
  Payload ID: 6955
  Gene Symbol: QRICH1
  Gene Name: glutamine-rich 1
  ENSP ID: ENSP00000405505
MNNSLENTISFEEYIRVKARSVPQHRMKEFLDSLASKGPEALQEFQQT

SEQ ID NO: 35202 - protein, 103 aa, Homo sapiens
  Payload ID: 6955
  Gene Symbol: QRICH1
  Gene Name: glutamine-rich 1
  ENSP ID: ENSP00000412870
MNNSLENTISFEEYIRVKARSVPQHRMKEFLDSLASKGPEALQEFQQTATTTMVYQQGGNCIYTDSTEVAGSLLELACPVTTSVQPQTQQEQQIQVQQPQQVQ

SEQ ID NO: 35203 - protein, 776 aa, Homo sapiens; identical to SEQ ID NO: 35199
  Payload ID: 6955
  Gene Symbol: QRICH1
  Gene Name: glutamine-rich 1
  Uniprot ID: Q2TAL8
  ENSP ID: ENSP00000412890

SEQ ID NO: 35204 - protein, 103 aa, Homo sapiens; identical to SEQ ID NO: 35202
  Payload ID: 6955
  Gene Symbol: QRICH1
  Gene Name: glutamine-rich 1
  ENSP ID: ENSP00000413051

SEQ ID NO: 35205 - protein, 103 aa, Homo sapiens; identical to SEQ ID NO: 35202
  Payload ID: 6955
  Gene Symbol: QRICH1
  Gene Name: glutamine-rich 1
  ENSP ID: ENSP00000416133

SEQ ID NO: 35206 - protein, 361 aa, Homo sapiens
  Payload ID: 6956
  Gene Symbol: QPCT
  Gene Name: glutaminyl-peptide cyclotransferase
  Uniprot ID: Q16769
  ENSP ID: ENSP00000344829
MAGGRHRRVVGTLHLLLLVAALPWASRGVSPSASAWPEEKNYHQPAILNSSALRQIAEGTSISEMWQNDLQPLLIERYPGSPGSYAARQHIMQRIQRLQADWVLEIDTFLSQTPYGYRSFSNIISTLNPTAKRHLVLACHYDSKYFSHWNNRVFVGATDSAVPCAMMLELARALDKKLLSLKTVSDSKPDLSLQLIFFDGEEAFLHWSPQDSLYGSRHLAAKMASTPHPPGARGTSQLHGMDLLVLLDLIGAPNPTFPNFFPNSARWFERLQAIEHELHELGLLKDHSLEGRYFQNYSYGGVIQDDHIPFLRRGVPVLHLIPSPFPEVWHTMDDNEENLDESTIDNLNKILQVFVLEYLHL

SEQ ID NO: 35207 - protein, 284 aa, Homo sapiens
  Payload ID: 6956
  Gene Symbol: QPCT
  Gene Name: glutaminyl-peptide cyclotransferase
  ENSP ID: ENSP00000385391
MAGGRHRRVVGTLHLLLLVAALPWASRGVSPSASAWPEEKHIMQRIQRLQADWVLEIDTFLSQTPYGYRSFSNIISTLNPTAKRHLVLACHYDSKYFSHWNNRVFVGATDSAVPCAMMLELARALDKKLLSLKTVSDSKPDLSLQLIFFDGEEAFLHWSPQDSLYGSRHLAAKMASTPHPPGARGTSQLHGMDLLVLLDLIGAPNPTFPNFFPNSARWFERLQAIEHELHELGLLKDHSLEGRYFQNYSYGGVIQDDHIPFLRRGVPVLHLIPSPFPEVWHTMD

SEQ ID NO: 35208 - protein, 117 aa, Homo sapiens
  Payload ID: 6956
  Gene Symbol: QPCT
  Gene Name: glutaminyl-peptide cyclotransferase
  ENSP ID: ENSP00000389227
MGQGNVDLLVLLDLIGAPNPTFPNFFPNSARWFERLQAIEHELHELGLLKDHSLEGRYFQNYSYGGVIQDDHIPFLRRGVPVLHLIPSPFPEVWHTMDDNEENLDESTIDNLNKILQ

SEQ ID NO: 35209 - protein, 382 aa, Homo sapiens
  Payload ID: 6957
  Gene Symbol: QPCTL
  Gene Name: glutaminyl-peptide cyclotransferase-like
  Uniprot ID: Q9NXS2
  ENSP ID: ENSP00000012049
MRSGGRGRPRLRLGERGLMEPLLPPKRRLLPRVRLLPLLLALAVGSAFYTIWSGWHRRTEELPLGRELRVPLIGSLPEARLRRVVGQLDPQRLWSTYLRPLLVVRTPGSPGNLQVRKFLEATLRSLTAGWHVELDPFTASTPLGPVDFGNVVATLDPRAARHLTLACHYDSKLFPPGSTPFVGATDSAVPCALLLELAQALDLELSRAKKQAAPVTLQLLFLDGEEALKEWGPKDSLYGSRHLAQLMESIPHSPGPTRIQAIELFMLLDLLGAPNPTFYSHFPRTVRWFHRLRSIEKRLHRLNLLQSHPQEVMYFQPGEPFGSVEDDHIPFLRRGVPVLHLISTPFPAVWHTPADTEVNLHPPTVHNLCRILAVFLAEYLGL

SEQ ID NO: 35210 - protein, 288 aa, Homo sapiens
  Payload ID: 6957
  Gene Symbol: QPCTL
  Gene Name: glutaminyl-peptide cyclotransferase-like
  Uniprot ID: Q9NXS2
  ENSP ID: ENSP00000387944
MRSGGRGRPRLRLGERGLMEPLLPPKRRLLPRVRLLPLLLALAVGSAFYTIWSGWHRRTEELPLGRELRVPLIGSLPEARLRRVVGQLDPQRLWSTYLRPLLVVRTPGSPGNLQVRKAAPVTLQLLFLDGEEALKEWGPKDSLYGSRHLAQLMESIPHSPGPTRIQAIELFMLLDLLGAPNPTFYSHFPRTVRWFHRLRSIEKRLHRLNLLQSHPQEVMYFQPGEPFGSVEDDHIPFLRRGVPVLHLISTPFPAVWHTPADTEVNLHPPTVHNLCRILAVFLAEYLGL

SEQ ID NO: 35211 - protein, 121 aa, Homo sapiens
  Payload ID: 6957
  Gene Symbol: QPCTL
  Gene Name: glutaminyl-peptide cyclotransferase-like
  ENSP ID: ENSP00000467813
MEPLLPPKRRLLPRVRLLPLLLALAVGSAFYTIWSGWHRRTEELPLGRELRVPLIGSLPEARLRRVVGQLDPQRLWSTYLRPLLVVRTPGSPGNLQVRKGPRIRLCPVPCCWSWPKHLTWS

SEQ ID NO: 35212 - protein, 319 aa, Homo sapiens
  Payload ID: 6958
  Gene Symbol: QRSL1
  Gene Name: glutaminyl-tRNA synthase (glutamine-hydrolyzing)-like 1
  ENSP ID: ENSP00000358040
MLGRSLREVSAALKQGQITPTELCQKCLSLIKKTKFLNAYITVSEEVALKQAEESEKRYKNGQSLGDLDGIPIAVKDNFSTSGIETTCASNMLKGYIPPYNATVVQKLLDQGALLMGKTNLDEFAMGSGSTDGVFGPVKNPWSYSKQYREKRKQNPHSENEDSDWLITGGSSGGSAAAVSAFTCYAALGSDTGGSTRNPAAHCGLVGFKPSYGLVSRHGLIPLVNSMDVPGILTRCVDDAAIVLGALAGPDPRDSTTVHEPINKPFMLPSLADVSKLCIGIPKVTFSFHYFTEILSSPIESTDLGGGLGGFESLLCHFY

SEQ ID NO: 35213 - protein, 528 aa, Homo sapiens
  Payload ID: 6958
  Gene Symbol: QRSL1
  Gene Name: glutaminyl-tRNA synthase (glutamine-hydrolyzing)-like 1
  Uniprot ID: Q9H0R6
  ENSP ID: ENSP00000358042
MLGRSLREVSAALKQGQITPTELCQKCLSLIKKTKFLNAYITVSEEVALKQAEESEKRYKNGQSLGDLDGIPIAVKDNFSTSGIETTCASNMLKGYIPPYNATVVQKLLDQGALLMGKTNLDEFAMGSGSTDGVFGPVKNPWSYSKQYREKRKQNPHSENEDSDWLITGGSSGGSAAAVSAFTCYAALGSDTGGSTRNPAAHCGLVGFKPSYGLVSRHGLIPLVNSMDVPGILTRCVDDAAIVLGALAGPDPRDSTTVHEPINKPFMLPSLADVSKLCIGIPKEYLVPELSSEVQSLWSKAADLFESEGAKVIEVSLPHTSYSIVCYHVLCTSEVASNMARFDGLQYGHRCDIDVSTEAMYAATRREGFNDVVRGRILSGNFFLLKENYENYFVKAQKVRRLIANDFVNAFNSGVDVLLTPTTLSEAVPYLEFIKEDNRTRSAQDDIFTQAVNMAGLPAVSIPVALSNQGLPIGLQFIGRAFCDQQLLTVAKWFEKQVQFPVIQLQELMDDCSAVLENEKLASVSLKQ

SEQ ID NO: 35214 - protein, 775 aa, Homo sapiens
  Payload ID: 6959
  Gene Symbol: QARS
  Gene Name: glutaminyl-tRNA synthetase
  Uniprot ID: P47897
  ENSP ID: ENSP00000307567
MAALDSLSLFTSLGLSEQKARETLKNSALSAQLREAATQAQQTLGSTIDKATGILLYGLASRLRDTRRLSFLVSYIASKKIHTEPQLSAALEYVRSHPLDPIDTVDFERECGVGVIVTPEQIEEAVEAAINRHRPQLLVERYHFNMGLLMGEARAVLKWADGKMIKNEVDMQVLHLLGPKLEADLEKKFKVAKARLEETDRRTAKDVVENGETADQTLSLMEQLRGEALKFHKPGENYKTPGYVVTPHTMNLLKQHLEITGGQVRTRFPPEPNGILHIGHAKAINFNFGYAKANNGICFLRFDDTNPEKEEAKFFTAICDMVAWLGYTPYKVTYASDYFDQLYAWAVELIRRGLAYVCHQRGEELKGHNTLPSPWRDRPMEESLLLFEAMRKGKFSEGEATLRMKLVMEDGKMDPVAYRVKYTPHHRTGDKWCIYPTYDYTHCLCDSIEHITHSLCTKEFQARRSSYFWLCNALDVYCPVQWEYGRLNLHYAVVSKRKILQLVATGAVRDWDDPRLFTLTALRRRGFPPEAINNFCARVGVTVAQTTMEPHLLEACVRDVLNDTAPRAMAVLESLRVIITNFPAAKSLDIQVPNFPADETKGFHQVPFAPIVFIERTDFKEEPEPGFKRLAWGQPVGLRHTGYVIELQHVVKGPSGCVESLEVTCRRADAGEKPKAFIHWVSQPLMCEVRLYERLFQHKNPEDPTEVPGGFLSDLNLASLHVVDAALVDCSVALAKPFDKFQFERLGYFSVDPDSHQGKLVFNRTVTLKEDPGKV

SEQ ID NO: 35215 - protein, 100 aa, Homo sapiens
  Payload ID: 6959
  Gene Symbol: QARS
  Gene Name: glutaminyl-tRNA synthetase
  ENSP ID: ENSP00000389823
MAALDSLSLFTSLGLSEQKARETLKNSALSAQLREAATQAQQTLGSTIDKATGILLYGLASRLRDTRRLSFLLPLSMCGVTPWTPSTLWTSSGNVAWVSL

SEQ ID NO: 35216 - protein, 764 aa, Homo sapiens
  Payload ID: 6959
  Gene Symbol: QARS
  Gene Name: glutaminyl-tRNA synthetase
  Uniprot ID: P47897
  ENSP ID: ENSP00000390015
MAALDSLSLFTSLGLSEQKARETLKNSALSAQLREAATQAQQTLGSTIDKATGILLYGLASRLRDTRRLSFLVSYIATALEYVRSHPLDPIDTVDFERECGVGVIVTPEQIEEAVEAAINRHRPQLLVERYHFNMGLLMGEARAVLKWADGKMIKNEVDMQVLHLLGPKLEADLEKKFKVAKARLEETDRRTAKDVVENGETADQTLSLMEQLRGEALKFHKPGENYKTPGYVVTPHTMNLLKQHLEITGGQVRTRFPPEPNGILHIGHAKAINFNFGYAKANNGICFLRFDDTNPEKEEAKFFTAICDMVAWLGYTPYKVTYASDYFDQLYAWAVELIRRGLAYVCHQRGEELKGHNTLPSPWRDRPMEESLLLFEAMRKGKFSEGEATLRMKLVMEDGKMDPVAYRVKYTPHHRTGDKWCIYPTYDYTHCLCDSIEHITHSLCTKEFQARRSSYFWLCNALDVYCPVQWEYGRLNLHYAVVSKRKILQLVATGAVRDWDDPRLFTLTALRRRGFPPEAINNFCARVGVTVAQTTMEPHLLEACVRDVLNDTAPRAMAVLESLRVIITNFPAAKSLDIQVPNFPADETKGFHQVPFAPIVFIERTDFKEEPEPGFKRLAWGQPVGLRHTGYVIELQHVVKGPSGCVESLEVTCRRADAGEKPKAFIHWVSQPLMCEVRLYERLFQHKNPEDPTEVPGGFLSDLNLASLHVVDAALVDCSVALAKPFDKFQFERLGYFSVDPDSHQGKLVFNRTVTLKEDPGKV

SEQ ID NO: 35217 - protein, 339 aa, Homo sapiens
  Payload ID: 6959
  Gene Symbol: QARS
  Gene Name: glutaminyl-tRNA synthetase
  ENSP ID: ENSP00000392850
MAALDSLSLFTSLGLSEQKARETLKNSALSAQLREAATQAQQTLGSTIDKATGILLYGLASRLRDTRRLSFLVSYIASKKIHTEPQLSGWWCQGLTFQEARLSLEFHEIRTLSVHFLEQRCHKLTGSFFSAALEYVRSHPLDPIDTVDFERECGVGVIVTPEQIEEAVEAAINRHRPQLLVERYHFNMGLLMGEARAVLKWADGKMIKNEVDMQVLHLLGPKLEADLEKKFKVAKARLEETDRRTAKDVVENGETADQTLSLMEQLRGEALKFHKPGENYKTPGYVVTPHTMNLLKQHLEITGGQVRTRFPPEPNGILHIGHAKAINFNFGYAKANNGI

SEQ ID NO: 35218 - protein, 253 aa, Homo sapiens
  Payload ID: 6959
  Gene Symbol: QARS
  Gene Name: glutaminyl-tRNA synthetase
  ENSP ID: ENSP00000396326
QWEYGRLNLHYAVVSKRKILQLVATGAVRDWDDPRLFTLTALRRRGFPPEAINNFCARVGVTVAQTTMEPHLLEACVRDVLNDTAPRAMAVLESLRVIITNFPAAKSLDIQVPNFPADETKGFHQVPFAPIVFIERTDFKEEPEPGFKRLAWGQPVGLRHTGYVIELQHVVKGPSGCVESLEVTCRRADAGEKPKAFIHWVSQPLMCEVRLYERLFQHKNPEDPTEVPGGFLSDLNLLVFNRTVTLKEDPGKV

SEQ ID NO: 35219 - protein, 100 aa, Homo sapiens; identical to SEQ ID NO: 35215
  Payload ID: 6959
  Gene Symbol: QARS
  Gene Name: glutaminyl-tRNA synthetase
  ENSP ID: ENSP00000415247

SEQ ID NO: 35220 - protein, 67 aa, Homo sapiens
  Payload ID: 6959
  Gene Symbol: QARS
  Gene Name: glutaminyl-tRNA synthetase
  ENSP ID: ENSP00000488917
MAALDSLSLFTSLGLSEQKARETLKNSALSAQLREAATQLPLSMCGVTPWTPSTLWTSSGNVAWVSL

SEQ ID NO: 35221 - protein, 187 aa, Homo sapiens
  Payload ID: 6959
  Gene Symbol: QARS
  Gene Name: glutaminyl-tRNA synthetase
  ENSP ID: ENSP00000488960
MAALDSLSLFTSLGLSEQKARETLKNSALSAQLREAATQQTLGSTIDKATGILLYGLASRLRDTRRLSFLVSYIASKKIHTEPQLSAALEYVRSHPLDPIDTVDFERECGVGVIVTPEQIEEAVEAAINRHRPQLLVERYHFNMGLLMGEARAVLKWADGKMIKNEVDMQVLHLLGPKLEADLEKKF

SEQ ID NO: 35222 - protein, 26 aa, Homo sapiens
  Payload ID: 6959
  Gene Symbol: QARS
  Gene Name: glutaminyl-tRNA synthetase
  ENSP ID: ENSP00000489004
QGGVKWCNHSSLWPQTTGLKLFSCLS

SEQ ID NO: 35223 - protein, 630 aa, Homo sapiens
  Payload ID: 6959
  Gene Symbol: QARS
  Gene Name: glutaminyl-tRNA synthetase
  ENSP ID: ENSP00000489011
MGLLMGEARAVLKWADGKMIKNEVDMQVLHLLGPKLEADLEKKFKVAKARLEETDRRTAKDVVENGETADQTLSLMEQLRGEALKFHKPGENYKTPGYVVTPHTMNLLKQHLEITGGQVRTRFPPEPNGILHIGHAKAINFNFGYAKANNGICFLRFDDTNPEKEEAKFFTAICDMVAWLGYTPYKVTYASDYFDQLYAWAVELIRRGLAYVCHQRGEELKGHNTLPSPWRDRPMEESLLLFEAMRKGKFSEGEATLRMKLVMEDGKMDPVAYRVKYTPHHRTGDKWCIYPTYDYTHCLCDSIEHITHSLCTKEFQARRSSYFWLCNALDVYCPVQWEYGRLNLHYAVVSKRKILQLVATGAVRDWDDPRLFTLTALRRRGFPPEAINNFCARVGVTVAQTTMEPHLLEACVRDVLNDTAPRAMAVLESLRVIITNFPAAKSLDIQVPNFPADETKGFHQVPFAPIVFIERTDFKEEPEPGFKRLAWGQPVGLRHTGYVIELQHVVKGPSGCVESLEVTCRRADAGEKPKAFIHWVSQPLMCEVRLYERLFQHKNPEDPTEVPGGFLSDLNLASLHVVDAALVDCSVALAKPFDKFQFERLGYFSVDPDSHQGKLVFNRTVTLKEDPGKV

SEQ ID NO: 35224 - protein, 96 aa, Homo sapiens
  Payload ID: 6959
  Gene Symbol: QARS
  Gene Name: glutaminyl-tRNA synthetase
  ENSP ID: ENSP00000489039
MGLLMGEARAVLKWADGKMIKNEVDMQVLHLLGPKLEADLEKKFKVAKARLEETDRRTAKDVVENGETADQTLSLMEQLRGEALKFHKPGENYKTP

SEQ ID NO: 35225 - protein, 191 aa, Homo sapiens
  Payload ID: 6959
  Gene Symbol: QARS
  Gene Name: glutaminyl-tRNA synthetase
  ENSP ID: ENSP00000489056
TLGSTIDKATGILLYGLASRLRDTRRLSFLVSYIASKKIHTEPQLSAALEYVRSHPLDPIDTVDFERECGVGVIVTPEQIEEAVEAAINRHRPQLLVERYHFNMGLLMEVGGVLFFAFLQLLVPMLLGEARAVLKWADGKMIKNEVDMQVLHLLGPKLEADLEKKFKVAKARLEETDRRTAKDVVENGETA

SEQ ID NO: 35226 - protein, 173 aa, Homo sapiens
  Payload ID: 6959
  Gene Symbol: QARS
  Gene Name: glutaminyl-tRNA synthetase
  ENSP ID: ENSP00000489082
MAALDSLSLFTSLGLSEQKARETLKNSALSAQLREAATQAQQTLGSTIDKATGILLYGLASRLRDTRRLSFLVSYIASKKIHTEPQLSAALEYVRSHPLDPIDTVDFERECGVGVIVTPEQIEEAVEAAINRHRPQLLVERYHFNMGLLMGEARAVLKWADGETADQTLSLME

SEQ ID NO: 35227 - protein, 194 aa, Homo sapiens
  Payload ID: 6959
  Gene Symbol: QARS
  Gene Name: glutaminyl-tRNA synthetase
  ENSP ID: ENSP00000489118
  MOD_RES (1)..(1): Any amino acid
XFDQLYAWAVELIRRGLAYVCHQRGEELKGHNTLPSPWRDRPMEESLLLFEAMRKGKFSEGEATLRMKLVMEDGKMDPVAYRVKCIYPTYDYTHCLCDSIEHITHSLCTKEFQARRSSYFWLCNALDVYCPVQWEYGRLNLHYAVVSKRKILQLVATGAVRDWDDPRLFTLTALRRRGFPPEAINNFCARVGVT

SEQ ID NO: 35228 - protein, 342 aa, Homo sapiens
  Payload ID: 6959
  Gene Symbol: QARS
  Gene Name: glutaminyl-tRNA synthetase
  ENSP ID: ENSP00000489154
MAALDSLSLFTSLGLSEQKARETLKNSALSAQLREAATQAQQTLGSTIDKATGILLYGLASRLRDTRRLSFLVSYIASKKIHTEPQLSAALEYVRSHPLDPIDTVDFERECGVGVIVTPEQIEEAVEAAINRHRPQLLVERYHFNMGLLMGEARAVLKWADGKMIKNEVDMQVLHLLGPKLEADLEKKFKVAKARLEETDRRTAKDVVENGETADQTLSLMEQLRGEALKFHKPGENYKTPGYVVTPHTMNLLKQHLEITGGQANNGICFLRFDDTNPEKEEAKFFTAICDMVAWLGYTPYKVTYASDYFDQLYAWAVELIRRGLAYVCHQRGEELKGHNTL

SEQ ID NO: 35229 - protein, 174 aa, Homo sapiens
  Payload ID: 6959
  Gene Symbol: QARS
  Gene Name: glutaminyl-tRNA synthetase
  ENSP ID: ENSP00000489170
MAALDSLSLFTSLGLSEQKARETLKNSALSAQLREAATQAQQTLGSTIDKATGILLYGLASRLRDTRRLSFLVSYIASKKIHTEPQLSAALEYVRSHPLDPIDTVDFERECGVGVIVTPEQIEEAVEAAINRHRPQLLVERYHFNMGLLMAPCAYASRRGSGCAEVGRWQNDQE

SEQ ID NO: 35230 - protein, 134 aa, Homo sapiens
  Payload ID: 6959
  Gene Symbol: QARS
  Gene Name: glutaminyl-tRNA synthetase
  ENSP ID: ENSP00000489214
AKSLDIQVPNFPADETKGFHQVPFAPIVFIERTDFKEEPEPGFKRLAWGQPVGLRHTGYVIELQHVVKGPSGCVESLEVTCRRADAGEKPKAFIHWVSQPLMCEVRLYERLFQHKNPEDPTEVPGGFLSDLNLH

SEQ ID NO: 35231 - protein, 83 aa, Homo sapiens
  Payload ID: 6959
  Gene Symbol: QARS
  Gene Name: glutaminyl-tRNA synthetase
  ENSP ID: ENSP00000489223
  MOD_RES (1)..(1): Any amino acid
XPEPGFKRLAWGQPVGLRHTGYVIELQHVVKGPSGCVESLEVTCRRADAGEKPKAFIHWVSQPLMCEVRLYERLHHYTWWMQH

SEQ ID NO: 35232 - protein, 100 aa, Homo sapiens; identical to SEQ ID NO: 35215
  Payload ID: 6959
  Gene Symbol: QARS
  Gene Name: glutaminyl-tRNA synthetase
  ENSP ID: ENSP00000489331

SEQ ID NO: 35233 - protein, 173 aa, Homo sapiens
  Payload ID: 6959
  Gene Symbol: QARS
  Gene Name: glutaminyl-tRNA synthetase
  ENSP ID: ENSP00000489365
MLLGEARAVLKWADGKMIKNEVDMQVLHLLGPKLEADLEKKFKVAKARLEETDRRTAKDVVENGETADQTLSLMEQLRGEALKFHKPGENYKTPGYVVTPHTMNLLKQHLEITGGQVRTRFPPEPNGILHIGHAKAINFNFGYAKANNGICFLRFDDTNPEKEEAKFFTAICD

SEQ ID NO: 35234 - protein, 75 aa, Homo sapiens
  Payload ID: 6959
  Gene Symbol: QARS
  Gene Name: glutaminyl-tRNA synthetase
  ENSP ID: ENSP00000489384
ASLHVVDAALVDCSVALAKPFDKFQFERLGYFSVDPDSHQGKRRGLTLAQGGVKWCNHSSLWPQTTGLKLFSCLS

SEQ ID NO: 35235 - protein, 100 aa, Homo sapiens; identical to SEQ ID NO: 35215
  Payload ID: 6959
  Gene Symbol: QARS
  Gene Name: glutaminyl-tRNA synthetase
  ENSP ID: ENSP00000489409

SEQ ID NO: 35236 - protein, 91 aa, Homo sapiens
  Payload ID: 6959
  Gene Symbol: QARS
  Gene Name: glutaminyl-tRNA synthetase
  ENSP ID: ENSP00000489462
SLDIQVPNFPADETKGFHQVPFAPIVFIERTDFKEEPEPGFKRLAWGQPVGLRHTGYVIELQHVVKVRASCSLPTAVPAGAKILSLTELSH

SEQ ID NO: 35237 - protein, 182 aa, Homo sapiens
  Payload ID: 6959
  Gene Symbol: QARS
  Gene Name: glutaminyl-tRNA synthetase
  ENSP ID: ENSP00000489550
MAALDSLSLFTSLGLSEQKARETLKNSAQQTLGSTIDKATGILLYGLASRLRDTRRLSFLVSYIASKKIHTEPQLSAALEYVRSHPLDPIDTVDFERECGVGVIVTPEQIEEAVEAAINRHRPQLLVERYHFNMGLLMGEARAVLKWADGKMIKNEVDMQVLHLLGPKLEADLEKKFKVAKA

SEQ ID NO: 35238 - protein, 68 aa, Homo sapiens
  Payload ID: 6959
  Gene Symbol: QARS
  Gene Name: glutaminyl-tRNA synthetase
  ENSP ID: ENSP00000489558
MLLGEARAVLKWADGKMIKNEVDMQVLHLLGPKLEADLEKKFKVAKARLEETDRRTAKDVVENGETAD

SEQ ID NO: 35239 - protein, 957 aa, Homo sapiens
  Payload ID: 6960
  Gene Symbol: ENPEP
  Gene Name: glutamyl aminopeptidase (aminopeptidase A)
  Uniprot ID: Q07075
  ENSP ID: ENSP00000265162
MNFAEREGSKRYCIQTKHVAILCAVVVGVGLIVGLAVGLTRSCDSSGDGGPGTAPAPSHLPSSTASPSGPPAQDQDICPASEDESGQWKNFRLPDFVNPVHYDLHVKPLLEEDTYTGTVSISINLSAPTRYLWLHLRETRITRLPELKRPSGDQVQVRRCFEYKKQEYVVVEAEEELTPSSGDGLYLLTMEFAGWLNGSLVGFYRTTYTENGQVKSIVATDHEPTDARKSFPCFDEPNKKATYTISITHPKEYGALSNMPVAKEESVDDKWTRTTFEKSVPMSTYLVCFAVHQFDSVKRISNSGKPLTIYVQPEQKHTAEYAANITKSVFDYFEEYFAMNYSLPKLDKIAIPDFGTGAMENWGLITYRETNLLYDPKESASSNQQRVATVVAHELVHQWFGNIVTMDWWEDLWLNEGFASFFEFLGVNHAETDWQMRDQMLLEDVLPVQEDDSLMSSHPIIVTVTTPDEITSVFDGISYSKGSSILRMLEDWIKPENFQKGCQMYLEKYQFKNAKTSDFWAALEEASRLPVKEVMDTWTRQMGYPVLNVNGVKNITQKRFLLDPRANPSQPPSDLGYTWNIPVKWTEDNITSSVLFNRSEKEGITLNSSNPSGNAFLKINPDHIGFYRVNYEVATWDSIATALSLNHKTFSSADRASLIDDAFALARAQLLDYKVALNLTKYLKREENFLPWQRVISAVTYIISMFEDDKELYPMIEEYFQGQVKPIADSLGWNDAGDHVTKLLRSSVLGFACKMGDREALNNASSLFEQWLNGTVSLPVNLRLLVYRYGMQNSGNEISWNYTLEQYQKTSLAQEKEKLLYGLASVKNVTLLSRYLDLLKDTNLIKTQDVFTVIRYISYNSYGKNMAWNWIQLNWDYLVNRYTLNNRNLGRIVTIAEPFNTELQLWQMESFFAKYPQAGAGEKPREQVLETVKNNIEWLKQHRNTIREWFFNLLESG

SEQ ID NO: 35240 - protein, 144 aa, Homo sapiens
  Payload ID: 6960
  Gene Symbol: ENPEP
  Gene Name: glutamyl aminopeptidase (aminopeptidase A)
  ENSP ID: ENSP00000426265
  MOD_RES (1)..(1): Any amino acid
XVTVTTPDEITSVFDGISYSKGSSILRMLEDWIKPENFQKGCQMYLEKYQFKNAKTSDFWAALEEASRLPVKEVMDTWTRQMGYPVLNVNGVKNITQKRFLLDPRANPSQPPSDLGYTWNIPVKWTEDNITSSVLFNRSEKEVN

SEQ ID NO: 35241 - protein, 1512 aa, Homo sapiens
  Payload ID: 6961
  Gene Symbol: EPRS
  Gene Name: glutamyl-prolyl-tRNA synthetase
  Uniprot ID: P07814
  ENSP ID: ENSP00000355890
MATLSLTVNSGDPPLGALLAVEHVKDDVSISVEEGKENILHVSENVIFTDVNSILRYLARVATTAGLYGSNLMEHTEIDHWLEFSATKLSSCDSFTSTINELNHCLSLRTYLVGNSLSLADLCVWATLKGNAAWQEQLKQKKAPVHVKRWFGFLEAQQAFQSVGTKWDVSTTKARVAPEKKQDVGKFVELPGAEMGKVTVRFPPEASGYLHIGHAKAALLNQHYQVNFKGKLIMRFDDTNPEKEKEDFEKVILEDVAMLHIKPDQFTYTSDHFETIMKYAEKLIQEGKAYVDDTPAEQMKAEREQRIDSKHRKNPIEKNLQMWEEMKKGSQFGQSCCLRAKIDMSSNNGCMRDPTLYRCKIQPHPRTGNKYNVYPTYDFACPIVDSIEGVTHALRTTEYHDRDEQFYWIIEALGIRKPYIWEYSRLNLNNTVLSKRKLTWFVNEGLVDGWDDPRFPTVRGVLRRGMTVEGLKQFIAAQGSSRSVVNMEWDKIWAFNKKVIDPVAPRYVALLKKEVIPVNVPEAQEEMKEVAKHPKNPEVGLKPVWYSPKVFIEGADAETFSEGEMVTFINWGNLNITKIHKNADGKIISLDAKLNLENKDYKKTTKVTWLAETTHALPIPVICVTYEHLITKPVLGKDEDFKQYVNKNSKHEELMLGDPCLKDLKKGDIIQLQRRGFFICDQPYEPVSPYSCKEAPCVLIYIPDGHTKEMPTSGSKEKTKVEATKNETSAPFKERPTPSLNNNCTTSEDSLVLYNRVAVQGDVVRELKAKKAPKEDVDAAVKQLLSLKAEYKEKTGQEYKPGNPPAEIGQNISSNSSASILESKSLYDEVAAQGEVVRKLKAEKSPKAKINEAVECLLSLKAQYKEKTGKEYIPGQPPLSQSSDSSPTRNSEPAGLETPEAKVLFDKVASQGEVVRKLKTEKAPKDQVDIAVQELLQLKAQYKSLIGVEYKPVSATGAEDKDKKKKEKENKSEKQNKPQKQNDGQRKDPSKNQGGGLSSSGAGEGQGPKKQTRLGLEAKKEENLADWYSQVITKSEMIEYHDISGCYILRPWAYAIWEAIKDFFDAEIKKLGVENCYFPMFVSQSALEKEKTHVADFAPEVAWVTRSGKTELAEPIAIRPTSETVMYPAYAKWVQSHRDLPIKLNQWCNVVRWEFKHPQPFLRTREFLWQEGHSAFATMEEAAEEVLQILDLYAQVYEELLAIPVVKGRKTEKEKFAGGDYTTTIEAFISASGRAIQGGTSHHLGQNFSKMFEIVFEDPKIPGEKQFAYQNSWGLTTRTIGVMTMVHGDNMGLVLPPRVACVQVVIIPCGITNALSEEDKEALIAKCNDYRRRLLSVNIRVRADLRDNYSPGWKFNHWELKGVPIRLEVGPRDMKSCQFVAVRRDTGEKLTVAENEAETKLQAILEDIQVTLFTRASEDLKTHMVVANTMEDFQKILDSGKIVQIPFCGEIDCEDWIKKTTARDQDLEPGAPSMGAKSLCIPFKPLCELQPGAKCVCGKNPAKYYTLFGRSY

SEQ ID NO: 35242 - protein, 968 aa, Homo sapiens
  Payload ID: 6961
  Gene Symbol: EPRS
  Gene Name: glutamyl-prolyl-tRNA synthetase
  ENSP ID: ENSP00000477245
MATLSLTVNSGDPPLGALLAVEHVKDDVSISVEEGKENILHVSENVIFTDVNSILRYLARVATTAGLYGSNLMEHTEIDHWLEFSATKLSSCDSFTSTINELNHCLSLRTYLVGNSLSLADLCVWATLKGNAAWQEQLKQKKAPVHVKRWFGFLEAQQAFQSVGTKWDVSTTKARVAPEKKQDVGKFVELPGAEMGKVTVRFPPEASGYLHIGHAKAALLNQHYQVNFKGKLIMRFDDTNPEKEKEDFEKVILEDVAMLHIKPDQFTYTSDHFETIMKYAEKLIQEGKAYVDDTPAEQMKAEREQRIDSKHRKNPIEKNLQMWEEMKKGSQFGQSCCLRAKIDMSSNNGCMRDPTLYRCKIQPHPRTGNKYNVYPTYDFACPIVDSIEGVTHALRTTEYHDRDEQFYWIIEALGIRKPYIWEYSRLNLNNTVLSKRKLTWFVNEGLVDGWDDPRFPTVRGVLRRGMTVEGLKQFIAAQGSSRSVVNMEWDKIWAFNKKLRALCKKVIDPVAPRYVALLKKEVIPVNVPEAQEEMKEVAKHPKNPEVGLKPVWYSPKVFIEGADAETFSEGEMVTFINWGNLNITKIHKNADGKIISLDAKLNLENKDYKKTTKVTWLAETTHALPIPVICVTYEHLITKPVLGKDEDFKQYVNKNSKHEELMLGDPCLKDLKKGDIIQLQRRGFFICDQPYEPVSPYSCKEAPCVLIYIPDGHTKEMPTSGSKEKTKVEATKNETSAPFKERPTPSLNNNCTTSEDSLVLYNRVAVQGDVVRELKAKKAPKEDVDAAVKQLLSLKAEYKEKTGQEYKPGNPPAEIGQNISSNSSASILESKSLYDEVAAQGEVVRKLKAEKSPKAKINEAVECLLSLKAQYKEKTGKEYIPGQPPLSQSSDSSPTRNSEPAGLETPEAKVLFDKVASQGEVVRKLKTEKAPKDQVDIAVQELLQLKAQYKSLIGVEYKPVSATGAEDK

SEQ ID NO: 35243 - protein, 194 aa, Homo sapiens
  Payload ID: 6961
  Gene Symbol: EPRS
  Gene Name: glutamyl-prolyl-tRNA synthetase
  ENSP ID: ENSP00000477493
MATLSLTVNSGDPPLGALLAVEHVKDDVSISVEEGKENILHVSENVIFTDVNSILRYLARVATTAGLYGSNLMEHTEIDHWLEFSATKLSSCDSFTSTINELNHCLSLRTYLVGNSLSLADLCVWATLKGNAAWQEQLKQKKAPVHVKRWFGFLEAQQAFQSVGTKWDVSTTKARVLLTHWACKSCSSEPALPG

SEQ ID NO: 35244 - protein, 523 aa, Homo sapiens
  Payload ID: 6962
  Gene Symbol: EARS2
  Gene Name: glutamyl-tRNA synthetase 2, mitochondrial
  Uniprot ID: Q5JPH6
  ENSP ID: ENSP00000395196
MAALLRRLLQRERPSAASGRPVGRREANLGTDAGVAVRVRFAPSPTGFLHLGGLRTALYNYIFAKKYQGSFILRLEDTDQTRVVPGAAENIEDMLEWAGIPPDESPRRGGPAGPYQQSQRLELYAQATEALLKTGAAYPCFCSPQRLELLKKEALRNHQTPRYDNRCRNMSQEQVAQKLAKDPKPAIRFRLEQVVPAFQDLVYGWNRHEVASVEGDPVIMKSDGFPTYHLACVVDDHHMGISHVLRGSEWLVSTAKHLLLYQALGWQPPHFAHLPLLLNRDGSKLSKRQGDVFLEHFAADGFLPDSLLDIITNCGSGFAENQMGRTLPELITQFNLTQVTCHSALLDLEKLPEFNRLHLQRLVSNESQRRQLVGKLQVLVEEAFGCQLQNRDVLNPVYVERILLLRQGHICRLQDLVSPVYSYLWTRPAVGRAQLDAISEKVDVIAKRVLGLLERSSMSLTQDMLNGELKKLSEGLEGTKYSNVMKLLRMALSGQQQGPPVAEMMLALGPKEVRERIQKVVSS

SEQ ID NO: 35245 - protein, 54 aa, Homo sapiens
  Payload ID: 6962
  Gene Symbol: EARS2
  Gene Name: glutamyl-tRNA synthetase 2, mitochondrial
  ENSP ID: ENSP00000455519
MAALLRRLLQRERPSAASGRPVGRREANLGTDAGVAVRVRFAPSPTGVVDAGIQ

SEQ ID NO: 35246 - protein, 99 aa, Homo sapiens
  Payload ID: 6962
  Gene Symbol: EARS2
  Gene Name: glutamyl-tRNA synthetase 2, mitochondrial
  ENSP ID: ENSP00000455789
MAALLRRLLQRERPSAASGRPVGRREANLGTDAGVAVRVRFAPSPTESHSTAAQAGVQRRDHGSLQPQRPQAQASCTWVASALPCTTTSLLRSTRGASS

SEQ ID NO: 35247 - protein, 79 aa, Homo sapiens
  Payload ID: 6962
  Gene Symbol: EARS2
  Gene Name: glutamyl-tRNA synthetase 2, mitochondrial
  ENSP ID: ENSP00000455875
MAALLRRLLQRERPSAASGRPVGRREANLGTDAGVAVRVRFAPSPTESHSTAAQAGVQRRDHGSLQPQRPQAQVILPPQ

SEQ ID NO: 35248 - protein, 534 aa, Homo sapiens
  Payload ID: 6962
  Gene Symbol: EARS2
  Gene Name: glutamyl-tRNA synthetase 2, mitochondrial
  Uniprot ID: Q5JPH6
  ENSP ID: ENSP00000456218
MAALLRRLLQRERPSAASGRPVGRREANLGTDAGVAVRVRFAPSPTGFLHLGGLRTALYNYIFAKKYQGSFILRLEDTDQTRVVPGAAENIEDMLEWAGIPPDESPRRGGPAGPYQQSQRLELYAQATEALLKTGAAYPCFCSPQRLELLKKEALRNHQTPRYDNRCRNMSQEQVAQKLAKDPKPAIRFRLEQVVPAFQDLVYGWNRHEVASVEGDPVIMKSDGFPTYHLACVVDDHHMGISHVLRGSEWLVSTAKHLLLYQALGWQPPHFAHLPLLLNRDGSKLSKRQGDVFLEHFAADGFLPDSLLDIITNCGSGFAENQMGRTLPELITQFNLTQVTCHSALLDLEKLPEFNRLHLQRLVSNESQRRQLVGKLQVLVEEAFGCQLQNRDVLNPVYVERILLLRQGHICRLQDLVSPVYSYLWTRPAVGRAQLDAISEKVDVIAKRVLGLLERSSMSLTQDMLNGELKKLSEGLEGTKYSNVMKLLRMALSGQQVRQGHGLDCSLEPLIDPLNLHFLAGTELNIEYTKVNET

SEQ ID NO: 35249 - protein, 523 aa, Homo sapiens; identical to SEQ ID NO: 35244
  Payload ID: 6962
  Gene Symbol: EARS2
  Gene Name: glutamyl-tRNA synthetase 2, mitochondrial
  Uniprot ID: Q5JPH6
  ENSP ID: ENSP00000456467

SEQ ID NO: 35250 - protein, 506 aa, Homo sapiens
  Payload ID: 6962
  Gene Symbol: EARS2
  Gene Name: glutamyl-tRNA synthetase 2, mitochondrial
  ENSP ID: ENSP00000457107
MAALLRRLLQRERPSAASGRPVGRREANLGTDAGVAVRVRFAPSPTGFLHLGGLRTALYNYIFAKKYQGSFILRLEDTDQTRVVPGAAENIEDMLEWAGIPPDESPRRGGPAGPYQQSQRLELYAQATEALLKTGAAYPCFCSPQRLELLKKEALRNHQTPRYDNRCRNMSQEQVAQKLAKDPKPAIRFRLEQVVPAFQDLVYGWNRHEVASVEGDPVIMKSDGFPTYHLACVVDDHHMGISHVLRGSEWLVSTAKHLLLYQALGWQPPHFAHLPLLLNRDGSKLSKRQGDVFLEHFAADGFLPDSLLDIITNCGSGFAENQMGRTLPELITQFNLTQVTCHSALLDLEKLPEFNRLHLQRLVSNESQRRQLVGKLQVLVEEAFGCQLQNRDVLNPVYVERILLLRQGHICRLQDLVSPVYSYLWTRPAVGRAQLDAISEKVDVIAKRVLGLLERSSMSLTQDMLNGELKKLSEGLEGTKYSNVMKLLRMALSGQQALSSILSIQR

SEQ ID NO: 35251 - protein, 112 aa, Homo sapiens
  Payload ID: 6962
  Gene Symbol: EARS2
  Gene Name: glutamyl-tRNA synthetase 2, mitochondrial
  ENSP ID: ENSP00000458604
MAALLRRLLQRERPSAASGRPAEAPCPVSAPRMFPNESFPVVSEWAGGGGLRQREPILQRRKLRCRSGNNSNCQEFLVFFVPSHLFRSFFHAFHTCALMTTCVTGVVDAGIQ

SEQ ID NO: 35252 - protein, 557 aa, Homo sapiens
  Payload ID: 6963
  Gene Symbol: GATB
  Gene Name: glutamyl-tRNA(Gln) amidotransferase, subunit B
  Uniprot ID: O75879
  ENSP ID: ENSP00000263985
MAAPMLRWGCRGRRWAFARVDGGSCHRRGAPTGSTSNQIRGESSVAQQPLHTAQKTRKGEHKWAAVVGLEIHAQISSNSKLFSGSQVRFSAPPNSLVSFFDASLPGTLPVLNRRCVEAAVMTGLALNCHINKKSLFDRKHYFYADLPAGYQITQQRLPIAVNGSLIYGVCAGKKQSQVIPKTVRIKQIQLEQDSGKSLHDNLRSQTLIDLNRAGVGLLEVVLEPDMSCGEEAATAVRELQLILQALGTSQANMAEGQLRVDANISVHHPGEPLGVRTEVKNLNSIRFLAKAIDYEIQRQINELENGGEILNETRSFHHKLGCTMSMRDKEGKQDYRFMPEPNLPPLVLYDATSLPAGADPQQVINIDQIRETLPELPSVTREKLVQQYGMLLEHSFTLLNEVGLLEFFQNVIKETRAEPKKVTSWVLNTFLGYLKQQNLAVSESPVTPSALAELLDLLDSRTISSSAAKQVFEELWKREGKTPGQIVSEKQLELMQDQGALEQLCHSVMEAHPQVVMDVKNRNPRAINKLIGLVRKATQSRADPVMIKEILEKKLSL

SEQ ID NO: 35253 - protein, 357 aa, Homo sapiens
  Payload ID: 6963
  Gene Symbol: GATB
  Gene Name: glutamyl-tRNA(Gln) amidotransferase, subunit B
  ENSP ID: ENSP00000420831
MAAPMLRWGCRGRRWAFARVDGGSCHRRGAPTGSTSNQIRGESSVAQQPLHTAQKTRKGEHKWAAVVGLEIHAQISSNSKLFSGSQVRFSAPPNSLVSFFDASLPGTLPVLNRRCVEAAVMTGLALNCHINKKSLFDRKHYFYADLPAGYQITQQRLPIAVNGSLIYGVCAGKKQSQVIPKTVRIKQIQLEQDSGKSLHDNLRSQTLIDLNRAGVGLLEVVLEPDMSCGEEAATAVRELQLILQALGTSQANMAEGQLRVDANISVHHPGEPLGVRTEVKNLNSIRFLAKAIDYEIQRQINELENGGEILNETRSFHHKLGCTMSMRDKEGKQDYRWLLLMAKYRYISGAGAYFKFI

SEQ ID NO: 35254 - protein, 136 aa, Homo sapiens
  Payload ID: 6963
  Gene Symbol: GATB
  Gene Name: glutamyl-tRNA(Gln) amidotransferase, subunit B
  ENSP ID: ENSP00000421005
  MOD_RES (1)..(1): Any amino acid
XRVDGGSCHRRGAPTGSTSNQIRGESSVAQQPLHTAQKTRKGEHKWAAVVGLEIHAQISSNSKLFSGSQVRFSAPPNSLVSFFDASLPGTLPVLNRRCVEAAVMTGLALNCHINKKSLFDRKHYFYADLPGRSRVR

SEQ ID NO: 35255 - protein, 115 aa, Homo sapiens
  Payload ID: 6963
  Gene Symbol: GATB
  Gene Name: glutamyl-tRNA(Gln) amidotransferase, subunit B
  ENSP ID: ENSP00000421105
MAAPMLRWGCRGRRWAFARVDGGSCHRRGAPTGSTSNQIRGESSVAQQPLHTAQKTRKGEHKWAAVVGLEIHAQISSNSKLFSGSQVRFSAPPNSLVSFFDASLPGTLPSEDSPS

SEQ ID NO: 35256 - protein, 146 aa, Homo sapiens
  Payload ID: 6963
  Gene Symbol: GATB
  Gene Name: glutamyl-tRNA(Gln) amidotransferase, subunit B
  ENSP ID: ENSP00000421240
MLRWGCRGRRWAFARVDGGSCHRRGAPTGSTSNQIRGESSVAQQPLHTAQKTRKGEHKWAAVVGLEIHAQISSNSKLFSGSQVRFSAPPNSLVSFFDASLPGTLPVLNRRCVEAAVMTGLALNCHINKKSLFDRKHYFYADLPRAS

SEQ ID NO: 35257 - protein, 141 aa, Homo sapiens
  Payload ID: 6963
  Gene Symbol: GATB
  Gene Name: glutamyl-tRNA(Gln) amidotransferase, subunit B
  ENSP ID: ENSP00000423999
  MOD_RES (1)..(1): Any amino acid
XRGRRWAFARVDGGSCHRRGAPTGSTSNQIRGESSVAQQPLHTAQKTRKGEHKWAAVVGLEIHAQISSNSKLFSGSQVRFSAPPNSLVSFFDASLPGTLPVLNRRCVEAAVMTGLALNCHINKKSLFDRKHYFYADLPRAS

SEQ ID NO: 35258 - protein, 132 aa, Homo sapiens
  Payload ID: 6963
  Gene Symbol: GATB
  Gene Name: glutamyl-tRNA(Gln) amidotransferase, subunit B
  ENSP ID: ENSP00000425294
  MOD_RES (1)..(1): Any amino acid
XFMPEPNLPPLVLYDATSLPAGADPQQVINIDQIRETLPELPSVTREKLVQQYGMLLEHSFTLLNEVGLLEFFQNVIKETRAEPKKVTSWVLNTFLGYLKQQNLAVSERCLRNCGRGKARLQGRLFQKSSLN

SEQ ID NO: 35259 - protein, 516 aa, Homo sapiens
  Payload ID: 6963
  Gene Symbol: GATB
  Gene Name: glutamyl-tRNA(Gln) amidotransferase, subunit B
  ENSP ID: ENSP00000426859
MAAPMLRWGCRGRRWAFARVDGGSCHRRGAPTGSTSNQIRGESSVAQQPLHTAQKTRKGEHKWAAVVGLEIHAQISSNSKLFSGSQVRFSAPPNSLVSFFDASLPGTLPVLNRRCVEAAVMTGLALNCHINKKSLFDRKHYFYADLPAGYQITQQRLPIAVNGSLIYGVCAGKKQSQVIPKTVRIKQIQLEQDSGKSLHDNLRSQTLIDLNRAEGQLRVDANISVHHPGEPLGVRTEVKNLNSIRFLAKAIDYEIQRQINELENGGEILNETRSFHHKLGCTMSMRDKEGKQDYRFMPEPNLPPLVLYDATSLPAGADPQQVINIDQIRETLPELPSVTREKLVQQYGMLLEHSFTLLNEVGLLEFFQNVIKETRAEPKKVTSWVLNTFLGYLKQQNLAVSESPVTPSALAELLDLLDSRTISSSAAKQVFEELWKREGKTPGQIVSEKQLELMQDQGALEQLCHSVMEAHPQVVMDVKNRNPRAINKLIGLVRKATQSRADPVMIKEILEKKLSL

SEQ ID NO: 35260 - protein, 47 aa, Homo sapiens
  Payload ID: 6964
  Gene Symbol: GATC
  Gene Name: glutamyl-tRNA(Gln) amidotransferase, subunit C
  ENSP ID: ENSP00000229384
MESVLEDRCLYLRSDNVVEGNCADELLQNSHRVVEEYFVAPPGNISL

SEQ ID NO: 35261 - protein, 136 aa, Homo sapiens
  Payload ID: 6964
  Gene Symbol: GATC
  Gene Name: glutamyl-tRNA(Gln) amidotransferase, subunit C
  Uniprot ID: O43716
  ENSP ID: ENSP00000446872
MWSRLVWLGLRAPLGGRQGFTSKADPQGSGRITAAVIEHLERLALVDFGSREAVARLEKAIAFADRLRAVDTDGVEPMESVLEDRCLYLRSDNVVEGNCADELLQNSHRVVEEYFVAPPGNISLPKLDEQEPFPHS

SEQ ID NO: 35262 - protein, 121 aa, Homo sapiens
  Payload ID: 6964
  Gene Symbol: GATC
  Gene Name: glutamyl-tRNA(Gln) amidotransferase, subunit C
  ENSP ID: ENSP00000448397
MWSRLVWLGLRAPLGGRQGFTSKADPQGSGRITAAVIEHLERLALVDFGSREAVARLEKAIAFADRLRAVDTDGVEPMESVLEDRLECSGVISAHYKLCFLHSSDSCASASQVAGITDVYT

SEQ ID NO: 35263 - protein, 106 aa, Homo sapiens
  Payload ID: 6965
  Gene Symbol: GLRX
  Gene Name: glutaredoxin (thioltransferase)
  Uniprot ID: P35754
  ENSP ID: ENSP00000237858
MAQEFVNCKIQPGKVVVFIKPTCPYCRRAQEILSQLPIKQGLLEFVDITATNHTNEIQDYLQQLTGARTVPRVFIGKDCIGGCSDLVSLQQSGELLTRLKQIGALQ

SEQ ID NO: 35264 - protein, 106 aa, Homo sapiens; identical to SEQ ID NO: 35263
  Payload ID: 6965
  Gene Symbol: GLRX
  Gene Name: glutaredoxin (thioltransferase)
  Uniprot ID: P35754
  ENSP ID: ENSP00000369314

SEQ ID NO: 35265 - protein, 106 aa, Homo sapiens; identical to SEQ ID NO: 35263
  Payload ID: 6965
  Gene Symbol: GLRX
  Gene Name: glutaredoxin (thioltransferase)
  Uniprot ID: P35754
  ENSP ID: ENSP00000422708

SEQ ID NO: 35266 - protein, 106 aa, Homo sapiens; identical to SEQ ID NO: 35263
  Payload ID: 6965
  Gene Symbol: GLRX
  Gene Name: glutaredoxin (thioltransferase)
  Uniprot ID: P35754
  ENSP ID: ENSP00000424636

SEQ ID NO: 35267 - protein, 106 aa, Homo sapiens; identical to SEQ ID NO: 35263
  Payload ID: 6965
  Gene Symbol: GLRX
  Gene Name: glutaredoxin (thioltransferase)
  Uniprot ID: P35754
  ENSP ID: ENSP00000427353

SEQ ID NO: 35268 - protein, 164 aa, Homo sapiens
  Payload ID: 6966
  Gene Symbol: GLRX2
  Gene Name: glutaredoxin 2
  Uniprot ID: Q9NS18
  ENSP ID: ENSP00000356409
MIWRRAALAGTRLVWSRSGSAGWLDRAAGAAGAAAAAASGMESNTSSSLENLATAPVNQIQETISDNCVVIFSKTSCSYCTMAKKLFHDMNVNYKVVELDLLEYGNQFQDALYKMTGERTVPRIFVNGTFIGGATDTHRLHKEGKLLPLVHQCYLKKSKRKEFQ

SEQ ID NO: 35269 - protein, 165 aa, Homo sapiens
  Payload ID: 6966
  Gene Symbol: GLRX2
  Gene Name: glutaredoxin 2
  Uniprot ID: Q9NS18
  ENSP ID: ENSP00000356410
MNPRDKQVSRFSPLKDVYTWVALAGIQRSGSPGRTRSAARRMESNTSSSLENLATAPVNQIQETISDNCVVIFSKTSCSYCTMAKKLFHDMNVNYKVVELDLLEYGNQFQDALYKMTGERTVPRIFVNGTFIGGATDTHRLHKEGKLLPLVHQCYLKKSKRKEFQ

SEQ ID NO: 35270 - protein, 335 aa, Homo sapiens
  Payload ID: 6967
  Gene Symbol: GLRX3
  Gene Name: glutaredoxin 3
  Uniprot ID: O76003
  ENSP ID: ENSP00000330836
MAAGAAEAAVAAVEEVGSAGQFEELLRLKAKSLLVVHFWAPWAPQCAQMNEVMAELAKELPQVSFVKLEAEGVPEVSEKYEISSVPTFLFFKNSQKIDRLDGAHAPELTKKVQRHASSGSFLPSANEHLKEDLNLRLKKLTHAAPCMLFMKGTPQEPRCGFSKQMVEILHKHNIQFSSFDIFSDEEVRQGLKAYSSWPTYPQLYVSGELIGGLDIIKELEASEELDTICPKAPKLEERLKVLTNKASVMLFMKGNKQEAKCGFSKQILEILNSTGVEYETFDILEDEEVRQGLKAYSNWPTYPQLYVKGELVGGLDIVKELKENGELLPILRGEN

SEQ ID NO: 35271 - protein, 335 aa, Homo sapiens; identical to SEQ ID NO: 35270
  Payload ID: 6967
  Gene Symbol: GLRX3
  Gene Name: glutaredoxin 3
  Uniprot ID: O76003
  ENSP ID: ENSP00000357633

SEQ ID NO: 35272 - protein, 335 aa, Homo sapiens; identical to SEQ ID NO: 35270
  Payload ID: 6967
  Gene Symbol: GLRX3
  Gene Name: glutaredoxin 3
  Uniprot ID: O76003
  ENSP ID: ENSP00000435445

SEQ ID NO: 35273 - protein, 157 aa, Homo sapiens
  Payload ID: 6968
  Gene Symbol: GLRX5
  Gene Name: glutaredoxin 5
  Uniprot ID: Q86SX6
  ENSP ID: ENSP00000328570
MSGSLGRAAAALLRWGRGAGGGGLWGPGVRAAGSGAGGGGSAEQLDALVKKDKVVVFLKGTPEQPQCGFSNAVVQILRLHGVRDYAAYNVLDDPELRQGIKDYSNWPTIPQVYLNGEFVGGCDILLQMHQNGDLVEELKKLGIHSALLDEKKDQDSK

SEQ ID NO: 35274 - protein, 137 aa, Homo sapiens
  Payload ID: 6968
  Gene Symbol: GLRX5
  Gene Name: glutaredoxin 5
  ENSP ID: ENSP00000451800
  MOD_RES (1)..(1): Any amino acid
XGAAPVRLQQRRGADPAAARRPRLRGLQRAGRPGAPTSHHPCGSELNRVVAQLRCHRVSLISCVSSEPFAHRTDHMHAGWFLGCCERLRAERVSLPHPSALDRDLAELWAFIRLTSHFGFCTEPHHPLHREPITVAG

SEQ ID NO: 35275 - protein, 290 aa, Homo sapiens
  Payload ID: 6969
  Gene Symbol: GRXCR1
  Gene Name: glutaredoxin, cysteine rich 1
  Uniprot ID: A8MXD5
  ENSP ID: ENSP00000382670
MLKREMKPESDRPRKVRFRIASSHSGRVLKEVYEDGQPSGSLDSECASICGIDGLGDSDGQQNGHIESEGDENENDQDSLLVLARAASEKGFGTRRVNILSKNGTVRGVKYKVSAGQALFNNLTKVLQQPSTDLEFDRVVIYTTCLRVVRTTFERCELVRKIFQNHRVKFEEKNIALNGEYGKELDERCRRVSEAPSLPVVFIDGHYLGGAEKILSMNESGELQDILTKIERVQHPHECPSCGGFGFLPCSVCHGSKMSMFRNCFTDSFKALKCTACNENGLQRCKNCAG

SEQ ID NO: 35276 - protein, 248 aa, Homo sapiens
  Payload ID: 6970
  Gene Symbol: GRXCR2
  Gene Name: glutaredoxin, cysteine rich 2
  Uniprot ID: A6NFK2
  ENSP ID: ENSP00000367214
MEDPEKKLNQKSDGKPRKVRFKISSSYSGRVLKQVFEDGQELESPKEEYPHSFLQESLETMDGVYGSGEVPRPQMCSPKLTAQRISVFREGNAYTLAGGQPRFNDYKANDHKPLPIIDFGKIIIYTNNLKIIRTPMDKRDFVRKILQKEEEAEEESLMNKEESYGGRDQHDRPLVEAESTLPQNRYTQEGDIPEDSCFHCRGSGSATCSLCHGSKFSMLANRFKESYRALRCPACNENGLQPCQICNQ

SEQ ID NO: 35277 - protein, 438 aa, Homo sapiens
  Payload ID: 6971
  Gene Symbol: GCDH
  Gene Name: glutaryl-CoA dehydrogenase
  Uniprot ID: Q92947
  ENSP ID: ENSP00000222214
MALRGVSVRLLSRGPGLHVLRTWVSSAAQTEKGGRTQSQLAKSSRPEFDWQDPLVLEEQLTTDEILIRDTFRTYCQERLMPRILLANRNEVFHREIISEMGELGVLGPTIKGYGCAGVSSVAYGLLARELERVDSGYRSAMSVQSSLVMHPIYAYGSEEQRQKYLPQLAKGELLGCFGLTEPNSGSDPSSMETRAHYNSSNKSYTLNGTKTWITNSPMADLFVVWARCEDGCIRGFLLEKGMRGLSAPRIQGKFSLRASATGMIIMDGVEVPEENVLPGASSLGGPFGCLNNARYGIAWGVLGASEFCLHTARQYALDRMQFGVPLARNQLIQKKLADMLTEITLGLHACLQLGRLKDQDKAAPEMVSLLKRNNCGKALDIARQARDMLGGNGISDEYHVIRHAMNLEAVNTYEGTHDIHALILGRAITGIQAFTASK

SEQ ID NO: 35278 - protein, 148 aa, Homo sapiens
  Payload ID: 6971
  Gene Symbol: GCDH
  Gene Name: glutaryl-CoA dehydrogenase
  ENSP ID: ENSP00000465618
MALRGVSVRLLSRGPGLHVLRTWVSSAAQTEKGGRTQSQLAKSSRPEFDWQDPLVLEEQLTTDEILIRDTFRTYCQERLMPRILLANRNEGYGCAGVSSVAYGLLARELERVDSGYRSAMSVQSSLVMHPIYAYGSEEQRQKYLPQLA

SEQ ID NO: 35279 - protein, 164 aa, Homo sapiens
  Payload ID: 6971
  Gene Symbol: GCDH
  Gene Name: glutaryl-CoA dehydrogenase
  ENSP ID: ENSP00000465770
MALRGVSVRLLSRGPGLHVLRTWVSSAAQTASRPEFDWQDPLVLEEQLTTDEILIRDTFRTYCQERLMPRILLANRNEVFHREIISEMGELGVLGPTIKGYGCAGVSSVAYGLLARELERVDSGYRSAMSVQSSLVMHPIYAYGSEEQRQKYLPQLAKGELLGC

SEQ ID NO: 35280 - protein, 438 aa, Homo sapiens; identical to SEQ ID NO: 35277
  Payload ID: 6971
  Gene Symbol: GCDH
  Gene Name: glutaryl-CoA dehydrogenase
  Uniprot ID: Q92947
  ENSP ID: ENSP00000466845

SEQ ID NO: 35281 - protein, 102 aa, Homo sapiens
  Payload ID: 6971
  Gene Symbol: GCDH
  Gene Name: glutaryl-CoA dehydrogenase
  ENSP ID: ENSP00000467735
  MOD_RES (1)..(1): Any amino acid
XGLHACLQLGRLKDQDKAAPEMVSLLKRNNCGKALDIARQARDMLGGNGISDEYHVIRHAMNLEAVNTYEGELIHSTAAAETMTPTEPSPDPHPTPSSGSES

SEQ ID NO: 35282 - protein, 86 aa, Homo sapiens
  Payload ID: 6971
  Gene Symbol: GCDH
  Gene Name: glutaryl-CoA dehydrogenase
  ENSP ID: ENSP00000468125
MALRGVSVRLLSRGPGLHVLRTWVSSAAQTEKGGRTQSQLAKCKDLWSHRVSAAPVQLSVCRRWTLSQNPRAARAGWQGRGQGQRH

SEQ ID NO: 35283 - protein, 204 aa, Homo sapiens
  Payload ID: 6971
  Gene Symbol: GCDH
  Gene Name: glutaryl-CoA dehydrogenase
  ENSP ID: ENSP00000468452
MALRGVSVRLLSRGPGLHVLRTWVSSAAQTEKGGRTQSQLAKSSRPEFDWQDPLVLEEQLTTDEILIRDTFRTYCQERLMPRILLANRNEESGSVAQAGVQWHDLGSLQILPPRLKRFSCLHPSSSWDYRIWLCWGFVCGLWAPGPRAGAGGQWLQVGDECPVLPRHAPYLCLWQRGTAAEVPAPAGQGGAPGLLRAHRAQQRK

SEQ ID NO: 35284 - protein, 131 aa, Homo sapiens
  Payload ID: 6971
  Gene Symbol: GCDH
  Gene Name: glutaryl-CoA dehydrogenase
  ENSP ID: ENSP00000468584
MALRGVSVRLLSRGPGLHVLRTWVSSAAQTEKGGRTQSQLAKSSRPEFDWQDPLVLEEQLTTDEILIRDTFRTYCQERLMPRILLANRNEVFHREIISEMGELGVLGPTIKGSSDSPASTPLVAGITGYGC

SEQ ID NO: 35285 - protein, 115 aa, Homo sapiens
  Payload ID: 6971
  Gene Symbol: GCDH
  Gene Name: glutaryl-CoA dehydrogenase
  ENSP ID: ENSP00000468625
  MOD_RES (1)..(1): Any amino acid
XMQFGVPLARNQLIQKKLADMLTEITLGLHACLQLGRLKDQDKAAPEMVSLLKRNNCGKALDIARQARDMLGGNGISDEYHVIRHAMNLEAVNTYEGMFLRQVSSEGSPGVRPDS

SEQ ID NO: 35286 - protein, 98 aa, Homo sapiens
  Payload ID: 6972
  Gene Symbol: GPX1
  Gene Name: glutathione peroxidase 1
  Uniprot ID: P07203
  ENSP ID: ENSP00000391316
  MOD_RES (49)..(49): Selenocysteine
MCAARLAAAAAAAQSVYAFSARPLAGGEPVSLGSLRGKVLLIENVASLXGTTVRDYTQMNELQRRLGPRGLVVLGFPCNQFGHQVRRAERGGAGADVQ

SEQ ID NO: 35287 - protein, 203 aa, Homo sapiens
  Payload ID: 6972
  Gene Symbol: GPX1
  Gene Name: glutathione peroxidase 1
  Uniprot ID: P07203
  ENSP ID: ENSP00000407375
  MOD_RES (49)..(49): Selenocysteine
MCAARLAAAAAAAQSVYAFSARPLAGGEPVSLGSLRGKVLLIENVASLXGTTVRDYTQMNELQRRLGPRGLVVLGFPCNQFGHQENAKNEEILNSLKYVRPGGGFEPNFMLFEKCEVNGAGAHPLFAFLREALPAPSDDATALMTDPKLITWSPVCRNDVAWNFEKFLVGPDGVPLRRYSRRFQTIDIEPDIEALLSQGPSCA

SEQ ID NO: 35288 - protein, 202 aa, Homo sapiens
  Payload ID: 6972
  Gene Symbol: GPX1
  Gene Name: glutathione peroxidase 1
  ENSP ID: ENSP00000478837
MCAARLAAAAAAAQSVYAFSARPLAGGEPVSLGSLRGKVLLIENVASLGTTVRDYTQMNELQRRLGPRGLVVLGFPCNQFGHQENAKNEEILNSLKYVRPGGGFEPNFMLFEKCEVNGAGAHPLFAFLREALPAPSDDATALMTDPKLITWSPVCRNDVAWNFEKFLVGPDGVPLRRYSRRFQTIDIEPDIEALLSQGPSCA

SEQ ID NO: 35289 - protein, 190 aa, Homo sapiens
  Payload ID: 6973
  Gene Symbol: GPX2
  Gene Name: glutathione peroxidase 2
  Uniprot ID: P18283
  ENSP ID: ENSP00000374265
  MOD_RES (40)..(40): Selenocysteine
MAFIAKSFYDLSAISLDGEKVDFNTFRGRAVLIENVASLXGTTTRDFTQLNELQCRFPRRLVVLGFPCNQFGHQENCQNEEILNSLKYVRPGGGYQPTFTLVQKCEVNGQNEHPVFAYLKDKLPYPYDDPFSLMTDPKLIIWSPVRRSDVAWNFEKFLIGPEGEPFRRYSRTFPTINIEPDIKRLLKVAI

SEQ ID NO: 35290 - protein, 78 aa, Homo sapiens
  Payload ID: 6973
  Gene Symbol: GPX2
  Gene Name: glutathione peroxidase 2
  ENSP ID: ENSP00000450991
  MOD_RES (40)..(40): Selenocysteine
MAFIAKSFYDLSAISLDGEKVDFNTFRGRAVLIENVASLXGTTTRDFTQLNELQCRFPRRLVVLGFPCNQFGHQNCSG

SEQ ID NO: 35291 - protein, 134 aa, Homo sapiens
  Payload ID: 6973
  Gene Symbol: GPX2
  Gene Name: glutathione peroxidase 2
  ENSP ID: ENSP00000451721
FIAKSFYDLSAISLDGEKENCQNEEILNSLKYVRPGGGYQPTFTLVQKCEVNGQNEHPVFAYLKDKLPYPYDDPFSLMTDPKLIIWSPVRRSDVAWNFEKFLIGPEGEPFRRYSRTFPTINIEPDIKRLLKVAI

SEQ ID NO: 35292 - protein, 78 aa, Homo sapiens
  Payload ID: 6973
  Gene Symbol: GPX2
  Gene Name: glutathione peroxidase 2
  ENSP ID: ENSP00000451844
  MOD_RES (40)..(40): Selenocysteine
MAFIAKSFYDLSAISLDGEKVDFNTFRGRAVLIENVASLXGTTTRDFTQLNELQCRFPRRLVVLGFPCNQFGHQERQK

SEQ ID NO: 35293 - protein, 189 aa, Homo sapiens
  Payload ID: 6973
  Gene Symbol: GPX2
  Gene Name: glutathione peroxidase 2
  ENSP ID: ENSP00000478082
MAFIAKSFYDLSAISLDGEKVDFNTFRGRAVLIENVASLGTTTRDFTQLNELQCRFPRRLVVLGFPCNQFGHQENCQNEEILNSLKYVRPGGGYQPTFTLVQKCEVNGQNEHPVFAYLKDKLPYPYDDPFSLMTDPKLIIWSPVRRSDVAWNFEKFLIGPEGEPFRRYSRTFPTINIEPDIKRLLKVAI

SEQ ID NO: 35294 - protein, 226 aa, Homo sapiens
  Payload ID: 6974
  Gene Symbol: GPX3
  Gene Name: glutathione peroxidase 3
  Uniprot ID: P22352
  ENSP ID: ENSP00000373477
  MOD_RES (73)..(73): Selenocysteine
MARLLQASCLLSLLLAGFVSQSRGQEKSKMDCHGGISGTIYEYGALTIDGEEYIPFKQYAGKYVLFVNVASYXGLTGQYIELNALQEELAPFGLVILGFPCNQFGKQEPGENSEILPTLKYVRPGGGFVPNFQLFEKGDVNGEKEQKFYTFLKNSCPPTSELLGTSDRLFWEPMKVHDIRWNFEKFLVGPDGIPIMRWHHRTTVSNVKMDILSYMRRQAALGVKRK

SEQ ID NO: 35295 - protein, 138 aa, Homo sapiens
  Payload ID: 6974
  Gene Symbol: GPX3
  Gene Name: glutathione peroxidase 3
  ENSP ID: ENSP00000427873
  MOD_RES (82)..(82): Selenocysteine
MARLLQASCLLSLLLAGFVSQSRGQEKSKAPRQMGNPQMDCHGGISGTIYEYGALTIDGEEYIPFKQYAGKYVLFVNVASYXGLTGQYIELNALQEELAPFGLVILGFPCNQFGKQEPGENSEILPTLKYVRPGGGFV

SEQ ID NO: 35296 - protein, 79 aa, Homo sapiens
  Payload ID: 6974
  Gene Symbol: GPX3
  Gene Name: glutathione peroxidase 3
  ENSP ID: ENSP00000429314
  MOD_RES (1)..(1): Any amino acid
XFGKQEPGENSEILPTLKYVRPGGGFVPNFQLFEKGDVNGEKEQKFYTFLKGQAIPQEGLGRKRVRGPQARLTLLLSLL

SEQ ID NO: 35297 - protein, 100 aa, Homo sapiens
  Payload ID: 6974
  Gene Symbol: GPX3
  Gene Name: glutathione peroxidase 3
  ENSP ID: ENSP00000429709
  MOD_RES (31)..(31): Selenocysteine
MARLLQASCLLSLLLAGFVSQSRGQEKSKNXMHYRKSLHHSVWSFWAFPATNLENRNQERTQRSFLPSSMSDQVEALSLISSSLRKGMSMERKSRNSTLS

SEQ ID NO: 35298 - protein, 63 aa, Homo sapiens
  Payload ID: 6974
  Gene Symbol: GPX3
  Gene Name: glutathione peroxidase 3
  ENSP ID: ENSP00000430508
  MOD_RES (44)..(44): Selenocysteine
MARLLQASCLLSLLLAGFVSQSRGQEKSKAPRQMGNPQVRETSXTPFAAPSAAGTPPPTVVVS

SEQ ID NO: 35299 - protein, 174 aa, Homo sapiens
  Payload ID: 6974
  Gene Symbol: GPX3
  Gene Name: glutathione peroxidase 3
  ENSP ID: ENSP00000430743
  MOD_RES (1)..(1): Any amino acid
  MOD_RES (43)..(43): Selenocysteine
  MOD_RES (111)..(111): Selenocysteine
  MOD_RES (152)..(152): Selenocysteine
  MOD_RES (165)..(165): Selenocysteine
XCHGGISGTIYEYGALTIDGEEYIPFKQYAGKYVLFVNVASYXGLTGQYIELNALQEELAPFGLVILGFPCNQFGKQEPGENSEILPTLKTPVLPPRSSWVHLTASSGNPXRFTTSAGTLRSSWWGQMVYPSCAGTTGPRSATSRWTSCPTXGGRQPWGSRGSNXRPSHPMSTM

SEQ ID NO: 35300 - protein, 72 aa, Homo sapiens
  Payload ID: 6974
  Gene Symbol: GPX3
  Gene Name: glutathione peroxidase 3
  ENSP ID: ENSP00000483660
MARLLQASCLLSLLLAGFVSQSRGQEKSKMDCHGGISGTIYEYGALTIDGEEYIPFKQYAGKYVLFVNVASY

SEQ ID NO: 35301 - protein, 225 aa, Homo sapiens
  Payload ID: 6974
  Gene Symbol: GPX3
  Gene Name: glutathione peroxidase 3
  ENSP ID: ENSP00000484258
MARLLQASCLLSLLLAGFVSQSRGQEKSKMDCHGGISGTIYEYGALTIDGEEYIPFKQYAGKYVLFVNVASYGLTGQYIELNALQEELAPFGLVILGFPCNQFGKQEPGENSEILPTLKYVRPGGGFVPNFQLFEKGDVNGEKEQKFYTFLKNSCPPTSELLGTSDRLFWEPMKVHDIRWNFEKFLVGPDGIPIMRWHHRTTVSNVKMDILSYMRRQAALGVKRK

SEQ ID NO: 35302 - protein, 197 aa, Homo sapiens
  Payload ID: 6975
  Gene Symbol: GPX4
  Gene Name: glutathione peroxidase 4
  Uniprot ID: P36969
  ENSP ID: ENSP00000346103
  MOD_RES (73)..(73): Selenocysteine
MSLGRLCRLLKPALLCGALAAPGLAGTMCASRDDWRCARSMHEFSAKDIDGHMVNLDKYRGFVCIVTNVASQXGKTEVNYTQLVDLHARYAECGLRILAFPCNQFGKQEPGSNEEIKEFAAGYNVKFDMFSKICVNGDDAHPLWKWMKIQPKGKGILGNAIKWNFTKFLIDKNGCVVKRYGPMEEPLVIEKDLPHYF

SEQ ID NO: 35303 - protein, 242 aa, Homo sapiens
  Payload ID: 6975
  Gene Symbol: GPX4
  Gene Name: glutathione peroxidase 4
  ENSP ID: ENSP00000464989
  MOD_RES (46)..(46): Selenocysteine
  MOD_RES (201)..(201): Selenocysteine
MCASRDDWRCARSMHEFSAKDIDGHMVNLDKYRGFVCIVTNVASQXGKTEVNYTQLVDLHARYAECGLRILAFPCNQFGKQEPGSNEEIKEFAAGYNVKFDMFSKICVNGDDAHPLWKWMKIQPKGKGILGNAIKWNFTKFGHRLSTVPHRQERLRGEALRTHGGAPGDREGPAPLFLAPQVCGPARAPAHALGAFHRHSXRPACKPAGGADPKIQRAPRRRKVPWPAGLGSAPPPLATLWE

SEQ ID NO: 35304 - protein, 175 aa, Homo sapiens
  Payload ID: 6975
  Gene Symbol: GPX4
  Gene Name: glutathione peroxidase 4
  ENSP ID: ENSP00000465828
  MOD_RES (46)..(46): Selenocysteine
MCASRDDWRCARSMHEFSAKDIDGHMVNLDKYRGFVCIVTNVASQXGKTEVNYTQLVDLHARYAECGLRILAFPCNQFGKQEPGSNEEIKEFAAGYNVKFDMFSKICVNGDDAHPLWKWMKIQPKGKGILGKTAWGLWGAAGDAHVHVLLFQCHQVELHQVPHRQERLRGEALRT

SEQ ID NO: 35305 - protein, 180 aa, Homo sapiens
  Payload ID: 6975
  Gene Symbol: GPX4
  Gene Name: glutathione peroxidase 4
  ENSP ID: ENSP00000466872
  MOD_RES (73)..(73): Selenocysteine
  MOD_RES (169)..(169): Selenocysteine
  MOD_RES (180)..(180): Selenocysteine
MSLGRLCRLLKPALLCGALAAPGLAGTMCASRDDWRCARSMHEFSAKDIDGHMVNLDKYRGFVCIVTNVASQXGKTEVNYTQLVDLHARYAECGLRILAFPCNQFGKQEPGSNEEIKEFAAGYNVKFDMFSKICVNGDDAHPLWKWMKIQPKGKGILGNSSSTRTAAWXSATDPWRSPWX

SEQ ID NO: 35306 - protein, 166 aa, Homo sapiens
  Payload ID: 6975
  Gene Symbol: GPX4
  Gene Name: glutathione peroxidase 4
  ENSP ID: ENSP00000467900
YAECGLRILAFPCNQFGKQEPGSNEEIKEFAAGYNVKFDMFSKICVNGDDAHPLWKWMKIQPKGKGILGNAIKWNFTKFLIDKNGCVVKRYGPMEEPLLHKCVAPPEPLPTPLEPSTGTHDGLPANLLVGQTRKSSVHPAGGRSHGLLGLARRPHPWLPCGNKQTN

SEQ ID NO: 35307 - protein, 155 aa, Homo sapiens
  Payload ID: 6975
  Gene Symbol: GPX4
  Gene Name: glutathione peroxidase 4
  ENSP ID: ENSP00000468349
  MOD_RES (33)..(33): Selenocysteine
MHEFSAKDIDGHMVNLDKYRGFVCIVTNVASQXGKTEVNYTQLVDLHARYAECGLRILAFPCNQFGKQEPGSNEEIKEFAAGYNVKFDMFSKICVNGDDAHPLWKWMKIQPKGKGILGNAIKWNFTKFLIDKNGCVVKRYGPMEEPLVIEKDLPH

SEQ ID NO: 35308 - protein, 179 aa, Homo sapiens
  Payload ID: 6975
  Gene Symbol: GPX4
  Gene Name: glutathione peroxidase 4
  ENSP ID: ENSP00000473614
  MOD_RES (110)..(110): Selenocysteine
MGRAGAGSPGRRRQRCQSRGRRRPRAPRRRKAPACRRRRARRRRKKPCPRSLRPEIHECPKSQDPCASRDDWRCARSMHEFSAKDIDGHMVNLDKYRGFVCIVTNVASQXGKTEVNYTQLVDLHARYAECGLRILAFPCNQFGKQEPGSNEEIKEFAAGYNVKFDMFSKICVNGDDAHP

SEQ ID NO: 35309 - protein, 233 aa, Homo sapiens
  Payload ID: 6975
  Gene Symbol: GPX4
  Gene Name: glutathione peroxidase 4
  ENSP ID: ENSP00000477503
MGRAGAGSPGRRRQRCQSRGRRRPRAPRRRKAPACRRRRARRRRKKPCPRSLRPEIHECPKSQDPCASRDDWRCARSMHEFSAKDIDGHMVNLDKYRGFVCIVTNVASQGKTEVNYTQLVDLHARYAECGLRILAFPCNQFGKQEPGSNEEIKEFAAGYNVKFDMFSKICVNGDDAHPLWKWMKIQPKGKGILGNAIKWNFTKFLIDKNGCVVKRYGPMEEPLVIEKDLPHYF

SEQ ID NO: 35310 - protein, 170 aa, Homo sapiens
  Payload ID: 6975
  Gene Symbol: GPX4
  Gene Name: glutathione peroxidase 4
  Uniprot ID: P36969
  ENSP ID: ENSP00000483655
  MOD_RES (46)..(46): Selenocysteine
MCASRDDWRCARSMHEFSAKDIDGHMVNLDKYRGFVCIVTNVASQXGKTEVNYTQLVDLHARYAECGLRILAFPCNQFGKQEPGSNEEIKEFAAGYNVKFDMFSKICVNGDDAHPLWKWMKIQPKGKGILGNAIKWNFTKFLIDKNGCVVKRYGPMEEPLVIEKDLPHYF

SEQ ID NO: 35311 - protein, 134 aa, Homo sapiens
  Payload ID: 6975
  Gene Symbol: GPX4
  Gene Name: glutathione peroxidase 4
  ENSP ID: ENSP00000484697
  MOD_RES (108)..(108): Selenocysteine
MGRAGAGSPGRRRQRCQSRGRRRPRAPRRRKAPACRRRRARRRRKKPCPRSLRPEIHECPKSQDPCASRDDWRCARSMHEFSAKDIDGHMVNLDKGFVCIVTNVASQXGKTEVNYTQLVDLHARYAECGLRILA

SEQ ID NO: 35312 - protein, 196 aa, Homo sapiens
  Payload ID: 6975
  Gene Symbol: GPX4
  Gene Name: glutathione peroxidase 4
  ENSP ID: ENSP00000485000
MSLGRLCRLLKPALLCGALAAPGLAGTMCASRDDWRCARSMHEFSAKDIDGHMVNLDKYRGFVCIVTNVASQGKTEVNYTQLVDLHARYAECGLRILAFPCNQFGKQEPGSNEEIKEFAAGYNVKFDMFSKICVNGDDAHPLWKWMKIQPKGKGILGNAIKWNFTKFLIDKNGCVVKRYGPMEEPLVIEKDLPHYF

SEQ ID NO: 35313 - protein, 221 aa, Homo sapiens
  Payload ID: 6976
  Gene Symbol: GPX5
  Gene Name: glutathione peroxidase 5
  Uniprot ID: O75715
  ENSP ID: ENSP00000392398
MTTQLRVVHLLPLLLACFVQTSPKQEKMKMDCHKDEKGTIYDYEAIALNKNEYVSFKQYVGKHILFVNVATYCGLTAQYPELNALQEELKPYGLVVLGFPCNQFGKQEPGDNKEILPGLKYVRPGGGFVPSFQLFEKGDVNGEKEQKVFSFLKHSCPHPSEILGTFKSISWDPVKVHDIRWNFEKFLVGPDGIPVMRWSHRATVSSVKTDILAYLKQFKTK

SEQ ID NO: 35314 - protein, 100 aa, Homo sapiens
  Payload ID: 6976
  Gene Symbol: GPX5
  Gene Name: glutathione peroxidase 5
  Uniprot ID: O75715
  ENSP ID: ENSP00000419935
MTTQLRVVHLLPLLLACFVQTSPKQEKMKMDCHKDEKGTIYDYEAIALNKNEYVSFKQYVGKHILFVNVATYCGLTAQYPGMSVQGEDLYLVSSFLRKGM

SEQ ID NO: 35315 - protein, 100 aa, Homo sapiens; identical to SEQ ID NO: 35314
  Payload ID: 6976
  Gene Symbol: GPX5
  Gene Name: glutathione peroxidase 5
  ENSP ID: ENSP00000449271

SEQ ID NO: 35316 - protein, 221 aa, Homo sapiens; identical to SEQ ID NO: 35313
  Payload ID: 6976
  Gene Symbol: GPX5
  Gene Name: glutathione peroxidase 5
  ENSP ID: ENSP00000450365

SEQ ID NO: 35317 - protein, 221 aa, Homo sapiens
  Payload ID: 6977
  Gene Symbol: GPX6
  Gene Name: glutathione peroxidase 6
  Uniprot ID: P59796
  ENSP ID: ENSP00000354581
  MOD_RES (73)..(73): Selenocysteine
MFQQFQASCLVLFFLVGFAQQTLKPQNRKVDCNKGVTGTIYEYGALTLNGEEYIQFKQFAGKHVLFVNVAAYXGLAAQYPELNALQEELKNFGVIVLAFPCNQFGKQEPGTNSEILLGLKYVCPGSGFVPSFQLFEKGDVNGEKEQKVFTFLKNSCPPTSDLLGSSSQLFWEPMKVHDIRWNFEKFLVGPDGVPVMHWFHQAPVSTVKSDILEYLKQFNTH

SEQ ID NO: 35318 - protein, 181 aa, Homo sapiens
  Payload ID: 6977
  Gene Symbol: GPX6
  Gene Name: glutathione peroxidase 6
  ENSP ID: ENSP00000417364
  MOD_RES (73)..(73): Selenocysteine
  MOD_RES (141)..(141): Selenocysteine
MFQQFQASCLVLFFLVGFAQQTLKPQNRKVDCNKGVTGTIYEYGALTLNGEEYIQFKQFAGKHVLFVNVAAYXGLAAQYPELNALQEELKNFGVIVLAFPCNQFGKQEPGTNSEILLGLKTPALRPLIFWAHQANSSGSPXRSMISAGTLRNFWWGPMESLSCIGSTRLQSAQSSQTSWST

SEQ ID NO: 35319 - protein, 220 aa, Homo sapiens
  Payload ID: 6977
  Gene Symbol: GPX6
  Gene Name: glutathione peroxidase 6
  ENSP ID: ENSP00000483462
MFQQFQASCLVLFFLVGFAQQTLKPQNRKVDCNKGVTGTIYEYGALTLNGEEYIQFKQFAGKHVLFVNVAAYGLAAQYPELNALQEELKNFGVIVLAFPCNQFGKQEPGTNSEILLGLKYVCPGSGFVPSFQLFEKGDVNGEKEQKVFTFLKNSCPPTSDLLGSSSQLFWEPMKVHDIRWNFEKFLVGPDGVPVMHWFHQAPVSTVKSDILEYLKQFNTH

SEQ ID NO: 35320 - protein, 72 aa, Homo sapiens
  Payload ID: 6977
  Gene Symbol: GPX6
  Gene Name: glutathione peroxidase 6
  ENSP ID: ENSP00000486277
MFQQFQASCLVLFFLVGFAQQTLKPQNRKVDCNKGVTGTIYEYGALTLNGEEYIQFKQFAGKHVLFVNVAAY

SEQ ID NO: 35321 - protein, 187 aa, Homo sapiens
  Payload ID: 6978
  Gene Symbol: GPX7
  Gene Name: glutathione peroxidase 7
  Uniprot ID: Q96SL4
  ENSP ID: ENSP00000354677
MVAATVAAAWLLLWAAACAQQEQDFYDFKAVNIRGKLVSLEKYRGSVSLVVNVASECGFTDQHYRALQQLQRDLGPHHFNVLAFPCNQFGQQEPDSNKEIESFARRTYSVSFPMFSKIAVTGTGAHPAFKYLAQTSGKEPTWNFWKYLVAPDGKVVGAWDPTVSVEEVRPQITALVRKLILLKREDL

SEQ ID NO: 35322 - protein, 90 aa, Homo sapiens
  Payload ID: 6979
  Gene Symbol: GPX8
  Gene Name: glutathione peroxidase 8 (putative)
  ENSP ID: ENSP00000296734
MEPLAAYPLKCSGPRAKVFAVLLSIVLCTVTLFLLQLKFLKPKINSFYAFEVKDAKGRTVSLEKYKGKILQRRNQGGIFGSILSTLRVKL

SEQ ID NO: 35323 - protein, 209 aa, Homo sapiens
  Payload ID: 6979
  Gene Symbol: GPX8
  Gene Name: glutathione peroxidase 8 (putative)
  Uniprot ID: Q8TED1
  ENSP ID: ENSP00000423822
MEPLAAYPLKCSGPRAKVFAVLLSIVLCTVTLFLLQLKFLKPKINSFYAFEVKDAKGRTVSLEKYKGKVSLVVNVASDCQLTDRNYLGLKELHKEFGPSHFSVLAFPCNQFGESEPRPSKEVESFARKNYGVTFPIFHKIKILGSEGEPAFRFLVDSSKKEPRWNFWKYLVNPEGQVVKFWKPEEPIEVIRPDIAALVRQVIIKKKEDL

SEQ ID NO: 35324 - protein, 158 aa, Homo sapiens
  Payload ID: 6979
  Gene Symbol: GPX8
  Gene Name: glutathione peroxidase 8 (putative)
  ENSP ID: ENSP00000427466
MEPLAAYPLKCSGPRAKVSLVVNVASDCQLTDRNYLGLKELHKEFGPSHFSVLAFPCNQFGESEPRPSKEVESFARKNYGVTFPIFHKIKILGSEGEPAFRFLVDSSKKEPRWNFWKYLVNPEGQVVKFWKPEEPIEVIRPDIAALVRQVIIKKKEDL

SEQ ID NO: 35325 - protein, 522 aa, Homo sapiens
  Payload ID: 6980
  Gene Symbol: GSR
  Gene Name: glutathione reductase
  Uniprot ID: P00390
  ENSP ID: ENSP00000221130
MALLPRALSAGAGPSWRRAARAFRGFLLLLPEPAALTRALSRAMACRQEPQPQGPPPAAGAVASYDYLVIGGGSGGLASARRAAELGARAAVVESHKLGGTCVNVGCVPKKVMWNTAVHSEFMHDHADYGFPSCEGKFNWRVIKEKRDAYVSRLNAIYQNNLTKSHIEIIRGHAAFTSDPKPTIEVSGKKYTAPHILIATGGMPSTPHESQIPGASLGITSDGFFQLEELPGRSVIVGAGYIAVEMAGILSALGSKTSLMIRHDKVLRSFDSMISTNCTEELENAGVEVLKFSQVKEVKKTLSGLEVSMVTAVPGRLPVMTMIPDVDCLLWAIGRVPNTKDLSLNKLGIQTDDKGHIIVDEFQNTNVKGIYAVGDVCGKALLTPVAIAAGRKLAHRLFEYKEDSKLDYNNIPTVVFSHPPIGTVGLTEDEAIHKYGIENVKTYSTSFTPMYHAVTKRKTKCVMKMVCANKEEKVVGIHMQGLGCDEMLQGFAVAVKMGATKADFDNTVAIHPTSSEELVTLR

SEQ ID NO: 35326 - protein, 144 aa, Homo sapiens
  Payload ID: 6980
  Gene Symbol: GSR
  Gene Name: glutathione reductase
  ENSP ID: ENSP00000430825
MWNTAVHSEFMHDHADYGFPSCEGKFNWRVIKEKRDAYVSRLNAIYQNNLTKSHIEIIRGHAAFTSDPKPTIEVSGKKYTAPHILIATGGMPSTPHESQIPGASLGITSDGFFQLEELPGRSVIVGAGYIAVEMAGILSALGSK

SEQ ID NO: 35327 - protein, 131 aa, Homo sapiens
  Payload ID: 6980
  Gene Symbol: GSR
  Gene Name: glutathione reductase
  ENSP ID: ENSP00000431044
PAAGAVASYDYLVIGGGSGGLASARRAAELGARAAVVESHKLGGTCVNVGCVPKKVMWNTAVHSEFMHDHADYGFPSCEGKFNWRVIKEKRDAYVSRLNAIYQNNLTKPQRHCWCRLHCCGDGRDPVSPGF

SEQ ID NO: 35328 - protein, 440 aa, Homo sapiens
  Payload ID: 6980
  Gene Symbol: GSR
  Gene Name: glutathione reductase
  Uniprot ID: P00390
  ENSP ID: ENSP00000438845
MALLPRALSAGAGPSWRRAARAFRGFLLLLPEPAALTRALSRAMACRQEPQPQGPPPAAGAVASYDYLVIGGGSGGLASARRAAELGARAAVVESHKLGGTCVNVGCVPKKVMWNTAVHSEFMHDHADYGFPSCEGKFNWRVIKEKRDAYVSRLNAIYQNNLTKSHIEIIRGHAAFTSDPKPTIEVSGKKYTAPHILIATGGMPSTPHESQIPGASLGITSDGFFQLEELPGRSVIVGAGYIAVEMAGILSALGSKTSLMIRHDKGIQTDDKGHIIVDEFQNTNVKGIYAVGDVCGKALLTPVAIAAGRKLAHRLFEYKEDSKLDYNNIPTVVFSHPPIGTVGLTEDEAIHKYGIENVKTYSTSFTPMYHAVTKRKTKCVMKMVCANKEEKVVGIHMQGLGCDEMLQGFAVAVKMGATKADFDNTVAIHPTSSEELVTLR

SEQ ID NO: 35329 - protein, 469 aa, Homo sapiens
  Payload ID: 6980
  Gene Symbol: GSR
  Gene Name: glutathione reductase
  Uniprot ID: P00390
  ENSP ID: ENSP00000444559
MALLPRALSAGAGPSWRRAARAFRGFLLLLPEPAALTRALSRAMACRQEPQPQGPPPAAGAVASYDYLVIGGGSGGLASARRAAELGARAAVVESHKLGGTCVNVGCVPKKVMWNTAVHSEFMHDHADYGFPSCEGKFNWRVIKEKRDAYVSRLNAIYQNNLTKSHIEIIRGHAAFTSDPKPTIEVSGKKYTAPHILIATGGMPSTPHESQIPGASLGITSDGFFQLEELPGRSVIVGAGYIAVEMAGILSALGSKTSLMIRHDKVLRSFDSMISTNCTEELENAGVEVLKFSQGIQTDDKGHIIVDEFQNTNVKGIYAVGDVCGKALLTPVAIAAGRKLAHRLFEYKEDSKLDYNNIPTVVFSHPPIGTVGLTEDEAIHKYGIENVKTYSTSFTPMYHAVTKRKTKCVMKMVCANKEEKVVGIHMQGLGCDEMLQGFAVAVKMGATKADFDNTVAIHPTSSEELVTLR

SEQ ID NO: 35330 - protein, 493 aa, Homo sapiens
  Payload ID: 6980
  Gene Symbol: GSR
  Gene Name: glutathione reductase
  Uniprot ID: P00390
  ENSP ID: ENSP00000445516
MALLPRALSAGAGPSWRRAARAFRGFLLLLPEPAALTRALSRAMACRQEPQPQGPPPAAGAVASYDYLVIGGGSGGLASARRAAELGARAAVVESHKLGGTCVNVGCVPKKVMWNTAVHSEFMHDHADYGFPSCEGKFNWRVIKEKRDAYVSRLNAIYQNNLTKSHIEIIRGHAAFTSDPKPTIEVSGKKYTAPHILIATGGMPSTPHESQIPGASLGITSDGFFQLEELPGRSVIVGAGYIAVEMAGILSALGSKTSLMIRHDKVKEVKKTLSGLEVSMVTAVPGRLPVMTMIPDVDCLLWAIGRVPNTKDLSLNKLGIQTDDKGHIIVDEFQNTNVKGIYAVGDVCGKALLTPVAIAAGRKLAHRLFEYKEDSKLDYNNIPTVVFSHPPIGTVGLTEDEAIHKYGIENVKTYSTSFTPMYHAVTKRKTKCVMKMVCANKEEKVVGIHMQGLGCDEMLQGFAVAVKMGATKADFDNTVAIHPTSSEELVTLR

SEQ ID NO: 35331 - protein, 222 aa, Homo sapiens
  Payload ID: 6981
  Gene Symbol: GSTA1
  Gene Name: glutathione S-transferase alpha 1
  Uniprot ID: P08263
  ENSP ID: ENSP00000335620
MAEKPKLHYFNARGRMESTRWLLAAAGVEFEEKFIKSAEDLDKLRNDGYLMFQQVPMVEIDGMKLVQTRAILNYIASKYNLYGKDIKERALIDMYIEGIADLGEMILLLPVCPPEEKDAKLALIKEKIKNRYFPAFEKVLKSHGQDYLVGNKLSRADIHLVELLYYVEELDSSLISSFPLLKALKTRISNLPTVKKFLQPGSPRKPPMDEKSLEEARKIFRF

SEQ ID NO: 35332 - protein, 222 aa, Homo sapiens
  Payload ID: 6982
  Gene Symbol: GSTA2
  Gene Name: glutathione S-transferase alpha 2
  Uniprot ID: P09210
  ENSP ID: ENSP00000420168
MAEKPKLHYSNIRGRMESIRWLLAAAGVEFEEKFIKSAEDLDKLRNDGYLMFQQVPMVEIDGMKLVQTRAILNYIASKYNLYGKDIKEKALIDMYIEGIADLGEMILLLPFSQPEEQDAKLALIQEKTKNRYFPAFEKVLKSHGQDYLVGNKLSRADIHLVELLYYVEELDSSLISSFPLLKALKTRISNLPTVKKFLQPGSPRKPPMDEKSLEESRKIFRF

SEQ ID NO: 35333 - protein, 222 aa, Homo sapiens
  Payload ID: 6983
  Gene Symbol: GSTA3
  Gene Name: glutathione S-transferase alpha 3
  Uniprot ID: Q16772
  ENSP ID: ENSP00000211122
MAGKPKLHYFNGRGRMEPIRWLLAAAGVEFEEKFIGSAEDLGKLRNDGSLMFQQVPMVEIDGMKLVQTRAILNYIASKYNLYGKDIKERALIDMYTEGMADLNEMILLLPLCRPEEKDAKIALIKEKTKSRYFPAFEKVLQSHGQDYLVGNKLSRADISLVELLYYVEELDSSLISNFPLLKALKTRISNLPTVKKFLQPGSPRKPPADAKALEEARKIFRF

SEQ ID NO: 35334 - protein, 172 aa, Homo sapiens
  Payload ID: 6983
  Gene Symbol: GSTA3
  Gene Name: glutathione S-transferase alpha 3
  ENSP ID: ENSP00000360007
MFQQVPMVEIDGMKLVQTRAILNYIASKYNLYGKDIKERALIDMYTEGMADLNEMILLLPLCRPEEKDAKIALIKEKTKSRYFPAFEKVLQSHGQDYLVGNKLSRADISLVELLYYVEELDSSLISNFPLLKALKTRISNLPTVKKFLQPGSPRKPPADAKALEEARKIFRF

SEQ ID NO: 35335 - protein, 108 aa, Homo sapiens
  Payload ID: 6983
  Gene Symbol: GSTA3
  Gene Name: glutathione S-transferase alpha 3
  ENSP ID: ENSP00000399142
MFQQVPMVEIDGMKLVQTRAILNYIASKYNLYGKDIKERALIDMYTEGMADLNEMILLLPLCRPEEKDAKIALIKEKTKSRYFPAFRADISLVELLYYVEELDSSLIS

SEQ ID NO: 35336 - protein, 222 aa, Homo sapiens
  Payload ID: 6983
  Gene Symbol: GSTA3
  Gene Name: glutathione S-transferase alpha 3
  ENSP ID: ENSP00000481135
MAGKPKLHYFNGRGRMEPIRWLLAAAGVEFEEKFIGSAEDLGKLRNDGSLMFQQVPMVEIDGMKLVQTRAILNYIASKYNLYGKDIKERALIDMYTEGMADLNEMILLLPLCRPEEKDAKIALIKEKTKSRYFPAFEKVLQSHGQDYLVGNKLSRADISLVELLYYVEELDSSLISNFPLLKALKTRISNLPMVKKFLQPGSPRKSLMDEKSLEEARKIFRF

SEQ ID NO: 35337 - protein, 222 aa, Homo sapiens
  Payload ID: 6984
  Gene Symbol: GSTA4
  Gene Name: glutathione S-transferase alpha 4
  Uniprot ID: O15217
  ENSP ID: ENSP00000359998
MAARPKLHYPNGRGRMESVRWVLAAAGVEFDEEFLETKEQLYKLQDGNHLLFQQVPMVEIDGMKLVQTRSILHYIADKHNLFGKNLKERTLIDMYVEGTLDLLELLIMHPFLKPDDQQKEVVNMAQKAIIRYFPVFEKILRGHGQSFLVGNQLSLADVILLQTILALEEKIPNILSAFPFLQEYTVKLSNIPTIKRFLEPGSKKKPPPDEIYVRTVYNIFRP

SEQ ID NO: 35338 - protein, 129 aa, Homo sapiens
  Payload ID: 6984
  Gene Symbol: GSTA4
  Gene Name: glutathione S-transferase alpha 4
  Uniprot ID: O15217
  ENSP ID: ENSP00000359999
MYVEGTLDLLELLIMHPFLKPDDQQKEVVNMAQKAIIRYFPVFEKILRGHGQSFLVGNQLSLADVILLQTILALEEKIPNILSAFPFLQEYTVKLSNIPTIKRFLEPGSKKKPPPDEIYVRTVYNIFRP

SEQ ID NO: 35339 - protein, 222 aa, Homo sapiens; identical to SEQ ID NO: 35337
  Payload ID: 6984
  Gene Symbol: GSTA4
  Gene Name: glutathione S-transferase alpha 4
  Uniprot ID: O15217
  ENSP ID: ENSP00000360002

SEQ ID NO: 35340 - protein, 89 aa, Homo sapiens
  Payload ID: 6984
  Gene Symbol: GSTA4
  Gene Name: glutathione S-transferase alpha 4
  ENSP ID: ENSP00000394228
MYVEGTLDLLELLIMHPFLKPDDQQKEVVNMAQKAIIRYFPVFEKILRGHGQSFLVGNQLSLADVILLQTILALEEKIPNILSAFPFLQ

SEQ ID NO: 35341 - protein, 222 aa, Homo sapiens
  Payload ID: 6985
  Gene Symbol: GSTA5
  Gene Name: glutathione S-transferase alpha 5
  Uniprot ID: Q7RTV2
  ENSP ID: ENSP00000284562
MAEKPKLHYSNARGSMESIRWLLAAAGVELEEKFLESAEDLDKLRNDGSLLFQQVPMVEIDGMKLVQTRAILNYIASKYNLYGKDMKERALIDMYTEGIVDLTEMILLLLICQPEERDAKTALVKEKIKNRYFPAFEKVLKSHRQDYLVGNKLSWADIHLVELFYYVEELDSSLISSFPLLKALKTRISNLPTVKKFLQPGSQRKPPMDEKSLEEARKIFRF

SEQ ID NO: 35342 - protein, 222 aa, Homo sapiens; identical to SEQ ID NO: 35341
  Payload ID: 6985
  Gene Symbol: GSTA5
  Gene Name: glutathione S-transferase alpha 5
  Uniprot ID: Q7RTV2
  ENSP ID: ENSP00000360028

SEQ ID NO: 35343 - protein, 222 aa, Homo sapiens
  Payload ID: 6985
  Gene Symbol: GSTA5
  Gene Name: glutathione S-transferase alpha 5
  ENSP ID: ENSP00000482006
MAEKPKLHYSNAQGRMESTWWLLAAAGVELEEKFLESAEDLDKLRNDGSLLFQQVPMVEIDGMKLVQTRAILNYIASKYNLYGKDMKERALIDMYTEGIVDLTEMILLLLICQPEERDAKTALVKEKIKNRYFPAFEKVLKSHRQDYLVGNKLSWADIHLVELFYYVEELDSSLISSFPLLKALKTRISNLPTVKKFLQPGSQRKPPMDEKSLEEARKIFRF

SEQ ID NO: 35344 - protein, 226 aa, Homo sapiens
  Payload ID: 6986
  Gene Symbol: GSTK1
  Gene Name: glutathione S-transferase kappa 1
  Uniprot ID: Q9Y2Q3
  ENSP ID: ENSP00000351181
MGPLPRTVELFYDVLSPYSWLGFEILCRYQNIWNINLQLRPSLITGIMKDSGNKPPGLLPRKGLYMANDLKLLRHHLQIPIHFPKDFLSVMLEKGSLSAMRFLTAVNLEHPEMLEKASRELWMRVWSRNEDITEPQSILAAAEKAGMSAEQAQGLLEKIATPKVKNQLKETTEAACRYGAFGLPITVAHVDGQTHMLFGSDRMELLAHLLGEKWMGPIPPAVNARL

SEQ ID NO: 35345 - protein, 214 aa, Homo sapiens
  Payload ID: 6986
  Gene Symbol: GSTK1
  Gene Name: glutathione S-transferase kappa 1
  Uniprot ID: Q9Y2Q3
  ENSP ID: ENSP00000386944
MGPLPRTVELFYDVLSPYSWLGFEILCRYQNIWNINLQLRPSLITGIMKDSGNKPPGLLPRKGLYMANDLKLLRHHLQIPIHFPKDFLSVMLEKGSLSAMRFLTAVNLEHPEMLEKASRELWMRVWSRAAEKAGMSAEQAQGLLEKIATPKVKNQLKETTEAACRYGAFGLPITVAHVDGQTHMLFGSDRMELLAHLLGEKWMGPIPPAVNARL

SEQ ID NO: 35346 - protein, 190 aa, Homo sapiens
  Payload ID: 6986
  Gene Symbol: GSTK1
  Gene Name: glutathione S-transferase kappa 1
  ENSP ID: ENSP00000406802
MGPLPRTVELFYDVLSPYSWLGFEILCRYQNIWNINLQLRPSLITGIMKDSGNKPPGLLPRKGLYMANDLKLLRHHLQIPIHFPKDFLSVMLEKGSLSAMRFLTAVNLEHPEMLEKASRELWMRVWSRNEDITEPQSILAAAEKAGMSAEQAQGLLEKIATPKVKNQLKETTEAACRYGERSGWALYLQP

SEQ ID NO: 35347 - protein, 118 aa, Homo sapiens
  Payload ID: 6986
  Gene Symbol: GSTK1
  Gene Name: glutathione S-transferase kappa 1
  ENSP ID: ENSP00000408341
MTKGSLEVKGTMELILCRYQNIWNINLQLRPSLITGIMKDSGNKPPGLLPRKGLYMANDLKLLRHHLQIPIHFPKDFLSVMLEKGSLSAMRFLTAVNLEHPEMLEKASRELWMRVWSR

SEQ ID NO: 35348 - protein, 183 aa, Homo sapiens
  Payload ID: 6986
  Gene Symbol: GSTK1
  Gene Name: glutathione S-transferase kappa 1
  Uniprot ID: Q9Y2Q3
  ENSP ID: ENSP00000415813
MGPLPRTVELFYDVLSPYSWLGFEILCRYQNIWNINLQLRPSLITGIMKDSGSLSAMRFLTAVNLEHPEMLEKASRELWMRVWSRNEDITEPQSILAAAEKAGMSAEQAQGLLEKIATPKVKNQLKETTEAACRYGAFGLPITVAHVDGQTHMLFGSDRMELLAHLLGEKWMGPIPPAVNARL

SEQ ID NO: 35349 - protein, 282 aa, Homo sapiens
  Payload ID: 6986
  Gene Symbol: GSTK1
  Gene Name: glutathione S-transferase kappa 1
  Uniprot ID: Q9Y2Q3
  ENSP ID: ENSP00000431049
MGPLPRTVELFYDVLSPYSWLGFEILCRYQNIWNINLQLRPSLITGIMKDSGNKPPGLLPRKGLYMANDLKLLRHHLQIPIHFPKDFLSVMLEKGSLSAMRFLTAVNLEHPEMLEKASRELWMRVWSRVSVGLWESSGRTLDDFLTFPRHVFRVMILPPPGGSTVLPVTPLSPHRLPAVFSSSQNEDITEPQSILAAAEKAGMSAEQAQGLLEKIATPKVKNQLKETTEAACRYGAFGLPITVAHVDGQTHMLFGSDRMELLAHLLGEKWMGPIPPAVNARL

SEQ ID NO: 35350 - protein, 181 aa, Homo sapiens
  Payload ID: 6987
  Gene Symbol: GSTM1
  Gene Name: glutathione S-transferase mu 1
  Uniprot ID: P09488
  ENSP ID: ENSP00000234981
MPMILGYWDIRGLAHAIRLLLEYTDSSYEEKKYTMGDAPDYDRSQWLNEKFKLGLDFPNLPYLIDGAHKITQSNAILCYIARKHNLCGETEEEKIRVDILENQTMDNHMQLGMICYNPEFEKLKPKYLEELPEKLKLYSEFLGKRPWFAGNKGLEKISAYMKSSRFLPRPVFSKMAVWGNK

SEQ ID NO: 35351 - protein, 218 aa, Homo sapiens
  Payload ID: 6987
  Gene Symbol: GSTM1
  Gene Name: glutathione S-transferase mu 1
  Uniprot ID: P09488
  ENSP ID: ENSP00000311469
MPMILGYWDIRGLAHAIRLLLEYTDSSYEEKKYTMGDAPDYDRSQWLNEKFKLGLDFPNLPYLIDGAHKITQSNAILCYIARKHNLCGETEEEKIRVDILENQTMDNHMQLGMICYNPEFEKLKPKYLEELPEKLKLYSEFLGKRPWFAGNKITFVDFLVYDVLDLHRIFEPKCLDAFPNLKDFISRFEGLEKISAYMKSSRFLPRPVFSKMAVWGNK

SEQ ID NO: 35352 - protein, 149 aa, Homo sapiens
  Payload ID: 6987
  Gene Symbol: GSTM1
  Gene Name: glutathione S-transferase mu 1
  ENSP ID: ENSP00000358834
MPMILGYWDIRGLAHAIRLLLEYTDSSYEEKKYTMGDAPDYDRSQWLNEKFKLGLDFPNLPYLIDGAHKITQSNAILCYIARKHNLCGETEEEKIRVDILENQTMDNHMQLGMICYNPEFGLEKISAYMKSSRFLPRPVFSKMAVWGNK

SEQ ID NO: 35353 - protein, 237 aa, Homo sapiens
  Payload ID: 6987
  Gene Symbol: GSTM1
  Gene Name: glutathione S-transferase mu 1
  ENSP ID: ENSP00000358838
MPMILGYWDIRGLAHAIRLLLEYTDSSYEEKKYTMGDAPDYDRSQWLNEKFKLGLDFPNGMLGSLVAQLSFAGFPSIQLPYLIDGAHKITQSNAILCYIARKHNLCGETEEEKIRVDILENQTMDNHMQLGMICYNPEFEKLKPKYLEELPEKLKLYSEFLGKRPWFAGNKITFVDFLVYDVLDLHRIFEPKCLDAFPNLKDFISRFEGLEKISAYMKSSRFLPRPVFSKMAVWGNK

SEQ ID NO: 35354 - protein, 85 aa, Homo sapiens
  Payload ID: 6987
  Gene Symbol: GSTM1
  Gene Name: glutathione S-transferase mu 1
  ENSP ID: ENSP00000455929
MPMILGYWDIRGLAHAIRLLLEYTDSSYEEKKYTMGDAPDYDRSQWLNEKFKLGLDFPNVGRQKRRRFVWTFWRTRPWTTICSWA

SEQ ID NO: 35355 - protein, 102 aa, Homo sapiens
  Payload ID: 6987
  Gene Symbol: GSTM1
  Gene Name: glutathione S-transferase mu 1
  ENSP ID: ENSP00000456315
MGDAPDYDRSQWLNEKFKLGLDFPNLPYLIDGAHKITQSNAILCYIARKHNLCGETEEEKIRVDILENQTMDNHMQLGMICYNPEFEKLKPKYLEELPEKLK

SEQ ID NO: 35356 - protein, 218 aa, Homo sapiens
  Payload ID: 6988
  Gene Symbol: GSTM2
  Gene Name: glutathione S-transferase mu 2 (muscle)
  Uniprot ID: P28161
  ENSP ID: ENSP00000241337
MPMTLGYWNIRGLAHSIRLLLEYTDSSYEEKKYTMGDAPDYDRSQWLNEKFKLGLDFPNLPYLIDGTHKITQSNAILRYIARKHNLCGESEKEQIREDILENQFMDSRMQLAKLCYDPDFEKLKPEYLQALPEMLKLYSQFLGKQPWFLGDKITFVDFIAYDVLERNQVFEPSCLDAFPNLKDFISRFEGLEKISAYMKSSRFLPRPVFTKMAVWGNK

SEQ ID NO: 35357 - protein, 181 aa, Homo sapiens
  Payload ID: 6988
  Gene Symbol: GSTM2
  Gene Name: glutathione S-transferase mu 2 (muscle)
  ENSP ID: ENSP00000358842
MPMTLGYWNIRGLAHSIRLLLEYTDSSYEEKKYTMGDAPDYDRSQWLNEKFKLGLDFPNLPYLIDGTHKITQSNAILRYIARKHNLCGESEKEQIREDILENQFMDSRMQLAKLCYDPDFEKLKPEYLQALPEMLKLYSQFLGKQPWFLGDKGLEKISAYMKSSRFLPRPVFTKMAVWGNK

SEQ ID NO: 35358 - protein, 193 aa, Homo sapiens
  Payload ID: 6988
  Gene Symbol: GSTM2
  Gene Name: glutathione S-transferase mu 2 (muscle)
  ENSP ID: ENSP00000358844
MPMTLGYWNIRGLAHSIRLLLEYTDSSYEEKKYTMGDAPDYDRSQWLNEKFKLGLDFPNLPYLIDGTHKITQSNAILRYIARKHNLCGESEKEQIREDILENQFMDSRMQLAKLCYDPDFEKLKPEYLQALPEMLKLYSQFLGKQPWFLGDKITFVDFIAYDVLERNQVFEPSCLDAFPNLKDFISRFEVFPL

SEQ ID NO: 35359 - protein, 220 aa, Homo sapiens
  Payload ID: 6988
  Gene Symbol: GSTM2
  Gene Name: glutathione S-transferase mu 2 (muscle)
  ENSP ID: ENSP00000358846
MPMTLGYWNIRGLAHSIRLLLEYTDSSYEEKKYTMGDAPDYDRSQWLNEKFKLGLDFPNLPYLIDGTHKITQSNAILRYIARKHNLCGESEKEQIREDILENQFMDSRMQLAKLCYDPDFEKLKPEYLQALPEMLKLYSQFLGKQPWFLGDKITFVDFIAYDVLERNQVFEPSCLDAFPNLKDFISRFEEKCNVGWSSRRNLDTVCRTSQRILCQNRENE

SEQ ID NO: 35360 - protein, 87 aa, Homo sapiens
  Payload ID: 6988
  Gene Symbol: GSTM2
  Gene Name: glutathione S-transferase mu 2 (muscle)
  ENSP ID: ENSP00000404662
MDSRMQLAKLCYDPDFEKLKPEYLQALPEMLKLYSQFLGKQPWFLGDKITFVDFIAYDVLERNQVFEPSCLDAFPNLKDFISRFEHS

SEQ ID NO: 35361 - protein, 191 aa, Homo sapiens
  Payload ID: 6988
  Gene Symbol: GSTM2
  Gene Name: glutathione S-transferase mu 2 (muscle)
  Uniprot ID: P28161
  ENSP ID: ENSP00000416883
MPMTLGYWNIRGLAHSIRLLLEYTDSSYEEKKYTMGDAPDYDRSQWLNEKFKLGLDFPNLPYLIDGTHKITQSNAILRYIARKHNLCGESEKEQIREDILENQFMDSRMQLAKLCYDPDFEKLKPEYLQALPEMLKLYSQFLGKQPWFLGDKITFVDFIAYDVLERNQVFEPSCLDAFPNLKDFISRFEHS

SEQ ID NO: 35362 - protein, 147 aa, Homo sapiens
  Payload ID: 6988
  Gene Symbol: GSTM2
  Gene Name: glutathione S-transferase mu 2 (muscle)
  ENSP ID: ENSP00000435157
MPMTLGYWNIRGLAHSIRLLLEYTDSSYEEKKYTMGDAPDYDRSQWLNEKFKLGLDFPNLPYLIDGTHKITQSNAILRYIARKHNLCGESEKEQIREDILENQFMDSRMQLAKLCYDPDFALPEMLKLYSQFLGKQPWFLGDKITFV

SEQ ID NO: 35363 - protein, 191 aa, Homo sapiens; identical to SEQ ID NO: 35361
  Payload ID: 6988
  Gene Symbol: GSTM2
  Gene Name: glutathione S-transferase mu 2 (muscle)
  Uniprot ID: P28161
  ENSP ID: ENSP00000435910

SEQ ID NO: 35364 - protein, 225 aa, Homo sapiens
  Payload ID: 6989
  Gene Symbol: GSTM3
  Gene Name: glutathione S-transferase mu 3 (brain)
  Uniprot ID: P21266
  ENSP ID: ENSP00000256594
MSCESSMVLGYWDIRGLAHAIRLLLEFTDTSYEEKRYTCGEAPDYDRSQWLDVKFKLDLDFPNLPYLLDGKNKITQSNAILRYIARKHNMCGETEEEKIRVDIIENQVMDFRTQLIRLCYSSDHEKLKPQYLEELPGQLKQFSMFLGKFSWFAGEKLTFVDFLTYDILDQNRIFDPKCLDEFPNLKAFMCRFEALEKIAAYLQSDQFCKMPINNKMAQWGNKPVC

SEQ ID NO: 35365 - protein, 225 aa, Homo sapiens; identical to SEQ ID NO: 35364
  Payload ID: 6989
  Gene Symbol: GSTM3
  Gene Name: glutathione S-transferase mu 3 (brain)
  Uniprot ID: P21266
  ENSP ID: ENSP00000354357

SEQ ID NO: 35366 - protein, 212 aa, Homo sapiens [sequence omitted]

SEQ ID NO: 35367 - protein, 195 aa, Homo sapiens
  Payload ID: 6990
  Gene Symbol: GSTM4
  Gene Name: glutathione S-transferase mu 4
  Uniprot ID: Q03013
  ENSP ID: ENSP00000316471
MSMTLGYWDIRGLAHAIRLLLEYTDSSYEEKKYTMGDAPDYDRSQWLNEKFKLGLDFPNLPYLIDGAHKITQSNAILCYIARKHNLCGETEEEKIRVDILENQAMDVSNQLARVCYSPDFEKLKPEYLEELPTMMQHFSQFLGKRPWFVGDKITFVDFLAYDVLDLHRIFEPNCLDAFPNLKDFISRFEVSCGIM

SEQ ID NO: 35368 - protein, 218 aa, Homo sapiens
  Payload ID: 6990
  Gene Symbol: GSTM4
  Gene Name: glutathione S-transferase mu 4
  ENSP ID: ENSP00000336744
MSMTLGYWDIRGLAHAIRLLLEYTDSSYEEKKYTMGDAPDYDRSQWLNEKFKLGLDFPNLPYLIDGAHKITQSNAILCYIARKHNLCGETEEEKIRVDILENQAMDVSNQLARVCYSPDFEKLKPEYLEELPTMMQHFSQFLGKRPWFVGDKITFVDFLAYDVLDLHRIFEPNCLDAFPNLKDFISRFEGLEKISAYMKSSRFLPRPVFTKMAVWGNK

SEQ ID NO: 35369 - protein, 202 aa, Homo sapiens
  Payload ID: 6990
  Gene Symbol: GSTM4
  Gene Name: glutathione S-transferase mu 4
  ENSP ID: ENSP00000358848
MLGSLLAQLSFPGFPSIQLPYLIDGAHKITQSNAILCYIARKHNLCGETEEEKIRVDILENQAMDVSNQLARVCYSPDFEKLKPEYLEELPTMMQHFSQFLGKRPWFVGDKITFVDFLAYDVLDLHRIFEPNCLDAFPNLKDFISRFEVMPPSSFLFDAPCSVTSFQMLSQSWSYIKNNLHLLSAGFMPGTLPSTLYLSCGI

SEQ ID NO: 35370 - protein, 218 aa, Homo sapiens
  Payload ID: 6990
  Gene Symbol: GSTM4
  Gene Name: glutathione S-transferase mu 4
  Uniprot ID: Q03013
  ENSP ID: ENSP00000358851
MSMTLGYWDIRGLAHAIRLLLEYTDSSYEEKKYTMGDAPDYDRSQWLNEKFKLGLDFPNLPYLIDGAHKITQSNAILCYIARKHNLCGETEEEKIRVDILENQAMDVSNQLARVCYSPDFEKLKPEYLEELPTMMQHFSQFLGKRPWFVGDKITFVDFLAYDVLDLHRIFEPNCLDAFPNLKDFISRFEGLEKISAYMKSSRFLPKPLYTRVAVWGNK

SEQ ID NO: 35371 - protein, 218 aa, Homo sapiens
  Payload ID: 6991
  Gene Symbol: GSTM5
  Gene Name: glutathione S-transferase mu 5
  Uniprot ID: P46439
  ENSP ID: ENSP00000256593
MPMTLGYWDIRGLAHAIRLLLEYTDSSYVEKKYTLGDAPDYDRSQWLNEKFKLGLDFPNLPYLIDGAHKITQSNAILRYIARKHNLCGETEEEKIRVDILENQVMDNHMELVRLCYDPDFEKLKPKYLEELPEKLKLYSEFLGKRPWFAGDKITFVDFLAYDVLDMKRIFEPKCLDAFLNLKDFISRFEGLKKISAYMKSSQFLRGLLFGKSATWNSK

SEQ ID NO: 35372 - protein, 218 aa, Homo sapiens
  Payload ID: 6991
  Gene Symbol: GSTM5
  Gene Name: glutathione S-transferase mu 5
  ENSP ID: ENSP00000358827
MPMTLGYWDIRGLAHAIRLLLEYTDSSYVEKKYTLGDAPDYDRSQWLNEKFKLGLDFPNLPYLIDGAHKITQSNAILRYIARKHNLCGETEEEKIRVDILENQTTDNWMQLVMICYHPEFEKLKPKYLEELPEKLKLYSEFLGKRPWFAGDKITFVDFLAYDVLDMKRIFEPKCLDAFLNLKDFISRFEGLKKISAYMKSSQFLRGLLFGKSATWNSK

SEQ ID NO: 35373 - protein, 202 aa, Homo sapiens
  Payload ID: 6991
  Gene Symbol: GSTM5
  Gene Name: glutathione S-transferase mu 5
  ENSP ID: ENSP00000358828
MLGSLVAQLSFPGFPSIQLPYLIDGAHKITQSNAILRYIARKHNLCGETEEEKIRVDILENQVMDNHMELVRLCYDPDFEKLKPKYLEELPEKLKLYSEFLGKRPWFAGDKITFVDFLAYDVLDMKRIFEPKCLDAFLNLKDFISRFEVMPPSSFLFDAPCSFLSFQMLSQSWSYTKNNSYVLSTGFMPGIMPSTLYLSCRI

SEQ ID NO: 35374 - protein, 208 aa, Homo sapiens
  Payload ID: 6992
  Gene Symbol: GSTO1
  Gene Name: glutathione S-transferase omega 1
  Uniprot ID: P78417
  ENSP ID: ENSP00000358724
MSGESARSLGKGSAPPGPVPEGSIRIYSMRFCPFAERTRLVLKAKGIRHEVININLKNKPEWFFKKNPFGLVPVLENSQGQLIYESAITCEYLDEAYPGKKLLPDDPYEKACQKMILELFSKVLTNKKTTFFGGNSISMIDYLIWPWFERLEAMKLNECVDHTPKLKLWMAAMKEDPTVSALLTSEKDWQGFLELYLQNSPEACDYGL

SEQ ID NO: 35375 - protein, 241 aa, Homo sapiens
  Payload ID: 6992
  Gene Symbol: GSTO1
  Gene Name: glutathione S-transferase omega 1
  Uniprot ID: P78417
  ENSP ID: ENSP00000358727
MSGESARSLGKGSAPPGPVPEGSIRIYSMRFCPFAERTRLVLKAKGIRHEVININLKNKPEWFFKKNPFGLVPVLENSQGQLIYESAITCEYLDEAYPGKKLLPDDPYEKACQKMILELFSKVPSLVGSFIRSQNKEDYAGLKEEFRKEFTKLEEVLTNKKTTFFGGNSISMIDYLIWPWFERLEAMKLNECVDHTPKLKLWMAAMKEDPTVSALLTSEKDWQGFLELYLQNSPEACDYGL

SEQ ID NO: 35376 - protein, 180 aa, Homo sapiens
  Payload ID: 6992
  Gene Symbol: GSTO1
  Gene Name: glutathione S-transferase omega 1
  ENSP ID: ENSP00000405325
MRFCPFAERTRLVLKAKGIRHEVININLKNKPEWFFKKNPFGLVPVLENSQGQLIYESAITCEYLDEAYPGKKLLPDDPYEKACQKMILELFSKVLTNKKTTFFGGNSISMIDYLIWPWFERLEAMKLNECVDHTPKLKLWMAAMKEDPTVSALLTSEKDWQGFLELYLQNSPEACDYGL

SEQ ID NO: 35377 - protein, 200 aa, Homo sapiens
  Payload ID: 6992
  Gene Symbol: GSTO1
  Gene Name: glutathione S-transferase omega 1
  ENSP ID: ENSP00000406708
MRFCPFAERTRLVLKAKGIRHEVININLKNKPEWFFKKNPFGLVPVLENSQGQLIYESAITCEYLDEAYPGKKLLPDDPYEKACQKMILELFSKVPSLVGSFIRSQNKEDYAGLKEEFRKEFTKLEEVLTNKKTTFFGGNSISMIDYLIWPWFERLEAMKLNECVDHTPKLKLWMAAMKEDPTVSALLTSEKDWQGFLEL

SEQ ID NO: 35378 - protein, 213 aa, Homo sapiens
  Payload ID: 6992
  Gene Symbol: GSTO1
  Gene Name: glutathione S-transferase omega 1
  Uniprot ID: P78417
  ENSP ID: ENSP00000441488
MRFCPFAERTRLVLKAKGIRHEVININLKNKPEWFFKKNPFGLVPVLENSQGQLIYESAITCEYLDEAYPGKKLLPDDPYEKACQKMILELFSKVPSLVGSFIRSQNKEDYAGLKEEFRKEFTKLEEVLTNKKTTFFGGNSISMIDYLIWPWFERLEAMKLNECVDHTPKLKLWMAAMKEDPTVSALLTSEKDWQGFLELYLQNSPEACDYGL

SEQ ID NO: 35379 - protein, 243 aa, Homo sapiens
  Payload ID: 6993
  Gene Symbol: GSTO2
  Gene Name: glutathione S-transferase omega 2
  Uniprot ID: Q9H4Y5
  ENSP ID: ENSP00000345023
MSGDATRTLGKGSQPPGPVPEGLIRIYSMRFCPYSHRTRLVLKAKDIRHEVVNINLRNKPEWYYTKHPFGHIPVLETSQCQLIYESVIACEYLDDAYPGRKLFPYDPYERARQKMLLELFCKVPHLTKECLVALRCGRECTNLKAALRQEFSNLEEILEYQNTTFFGGTCISMIDYLLWPWFERLDVYGILDCVSHTPALRLWISAMKWDPTVCALLMDKSIFQGFLNLYFQNNPNAFDFGLC

SEQ ID NO: 35380 - protein, 215 aa, Homo sapiens
  Payload ID: 6993
  Gene Symbol: GSTO2
  Gene Name: glutathione S-transferase omega 2
  Uniprot ID: Q9H4Y5
  ENSP ID: ENSP00000358721
MRFCPYSHRTRLVLKAKDIRHEVVNINLRNKPEWYYTKHPFGHIPVLETSQCQLIYESVIACEYLDDAYPGRKLFPYDPYERARQKMLLELFCKVPHLTKECLVALRCGRECTNLKAALRQEFSNLEEILEYQNTTFFGGTCISMIDYLLWPWFERLDVYGILDCVSHTPALRLWISAMKWDPTVCALLMDKSIFQGFLNLYFQNNPNAFDFGLC

SEQ ID NO: 35381 - protein, 209 aa, Homo sapiens
  Payload ID: 6993
  Gene Symbol: GSTO2
  Gene Name: glutathione S-transferase omega 2
  Uniprot ID: Q9H4Y5
  ENSP ID: ENSP00000390986
MSGDATRTLGKGSQPPGPVPEGLIRIYSMRFCPYSHRTRLVLKAKDIRHEVVNINLRNKPEWYYTKHPFGHIPVLETSQCQLIYESVIACEYLDDAYPGRKLFPYDPYERARQKMLLELFCKILEYQNTTFFGGTCISMIDYLLWPWFERLDVYGILDCVSHTPALRLWISAMKWDPTVCALLMDKSIFQGFLNLYFQNNPNAFDFGLC

SEQ ID NO: 35382 - protein, 174 aa, Homo sapiens
  Payload ID: 6994
  Gene Symbol: GSTP1
  Gene Name: glutathione S-transferase pi 1
  ENSP ID: ENSP00000381604
MPPYTVVYFPVRGRCAALRMLLADQGQSWKEEVVTVETWQEGSLKASCLYGQLPKFQDGDLTLYQSNTILRHLGRTLGLYGKDQQEAALVDMVNDGVEDLRCKYISLIYTNYISFADYNLLDLLLIHEVLAPGCLDAFPLLSAYVGRLSARPKLKAFLASPEYVNLPINGNGKQ

SEQ ID NO: 35383 - protein, 210 aa, Homo sapiens
  Payload ID: 6994
  Gene Symbol: GSTP1
  Gene Name: glutathione S-transferase pi 1
  Uniprot ID: P09211
  ENSP ID: ENSP00000381607
MPPYTVVYFPVRGRCAALRMLLADQGQSWKEEVVTVETWQEGSLKASCLYGQLPKFQDGDLTLYQSNTILRHLGRTLGLYGKDQQEAALVDMVNDGVEDLRCKYISLIYTNYEAGKDDYVKALPGQLKPFETLLSQNQGGKTFIVGDQISFADYNLLDLLLIHEVLAPGCLDAFPLLSAYVGRLSARPKLKAFLASPEYVNLPINGNGKQ

SEQ ID NO: 35384 - protein, 69 aa, Homo sapiens
  Payload ID: 6994
  Gene Symbol: GSTP1
  Gene Name: glutathione S-transferase pi 1
  ENSP ID: ENSP00000484686
EAGKDDYVKALPGQLKPFETLLSQNQGGKTFIVGDQVSIWPHAVPSSPPSASRWTQVSPSLTTTCWTCC

SEQ ID NO: 35385 - protein, 79 aa, Homo sapiens
  Payload ID: 6994
  Gene Symbol: GSTP1
  Gene Name: glutathione S-transferase pi 1
  ENSP ID: ENSP00000484929
  MOD_RES (1)..(1): Any amino acid
XRCAALRMLLADQGQSWKEEVVTVETWQEGSLKASCLYGQLPKFQDGDLTLYQSNTILRHLGRTLGWGSQTAPWLAHPQ

SEQ ID NO: 35386 - protein, 44 aa, Homo sapiens
  Payload ID: 6995
  Gene Symbol: GSTT1
  Gene Name: glutathione S-transferase theta 1
  ENSP ID: ENSP00000479871
MGLELYLDLLSQPCRAVYIFAKKNDIPFELRIVDLIKVWPSCST

SEQ ID NO: 35387 - protein, 240 aa, Homo sapiens
  Payload ID: 6995
  Gene Symbol: GSTT1
  Gene Name: glutathione S-transferase theta 1
  Uniprot ID: P30711
  ENSP ID: ENSP00000481741
MGLELYLDLLSQPCRAVYIFAKKNDIPFELRIVDLIKGQHLSDAFAQVNPLKKVPALKDGDFTLTESVAILLYLTRKYKVPDYWYPQDLQARARVDEYLAWQHTTLRRSCLRALWHKVMFPVFLGEPVSPQTLAATLAELDVTLQLLEDKFLQNKAFLTGPHISLADLVAITELMHPVGAGCQVFEGRPKLATWRQRVEAAVGEDLFQEAHEVILKAKDFPPADPTIKQKLMPWVLAMIR

SEQ ID NO: 35388 - protein, 65 aa, Homo sapiens
  Payload ID: 6995
  Gene Symbol: GSTT1
  Gene Name: glutathione S-transferase theta 1
  ENSP ID: ENSP00000485765
MGLELYLDLLSQPCRAVYIFAKKNDIPFELRIVDLIKGQHLSDAFAQVNPLKKVPALKDGDFTLT

SEQ ID NO: 35389 - protein, 45 aa, Homo sapiens
  Payload ID: 6995
  Gene Symbol: GSTT1
  Gene Name: glutathione S-transferase theta 1
  ENSP ID: ENSP00000485775
MGLELYLDLLSQPCRAVYIFAKKNDIPFELRIVDLIKGDVPCFPG

SEQ ID NO: 35390 - protein, 97 aa, Homo sapiens
  Payload ID: 6995
  Gene Symbol: GSTT1
  Gene Name: glutathione S-transferase theta 1
  ENSP ID: ENSP00000485976
MGLELYLDLLSQPCRAVYIFAKKNDIPFELRIVDLIKGQHLSDAFAQVNPLKKVPALKDGDFTLTERTCRPVPVWMSTWHGSTRLCGEAASGPCGIR

SEQ ID NO: 35391 - protein, 65 aa, Homo sapiens
  Payload ID: 6995
  Gene Symbol: GSTT1
  Gene Name: glutathione S-transferase theta 1
  ENSP ID: ENSP00000485987
MGLELYLDLLSQPCRAVYIFAKKNDIPFELRIVDLIKARGCWLPSLRRPTQAGHMAAARGGSSGG

SEQ ID NO: 35392 - protein, 46 aa, Homo sapiens
  Payload ID: 6995
  Gene Symbol: GSTT1
  Gene Name: glutathione S-transferase theta 1
  ENSP ID: ENSP00000486732
MGLELYLDLLSQPCRAVYIFAKKNDIPFELRIVDLIKGPAGPCPCG

SEQ ID NO: 35393 - protein, 114 aa, Homo sapiens
  Payload ID: 6995
  Gene Symbol: GSTT1
  Gene Name: glutathione S-transferase theta 1
  ENSP ID: ENSP00000486820
MGLELYLDLLSQPCRAVYIFAKKNDIPFELRIVDLIKDGVSLCRPGWSAVAGSQLTATSAARNLVLCLLFLLGRSALKRCLCPGEPPQEGASLEGRGLHLDGECGHPALPDAQI

SEQ ID NO: 35394 - protein, 105 aa, Homo sapiens
  Payload ID: 6995
  Gene Symbol: GSTT1
  Gene Name: glutathione S-transferase theta 1
  ENSP ID: ENSP00000486937
MGLELYLDLLSQPCRAVYIFAKKNDIPFELRIVDLIKGQHLSDAFAQVNPLKKVPALKDGDFTLTESPWVLAAKSSKADPSWPHGGSAWRQQWGRTSSRRPMRSF

SEQ ID NO: 35395 - protein, 226 aa, Homo sapiens
  Payload ID: 6995
  Gene Symbol: GSTT1
  Gene Name: glutathione S-transferase theta 1
  ENSP ID: ENSP00000486973
MGLELYLDLLSQPCRAVYIFAKKNDIPFELRIVDLIKDGVSLCRPGWSAVAGSQLTATSAARNLVLCLLFLLGRSALKRCLCPGEPPQEGASLEGRGLHLDGEVMFPVFLGEPVSPQTLAATLAELDVTLQLLEDKFLQNKAFLTGPHISLADLVAITELMHPVGAGCQVFEGRPKLATWRQRVEAAVGEDLFQEAHEVILKAKDFPPADPTIKQKLMPWVLAMIR

SEQ ID NO: 35396 - protein, 229 aa, Homo sapiens
  Payload ID: 6996
  Gene Symbol: GSTT2
  Gene Name: glutathione S-transferase theta 2 (gene/pseudogene)
  ENSP ID: ENSP00000385765
MGLELFLDLVSQPSRAVYIFAKKNGIPLELRTVDLVKGQHKSKEFLQINSLGKLPTLKDGDFILTESSAILIYLSCKYQTPDHWYPSDLQARARVHEYLGWHADCIRGTFGIPLWVQMLGPLIGVQVPEEKVERNRTAMDQALQWLEDKFLGDRPFLAGQQPVALGYELFEGRPRLAAWRGVEAFLGAELCQEAHSIILSILEQAAKKTLPTPSPEAYQAMLLRIARIP

SEQ ID NO: 35397 - protein, 244 aa, Homo sapiens
  Payload ID: 6996
  Gene Symbol: GSTT2
  Gene Name: glutathione S-transferase theta 2 (gene/pseudogene)
  Uniprot ID: P0CG29
  ENSP ID: ENSP00000477540
MGLELFLDLVSQPSRAVYIFAKKNGIPLELRTVDLVKGQHKSKEFLQINSLGKLPTLKDGDFILTESSAILIYLSCKYQTPDHWYPSDLQARARVHEYLGWHADCIRGTFGIPLWVQVLGPLIGVQVPKEKVERNRTAMDQALQWLEDKFLGDRPFLAGQQVTLADLMALEELMQPVALGYELFEGRPRLAAWRGRVEAFLGAELCQEAHSIILSILEQAAKKTLPTPSPEAYQAMLLRIARIP

SEQ ID NO: 35398 - protein, 243 aa, Homo sapiens
  Payload ID: 6996
  Gene Symbol: GSTT2
  Gene Name: glutathione S-transferase theta 2 (gene/pseudogene)
  ENSP ID: ENSP00000481555
MGLELFLDLVSQPSRAVYIFAKKNGIPLELRTVDLVKGQHKSKEFLQINSLGKLPTLKDGDFILTESSAILIYLSCKYQTPDHWYPSDLQARARVHEYLGWHADCIRGTFGIPLWVQMLGPLIGVQVPEEKVERNRTAMDQALQWLEDKFLGDRPFLAGQQVTLADLMALEELMQPVALGYELFEGRPRLAAWRGVEAFLGAELCQEAHSIILSILEQAAKKTLPTPSPEAYQAMLLRIARIP

SEQ ID NO: 35399 - protein, 243 aa, Homo sapiens; identical to SEQ ID NO: 35398
  Payload ID: 6996
  Gene Symbol: GSTT2
  Gene Name: glutathione S-transferase theta 2 (gene/pseudogene)
  ENSP ID: ENSP00000488993

SEQ ID NO: 35400 - protein, 244 aa, Homo sapiens
  Payload ID: 6997
  Gene Symbol: GSTT2B
  Gene Name: glutathione S-transferase theta 2B (gene/pseudogene)
  Uniprot ID: P0CG30
  ENSP ID: ENSP00000290765
MGLELFLDLVSQPSRAVYIFAKKNGIPLELRTVDLVKGQHKSKEFLQINSLGKLPTLKDGDFILTESSAILIYLSCKYQTPDHWYPSDLQARARVHEYLGWHADCIRGTFGIPLWVQVLGPLIGVQVPEEKVERNRTAMDQALQWLEDKFLGDRPFLAGQQVTLADLMALEELMQPVALGYELFEGRPRLAAWRGRVEAFLGAELCQEAHSIILSILEQAAKKTLPTPSPEAYQAMLLRIARIP

SEQ ID NO: 35401 - protein, 230 aa, Homo sapiens
  Payload ID: 6997
  Gene Symbol: GSTT2B
  Gene Name: glutathione S-transferase theta 2B (gene/pseudogene)
  ENSP ID: ENSP00000385116
MGLELFLDLVSQPSRAVYIFAKKNGIPLELRTVDLVKGQHKSKEFLQINSLGKLPTLKDGDFILTESSAILIYLSCKYQTPDHWYPSDLQARARVHEYLGWHADCIRGTFGIPLWVQVLGPLIGVQVPEEKVERNRTAMDQALQWLEDKFLGDRPFLAGQQPVALGYELFEGRPRLAAWRGRVEAFLGAELCQEAHSIILSILEQAAKKTLPTPSPEAYQAMLLRIARIP

SEQ ID NO: 35402 - protein, 244 aa, Homo sapiens; identical to SEQ ID NO: 35400
  Payload ID: 6997
  Gene Symbol: GSTT2B
  Gene Name: glutathione S-transferase theta 2B (gene/pseudogene)
  ENSP ID: ENSP00000478389

SEQ ID NO: 35403 - protein, 216 aa, Homo sapiens
  Payload ID: 6998
  Gene Symbol: GSTZ1
  Gene Name: glutathione S-transferase zeta 1
  ENSP ID: ENSP00000216465
MQAGKPILYSYFRSSCSWRVRIALALKGIDYETVPINLIKDGGQQFSKDFQALNPMKQVPTLKIDGITIHQSLAIIEYLEEMRPTPRLLPQDPKKRASVRMISDLIAGGIQPLQNLSVLKQVGEEMQLTWAQNAITCGFNALEQILQSTAGIYCVGDEVTMADLCLVPQVANAERFKVDLTPYPTISSINKRLLVLEAFQVSHPCRQPDTPTELRA

SEQ ID NO: 35404 - protein, 174 aa, Homo sapiens
  Payload ID: 6998
  Gene Symbol: GSTZ1
  Gene Name: glutathione S-transferase zeta 1
  ENSP ID: ENSP00000314404
MQAGKPILYSYFRSSCSWRVRIALALKGIDYETVPINLIKDGGQQFSKDFQALNPMKQVPTLKIDGITIHQSNLSVLKQVGEEMQLTWAQNAITCGFNALEQILQSTAGIYCVGDEVTMADLCLVPQVANAERFKVDLTPYPTISSINKRLLVLEAFQVSHPCRQPDTPTELRA

SEQ ID NO: 35405 - protein, 161 aa, Homo sapiens
  Payload ID: 6998
  Gene Symbol: GSTZ1
  Gene Name: glutathione S-transferase zeta 1
  Uniprot ID: O43708
  ENSP ID: ENSP00000354959
MKQVPTLKIDGITIHQSLAIIEYLEEMRPTPRLLPQDPKKRASVRMISDLIAGGIQPLQNLSVLKQVGEEMQLTWAQNAITCGFNALEQILQSTAGIYCVGDEVTMADLCLVPQVANAERFKVDLTPYPTISSINKRLLVLEAFQVSHPCRQPDTPTELRA

SEQ ID NO: 35406 - protein, 161 aa, Homo sapiens; identical to SEQ ID NO: 35405
  Payload ID: 6998
  Gene Symbol: GSTZ1
  Gene Name: glutathione S-transferase zeta 1
  Uniprot ID: O43708
  ENSP ID: ENSP00000377335

SEQ ID NO: 35407 - protein, 189 aa, Homo sapiens
  Payload ID: 6998
  Gene Symbol: GSTZ1
  Gene Name: glutathione S-transferase zeta 1
  ENSP ID: ENSP00000450487
MQAGKPILYSYFRSSCSWRVRIALALKGIDYETVPINLIKDGGQQLAIIEYLEEMRPTPRLLPQDPKKRASVRMISDLIAGGIQPLQNLSVLKQVGEEMQLTWAQNAITCGFNALEQILQSTAGIYCVGDEVTMADLCLVPQVANAERFKVDLTPYPTISSINKRLLVLEAFQVSHPCRQPDTPTELRA

SEQ ID NO: 35408 - protein, 119 aa, Homo sapiens
  Payload ID: 6998
  Gene Symbol: GSTZ1
  Gene Name: glutathione S-transferase zeta 1
  ENSP ID: ENSP00000451150
MKQVPTLKIDGITIHQSNLSVLKQVGEEMQLTWAQNAITCGFNALEQILQSTAGIYCVGDEVTMADLCLVPQVANAERFKVDLTPYPTISSINKRLLVLEAFQVSHPCRQPDTPTELRA

SEQ ID NO: 35409 - protein, 70 aa, Homo sapiens
  Payload ID: 6998
  Gene Symbol: GSTZ1
  Gene Name: glutathione S-transferase zeta 1
  ENSP ID: ENSP00000451850
VRMISDLIAGGIQPLQNLSVLKQVGEEMQLTWAQNAITCGFNALEQILQSTAGIYCVGDESRSGHTQSSH

SEQ ID NO: 35410 - protein, 161 aa, Homo sapiens; identical to SEQ ID NO: 35405
  Payload ID: 6998
  Gene Symbol: GSTZ1
  Gene Name: glutathione S-transferase zeta 1
  Uniprot ID: O43708
  ENSP ID: ENSP00000451927

SEQ ID NO: 35411 - protein, 217 aa, Homo sapiens
  Payload ID: 6998
  Gene Symbol: GSTZ1
  Gene Name: glutathione S-transferase zeta 1
  ENSP ID: ENSP00000451976
MTESGKPILYSYFRSSCSWRVRIALALKGIDYETVPINLIKDGGQQFSKDFQALNPMKQVPTLKIDGITIHQSLAIIEYLEEMRPTPRLLPQDPKKRASVRMISDLIAGGIQPLQNLSVLKQVGEEMQLTWAQNAITCGFNALEQILQSTAGIYCVGDEVTMADLCLVPQVANAERFKVDLTPYPTISSINKRLLVLEAFQVSHPCRQPDTPTELRA

SEQ ID NO: 35412 - protein, 38 aa, Homo sapiens
  Payload ID: 6998
  Gene Symbol: GSTZ1
  Gene Name: glutathione S-transferase zeta 1
  ENSP ID: ENSP00000452346
MKQVPTLKIDGITIHQSLAIIEYLEEMRPTPRLLPQDP

SEQ ID NO: 35413 - protein, 202 aa, Homo sapiens
  Payload ID: 6998
  Gene Symbol: GSTZ1
  Gene Name: glutathione S-transferase zeta 1
  ENSP ID: ENSP00000452498
MQAGKPILYSYFRSSCSWRVRIALALKGIDYETVPINLIKDGGQQFSKDFQALNPMKQLAIIEYLEEMRPTPRLLPQDPKKRASVRMISDLIAGGIQPLQNLSVLKQVGEEMQLTWAQNAITCGFNALEQILQSTAGIYCVGDEVTMADLCLVPQVANAERFKVDLTPYPTISSINKRLLVLEAFQVSHPCRQPDTPTELRA

SEQ ID NO: 35414 - protein, 59 aa, Homo sapiens
  Payload ID: 6998
  Gene Symbol: GSTZ1
  Gene Name: glutathione S-transferase zeta 1
  ENSP ID: ENSP00000452531
MKQVPTLKIDGITIHQSLAIIEYLEEMRPTPRLLPQDPKKRASVRMISDLIAGGIQPLQ

SEQ ID NO: 35415 - protein, 633 aa, Homo sapiens
  Payload ID: 6999
  Gene Symbol: GSTCD
  Gene Name: glutathione S-transferase, C-terminal domain containing
  Uniprot ID: Q8NEC7
  ENSP ID: ENSP00000353695
MKAIKKSLTEEEYLYLDFSHQTEGCIFPLHTSVTLFLLSYCDCKIFKICLVVTKEVSRDSSLLRDDLIQDVEIQIISRQELPPIVQNCCLPAVVERSDNFCRAGLAVVLRHIIQKSYEADPLKKELLELLGFKKTCLKACAEVSQWTRLCELTIPLAIENFLRESSDQPPTIPVEILQLEKKLSEPVRVHNDDKLRRQKLKQQKADGVGPPLTKGKAKSKVHTQETSEGLDSSSKSLELKVAFSKLTVQEEPATTNREPSHIRKAKASDLPPLEHVFAEGLYFTLADIVLLPCIHHFLVIISRKFSEKLVEFPLLASWYQRIQEVPGVKTAASKCGIQFLHLPKLLTTSTEQHPNLCEVPGVEEQSDPLFIGGPRPTMAKLMEKGIEVMFSPHPCPTWTLDWNVLPAAVSPKEGKMSSDRALRKQQQLNNLVYVVTNQAKPGDRIVDFCSGGGHVGIVLAHMLPSCQVTLIENKELSLIRAKKRSDELGLSNIWFIQANMEYFTGMFNIGVALHACGVATDMVIEHCIKTRASFVTCPCCYGFIQNTSKFNFPKSEQFKKTLSYKEHMILCRFADQTAVQLPPQRRLIGKQCMCLVDLDRARAAEECGYSVQVISMEPESCSPKNNMIVGVPI

SEQ ID NO: 35416 - protein, 633 aa, Homo sapiens; identical to SEQ ID NO: 35415
  Payload ID: 6999
  Gene Symbol: GSTCD
  Gene Name: glutathione S-transferase, C-terminal domain containing
  Uniprot ID: Q8NEC7
  ENSP ID: ENSP00000378216

SEQ ID NO: 35417 - protein, 546 aa, Homo sapiens
  Payload ID: 6999
  Gene Symbol: GSTCD
  Gene Name: glutathione S-transferase, C-terminal domain containing
  Uniprot ID: Q8NEC7
  ENSP ID: ENSP00000378218
MKAIKKSLTEEEYLYLDFSHQTEGCIFPLHTSVTLFLLSYCDCKIFKICLVVTKEVSQWTRLCELTIPLAIENFLRESSDQPPTIPVEILQLEKKLSEPVRVHNDDKLRRQKLKQQKADGVGPPLTKGKAKSKVHTQETSEGLDSSSKSLELKVAFSKLTVQEEPATTNREPSHIRKAKASDLPPLEHVFAEGLYFTLADIVLLPCIHHFLVIISRKFSEKLVEFPLLASWYQRIQEVPGVKTAASKCGIQFLHLPKLLTTSTEQHPNLCEVPGVEEQSDPLFIGGPRPTMAKLMEKGIEVMFSPHPCPTWTLDWNVLPAAVSPKEGKMSSDRALRKQQQLNNLVYVVTNQAKPGDRIVDFCSGGGHVGIVLAHMLPSCQVTLIENKELSLIRAKKRSDELGLSNIWFIQANMEYFTGMFNIGVALHACGVATDMVIEHCIKTRASFVTCPCCYGFIQNTSKFNFPKSEQFKKTLSYKEHMILCRFADQTAVQLPPQRRLIGKQCMCLVDLDRARAAEECGYSVQVISMEPESCSPKNNMIVGVPI

SEQ ID NO: 35418 - protein, 633 aa, Homo sapiens; identical to SEQ ID NO: 35415
  Payload ID: 6999
  Gene Symbol: GSTCD
  Gene Name: glutathione S-transferase, C-terminal domain containing
  Uniprot ID: Q8NEC7
  ENSP ID: ENSP00000422354

SEQ ID NO: 35419 - protein, 340 aa, Homo sapiens
  Payload ID: 6999
  Gene Symbol: GSTCD
  Gene Name: glutathione S-transferase, C-terminal domain containing
  ENSP ID: ENSP00000422858
MKAIKKSLTEEEYLYLDFSHQTEGCIFPLHTSVTLFLLSYCDCKIFKICLVVTKEVSQWTRLCELTIPLAIENFLRESSDQPPTIPVEILQLEKKLSEPVRVHNDDKLRRQKLKQQKADGVGPPLTKGKAKSKVHTQETSEGLDSSSKSLELKVAFSKLTVQEEPATTNREPSHIRKAKASDLPPLEHVFAEGLYFTLADIVLLPCIHHFLVIISRKFSEKLVEFPLLASWYQRIQEVPGVKTAASKCGIQFLHLPKLLTTSTEQHPNLCEVPGVEEQSDPLFIGGPRPTMAKLMEKGIEVMFSPHPCPTWTLDWNVLPAAVSPKEDGVLLCHSGWNAVV

SEQ ID NO: 35420 - protein, 40 aa, Homo sapiens
  Payload ID: 6999
  Gene Symbol: GSTCD
  Gene Name: glutathione S-transferase, C-terminal domain containing
  ENSP ID: ENSP00000423639
MKAIKKSLTEEEYLYLDFSHQTEGCIFPLHTSVTLFLLSY

SEQ ID NO: 35421 - protein, 167 aa, Homo sapiens
  Payload ID: 6999
  Gene Symbol: GSTCD
  Gene Name: glutathione S-transferase, C-terminal domain containing
  ENSP ID: ENSP00000423779
MKAIKKSLTEEEYLYLDFSHQTEGCIFPLHTSVTLFLLSYCDCKIFKICLVVTKEVSRDSSLLRDDLIQDVEIQIISRQELPPIVQNCCLPAVVERSDNFCRAGLAVVLRHIIQKSYEADPLKKELLELLGFKKTCLKACAEVSQWTRLCELTIPLAIENFLRESSD

SEQ ID NO: 35422 - protein, 166 aa, Homo sapiens
  Payload ID: 6999
  Gene Symbol: GSTCD
  Gene Name: glutathione S-transferase, C-terminal domain containing
  ENSP ID: ENSP00000423792
MKAIKKSLTEEEYLYLDFSHQTEGCIFPLHTSVTLFLLSYCDCKIFKICLVVTKEVSRDSSLLRDDLIQDVEIQIISRQELPPIVQNCCLPAVVERSDNFCRAGLAVVLRHIIQKSYEADPLKKELLELLGFKKTCLKACAEVSQWTRLCELTIPLAIENFLRESS

SEQ ID NO: 35423 - protein, 474 aa, Homo sapiens
  Payload ID: 7000
  Gene Symbol: GSS
  Gene Name: glutathione synthetase
  Uniprot ID: P48637
  ENSP ID: ENSP00000216951
MATNWGSLLQDKQQLEELARQAVDRALAEGVLLRTSQEPTSSEVVSYAPFTLFPSLVPSALLEQAYAVQMDFNLLVDAVSQNAAFLEQTLSSTIKQDDFTARLFDIHKQVLKEGIAQTVFLGLNRSDYMFQRSADGSPALKQIEINTISASFGGLASRTPAVHRHVLSVLSKTKEAGKILSNNPSKGLALGIAKAWELYGSPNALVLLIAQEKERNIFDQRAIENELLARNIHVIRRTFEDISEKGSLDQDRRLFVDGQEIAVVYFRDGYMPRQYSLQNWEARLLLERSHAAKCPDIATQLAGTKKVQQELSRPGMLEMLLPGQPEAVARLRATFAGLYSLDVGEEGDQAIAEALAAPSRFVLKPQREGGGNNLYGEEMVQALKQLKDSEERASYILMEKIEPEPFENCLLRPGSPARVVQCISELGIFGVYVRQEKTLVMNKHVGHLLRTKAIEHADGGVAAGVAVLDNPYPV

SEQ ID NO: 35424 - protein, 363 aa, Homo sapiens
  Payload ID: 7000
  Gene Symbol: GSS
  Gene Name: glutathione synthetase
  Uniprot ID: P48637
  ENSP ID: ENSP00000407517
MATNWGSLLQDKQQLEELARQAVDRALAEGVLLRTSQEPTSSEVVSYAPFTLFPSLVPSALLEQAYAVQMDFNLLVDAVSQNAAFLEQTLSSALVLLIAQEKERNIFDQRAIENELLARNIHVIRRTFEDISEKGSLDQDRRLFVDGQEIAVVYFRDGYMPRQYSLQNWEARLLLERSHAAKCPDIATQLAGTKKVQQELSRPGMLEMLLPGQPEAVARLRATFAGLYSLDVGEEGDQAIAEALAAPSRFVLKPQREGGGNNLYGEEMVQALKQLKDSEERASYILMEKIEPEPFENCLLRPGSPARVVQCISELGIFGVYVRQEKTLVMNKHVGHLLRTKAIEHADGGVAAGVAVLDNPYPV

SEQ ID NO: 35425 - protein, 335 aa, Homo sapiens
  Payload ID: 7001
  Gene Symbol: GAPDH
  Gene Name: glyceraldehyde-3-phosphate dehydrogenase
  Uniprot ID: P04406
  ENSP ID: ENSP00000229239
MGKVKVGVNGFGRIGRLVTRAAFNSGKVDIVAINDPFIDLNYMVYMFQYDSTHGKFHGTVKAENGKLVINGNPITIFQERDPSKIKWGDAGAEYVVESTGVFTTMEKAGAHLQGGAKRVIISAPSADAPMFVMGVNHEKYDNSLKIISNASCTTNCLAPLAKVIHDNFGIVEGLMTTVHAITATQKTVDGPSGKLWRDGRGALQNIIPASTGAAKAVGKVIPELNGKLTGMAFRVPTANVSVVDLTCRLEKPAKYDDIKKVVKQASEGPLKGILGYTEHQVVSSDFNSDTHSSTFDAGAGIALNDHFVKLISWYDNEFGYSNRVVDLMAHMASKE

SEQ ID NO: 35426 - protein, 260 aa, Homo sapiens
  Payload ID: 7001
  Gene Symbol: GAPDH
  Gene Name: glyceraldehyde-3-phosphate dehydrogenase
  ENSP ID: ENSP00000380065
MEEMRDPSKIKWGDAGAEYVVESTGVFTTMEKAGAHLQGGAKRVIISAPSADAPMFVMGVNHEKYDNSLKIISNASCTTNCLAPLAKVIHDNFGIVEGLMTTVHAITATQKTVDGPSGKLWRDGRGALQNIIPASTGAAKAVGKVIPELNGKLTGMAFRVPTANVSVVDLTCRLEKPAKYDDIKKVVKQASEGPLKGILGYTEHQVVSSDFNSDTHSSTFDAGAGIALNDHFVKLISWYDNEFGYSNRVVDLMAHMASKE

SEQ ID NO: 35427 - protein, 293 aa, Homo sapiens
  Payload ID: 7001
  Gene Symbol: GAPDH
  Gene Name: glyceraldehyde-3-phosphate dehydrogenase
  Uniprot ID: P04406
  ENSP ID: ENSP00000380067
MVYMFQYDSTHGKFHGTVKAENGKLVINGNPITIFQERDPSKIKWGDAGAEYVVESTGVFTTMEKAGAHLQGGAKRVIISAPSADAPMFVMGVNHEKYDNSLKIISNASCTTNCLAPLAKVIHDNFGIVEGLMTTVHAITATQKTVDGPSGKLWRDGRGALQNIIPASTGAAKAVGKVIPELNGKLTGMAFRVPTANVSVVDLTCRLEKPAKYDDIKKVVKQASEGPLKGILGYTEHQVVSSDFNSDTHSSTFDAGAGIALNDHFVKLISWYDNEFGYSNRVVDLMAHMASKE

SEQ ID NO: 35428 - protein, 335 aa, Homo sapiens; identical to SEQ ID NO: 35425
  Payload ID: 7001
  Gene Symbol: GAPDH
  Gene Name: glyceraldehyde-3-phosphate dehydrogenase
  Uniprot ID: P04406
  ENSP ID: ENSP00000380068

SEQ ID NO: 35429 - protein, 335 aa, Homo sapiens; identical to SEQ ID NO: 35425
  Payload ID: 7001
  Gene Symbol: GAPDH
  Gene Name: glyceraldehyde-3-phosphate dehydrogenase
  Uniprot ID: P04406
  ENSP ID: ENSP00000380070

SEQ ID NO: 35430 - protein, 293 aa, Homo sapiens; identical to SEQ ID NO: 35427
  Payload ID: 7001
  Gene Symbol: GAPDH
  Gene Name: glyceraldehyde-3-phosphate dehydrogenase
  Uniprot ID: P04406
  ENSP ID: ENSP00000478864

SEQ ID NO: 35431 - protein, 408 aa, Homo sapiens
  Payload ID: 7002
  Gene Symbol: GAPDHS
  Gene Name: glyceraldehyde-3-phosphate dehydrogenase, spermatogenic
  Uniprot ID: O14556
  ENSP ID: ENSP00000222286
MSKRDIVLTNVTVVQLLRQPCPVTRAPPPPEPKAEVEPQPQPEPTPVREEIKPPPPPLPPHPATPPPKMVSVARELTVGINGFGRIGRLVLRACMEKGVKVVAVNDPFIDPEYMVYMFKYDSTHGRYKGSVEFRNGQLVVDNHEISVYQCKEPKQIPWRAVGSPYVVESTGVYLSIQAASDHISAGAQRVVISAPSPDAPMFVMGVNENDYNPGSMNIVSNASCTTNCLAPLAKVIHERFGIVEGLMTTVHSYTATQKTVDGPSRKAWRDGRGAHQNIIPASTGAAKAVTKVIPELKGKLTGMAFRVPTPDVSVVDLTCRLAQPAPYSAIKEAVKAAAKGPMAGILAYTEDEVVSTDFLGDTHSSIFDAKAGIALNDNFVKLISWYDNEYGYSHRVVDLLRYMFSRDK

SEQ ID NO: 35432 - protein, 44 aa, Homo sapiens
  Payload ID: 7002
  Gene Symbol: GAPDHS
  Gene Name: glyceraldehyde-3-phosphate dehydrogenase, spermatogenic
  ENSP ID: ENSP00000466432
MSKRDIVLTNVTVVQLLRQPCPDLDASVAWSCAPAWRRVLRWWL

SEQ ID NO: 35433 - protein, 179 aa, Homo sapiens
  Payload ID: 7002
  Gene Symbol: GAPDHS
  Gene Name: glyceraldehyde-3-phosphate dehydrogenase, spermatogenic
  ENSP ID: ENSP00000467255
MVSVARELTVGINGFGRIGRLVLRACMEKGVKVVAVNDPFIDPEYMVYMFKYDSTHGRYKGSVEFRNGQLVVDNHEISVYQCKEPKQIPWRAVGSPYVVESTGVYLSIQAASDHISAGAQRVVISAPSPDAPMFVMGVNENDYNPGSMNIVSNASCTTNCLAPLAKVIHERFGIVEGLM

SEQ ID NO: 35434 - protein, 234 aa, Homo sapiens
  Payload ID: 7003
  Gene Symbol: GLYCTK
  Gene Name: glycerate kinase
  Uniprot ID: Q8IVS8
  ENSP ID: ENSP00000301965
MAAALQVLPRLARAPLHPLLWRGSVARLASSMALAEQARQLFESAVGAVLPGPMLHRALSLDPGGRQLKVRDRNFQLRQNLYLVGFGKAVLGMAAAAEELLGQHLVQGVISVPKGIRAAMERAGKQEMLLKPHSRVQVFEGAEDNLPDRDALRAALAIQQLAEGLTADDLLLVLISGGEPHPVRCGGGPCGGDCQWPHRGQFPQCARLPAYPQSLRPPCSPATFCEDCAVSGRL

SEQ ID NO: 35435 - protein, 523 aa, Homo sapiens
  Payload ID: 7003
  Gene Symbol: GLYCTK
  Gene Name: glycerate kinase
  Uniprot ID: Q8IVS8
  ENSP ID: ENSP00000389175
MAAALQVLPRLARAPLHPLLWRGSVARLASSMALAEQARQLFESAVGAVLPGPMLHRALSLDPGGRQLKVRDRNFQLRQNLYLVGFGKAVLGMAAAAEELLGQHLVQGVISVPKGIRAAMERAGKQEMLLKPHSRVQVFEGAEDNLPDRDALRAALAIQQLAEGLTADDLLLVLISGGGSALLPAPIPPVTLEEKQTLTRLLAARGATIQELNTIRKALSQLKGGGLAQAAYPAQVVSLILSDVVGDPVEVIASGPTVASSHNVQDCLHILNRYGLRAALPRSVKTVLSRADSDPHGPHTCGHVLNVIIGSNVLALAEAQRQAEALGYQAVVLSAAMQGDVKSMAQFYGLLAHVARTRLTPSMAGASVEEDAQLHELAAELQIPDLQLEEALETMAWGRGPVCLLAGGEPTVQLQGSGRGGRNQELALRVGAELRRWPLGPIDVLFLSGGTDGQDGPTEAAGAWVTPELASQAAAEGLDIATFLAHNDSHTFFCCLQGGAHLLHTGMTGTNVMDTHLLFLRPR

SEQ ID NO: 35436 - protein, 283 aa, Homo sapiens
  Payload ID: 7003
  Gene Symbol: GLYCTK
  Gene Name: glycerate kinase
  ENSP ID: ENSP00000417264
MELLLSQSCIWWPMVGEGRTIISCGIKAMERSGNYLIWLQKGEMLLKPHSRVQVFEGAEDNLPDRDALRAALAIQQLAEGLTADDLLLVLISGGGSALLPAPIPPVTLEEKQTLTRLLAARGATIQELNTIRKALSQLKGGGLAQAAYPAQVVSLILSDVVGDPVEVIASGPTVASSHNVQDCLHILNRYGLRAALPRSVKTVLSRADSDPHGPHTCGHVLNVIIGSNVLALAEAQRQAEALGYQAVVLSAAMQGWGTPAAHRDDRYQCHGHPPLVPAASVMA

SEQ ID NO: 35437 - protein, 240 aa, Homo sapiens
  Payload ID: 7003
  Gene Symbol: GLYCTK
  Gene Name: glycerate kinase
  ENSP ID: ENSP00000417526
MLLKPHSRVQVFEGAEDNLPDRDALRAALAIQQLAEGLTADDLLLVLISGGGSALLPAPIPPVTLEEKQTLTRLLAARGATIQELNTIRKALSQLKGGGLAQAAYPAQVVSLILSDVVGDPVEVIASGPTVASSHNVQDCLHILNRYGLRAALPRSVKTVLSRADSDPHGPHTCGHVLNVIIGSNVLALAEAQRQAEALGYQAVVLSAAMQGWGTPAAHRDDRYQCHGHPPLVPAASVMA

SEQ ID NO: 35438 - protein, 205 aa, Homo sapiens
  Payload ID: 7003
  Gene Symbol: GLYCTK
  Gene Name: glycerate kinase
  Uniprot ID: Q8IVS8
  ENSP ID: ENSP00000418951
MAAALQVLPRLARAPLHPLLWRGSVARLASSMALAEQARQLFESAVGAVLPGPMLHRALSLDPGGRQLKVRDRNFQLRQNLYLVGFGKAVLGMAAAAEELLGQHLVQGVISVPKGIRAAMERAGKQEMLLKPHSRVQVFEGAEDNLPDRDALRAALAIQQLAEGLTADDLLLVLISGWGTPAAHRDDRYQCHGHPPLVPAASVMA

SEQ ID NO: 35439 - protein, 234 aa, Homo sapiens; identical to SEQ ID NO: 35434
  Payload ID: 7003
  Gene Symbol: GLYCTK
  Gene Name: glycerate kinase
  Uniprot ID: Q8IVS8
  ENSP ID: ENSP00000419008

SEQ ID NO: 35440 - protein, 212 aa, Homo sapiens
  Payload ID: 7003
  Gene Symbol: GLYCTK
  Gene Name: glycerate kinase
  ENSP ID: ENSP00000419868
MAAALQVLPRLARAPLHPLLWRGSVARLASSMALAEQARQLFESAVGAVLPGPMLHRALSLDPGGRQLKVRDRNFQLRQNLYLVGFGKAVLGMAAAAEELLGQHLVQGVISVPKGIRAAMERAGKQEMLLKPHSRVQVFEGAEDNLPDRDALRAALAIQQLAEGLTADDLLLVLISEVGVQLCCLPPSHLSHWRRSRHSLDCWQPVEPPSRS

SEQ ID NO: 35441 - protein, 94 aa, Homo sapiens
  Payload ID: 7004
  Gene Symbol: GK
  Gene Name: glycerol kinase
  ENSP ID: ENSP00000368221
KILDAMNRDCGIPLSHLQVDGGMTSNKILMQLQADILYIPVVKPSMPETTALGAAMAAGAAEGVGVWSLEPEDLSAVTMERFEPQINAEGTFKE

SEQ ID NO: 35442 - protein, 118 aa, Homo sapiens
  Payload ID: 7004
  Gene Symbol: GK
  Gene Name: glycerol kinase
  ENSP ID: ENSP00000368224
MAASKKAVLGPLVGAVDQGTSSTRFLVFNSKTAELLSHHQVEIKQEFPREGWVEQDPKEILHSVYECIEKTCEKLGQLNIDISNIKAIGVSNQRETTVVWDKITGEPLYNAVDCLTNE

SEQ ID NO: 35443 - protein, 553 aa, Homo sapiens
  Payload ID: 7004
  Gene Symbol: GK
  Gene Name: glycerol kinase
  Uniprot ID: P32189
  ENSP ID: ENSP00000368226
MAASKKAVLGPLVGAVDQGTSSTRFLVFNSKTAELLSHHQVEIKQEFPREGWVEQDPKEILHSVYECIEKTCEKLGQLNIDISNIKAIGVSNQRETTVVWDKITGEPLYNAVVWLDLRTQSTVESLSKRIPGNNNFVKSKTGLPLSTYFSAVKLRWLLDNVRKVQKAVEEKRALFGTIDSWLIWSLTGGVNGGVHCTDVTNASRTMLFNIHSLEWDKQLCEFFGIPMEILPNVRSSSEIYGLMKAGALEGVPISGCLGDQSAALVGQMCFQIGQAKNTYGTGCFLLCNTGHKCVFSDHGLLTTVAYKLGRDKPVYYALEGSVAIAGAVIRWLRDNLGIIKTSEEIEKLAKEVGTSYGCYFVPAFSGLYAPYWEPSARGIICGLTQFTNKCHIAFAALEAVCFQTREILDAMNRDCGIPLSHLQVDGGMTSNKILMQLQADILYIPVVKPSMPETTALGAAMAAGAAEGVGVWSLEPEDLSAVTMERFEPQINAEESEIRYSTWKKAVMKSMGWVTTQSPESGDPSIFCSLPLGFFIVSSMVMLIGARYISGIP

SEQ ID NO: 35444 - protein, 524 aa, Homo sapiens
  Payload ID: 7004
  Gene Symbol: GK
  Gene Name: glycerol kinase
  Uniprot ID: P32189
  ENSP ID: ENSP00000368228
MAASKKAVLGPLVGAVDQGTSSTRFLVFNSKTAELLSHHQVEIKQEFPREGWVEQDPKEILHSVYECIEKTCEKLGQLNIDISNIKAIGVSNQRETTVVWDKITGEPLYNAVVWLDLRTQSTVESLSKRIPGNNNFVKSKTGLPLSTYFSAVKLRWLLDNVRKVQKAVEEKRALFGTIDSWLIWSLTGGVNGGVHCTDVTNASRTMLFNIHSLEWDKQLCEFFGIPMEILPNVRSSSEIYGLMKAGALEGVPISGCLGDQSAALVGQMCFQIGQAKNTYGTGCFLLCNTGHKCVFSDHGLLTTVAYKLGRDKPVYYALEGSVAIAGAVIRWLRDNLGIIKTSEEIEKLAKEVGTSYGCYFVPAFSGLYAPYWEPSARGIICGLTQFTNKCHIAFAALEAVCFQTREILDAMNRDCGIPLSHLQVDGGMTSNKILMQLQADILYIPVVKPSMPETTALGAAMAAGAAEGVGVWSLEPEDLSAVTMERFEPQINAEESEIRYSTWKKAVMKSMGWVTTQSPESGIP

SEQ ID NO: 35445 - protein, 530 aa, Homo sapiens
  Payload ID: 7004
  Gene Symbol: GK
  Gene Name: glycerol kinase
  Uniprot ID: P32189
  ENSP ID: ENSP00000368229
MAASKKAVLGPLVGAVDQGTSSTRFLVFNSKTAELLSHHQVEIKQEFPREGWVEQDPKEILHSVYECIEKTCEKLGQLNIDISNIKAIGVSNQRETTVVWDKITGEPLYNAVVWLDLRTQSTVESLSKRIPGNNNFVKSKTGLPLSTYFSAVKLRWLLDNVRKVQKAVEEKRALFGTIDSWLIWSLTGGVNGGVHCTDVTNASRTMLFNIHSLEWDKQLCEFFGIPMEILPNVRSSSEIYGLMKISHSVKAGALEGVPISGCLGDQSAALVGQMCFQIGQAKNTYGTGCFLLCNTGHKCVFSDHGLLTTVAYKLGRDKPVYYALEGSVAIAGAVIRWLRDNLGIIKTSEEIEKLAKEVGTSYGCYFVPAFSGLYAPYWEPSARGIICGLTQFTNKCHIAFAALEAVCFQTREILDAMNRDCGIPLSHLQVDGGMTSNKILMQLQADILYIPVVKPSMPETTALGAAMAAGAAEGVGVWSLEPEDLSAVTMERFEPQINAEESEIRYSTWKKAVMKSMGWVTTQSPESGIP

SEQ ID NO: 35446 - protein, 559 aa, Homo sapiens
  Payload ID: 7004
  Gene Symbol: GK
  Gene Name: glycerol kinase
  Uniprot ID: P32189
  ENSP ID: ENSP00000401720
MAASKKAVLGPLVGAVDQGTSSTRFLVFNSKTAELLSHHQVEIKQEFPREGWVEQDPKEILHSVYECIEKTCEKLGQLNIDISNIKAIGVSNQRETTVVWDKITGEPLYNAVVWLDLRTQSTVESLSKRIPGNNNFVKSKTGLPLSTYFSAVKLRWLLDNVRKVQKAVEEKRALFGTIDSWLIWSLTGGVNGGVHCTDVTNASRTMLFNIHSLEWDKQLCEFFGIPMEILPNVRSSSEIYGLMKISHSVKAGALEGVPISGCLGDQSAALVGQMCFQIGQAKNTYGTGCFLLCNTGHKCVFSDHGLLTTVAYKLGRDKPVYYALEGSVAIAGAVIRWLRDNLGIIKTSEEIEKLAKEVGTSYGCYFVPAFSGLYAPYWEPSARGIICGLTQFTNKCHIAFAALEAVCFQTREILDAMNRDCGIPLSHLQVDGGMTSNKILMQLQADILYIPVVKPSMPETTALGAAMAAGAAEGVGVWSLEPEDLSAVTMERFEPQINAEESEIRYSTWKKAVMKSMGWVTTQSPESGDPSIFCSLPLGFFIVSSMVMLIGARYISGIP

SEQ ID NO: 35447 - protein, 123 aa, Homo sapiens
  Payload ID: 7004
  Gene Symbol: GK
  Gene Name: glycerol kinase
  ENSP ID: ENSP00000404682
NAPAAPVSPGPSVPVAVVPSGSSVPAPGTSSVWLDLRTQSTVESLSKRIPGNNNFVKSKTGLPLSTYFSAVKLRWLLDNVRKVQKAVEEKRALFGTIDSWLIWSLTGGVNGGVHCTDVTNASR

SEQ ID NO: 35448 - protein, 90 aa, Homo sapiens
  Payload ID: 7004
  Gene Symbol: GK
  Gene Name: glycerol kinase
  ENSP ID: ENSP00000417942
MAASKKAVLGPLVGAVDQGTSSTRFLVFNSKTAELLSHHQVEIKQEFPREGYWCQQPEGNHCSLGQDNWRASLQCCGPRQAFHLALTSVQ

SEQ ID NO: 35449 - protein, 102 aa, Homo sapiens
  Payload ID: 7004
  Gene Symbol: GK
  Gene Name: glycerol kinase
  ENSP ID: ENSP00000418873
MAASKKAVLGPLVGAVDQGTSSTRFLVFNSKTAELLSHHQVEIKQEFPREGWVEQDPKEILHSVYECIEKTCEKLGQLNIDISNIKDNPTSCFMEKVEGLRP

SEQ ID NO: 35450 - protein, 37 aa, Homo sapiens
  Payload ID: 7004
  Gene Symbol: GK
  Gene Name: glycerol kinase
  ENSP ID: ENSP00000419332
MAASKKAVLGPLVGAVDQGTSSTRFLLLVSATRGKPL

SEQ ID NO: 35451 - protein, 41 aa, Homo sapiens
  Payload ID: 7004
  Gene Symbol: GK
  Gene Name: glycerol kinase
  ENSP ID: ENSP00000419771
SARVAKFRCCLIPDSDSITCIPLKPAFSGMAPDVAYSTPTS

SEQ ID NO: 35452 - protein, 79 aa, Homo sapiens
  Payload ID: 7004
  Gene Symbol: GK
  Gene Name: glycerol kinase
  ENSP ID: ENSP00000420676
MAASKKAVLGPLVGAVDQGTSSTRFLVFNSKTAELLSHHQVEIKQEFPREGYWCQQPEGNHCSLGQDNWRASLQCCGVA

SEQ ID NO: 35453 - protein, 553 aa, Homo sapiens
  Payload ID: 7005
  Gene Symbol: GK2
  Gene Name: glycerol kinase 2
  Uniprot ID: Q14410
  ENSP ID: ENSP00000351706
MAAPKTAAVGPLVGAVVQGTNSTRFLVFNSKTAELLSHHKVELTQEFPKEGWVEQDPKEILQSVYECIARTCEKLDELNIDISNIKAVGVSNQRETTVIWDKLTGEPLYNAVVWLDLRTQTTVEDLSKKIPGNSNFVKSKTGLPLSTYFSAVKLRWMLDNVRNVQKAVEEGRALFGTIDSWLIWSLTGGVNGGVHCTDVTNASRTMLFNIHSLEWDKELCDFFEIPMDLLPNVFSSSEIYGLIKTGALEGVPISGCLGDQCAALVGQMCFQEGQAKNTYGTGCFLLCNTGRKCVFSEHGLLTTVAYKLGREKPAYYALEGSVAIAGAVIRWLRDNLGIIETSGDIERLAKEVGTSYGCYFVPAFSGLYAPYWEPSARGILCGLTQFTNKCHIAFAALEAVCFQTREILEAMNRDCGIPLRHLQVDGGMTNNKVLMQLQADILHIPVIKPFMPETTALGAAMAAGAAEGVSVWSLEPQALSVLRMERFEPQIQATESEIRYATWKKAVMKSMGWVTSQSPEGGDPSIFSSLPLGFFIVSSMVMLIGARYISGVP

SEQ ID NO: 35454 - protein, 17 aa, Homo sapiens
  Payload ID: 7006
  Gene Symbol: GK5
  Gene Name: glycerol kinase 5 (putative)
  ENSP ID: ENSP00000417153
  MOD_RES (1)..(1): Any amino acid
XFVPSFSGLQTLSHSVT

SEQ ID NO: 35455 - protein, 529 aa, Homo sapiens
  Payload ID: 7006
  Gene Symbol: GK5
  Gene Name: glycerol kinase 5 (putative)
  Uniprot ID: Q6ZS86
  ENSP ID: ENSP00000418001
MSGLLTDPEQRAQEPRYPGFVLGLDVGSSVIRCHVYDRAARVCGSSVQKVENLYPQIGWVEIDPDVLWIQFVAVIKEAVKAAGIQMNQIVGLGISTQRATFITWNKKTGNHFHNFISWQDLRAVELVKSWNNSLLMKIFHSSCRVLHFFTRSKRLFTASLFTFTTQQTSLRLVWILQNLTEVQKAVEEENCCFGTIDTWLLYKLTKGSVYATDFSNASTTGLFDPYKMCWSGMITSLISIPLSLLPPVRDTSHNFGSVDEEIFGVPIPIVALVADQQSAMFGECCFQTGDVKLTMGTGTFLDINTGNSLQQTTGGFYPLIGWKIGQEVVCLAESNAGDTGTAIKWAQQLDLFTDAAETEKMAKSLEDSEGVCFVPSFSGLQAPLNDPWACASFMGLKPSTSKYHLVRAILESIAFRNKQLYEMMKKEIHIPVRKIRADGGVCKNGFVMQMTSDLINENIDRPADIDMSCLGAASLAGLAVGFWTDKEELKKLRQSEVVFKPQKKCQEYEMSLENWAKAVKRSMNWYNKT

SEQ ID NO: 35456 - protein, 153 aa, Homo sapiens
  Payload ID: 7006
  Gene Symbol: GK5
  Gene Name: glycerol kinase 5 (putative)
  ENSP ID: ENSP00000418239
MSGLLTDPEQRAQEPRYPGFVLGLDVGSSVIRCHVYDRAARVCGSSVQKVENLYPQIGWVEIDPDVLWIQFVAVIKEAVKAAGIQMNQIVGLGISTQRATFITWNKKTGNHFHNFISWQDLRAVELVKSWNNSLLMKVIFFLCDLDIVGFFFL

SEQ ID NO: 35457 - protein, 301 aa, Homo sapiens
  Payload ID: 7006
  Gene Symbol: GK5
  Gene Name: glycerol kinase 5 (putative)
  Uniprot ID: Q6ZS86
  ENSP ID: ENSP00000419031
MSGLLTDPEQRAQEPRYPGFVLGLDVGSSVIRCHVYDRAARVCGSSVQKVENLYPQIGWVEIDPDVLWIQFVAVIKEAVKAAGIQMNQIVGLGISTQRATFITWNKKTGNHFHNFISWQDLRAVELVKSWNNSLLMKIFHSSCRVLHFFTRSKRLFTASLFTFTTQQTSLRLVWILQNLTEVQKAVEEENCCFGTIDTWLLYKLTKGSVYATDFSNASTTGLFDPYKMCWSGMITSLISIPLSLLPPVRDTSHNFGSVDEEIFGVPIPIVALLKVPGYDQNICYIFGKGTIEPVFYHGSTL

SEQ ID NO: 35458 - protein, 301 aa, Homo sapiens; identical to SEQ ID NO: 35457
  Payload ID: 7006
  Gene Symbol: GK5
  Gene Name: glycerol kinase 5 (putative)
  Uniprot ID: Q6ZS86
  ENSP ID: ENSP00000420312

SEQ ID NO: 35459 - protein, 172 aa, Homo sapiens
  Payload ID: 7006
  Gene Symbol: GK5
  Gene Name: glycerol kinase 5 (putative)
  ENSP ID: ENSP00000420593
QQLDLFTDAAETEKMAKSLEDSEGVCFVPSFSGLQAPLNDPWACASFMGLKPSTSKYHLVRAILESIAFRNKQLYEMMKKEIHIPVRKIRADGGVCKNGFVMQMTSDLINENIDRPADIDMSCLGAASLAGLAVGMCEIYKNESFLANSSLQIAFLLSNYKILESLESLGVH

SEQ ID NO: 35460 - protein, 795 aa, Homo sapiens
  Payload ID: 7007
  Gene Symbol: GPAT2
  Gene Name: glycerol-3-phosphate acyltransferase 2, mitochondrial
  Uniprot ID: Q6NUI2
  ENSP ID: ENSP00000352547
MATMLEGRCQTQPRSSPSGREASLWSSGFGMKLEAVTPFLGKYRPFVGRCCQTCTPKSWESLFHRSITDLGFCNVILVKEENTRFRGWLVRRLCYFLWSLEQHIPPCQDVPQKIMESTGVQNLLSGRVPGGTGEGQVPDLVKKEVQRILGHIQAPPRPFLVRLFSWALLRFLNCLFLNVQLHKGQMKMVQKAAQAGLPLVLLSTHKTLLDGILLPFMLLSQGLGVLRVAWDSRACSPALRALLRKLGGLFLPPEASLSLDSSEGLLARAVVQAVIEQLLVSGQPLLIFLEEPPGALGPRLSALGQAWVGFVVQAVQVGIVPDALLVPVAVTYDLVPDAPCDIDHASAPLGLWTGALAVLRSLWSRWGCSHRICSRVHLAQPFSLQEYIVSARSCWGGRQTLEQLLQPIVLGQCTAVPDTEKEQEWTPITGPLLALKEEDQLLVRRLSCHVLSASVGSSAVMSTAIMATLLLFKHQKLLGEFSWLTEEILLRGFDVGFSGQLRSLLQHSLSLLRAHVALLRIRQGDLLVVPQPGPGLTHLAQLSAELLPVFLSEAVGACAVRGLLAGRVPPQGPWELQGILLLSQNELYRQILLLMHLLPQDLLLLKPCQSSYCYCQEVLDRLIQCGLLVAEETPGSRPACDTGRQRLSRKLLWKPSGDFTDSDSDDFGEADGRYFRLSQQSHCPDFFLFLCRLLSPLLKAFAQAAAFLRQGQLPDTELGYTEQLFQFLQATAQEEGIFECADPKLAISAVWTFRDLGVLQQTPSPAGPRLHLSPTFASLDNQEKLEQFIRQFICS

SEQ ID NO: 35461 - protein, 795 aa, Homo sapiens; identical to SEQ ID NO: 35460
  Payload ID: 7007
  Gene Symbol: GPAT2
  Gene Name: glycerol-3-phosphate acyltransferase 2, mitochondrial
  Uniprot ID: Q6NUI2
  ENSP ID: ENSP00000389395

SEQ ID NO: 35462 - protein, 724 aa, Homo sapiens
  Payload ID: 7007
  Gene Symbol: GPAT2
  Gene Name: glycerol-3-phosphate acyltransferase 2, mitochondrial
  ENSP ID: ENSP00000393770
MATMLEGRCQTQPRSSPSGREASLWSSGFGMKLEAVTPFLGKYRPFVGRCCQTCTPKSWESLFHRSITDLGFCNVILVKEENTRFRGWLVRRLCYFLWSLEQHIPPCQDVPQKIMESTGVQNLLSGRVPGGTGEGQVPDLVKKEVQRILGHIQAPPRPFLVRLFSWALLRFLNCLFLNVQLHKGQMKMVQKAAQAGLPLVLLSTHKTLLDGILLPFMLLSQGLGVLRVAWDSRACSPALRALLRKLGGLFLPPEASLSLDSSEGLLARAVVQAASAPLGLWTGALAVLRSLWSRWGCSHRICSRVHLAQPFSLQEYIVSARSCWGGRQTLEQLLQPIVLGQCTAVPDTEKEQEWTPITGPLLALKEEDQLLVRRLSCHVLSASVGSSAVMSTAIMATLLLFKHQKLLGEFSWLTEEILLRGFDVGFSGQLRSLLQHSLSLLRAHVALLRIRQGDLLVVPQPGPGLTHLAQLSAELLPVFLSEAVGACAVRGLLAGRVPPQGPWELQGILLLSQNELYRQILLLMHLLPQDLLLLKPCQSSYCYCQEVLDRLIQCGLLVAEETPGSRPACDTGRQRLSRKLLWKPSGDFTDSDSDDFGEADGRYFRLSQQSHCPDFFLFLCRLLSPLLKAFAQAAAFLRQGQLPDTELGYTEQLFQFLQATAQEEGIFECADPKLAISAVWTFRDLGVLQQTPSPAGPRLHLSPTFASLDNQEKLEQFIRQFICS

SEQ ID NO: 35463 - protein, 160 aa, Homo sapiens
  Payload ID: 7007
  Gene Symbol: GPAT2
  Gene Name: glycerol-3-phosphate acyltransferase 2, mitochondrial
  ENSP ID: ENSP00000401334
MATMLEGRCQTQPRSSPSGREASLWSSGFGMKLEAVTPFLGKYRPFVGRCCQTCTPKSWESLFHRSITDLGFCNVILVKEENTRFRGWLVRRLCYFLWSLEQHIPPCQDVPQKIMESTGVQNLLSGRVPGGTGEGQVPDLVKKEVQRILGHIQAPPRPFL

SEQ ID NO: 35464 - protein, 434 aa, Homo sapiens
  Payload ID: 7008
  Gene Symbol: GPAT3
  Gene Name: glycerol-3-phosphate acyltransferase 3
  Uniprot ID: Q53EU6
  ENSP ID: ENSP00000264409
MEGAELAGKILSTWLTLVLGFILLPSVFGVSLGISEIYMKILVKTLEWATIRIEKGTPKESILKNSASVGIIQRDESPMEKGLSGLRGRDFELSDVFYFSKKGLEAIVEDEVTQRFSSEELVSWNLLTRTNVNFQYISLRLTMVWVLGVIVRYCVLLPLRVTLAFIGISLLVIGTTLVGQLPDSSLKNWLSELVHLTCCRICVRALSGTIHYHNKQYRPQKGGICVANHTSPIDVLILTTDGCYAMVGQVHGGLMGIIQRAMVKACPHVWFERSEMKDRHLVTKRLKEHIADKKKLPILIFPEGTCINNTSVMMFKKGSFEIGGTIHPVAIKYNPQFGDAFWNSSKYNMVSYLLRMMTSWAIVCDVWYMPPMTREEGEDAVQFANRVKSAIAIQGGLTELPWDGGLKRAKVKDIFKEEQQKNYSKMIVGNGSLS

SEQ ID NO: 35465 - protein, 434 aa, Homo sapiens; identical to SEQ ID NO: 35464
  Payload ID: 7008
  Gene Symbol: GPAT3
  Gene Name: glycerol-3-phosphate acyltransferase 3
  Uniprot ID: Q53EU6
  ENSP ID: ENSP00000378651

SEQ ID NO: 35466 - protein, 434 aa, Homo sapiens; identical to SEQ ID NO: 35464
  Payload ID: 7008
  Gene Symbol: GPAT3
  Gene Name: glycerol-3-phosphate acyltransferase 3
  Uniprot ID: Q53EU6
  ENSP ID: ENSP00000482571

SEQ ID NO: 35467 - protein, 456 aa, Homo sapiens
  Payload ID: 7009
  Gene Symbol: GPAT4
  Gene Name: glycerol-3-phosphate acyltransferase 4
  Uniprot ID: Q86UL3
  ENSP ID: ENSP00000380184
MFLLLPFDSLIVNLLGISLTVLFTLLLVFIIVPAIFGVSFGIRKLYMKSLLKIFAWATLRMERGAKEKNHQLYKPYTNGIIAKDPTSLEEEIKEIRRSGSSKALDNTPEFELSDIFYFCRKGMETIMDDEVTKRFSAEELESWNLLSRTNYNFQYISLRLTVLWGLGVLIRYCFLLPLRIALAFTGISLLVVGTTVVGYLPNGRFKEFMSKHVHLMCYRICVRALTAIITYHDRENRPRNGGICVANHTSPIDVIILASDGYYAMVGQVHGGLMGVIQRAMVKACPHVWFERSEVKDRHLVAKRLTEHVQDKSKLPILIFPEGTCINNTSVMMFKKGSFEIGATVYPVAIKYDPQFGDAFWNSSKYGMVTYLLRMMTSWAIVCSVWYLPPMTREADEDAVQFANRVKSAIARQGGLVDLLWDGGLKREKVKDTFKEEQQKLYSKMIVGNHKDRSRS

SEQ ID NO: 35468 - protein, 179 aa, Homo sapiens
  Payload ID: 7009
  Gene Symbol: GPAT4
  Gene Name: glycerol-3-phosphate acyltransferase 4
  ENSP ID: ENSP00000428630
MFLLLPFDSLIVNLLGISLTVLFTLLLVFIIVPAIFGVSFGIRKLYMKSLLKIFAWATLRMERGAKEKNHQLYKPYTNGIIAKDPTSLEEEIKEIRRSGSSKALDNTPEFELSDIFYFCRKGMETIMDDEVTKRFSAEELESWNLLSRTNYNFQYISLRLTVLWGLGVLIRYCFLLPLR

SEQ ID NO: 35469 - protein, 29 aa, Homo sapiens
  Payload ID: 7009
  Gene Symbol: GPAT4
  Gene Name: glycerol-3-phosphate acyltransferase 4
  ENSP ID: ENSP00000428648
MFLLLPFDSLIVNLLGISLTVLFTLLLVF

SEQ ID NO: 35470 - protein, 158 aa, Homo sapiens
  Payload ID: 7009
  Gene Symbol: GPAT4
  Gene Name: glycerol-3-phosphate acyltransferase 4
  ENSP ID: ENSP00000429477
MKSLLKIFAWATLRMERGAKEKNHQLYKPYTNGIIAKDPTSLEEEIKEIRRSGSSKALDNTPEFELSDIFYFCRKGMETIMDDEVTKRFSAEELESWNLLSRTNYNFQYISLRLTVLWGLGVLIRYCFLLPLRIALAFTGISLLVVGTTVVGYLPNGR

SEQ ID NO: 35471 - protein, 828 aa, Homo sapiens
  Payload ID: 7010
  Gene Symbol: GPAM
  Gene Name: glycerol-3-phosphate acyltransferase, mitochondrial
  Uniprot ID: Q9HCL2
  ENSP ID: ENSP00000265276
MDESALTLGTIDVSYLPHSSEYSVGRCKHTSEEWGECGFRPTIFRSATLKWKESLMSRKRPFVGRCCYSCTPQSWDKFFNPSIPSLGLRNVIYINETHTRHRGWLARRLSYVLFIQERDVHKGMFATNVTENVLNSSRVQEAIAEVAAELNPDGSAQQQSKAVNKVKKKAKRILQEMVATVSPAMIRLTGWVLLKLFNSFFWNIQIHKGQLEMVKAATETNLPLLFLPVHRSHIDYLLLTFILFCHNIKAPYIASGNNLNIPIFSTLIHKLGGFFIRRRLDETPDGRKDVLYRALLHGHIVELLRQQQFLEIFLEGTRSRSGKTSCARAGLLSVVVDTLSTNVIPDILIIPVGISYDRIIEGHYNGEQLGKPKKNESLWSVARGVIRMLRKNYGCVRVDFAQPFSLKEYLESQSQKPVSALLSLEQALLPAILPSRPSDAADEGRDTSINESRNATDESLRRRLIANLAEHILFTASKSCAIMSTHIVACLLLYRHRQGIDLSTLVEDFFVMKEEVLARDFDLGFSGNSEDVVMHAIQLLGNCVTITHTSRNDEFFITPSTTVPSVFELNFYSNGVLHVFIMEAIIACSLYAVLNKRGLGGPTSTPPNLISQEQLVRKAASLCYLLSNEGTISLPCQTFYQVCHETVGKFIQYGILTVAEHDDQEDISPSLAEQQWDKKLPEPLSWRSDEEDEDSDFGEEQRDCYLKVSQSKEHQQFITFLQRLLGPLLEAYSSAAIFVHNFSGPVPEPEYLQKLHKYLITRTERNVAVYAESATYCLVKNAVKMFKDIGVFKETKQKRVSVLELSSTFLPQCNRQKLLEYILSFVVL

SEQ ID NO: 35472 - protein, 710 aa, Homo sapiens
  Payload ID: 7010
  Gene Symbol: GPAM
  Gene Name: glycerol-3-phosphate acyltransferase, mitochondrial
  ENSP ID: ENSP00000358433
MDESALTLGTIDVSYLPHSSEYSVGRCKHTSEEWGECGFRPTIFRSATLKWKESLMSRKRPFVGRCCYSCTPQSWDKFFNPSIPSLGLRNVIYINETHTRHRGWLARRLSYVLFIQERDVHKGMFATNVTENVLNSSRVQEAIAEVAAELNPDGSAQQQSKAVNKVKKKAKRILQEMVATVSPAMIRLTGWVLLKLFNSFFWNIQIHKGQLEMVKAATETNLPLLFLPVHRSHIDYLLLTFILFCHNIKAPYIASGNNLNIPIFSTLIHKLGGFFIRRRLDETPDGRKDVLYRALLHGHIVELLRQQQFLEIFLEGTRSRSGKTSCARAGLLSVVVDTLSTNVIPDILIIPVGISYDRIIEGHYNGEQLGKPKKNESLWSVARGVIRMLRKNYGCVRVDFAQPFSLKEYLESQSQKPVSALLSLEQALLPAILPSRPSDAADEGRDTSINESRNATDESLRRRLIANLAEHILFTASKSCAIMSTHIVACLLLYRHRQGIDLSTLVEDFFVMKEEVLARDFDLGFSGNSEDVVMHAIQLLGNCVTITHTSRNDEFFITPSTTVPSVFELNFYSNGVLHVFIMEAIIACSLYAVLNKRGLGGPTSTPPNLISQEQLVRKAASLCYLLSNEGTISLPCQTFYQVCHETVGKFIQYGILTVAEHDDQEDISPSLAEQQWDKKLPEPLSWRSDEEDEDSDFGEEQRDCYLKVLG

SEQ ID NO: 35473 - protein, 349 aa, Homo sapiens
  Payload ID: 7011
  Gene Symbol: GPD1
  Gene Name: glycerol-3-phosphate dehydrogenase 1 (soluble)
  Uniprot ID: P21695
  ENSP ID: ENSP00000301149
MASKKVCIVGSGNWGSAIAKIVGGNAAQLAQFDPRVTMWVFEEDIGGKKLTEIINTQHENVKYLPGHKLPPNVVAVPDVVQAAEDADILIFVVPHQFIGKICDQLKGHLKANATGISLIKGVDEGPNGLKLISEVIGERLGIPMSVLMGANIASEVADEKFCETTIGCKDPAQGQLLKELMQTPNFRITVVQEVDTVEICGALKNVVAVGAGFCDGLGFGDNTKAAVIRLGLMEMIAFAKLFCSGPVSSATFLESCGVADLITTCYGGRNRKVAEAFARTGKSIEQLEKELLNGQKLQGPETARELYSILQHKGLVDKFPLFMAVYKVCYEGQPVGEFIHCLQNHPEHM

SEQ ID NO: 35474 - protein, 326 aa, Homo sapiens
  Payload ID: 7011
  Gene Symbol: GPD1
  Gene Name: glycerol-3-phosphate dehydrogenase 1 (soluble)
  Uniprot ID: P21695
  ENSP ID: ENSP00000446768
MASKKVCIVGSGNWGSAIAKIVGGNAAQLAQFDPRVTMWVFEEDIGGKKLTEIINTQHENVKYLPGHKLPPNVFIGKICDQLKGHLKANATGISLIKGVDEGPNGLKLISEVIGERLGIPMSVLMGANIASEVADEKFCETTIGCKDPAQGQLLKELMQTPNFRITVVQEVDTVEICGALKNVVAVGAGFCDGLGFGDNTKAAVIRLGLMEMIAFAKLFCSGPVSSATFLESCGVADLITTCYGGRNRKVAEAFARTGKSIEQLEKELLNGQKLQGPETARELYSILQHKGLVDKFPLFMAVYKVCYEGQPVGEFIHCLQNHPEHM

SEQ ID NO: 35475 - protein, 50 aa, Homo sapiens
  Payload ID: 7011
  Gene Symbol: GPD1
  Gene Name: glycerol-3-phosphate dehydrogenase 1 (soluble)
  ENSP ID: ENSP00000448244
MASKKVCIVGSGNWSLGTICHGSGGDKEGAQPSPRSWVAMQPSWHSLTHG

SEQ ID NO: 35476 - protein, 351 aa, Homo sapiens
  Payload ID: 7012
  Gene Symbol: GPD1L
  Gene Name: glycerol-3-phosphate dehydrogenase 1-like
  Uniprot ID: Q8N335
  ENSP ID: ENSP00000282541
MAAAPLKVCIVGSGNWGSAVAKIIGNNVKKLQKFASTVKMWVFEETVNGRKLTDIINNDHENVKYLPGHKLPENVVAMSNLSEAVQDADLLVFVIPHQFIHRICDEITGRVPKKALGITLIKGIDEGPEGLKLISDIIREKMGIDISVLMGANIANEVAAEKFCETTIGSKVMENGLLFKELLQTPNFRITVVDDADTVELCGALKNIVAVGAGFCDGLRCGDNTKAAVIRLGLMEMIAFARIFCKGQVSTATFLESCGVADLITTCYGGRNRRVAEAFARTGKTIEELEKEMLNGQKLQGPQTSAEVYRILKQKGLLDKFPLFTAVYQICYESRPVQEMLSCLQSHPEHT

SEQ ID NO: 35477 - protein, 64 aa, Homo sapiens
  Payload ID: 7012
  Gene Symbol: GPD1L
  Gene Name: glycerol-3-phosphate dehydrogenase 1-like
  ENSP ID: ENSP00000392199
MAAAPLKVCIVGSGNWLPCQILARLCRMQTCWCLSFPTSSFTESVMRSLGECPRKRWESPSSRA

SEQ ID NO: 35478 - protein, 127 aa, Homo sapiens
  Payload ID: 7012
  Gene Symbol: GPD1L
  Gene Name: glycerol-3-phosphate dehydrogenase 1-like
  ENSP ID: ENSP00000393861
MWVFEETVNGRKLTDIINNDHENVKYLPGHKLPENVVAMSNLSEAVQDADLLVFVIPHQFIHRICDEITGRVPKKALGITLIKGIDEGPEGLKLISDIIREKMGIDISVLMGANIANEVAAEKFCET

SEQ ID NO: 35479 - protein, 173 aa, Homo sapiens
  Payload ID: 7012
  Gene Symbol: GPD1L
  Gene Name: glycerol-3-phosphate dehydrogenase 1-like
  ENSP ID: ENSP00000408770
MAAAPLKVCIVGSGNWGSAVAKIIGNNVKKLQKFASTVKMWVFEETVNGRKLTDIINNDHENVKYLPGHKLPENVGIDEGPEGLKLISDIIREKMGIDISVLMGANIANEVAAEKFCETTIGSKVMENGLLFKELLQTPNFRITVVDDADTVELCGALKNIVAVGAGFCDGLR

SEQ ID NO: 35480 - protein, 144 aa, Homo sapiens
  Payload ID: 7012
  Gene Symbol: GPD1L
  Gene Name: glycerol-3-phosphate dehydrogenase 1-like
  ENSP ID: ENSP00000416518
MWVFEETVNGRKLTDIINNDHENVKYLPGHKLPENVVAMSNLSEAVQDADLLVFVIPHQFIHRICDEITGRVPKKALGITLIKGIDEGPEGLKLISDIIREKMGIDISVLMGANIANEVAAEKFCETTIGSKVMENGLLFKELL

SEQ ID NO: 35481 - protein, 727 aa, Homo sapiens
  Payload ID: 7013
  Gene Symbol: GPD2
  Gene Name: glycerol-3-phosphate dehydrogenase 2 (mitochondrial)
  Uniprot ID: P43304
  ENSP ID: ENSP00000308610
MAFQKAVKGTILVGGGALATVLGLSQFAHYRRKQMNLAYVKAADCISEPVNREPPSREAQLLTLQNTSEFDILVIGGGATGSGCALDAVTRGLKTALVERDDFSSGTSSRSTKLIHGGVRYLQKAIMKLDIEQYRMVKEALHERANLLEIAPHLSAPLPIMLPVYKWWQLPYYWVGIKLYDLVAGSNCLKSSYVLSKSRALEHFPMLQKDKLVGAIVYYDGQHNDARMNLAIALTAARYGAATANYMEVVSLLKKTDPQTGKVRVSGARCKDVLTGQEFDVRAKCVINATGPFTDSVRKMDDKDAAAICQPSAGVHIVMPGYYSPESMGLLDPATSDGRVIFFLPWQKMTIAGTTDTPTDVTHHPIPSEEDINFILNEVRNYLSCDVEVRRGDVLAAWSGIRPLVTDPKSADTQSISRNHVVDISESGLITIAGGKWTTYRSMAEDTINAAVKTHNLKAGPSRTVGLFLQGGKDWSPTLYIRLVQDYGLESEVAQHLAATYGDKAFEVAKMASVTGKRWPIVGVRLVSEFPYIEAEVKYGIKEYACTAVDMISRRTRLAFLNVQAAEEALPRIVELMGRELNWDDYKKQEQLETARKFLYYEMGYKSRSEQLTDRSEISLLPSDIDRYKKRFHKFDADQKGFITIVDVQRVLESINVQMDENTLHEILNEVDLNKNGQVELNEFLQLMSAIQKGRVSGSRLAILMKTAEENLDRRVPIPVDRSCGGL

SEQ ID NO: 35482 - protein, 727 aa, Homo sapiens; identical to SEQ ID NO: 35481
  Payload ID: 7013
  Gene Symbol: GPD2
  Gene Name: glycerol-3-phosphate dehydrogenase 2 (mitochondrial)
  Uniprot ID: P43304
  ENSP ID: ENSP00000386425

SEQ ID NO: 35483 - protein, 601 aa, Homo sapiens
  Payload ID: 7013
  Gene Symbol: GPD2
  Gene Name: glycerol-3-phosphate dehydrogenase 2 (mitochondrial)
  Uniprot ID: P43304
  ENSP ID: ENSP00000386484
MKLDIEQYRMVKEALHERANLLEIAPHLSAPLPIMLPVYKWWQLPYYWVGIKLYDLVAGSNCLKSSYVLSKSRALEHFPMLQKDKLVGAIVYYDGQHNDARMNLAIALTAARYGAATANYMEVVSLLKKTDPQTGKVRVSGARCKDVLTGQEFDVRAKCVINATGPFTDSVRKMDDKDAAAICQPSAGVHIVMPGYYSPESMGLLDPATSDGRVIFFLPWQKMTIAGTTDTPTDVTHHPIPSEEDINFILNEVRNYLSCDVEVRRGDVLAAWSGIRPLVTDPKSADTQSISRNHVVDISESGLITIAGGKWTTYRSMAEDTINAAVKTHNLKAGPSRTVGLFLQGGKDWSPTLYIRLVQDYGLESEVAQHLAATYGDKAFEVAKMASVTGKRWPIVGVRLVSEFPYIEAEVKYGIKEYACTAVDMISRRTRLAFLNVQAAEEALPRIVELMGRELNWDDYKKQEQLETARKFLYYEMGYKSRSEQLTDRSEISLLPSDIDRYKKRFHKFDADQKGFITIVDVQRVLESINVQMDENTLHEILNEVDLNKNGQVELNEFLQLMSAIQKGRVSGSRLAILMKTAEENLDRRVPIPVDRSCGGL

SEQ ID NO: 35484 - protein, 727 aa, Homo sapiens; identical to SEQ ID NO: 35481
  Payload ID: 7013
  Gene Symbol: GPD2
  Gene Name: glycerol-3-phosphate dehydrogenase 2 (mitochondrial)
  Uniprot ID: P43304
  ENSP ID: ENSP00000386626

SEQ ID NO: 35485 - protein, 56 aa, Homo sapiens
  Payload ID: 7013
  Gene Symbol: GPD2
  Gene Name: glycerol-3-phosphate dehydrogenase 2 (mitochondrial)
  ENSP ID: ENSP00000387475
MAFQKAVKGTILVGGGALATVLGLSQFAHYRRKQNIVLSGELRNEECILLRKCGKT

SEQ ID NO: 35486 - protein, 56 aa, Homo sapiens; identical to SEQ ID NO: 35485
  Payload ID: 7013
  Gene Symbol: GPD2
  Gene Name: glycerol-3-phosphate dehydrogenase 2 (mitochondrial)
  ENSP ID: ENSP00000408522

SEQ ID NO: 35487 - protein, 727 aa, Homo sapiens; identical to SEQ ID NO: 35481
  Payload ID: 7013
  Gene Symbol: GPD2
  Gene Name: glycerol-3-phosphate dehydrogenase 2 (mitochondrial)
  Uniprot ID: P43304
  ENSP ID: ENSP00000409708

SEQ ID NO: 35488 - protein, 109 aa, Homo sapiens
  Payload ID: 7013
  Gene Symbol: GPD2
  Gene Name: glycerol-3-phosphate dehydrogenase 2 (mitochondrial)
  ENSP ID: ENSP00000412621
MAFQKAVKGTILVGGGALATVLGLSQFAHYRRKQMNLAYVKAADCISEPVNREPPSREAQLLTLQNTSEFDILVIGGGATGSGCALDAVTRGLKTALVERDDFSSGTSS

SEQ ID NO: 35489 - protein, 379 aa, Homo sapiens
  Payload ID: 7013
  Gene Symbol: GPD2
  Gene Name: glycerol-3-phosphate dehydrogenase 2 (mitochondrial)
  ENSP ID: ENSP00000440892
MAFQKAVKGTILVGGGALATVLGLSQFAHYRRKQMNLAYVKAADCISEPVNREPPSREAQLLTLQNTSEFDILVIGGGATGSGCALDAVTRGLKTALVERDDFSSGTSSRSTKLIHGGVRYLQKAIMKLDIEQYRMVKEALHERANLLEIAPHLSAPLPIMLPVYKWWQLPYYWVGIKLYDLVAGSNCLKSSYVLSKSRALEHFPMLQKDKLVGAIVYYDGQHNDARMNLAIALTAARYGAATANYMEVVSLLKKTDPQTGKVRVSGARCKDVLTGQEFDVRAKCVINATGPFTDSVRKMDDKDAAAICQPSAGVHIVMPGYYSPESMGLLDPATSDGRVIFFLPWQKMTIAGTTDTPTDVTHHPIPSEEDINFILNEV

SEQ ID NO: 35490 - protein, 680 aa, Homo sapiens
  Payload ID: 7014
  Gene Symbol: GNPAT
  Gene Name: glyceronephosphate O-acyltransferase
  Uniprot ID: O15228
  ENSP ID: ENSP00000355607
MESSSSSNSYFSVGPTSPSAVVLLYSKELKKWDEFEDILEERRHVSDLKFAMKCYTPLVYKGITPCKPIDIKCSVLNSEEIHYVIKQLSKESLQSVDVLREEVSEILDEMSHKLRLGAIRFCAFTLSKVFKQIFSKVCVNEEGIQKLQRAIQEHPVVLLPSHRSYIDFLMLSFLLYNYDLPVPVIAAGMDFLGMKMVGELLRMSGAFFMRRTFGGNKLYWAVFSEYVKTMLRNGYAPVEFFLEGTRSRSAKTLTPKFGLLNIVMEPFFKREVFDTYLVPISISYDKILEETLYVYELLGVPKPKESTTGLLKARKILSENFGSIHVYFGDPVSLRSLAAGRMSRSSYNLVPRYIPQKQSEDMHAFVTEVAYKMELLQIENMVLSPWTLIVAVLLQNRPSMDFDALVEKTLWLKGLTQAFGGFLIWPDNKPAEEVVPASILLHSNIASLVKDQVILKVDSGDSEVVDGLMLQHITLLMCSAYRNQLLNIFVRPSLVAVALQMTPGFRKEDVYSCFRFLRDVFADEFIFLPGNTLKDFEEGCYLLCKSEAIQVTTKDILVTEKGNTVLEFLVGLFKPFVESYQIICKYLLSEEEDHFSEEQYLAAVRKFTSQLLDQGTSQCYDVLSSDVQKNALAACVRLGVVEKKKINNNCIFNVNEPATTKLEEMLGCKTPIGKPATAKL

SEQ ID NO: 35491 - protein, 222 aa, Homo sapiens
  Payload ID: 7014
  Gene Symbol: GNPAT
  Gene Name: glyceronephosphate O-acyltransferase
  ENSP ID: ENSP00000402811
MESSSSSNSYFSVGPTSPSAVVLLYSLSKESLQSVDVLREEVSEILDEMSHKLRLGAIRFCAFTLSKVFKQIFSKVCVNEEGIQKLQRAIQEHPVVLLPSHRSYIDFLMLSFLLYNYDLPVPVIAAGMDFLGMKMVGELLRMSGAFFMRRTFGGNKLYWAVFSEYVKTMLRNGYAPVEFFLEGTRSRSAKTLTPKFGLLNIVMEPFFKREVFDTYLVPISIS

SEQ ID NO: 35492 - protein, 587 aa, Homo sapiens
  Payload ID: 7014
  Gene Symbol: GNPAT
  Gene Name: glyceronephosphate O-acyltransferase
  ENSP ID: ENSP00000411640
MESSSSSNSYFSVGPTSPSAVVLLYSKELKKWDEFEDILEERRHVSDLKFAMKCYTPLVYKGITPCKPIDIKCSVLNSEEIHYVIKQLSKESLQSVDVLREEVSEILDEMSHKLRLGAIRFCAFTLSKVFKQIFSKLQRAIQEHPVVLLPSHRSYIDFLMLSFLLYNYDLPVPVIAAGMDFLGMKMVGELLRMSGAFFMRRTFGGNKLYWAVFSEYVKTMLRNGYAPVEFFLEGTRSRSAKTLTPKFGLLNIVMEPFFKREVFDTYLVPISISYDKILEETLYVYELLGVPKPKESTTGLLKARKILSENFGSIHVYFGDPVSLRSLAAGRMSRSSYNLVPRYIPQKQSEDMHAFVTEVAYKMELLQIENMVLSPWTLIVAVLLQNRPSMDFDALVEKTLWLKGLTQAFGGFLIWPDNKPAEEVVPASILLHSNIASLVKDQVILKVDSGDSEVVDGLMLQHITLLMCSAYRNQLLNIFVRPSLVAVALQMTPGFRKEDVYSCFRFLRDVFADEFIFLPGNTLKDFEEGCYLLCKSEAIQVTTKDILVTEKGNTVLEFLVGLFKPFVESYQIICKYLLSEEEDHFSE

SEQ ID NO: 35493 - protein, 672 aa, Homo sapiens
  Payload ID: 7015
  Gene Symbol: GPCPD1
  Gene Name: glycerophosphocholine phosphodiesterase 1
  Uniprot ID: Q9NPB8
  ENSP ID: ENSP00000368305
MTPSQVAFEIRGTLLPGEVFAICGSCDALGNWNPQNAVALLPENDTGESMLWKATIVLSRGVSVQYRYFKGYFLEPKTIGGPCQVIVHKWETHLQPRSITPLESEIIIDDGQFGIHNGVETLDSGWLTCQTEIRLRLHYSEKPPVSITKKKLKKSRFRVKLTLEGLEEDDDDRVSPTVLHKMSNSLEISLISDNEFKCRHSQPECGYGLQPDRWTEYSIQTMEPDNLELIFDFFEEDLSEHVVQGDALPGHVGTACLLSSTIAESGKSAGILTLPIMSRNSRKTIGKVRVDYIIIKPLPGYSCDMKSSFSKYWKPRIPLDVGHRGAGNSTTTAQLAKVQENTIASLRNAASHGAAFVEFDVHLSKDFVPVVYHDLTCCLTMKKKFDADPVELFEIPVKELTFDQLQLLKLTHVTALKSKDRKESVVQEENSFSENQPFPSLKMVLESLPEDVGFNIEIKWICQQRDGMWDGNLSTYFDMNLFLDIILKTVLENSGKRRIVFSSFDADICTMVRQKQNKYPILFLTQGKSEIYPELMDLRSRTTPIAMSFAQFENLLGINVHTEDLLRNPSYIQEAKAKGLVIFCWGDDTNDPENRRKLKELGVNGLIYDRIYDWMPEQPNIFQVEQLERLKQELPELKSCLCPTVSRFVPSSLCGESDIHVDANGIDNVENA

SEQ ID NO: 35494 - protein, 264 aa, Homo sapiens
  Payload ID: 7015
  Gene Symbol: GPCPD1
  Gene Name: glycerophosphocholine phosphodiesterase 1
  ENSP ID: ENSP00000396720
  MOD_RES (1)..(1): Any amino acid
XCDMKSSFSKYWKPRIPLDVGHRGAGNSTTTAQLAKVQENTIASLRNAASHGAAFVEFDVHLSKDFVPVVYHDLTCCLTMKKNLWFRRKIPFQKISHFLLLRWVRQKQNKYPILFLTQGKSEIYPELMDLRSRTTPIAMSFAQFENLLGINVHTEDLLRNPSYIQEAKAKGLVIFCWGDDTNDPENRRKLKELGVNGLIYDRIYDWMPEQPNIFQVEQLERLKQELPELKSCLCPTVSRFVPSSLCGESDIHVDANGIDNVENA

SEQ ID NO: 35495 - protein, 62 aa, Homo sapiens
  Payload ID: 7015
  Gene Symbol: GPCPD1
  Gene Name: glycerophosphocholine phosphodiesterase 1
  ENSP ID: ENSP00000487616
  MOD_RES (1)..(1): Any amino acid
XENTIASLRNAASHGAAFVEFDVHLSKDFVPVVYHDLTCCLTMKKLSSALQLSASCIFLPEI

SEQ ID NO: 35496 - protein, 101 aa, Homo sapiens
  Payload ID: 7015
  Gene Symbol: GPCPD1
  Gene Name: glycerophosphocholine phosphodiesterase 1
  ENSP ID: ENSP00000488635
MTPSQVAFEIRGTLLPGEVFAICGSCDALGNWNPQNAVALLPENDTGESMLWKATIVLSRGVSVQYRYFKGYFLEPKKAKLLLTMDNLESTMVLKLWILDG

SEQ ID NO: 35497 - protein, 331 aa, Homo sapiens
  Payload ID: 7016
  Gene Symbol: GDE1
  Gene Name: glycerophosphodiester phosphodiesterase 1
  Uniprot ID: Q9NZC3
  ENSP ID: ENSP00000261386
MWLWEDQGGLLGPFSFLLLVLLLVTRSPVNACLLTGSLFVLLRVFSFEPVPSCRALQVLKPRDRISAIAHRGGSHDAPENTLAAIRQAAKNGATGVELDIEFTSDGIPVLMHDNTVDRTTDGTGRLCDLTFEQIRKLNPAANHRLRNDFPDEKIPTLREAVAECLNHNLTIFFDVKGHAHKATEALKKMYMEFPQLYNNSVVCSFLPEVIYKMRQTDRDVITALTHRPWSLSHTGDGKPRYDTFWKHFIFVMMDILLDWSMHNILWYLCGISAFLMQKDFVSPAYLKKWSAKGIQVVGWTVNTFDEKSYYESHLGSSYITDSMVEDCEPHF

SEQ ID NO: 35498 - protein, 102 aa, Homo sapiens
  Payload ID: 7016
  Gene Symbol: GDE1
  Gene Name: glycerophosphodiester phosphodiesterase 1
  ENSP ID: ENSP00000454755
MHDNTVDRTTDGTGRLCDLTFEQIRKLNPAANHRLRNDFPDEKIPTLREAVAECLNHNLTIFFDVKGHAHKATEALKKMYMEFPQLYNNSVVCSFLPEVIYK

SEQ ID NO: 35499 - protein, 129 aa, Homo sapiens
  Payload ID: 7016
  Gene Symbol: GDE1
  Gene Name: glycerophosphodiester phosphodiesterase 1
  ENSP ID: ENSP00000456295
GVELDIEFTSDGIPVLMHDNTVDRTTDGTGRLCDLTFEQIRKLNPAANHRLRNDFPDEKIPTLREAVAECLNHNLTIFFDVKGHAHKATEALKKMYMEFPQLYNNSVVCSFLPEVIYKVTFGIFLVHIR

SEQ ID NO: 35500 - protein, 108 aa, Homo sapiens
  Payload ID: 7016
  Gene Symbol: GDE1
  Gene Name: glycerophosphodiester phosphodiesterase 1
  ENSP ID: ENSP00000457431
MWLWEDQGGLLGPFSFLLLVLLLVTRSPVNACLLTGSLFVLLRVFSFEPVPSCRALQVLKPRDRISAIAHRGGSHDAPENTLAAIRQLRMEQQAWSWTLSLLLTGFLS

SEQ ID NO: 35501 - protein, 314 aa, Homo sapiens
  Payload ID: 7017
  Gene Symbol: GDPD1
  Gene Name: glycerophosphodiester phosphodiesterase domain containing 1
  Uniprot ID: Q8N9F7
  ENSP ID: ENSP00000284116
MSSTAAFYLLSTLGGYLVTSFLLLKYPTLLHQRKKQRFLSKHISHRGGAGENLENTMAAFQHAVKIGTDMLELDCHITKDEQVVVSHDENLKRATGVNVNISDLKYCELPPYLGKLDVSFQRACQCEGKDNRIPLLKEVFEAFPNTPINIDIKVNNNVLIKKVSELVKRYNREHLTVWGNANYEIVEKCYKENSDIPILFSLQRVLLILGLFFTGLLPFVPIREQFFEIPMPSIILKLKEPHTMSRSQKFLIWLSDLLLMRKALFDHLTARGIQVYIWVLNEEQEYKRAFDLGATGVMTDYPTKLRDFLHNFSA

SEQ ID NO: 35502 - protein, 130 aa, Homo sapiens
  Payload ID: 7017
  Gene Symbol: GDPD1
  Gene Name: glycerophosphodiester phosphodiesterase domain containing 1
  ENSP ID: ENSP00000462895
MSSTAAFYLLSTLGGYLVTSFLLLKYPTLLHQRKKQRFLSKHISHRGGAGENLENTMAAFQHAVKIGTDMLELDCHITKDEQVVVSHDENLKRATGVNVNISDLKYCELPPYLGKLDVSFQRGFRVGEAV

SEQ ID NO: 35503 - protein, 289 aa, Homo sapiens
  Payload ID: 7017
  Gene Symbol: GDPD1
  Gene Name: glycerophosphodiester phosphodiesterase domain containing 1
  Uniprot ID: Q8N9F7
  ENSP ID: ENSP00000463273
MSSTAAFYLLSTLGGYLVTSFLLLKYPTLLHQRKKQRFLSKHISHRGGAGENLENTMAAFQHAVKIGTDMLELDCHITKDEQVVVSHDENLKRATGVNVNISDLKYCELPPYLGKLDVSFQRACQCEGKDNRIPLLKEVFEAFPNTPINIDIKVNNNVLIKKVSELVKRYNREHLTVWGNANYEIVEKCYKENSDIPILFSLQRVLLILGLFFTGLLPFVPIREQFFEIPMPSIILKLKEPHTMSRSQKFLIWLSDLLLMRKALFEPLHPASKRNFEGHCSYLVVSCYF

SEQ ID NO: 35504 - protein, 210 aa, Homo sapiens
  Payload ID: 7017
  Gene Symbol: GDPD1
  Gene Name: glycerophosphodiester phosphodiesterase domain containing 1
  ENSP ID: ENSP00000463818
MSSTAAFYLLSTLGGYLVTSFLLLKYPTLLHQRKKQRFLSKHISHRGGAGENLENTMAAFQHAVKIGTDMLELDCHITKDEQVVVSHDENLKRATGVNVNISDLKYCELPPYLGKLDVSFQRACQCEGKDNRIPLLKEVFEAFPNTPINIDIKVNNNVLIKKVSELVKRYNREHLTVWGNANYEIVEKCYKEAKRTTHHVQKSKVSHLAF

SEQ ID NO: 35505 - protein, 121 aa, Homo sapiens
  Payload ID: 7017
  Gene Symbol: GDPD1
  Gene Name: glycerophosphodiester phosphodiesterase domain containing 1
  ENSP ID: ENSP00000464351
SDIPILFSLQRVLLILGLFFTGLLPFVPIREQFFEIPMPSIILKLKEPHTMSRSQKFLIWLSDLLLMRKALFDHLTARGIQVYIWVLNEEQEYKRAFDLGATGVMTDYPTKLRDFLHNFSA

SEQ ID NO: 35506 - protein, 290 aa, Homo sapiens
  Payload ID: 7017
  Gene Symbol: GDPD1
  Gene Name: glycerophosphodiester phosphodiesterase domain containing 1
  Uniprot ID: Q8N9F7
  ENSP ID: ENSP00000464690
MSSTAAFYLLSTLGGYLVTSFLLLKYPTLLHQRKKQRFLSKHISHRGGAGENLENTMAAFQHAVKIGTDMLELDCHITKDEQVVVSHDENLKRATGVNVNISDLKYCELPPYLGKLDVSFQRACQCEGKDNRIPLLKEVFEAFPNTPINIDIKVNNNVLIKKVSELVKRYNREHLTVWGNANYEIVEKCYKENSDIPILFSLQRVLLILGLFFTGLLPFVPIREQFFEIPMPSIILKLKEPHTMSRSQKFLIWLSDLLLMRKALFDHLTARGIQVSFWNDAFWKQHSSPV

SEQ ID NO: 35507 - protein, 539 aa, Homo sapiens
  Payload ID: 7018
  Gene Symbol: GDPD2
  Gene Name: glycerophosphodiester phosphodiesterase domain containing 2
  Uniprot ID: Q9HCC8
  ENSP ID: ENSP00000363503
MAESPGCCSVWARCLHCLYSCHWRKCPRERMQTSKCDCIWFGLLFLTFLLSLSWLYIGLVLLNDLHNFNEFLFRRWGHWMDWSLAFLLVISLLVTYASLLLVLALLLRLCRQPLHLHSLHKVLLLLIMLLVAAGLVGLDIQWQQEWHSLRVSLQATAPFLHIGAAAGIALLAWPVADTFYRIHRRGPKILLLLLFFGVVLVIYLAPLCISSPCIMEPRDLPPKPGLVGHRGAPMLAPENTLMSLRKTAECGATVFETDVMVSSDGVPFLMHDEHLSRTTNVASVFPTRITAHSSDFSWTELKRLNAGSWFLERRPFWGAKPLAGPDQKEAESQTVPALEELLEEAAALNLSIMFDLRRPPQNHTYYDTFVIQTLETVLNARVPQAMVFWLPDEDRANVQRRAPGMRQIYGRQGGNRTERPQFLNLPYQDLPLLDIKALHKDNVSVNLFVVNKPWLFSLLWCAGVDSVTTNDCQLLQQMRYPIWLITPQTYLIIWVITNCVSTMLLLWTFLLQRRFVKKRGKTGLETAVLLTRINNFMME

SEQ ID NO: 35508 - protein, 590 aa, Homo sapiens
  Payload ID: 7018
  Gene Symbol: GDPD2
  Gene Name: glycerophosphodiester phosphodiesterase domain containing 2
  Uniprot ID: Q9HCC8
  ENSP ID: ENSP00000414019
MAESPGCCSVWARCLHCLYSCHWRKCPRERMQTSKCDCIWFGLLFLTFLLSLSWLYIGLVLLNDLHNFNEFLFRRWGHWMDWSLAFLLVISLLVTYASLLLVLALLLRLCRQPLHLHSLHKVLLLLIMLLVAAGLVGLDIQWQQEWHSLRVSLQATAPFLHIGAAAGIALLAWPVADTFYRIHRRGPKILLLLLFFGVVLVIYLAPLCISSPCIMEPRDLPPKPGLVGHRGAPMLAPENTLMSLRKTAECGATVFETDVMVSSDGVPFLMHDEHLSRTTNVASVFPTRITAHSSDFSWTELKRLNAGSWFLERRPFWGAKPLAGPDQKEAESQTVPALEELLEEAAALNLSIMFDLRRPPQNHTYYDTFVIQTLETVLNARVPQAMVFWLPDEDRANVQRRAPGMRQIYGRQGGNRTERPQFLNLPYQDLPLLDIKDRFLLPAQAGLKLLASSNLPASASQSAGITGLSHCPPQPPGYKHELSHLAMALHKDNVSVNLFVVNKPWLFSLLWCAGVDSVTTNDCQLLQQMRYPIWLITPQTYLIIWVITNCVSTMLLLWTFLLQRRFVKKRGKTGLETAVLLTRINNFMME

SEQ ID NO: 35509 - protein, 460 aa, Homo sapiens
  Payload ID: 7018
  Gene Symbol: GDPD2
  Gene Name: glycerophosphodiester phosphodiesterase domain containing 2
  Uniprot ID: Q9HCC8
  ENSP ID: ENSP00000444601
MDWSLAFLLVISLLVTYASLLLVLALLLRLCRQPLHLHSLHKVLLLLIMLLVAAGLVGLDIQWQQEWHSLRVSLQATAPFLHIGAAAGIALLAWPVADTFYRIHRRGPKILLLLLFFGVVLVIYLAPLCISSPCIMEPRDLPPKPGLVGHRGAPMLAPENTLMSLRKTAECGATVFETDVMVSSDGVPFLMHDEHLSRTTNVASVFPTRITAHSSDFSWTELKRLNAGSWFLERRPFWGAKPLAGPDQKEAESQTVPALEELLEEAAALNLSIMFDLRRPPQNHTYYDTFVIQTLETVLNARVPQAMVFWLPDEDRANVQRRAPGMRQIYGRQGGNRTERPQFLNLPYQDLPLLDIKALHKDNVSVNLFVVNKPWLFSLLWCAGVDSVTTNDCQLLQQMRYPIWLITPQTYLIIWVITNCVSTMLLLWTFLLQRRFVKKRGKTGLETAVLLTRINNFMME

SEQ ID NO: 35510 - protein, 460 aa, Homo sapiens; identical to SEQ ID NO: 35509
  Payload ID: 7018
  Gene Symbol: GDPD2
  Gene Name: glycerophosphodiester phosphodiesterase domain containing 2
  Uniprot ID: Q9HCC8
  ENSP ID: ENSP00000445982

SEQ ID NO: 35511 - protein, 318 aa, Homo sapiens
  Payload ID: 7019
  Gene Symbol: GDPD3
  Gene Name: glycerophosphodiester phosphodiesterase domain containing 3
  Uniprot ID: Q7L5L3
  ENSP ID: ENSP00000384363
MSLLLYYALPALGSYAMLSIFFLRRPHLLHTPRAPTFRIRLGAHRGGSGELLENTMEAMENSMAQRSDLLELDCQLTRDRVVVVSHDENLCRQSGLNRDVGSLDFEDLPLYKEKLEVYFSPGHFAHGSDRRMVRLEDLFQRFPRTPMSVEIKGKNEELIREIAGLVRRYDRNEITIWASEKSSVMKKCKAANPEMPLSFTISRGFWVLLSYYLGLLPFIPIPEKFFFCFLPNIINRTYFPFSCSCLNQLLAVVSKWLIMRKSLIRHLEERGVQVVFWCLNEESDFEAAFSVGATGVITDYPTALRHYLDNHGPAARTS

SEQ ID NO: 35512 - protein, 47 aa, Homo sapiens
  Payload ID: 7019
  Gene Symbol: GDPD3
  Gene Name: glycerophosphodiester phosphodiesterase domain containing 3
  ENSP ID: ENSP00000454472
  MOD_RES (1)..(1): Any amino acid
XINRTYFPFSCSCLNQLLAVVSKWWSFGALMKSRILKQPSAWEPLAS

SEQ ID NO: 35513 - protein, 41 aa, Homo sapiens
  Payload ID: 7019
  Gene Symbol: GDPD3
  Gene Name: glycerophosphodiester phosphodiesterase domain containing 3
  ENSP ID: ENSP00000455508
  MOD_RES (1)..(1): Any amino acid
XTYFPFSCSCLNQLLAVVSKWLIMRKSLIRHLEERGVQVRP

SEQ ID NO: 35514 - protein, 520 aa, Homo sapiens
  Payload ID: 7020
  Gene Symbol: GDPD4
  Gene Name: glycerophosphodiester phosphodiesterase domain containing 4
  Uniprot ID: Q6W3E5
  ENSP ID: ENSP00000320815
MLLFLWIETSSEYFNFDWVTFLGTGYWFFWSIFILSLARILTAYSSLLLLLGFLLLWERIELYLHLCHKILILLVILLCVILMFIICKFWKERWLVAGLSMQIFAPYVHLVSITVMVILFWPVAFYVACLEREVRMRRYRMTHSEKKRLKQCNVITRLRGLQVPVGLPFLLILLGLYLMPLGIYSPCIQEKENLGPKPTIFGHRGAPMLGPENTMMSFEKAVEHGAHGLETDIHLSYDHVPFLMHDFDLKRTTNIGEVQPESACENPAFFNWDFLSTLNAGKWFVKPELRPFYNMKPLSEADKERARNQSIPTLADLLTLAEKERKFVIFDLHRPPPKHPLRHTFVRQVVSVILASKIEQHLIFWLPAHDRQYVRSVAPGFQHVGRLVSIETLAKNNISIINVDYKKLFPNGLRDYKAANIHINVYTVNEPWLFSLAWCSRINSVTTDNIGLLSQLDHPHFFMTPKFYVFMWLLADIISVLFIVAIFCFHWRRETEKEKLFETSSTRTDTQSGSKNEEDR

SEQ ID NO: 35515 - protein, 623 aa, Homo sapiens
  Payload ID: 7020
  Gene Symbol: GDPD4
  Gene Name: glycerophosphodiester phosphodiesterase domain containing 4
  Uniprot ID: Q6W3E5
  ENSP ID: ENSP00000365390
MLLFLWIETSSEYFNFDWVTFLGTGYWFFWSIFILSLARILTAYSSLLLLLGFLLLWERIELYLHLCHKILILLVILLCVILMFIICKFWKERWLVAGLSMQIFAPYVHLVSITVMVILFWPVAFYVACLEREVRMRRYRMTHSEKKRLKQCNVITRLRGLQVPVGLPFLLILLGLYLMPLGIYSPCIQEKENLGPKPTIFGHRGAPMLGPENTMMSFEKAVEHGAHGLETDIHLSYDHVPFLMHDFDLKRTTNIGEVQPESACENPAFFNWDFLSTLNAGKWFVKPELRPFYNMKPLSEADKERARNQSIPTLADLLTLAEKERKFVIFDLHRPPPKHPLRHTFVRQVVSVILASKIEQHLIFWLPAHDRQYVRSVAPGFQHVGRLVSIETLAKNNISIINVDYKKLFPNGLRDYKAANIHINVYTVNEPWLFSLAWCSRINSVTTDNIGLLSQLDHPHFFMTPKFYVFMWLLADIISVLFIVAIFCFHWRRETEKEKLFETSSTRTDTQSGNLHIAMKPPVRVVEGPWTLAALYPALPKSGKEHQGHFNFAAPSKKLLPIKNAVTPLKPGKHEIQPPMPTVVFELTQAPTRQATSEATFQTTLPTLKVDKPTMPSIEVPYP

SEQ ID NO: 35516 - protein, 605 aa, Homo sapiens
  Payload ID: 7021
  Gene Symbol: GDPD5
  Gene Name: glycerophosphodiester phosphodiesterase domain containing 5
  Uniprot ID: Q8WTR4
  ENSP ID: ENSP00000337972
MVRHQPLQYYEPQLCLSCLTGIYGCRWKRYQRSHDDTTPWERLWFLLLTFTFGLTLTWLYFWWEVHNDYDEFNWYLYNRMGYWSDWPVPILVTTAAAFAYIAGLLVLALCHIAVGQQMNLHWLHKIGLVVILASTVVAMSAVAQLWEDEWEVLLISLQGTAPFLHVGAVAAVTMLSWIVAGQFARAERTSSQVTILCTFFTVVFALYLAPLTISSPCIMEKKDLGPKPALIGHRGAPMLAPEHTLMSFRKALEQKLYGLQADITISLDGVPFLMHDTTLRRTTNVEEEFPELARRPASMLNWTTLQRLNAGQWFLKTDPFWTASSLSPSDHREAQNQSICSLAELLELAKGNATLLLNLRDPPREHPYRSSFINVTLEAVLHSGFPQHQVMWLPSRQRPLVRKVAPGFQQTSGSKEAVASLRRGHIQRLNLRYTQVSRQELRDYASWNLSVNLYTVNAPWLFSLLWCAGVPSVTSDNSHALSQVPSPLWIMPPDEYCLMWVTADLVSFTLIVGIFVLQKWRLGGIRSYNPEQIMLSAAVRRTSRDVSIMKEKLIFSEISDGVEVSDVLSVCSDNSYDTYANSTATPVGPRGGGSHTKTLIERSGR

SEQ ID NO: 35517 - protein, 135 aa, Homo sapiens
  Payload ID: 7021
  Gene Symbol: GDPD5
  Gene Name: glycerophosphodiester phosphodiesterase domain containing 5
  ENSP ID: ENSP00000396535
MVRHQPLQYYEPQLCLSCLTGIYGCRWKRYQRSHDDTTPWERLWFLLLTFTFGLTLTWLYFWWEVHNDYDEFNWYLYNRMGYWSDWPVPILVTTAAAFAYIAGLLVLALCHIAVGQQMNLHWLHKASSGLPLSPL

SEQ ID NO: 35518 - protein, 605 aa, Homo sapiens; identical to SEQ ID NO: 35516
  Payload ID: 7021
  Gene Symbol: GDPD5
  Gene Name: glycerophosphodiester phosphodiesterase domain containing 5
  Uniprot ID: Q8WTR4
  ENSP ID: ENSP00000433214

SEQ ID NO: 35519 - protein, 73 aa, Homo sapiens
  Payload ID: 7021
  Gene Symbol: GDPD5
  Gene Name: glycerophosphodiester phosphodiesterase domain containing 5
  ENSP ID: ENSP00000433727
MVRHQPLQYYEPQLCLSCLTGIYGCRWKRYQRSHDDTTPWERLWFLLLTFTFGLTLTWLYFWWEVHNDYDEFN

SEQ ID NO: 35520 - protein, 467 aa, Homo sapiens
  Payload ID: 7021
  Gene Symbol: GDPD5
  Gene Name: glycerophosphodiester phosphodiesterase domain containing 5
  Uniprot ID: Q8WTR4
  ENSP ID: ENSP00000434050
MSAVAQLWEDEWEVLLISLQGTAPFLHVGAVAAVTMLSWIVAGQFARAERTSSQVTILCTFFTVVFALYLAPLTISSPCIMEKKDLGPKPALIGHRGAPMLAPEHTLMSFRKALEQKLYGLQADITISLDGVPFLMHDTTLRRTTNVEEEFPELARRPASMLNWTTLQRLNAGQWFLKTDPFWTASSLSPSDHREAQNQSICSLAELLELAKGNATLLLNLRDPPREHPYRSSFINVTLEAVLHSGFPQHQVMWLPSRQRPLVRKVAPGFQQTSGSKEAVASLRRGHIQRLNLRYTQVSRQELRDYASWNLSVNLYTVNAPWLFSLLWCAGVPSVTSDNSHALSQVPSPLWIMPPDEYCLMWVTADLVSFTLIVGIFVLQKWRLGGIRSYNPEQIMLSAAVRRTSRDVSIMKEKLIFSEISDGVEVSDVLSVCSDNSYDTYANSTATPVGPRGGGSHTKTLIERSGR

SEQ ID NO: 35521 - protein, 360 aa, Homo sapiens
  Payload ID: 7021
  Gene Symbol: GDPD5
  Gene Name: glycerophosphodiester phosphodiesterase domain containing 5
  Uniprot ID: Q8WTR4
  ENSP ID: ENSP00000435196
MSFRKALEQKLYGLQADITISLDGVPFLMHDTTLRRTTNVEEEFPELARRPASMLNWTTLQRLNAGQWFLKTDPFWTASSLSPSDHREAQNQSICSLAELLELAKGNATLLLNLRDPPREHPYRSSFINVTLEAVLHSGFPQHQVMWLPSRQRPLVRKVAPGFQQTSGSKEAVASLRRGHIQRLNLRYTQVSRQELRDYASWNLSVNLYTVNAPWLFSLLWCAGVPSVTSDNSHALSQVPSPLWIMPPDEYCLMWVTADLVSFTLIVGIFVLQKWRLGGIRSYNPEQIMLSAAVRRTSRDVSIMKEKLIFSEISDGVEVSDVLSVCSDNSYDTYANSTATPVGPRGGGSHTKTLIERSGR

SEQ ID NO: 35522 - protein, 175 aa, Homo sapiens
  Payload ID: 7021
  Gene Symbol: GDPD5
  Gene Name: glycerophosphodiester phosphodiesterase domain containing 5
  ENSP ID: ENSP00000435728
AVASLRRGHIQRLNLRYTQVSRQELRDYASWNLSVNLYTVNAPWLFSLLWCAGVPSVTSDNSHALSQVPSPLWIMPPDEYCLMWVTADLVSFTLIVGIFVLQNYHLIRWRLGGIRSYNPEQIMLSAAVRRTSRDVSIMKEKLIFSEISDGVEVSDVLSVCSDNSYDTYANSTATP

SEQ ID NO: 35523 - protein, 486 aa, Homo sapiens
  Payload ID: 7021
  Gene Symbol: GDPD5
  Gene Name: glycerophosphodiester phosphodiesterase domain containing 5
  Uniprot ID: Q8WTR4
  ENSP ID: ENSP00000437049
MVRHQPLQYYEPQLCLSCLTGIYGCRWKRYQRSHDDTTPGTAPFLHVGAVAAVTMLSWIVAGQFARAERTSSQVTILCTFFTVVFALYLAPLTISSPCIMEKKDLGPKPALIGHRGAPMLAPEHTLMSFRKALEQKLYGLQADITISLDGVPFLMHDTTLRRTTNVEEEFPELARRPASMLNWTTLQRLNAGQWFLKTDPFWTASSLSPSDHREAQNQSICSLAELLELAKGNATLLLNLRDPPREHPYRSSFINVTLEAVLHSGFPQHQVMWLPSRQRPLVRKVAPGFQQTSGSKEAVASLRRGHIQRLNLRYTQVSRQELRDYASWNLSVNLYTVNAPWLFSLLWCAGVPSVTSDNSHALSQVPSPLWIMPPDEYCLMWVTADLVSFTLIVGIFVLQKWRLGGIRSYNPEQIMLSAAVRRTSRDVSIMKEKLIFSEISDGVEVSDVLSVCSDNSYDTYANSTATPVGPRGGGSHTKTLIERSGR

SEQ ID NO: 35524 - protein, 135 aa, Homo sapiens; identical to SEQ ID NO: 35517
  Payload ID: 7021
  Gene Symbol: GDPD5
  Gene Name: glycerophosphodiester phosphodiesterase domain containing 5
  ENSP ID: ENSP00000437123

SEQ ID NO: 35525 - protein, 423 aa, Homo sapiens
  Payload ID: 7022
  Gene Symbol: GATM
  Gene Name: glycine amidinotransferase (L-arginine:glycine amidinotransferase)
  Uniprot ID: P50440
  ENSP ID: ENSP00000379895
MLRVRCLRGGSRGAEAVHYIGSRLGRTLTGWVQRTFQSTQAATASSRNSCAADDKATEPLPKDCPVSSYNEWDPLEEVIVGRAENACVPPFTIEVKANTYEKYWPFYQKQGGHYFPKDHLKKAVAEIEEMCNILKTEGVTVRRPDPIDWSLKYKTPDFESTGLYSAMPRDILIVVGNEIIEAPMAWRSRFFEYRAYRSIIKDYFHRGAKWTTAPKPTMADELYNQDYPIHSVEDRHKLAAQGKFVTTEFEPCFDAADFIRAGRDIFAQRSQVTNYLGIEWMRRHLAPDYRVHIISFKDPNPMHIDATFNIIGPGIVLSNPDRPCHQIDLFKKAGWTIITPPTPIIPDDHPLWMSSKWLSMNVLMLDEKRVMVDANEVPIQKMFEKLGITTIKVNIRNANSLGGGFHCWTCDVRRRGTLQSYLD

SEQ ID NO: 35526 - protein, 96 aa, Homo sapiens
  Payload ID: 7022
  Gene Symbol: GATM
  Gene Name: glycine amidinotransferase (L-arginine:glycine amidinotransferase)
  ENSP ID: ENSP00000452971
MLRVRCLRGGSRGAEAVHYIGSRLGRTLTGWVQRTFQSTQAATASSRNSCAADDKATEPLPKDCPVSSYNEWDPLEEVIVGRAENACVPPFTIEVK

SEQ ID NO: 35527 - protein, 15 aa, Homo sapiens
  Payload ID: 7022
  Gene Symbol: GATM
  Gene Name: glycine amidinotransferase (L-arginine:glycine amidinotransferase)
  ENSP ID: ENSP00000453087
MCNILKTEGVTVRRP

SEQ ID NO: 35528 - protein, 32 aa, Homo sapiens
  Payload ID: 7022
  Gene Symbol: GATM
  Gene Name: glycine amidinotransferase (L-arginine:glycine amidinotransferase)
  ENSP ID: ENSP00000453151
MCNILKTEGVTVRRPDPIDWSLKYKTPDFEST

SEQ ID NO: 35529 - protein, 167 aa, Homo sapiens
  Payload ID: 7022
  Gene Symbol: GATM
  Gene Name: glycine amidinotransferase (L-arginine:glycine amidinotransferase)
  ENSP ID: ENSP00000453781
MLRVRCLRGGSRGAEAVHYIGSRANTYEKYWPFYQKQGGHYFPKDHLKKAVAEIEEMCNILKTEGVTVRRPDPIDWSLKYKTPDFESTGLYSAMPRDILIVVGNEIIEAPMAWRSRFFEYRAYRSIIKDYFHRGAKWTTAPKPTMADELYNQDYPIHSVEDRHKLAA

SEQ ID NO: 35530 - protein, 31 aa, Homo sapiens
  Payload ID: 7022
  Gene Symbol: GATM
  Gene Name: glycine amidinotransferase (L-arginine:glycine amidinotransferase)
  ENSP ID: ENSP00000453860
MCNILKTEGVTVRRPDPIDWSLKYKTPDFES

SEQ ID NO: 35531 - protein, 391 aa, Homo sapiens
  Payload ID: 7022
  Gene Symbol: GATM
  Gene Name: glycine amidinotransferase (L-arginine:glycine amidinotransferase)
  Uniprot ID: P50440
  ENSP ID: ENSP00000454008
MLRVRCLRGGSRGAEAVHYIGSRLGRTLTGWVQRTFQSTQAATASSRNSCAADDKATEPLPKDCPVSSYNEWDPLEEVIVGRAENACVPPFTIEVKANTYEKYWPFYQKQGGHYFPKDHLKKAVAEIEEMCNILKTEGVTVRRPDPIDWSLKYKTPDFESTGLYSAMPRDILIVVGNEIIEAPMAWRSRFFEYRAYRSIIKDYFHRGAKWTTAPKPTMADELYNQDYPIHSVEDRHKLAAQGKFVTTEFEPCFDAADFIRAGRDIFAQRSQVTNYLGIEWMRRHLAPDYRVHIISFKDPNPMHIDATFNIIGPGIVLSNPDRPCHQIDLFKKAGWTIITPPTPIIPDDHPLWMSSKWLSMNVLMLDEKRVMVDANEVPIQKMFEKLGMYNK

SEQ ID NO: 35532 - protein, 419 aa, Homo sapiens
  Payload ID: 7023
  Gene Symbol: GCAT
  Gene Name: glycine C-acetyltransferase
  Uniprot ID: O75600
  ENSP ID: ENSP00000248924
MWPGNAWRAALFWVPRGRRAQSALAQLRGILEGELEGIRGAGTWKSERVITSRQGPHIRVDGVSGGILNFCANNYLGLSSHPEVIQAGLQALEEFGAGLSSVRFICGTQSIHKNLEAKIARFHQREDAILYPSCYDANAGLFEALLTPEDAVLSDELNHASIIDGIRLCKAHKYRYRHLDMADLEAKLQEAQKHRLRLVATDGAFSMDGDIAPLQEICCLASRYGALVFMDECHATGFLGPTGRGTDELLGVMDQVTIINSTLGKALGGASGGYTTGPGPLVSLLRQRARPYLFSNSLPPAVVGCASKALDLLMGSNTIVQSMAAKTQRFRSKMEAAGFTISGASHPICPVMLGDARLASRMADDMLKRGIFVIGFSYPVVPKGKARIRVQISAVHSEEDIDRCVEAFVEVGRLHGALP

SEQ ID NO: 35533 - protein, 445 aa, Homo sapiens
  Payload ID: 7023
  Gene Symbol: GCAT
  Gene Name: glycine C-acetyltransferase
  Uniprot ID: O75600
  ENSP ID: ENSP00000371110
MWPGNAWRAALFWVPRGRRAQSALAQLRGILEGELEGIRGAGTWKSERVITSRQGPHIRVDGVSGGPGTVIFPGLPLPHLSCCIHLLSFTSGILNFCANNYLGLSSHPEVIQAGLQALEEFGAGLSSVRFICGTQSIHKNLEAKIARFHQREDAILYPSCYDANAGLFEALLTPEDAVLSDELNHASIIDGIRLCKAHKYRYRHLDMADLEAKLQEAQKHRLRLVATDGAFSMDGDIAPLQEICCLASRYGALVFMDECHATGFLGPTGRGTDELLGVMDQVTIINSTLGKALGGASGGYTTGPGPLVSLLRQRARPYLFSNSLPPAVVGCASKALDLLMGSNTIVQSMAAKTQRFRSKMEAAGFTISGASHPICPVMLGDARLASRMADDMLKRGIFVIGFSYPVVPKGKARIRVQISAVHSEEDIDRCVEAFVEVGRLHGALP

SEQ ID NO: 35534 - protein, 239 aa, Homo sapiens
  Payload ID: 7023
  Gene Symbol: GCAT
  Gene Name: glycine C-acetyltransferase
  ENSP ID: ENSP00000388151
  MOD_RES (1)..(1): Any amino acid
XGRRAQSALAQLRGILEGELEGIRGAGTWKSERVITSRQGPHIRVDGVSGGILNFCANNYLGLSSHPEVIQAGLQALEEFGAGLSSVRFICGTQSIHKNLEAKIARFHQREDAILYPSCYDANAGLFESRALVQPGTETRGPQREAQNTLPLYPEERPGWQYSFLICWSPGQGRSPGWLNDGSTLTASLQALLTPEDAVLSDELNHASIIDGIRLCKAHKYRYRHLDMADLEAKLQEAQ

SEQ ID NO: 35535 - protein, 91 aa, Homo sapiens
  Payload ID: 7023
  Gene Symbol: GCAT
  Gene Name: glycine C-acetyltransferase
  ENSP ID: ENSP00000402213
MWPGNAWRAALFWVPRGRRAQSALAQLRGILEGELEGIRGAGTWKSERVITSRQGPHIRVDGVSGEHPQESRSKNSPLPPAGGCHPLSQLL

SEQ ID NO: 35536 - protein, 177 aa, Homo sapiens
  Payload ID: 7023
  Gene Symbol: GCAT
  Gene Name: glycine C-acetyltransferase
  ENSP ID: ENSP00000406719
MWPGNAWRAALFWVPRGRRAQSALAQLRGILEGELEGIRGAGTWKSERVITSRQGPHIRVDGVSGGPGTVIFPGLPLPHLSCCIHLLSFTSGILNFCANNYLGLSSHPEVIQAGLQALEEFGAGLSSVRFICGTQSIHKNLEAKIARFHQREDAILYPSCYDANAGLFESRALVQPG

SEQ ID NO: 35537 - protein, 173 aa, Homo sapiens
  Payload ID: 7024
  Gene Symbol: GCSH
  Gene Name: glycine cleavage system protein H (aminomethyl carrier)
  Uniprot ID: P23434
  ENSP ID: ENSP00000319531
MALRVVRSVRALLCTLRAVPSPAAPCPPRPWQLGVGAVRTLRTGPALLSVRKFTEKHEWVTTENGIGTVGISNFAQEALGDVVYCSLPEVGTKLNKQDEFGALESVKAASELYSPLSGEVTEINEALAENPGLVNKSCYEDGWLIKMTLSNPSELDELMSEEAYEKYIKSIEE

SEQ ID NO: 35538 - protein, 162 aa, Homo sapiens
  Payload ID: 7024
  Gene Symbol: GCSH
  Gene Name: glycine cleavage system protein H (aminomethyl carrier)
  ENSP ID: ENSP00000455019
MALRVVRSVRALLCTLRAVPSPAAPCPPRPWQLGVGAVRTLRTGPALLSVRKFTEKHEWVTTENGIGTVGISNFAQEALGDVVYCSLPEVGTKLNKQDEFGALESVKAASELYSPLSGEVTEINEALAENPGLVNKSCYEDGKLLLEISQGITTTVNILSRI

SEQ ID NO: 35539 - protein, 50 aa, Homo sapiens
  Payload ID: 7024
  Gene Symbol: GCSH
  Gene Name: glycine cleavage system protein H (aminomethyl carrier)
  ENSP ID: ENSP00000455287
MALRVVRSVRALLCTLRAVPSPAAPCPPRPWQLGVGAVRTLRTGPALLSG

SEQ ID NO: 35540 - protein, 66 aa, Homo sapiens
  Payload ID: 7024
  Gene Symbol: GCSH
  Gene Name: glycine cleavage system protein H (aminomethyl carrier)
  ENSP ID: ENSP00000455579
  MOD_RES (1)..(1): Any amino acid
XCTLRAVPSPAAPCPPRPWQLGVGAVRTLRTGPALLSVRKFTEKHEWVTTENGIGTVGISNFAQVG

SEQ ID NO: 35541 - protein, 79 aa, Homo sapiens
  Payload ID: 7024
  Gene Symbol: GCSH
  Gene Name: glycine cleavage system protein H (aminomethyl carrier)
  ENSP ID: ENSP00000457630
  MOD_RES (1)..(1): Any amino acid
XRSVRALLCTLRAVPSPAAPCPPRPWQLGVGAVRTLRTGPALLSVRKFTEKHEWVTTENGIGTVGISNFAQMSLVLWKV

SEQ ID NO: 35542 - protein, 43 aa, Homo sapiens
  Payload ID: 7024
  Gene Symbol: GCSH
  Gene Name: glycine cleavage system protein H (aminomethyl carrier)
  ENSP ID: ENSP00000457645
  MOD_RES (1)..(1): Any amino acid
XRAGPALHPARGPVTRRALPAEALAAGGGRRPYAAHWTRSALG

SEQ ID NO: 35543 - protein, 1020 aa, Homo sapiens
  Payload ID: 7025
  Gene Symbol: GLDC
  Gene Name: glycine dehydrogenase (decarboxylating)
  Uniprot ID: P23378
  ENSP ID: ENSP00000370737
MQSCARAWGLRLGRGVGGGRRLAGGSGPCWAPRSRDSSSGGGDSAAAGASRLLERLLPRHDDFARRHIGPGDKDQREMLQTLGLASIDELIEKTVPANIRLKRPLKMEDPVCENEILATLHAISSKNQIWRSYIGMGYYNCSVPQTILRNLLENSGWITQYTPYQPEVSQGRLESLLNYQTMVCDITGLDMANASLLDEGTAAAEALQLCYRHNKRRKFLVDPRCHPQTIAVVQTRAKYTGVLTELKLPCEMDFSGKDVSGVLFQYPDTEGKVEDFTELVERAHQSGSLACCATDLLALCILRPPGEFGVDIALGSSQRFGVPLGYGGPHAAFFAVRESLVRMMPGRMVGVTRDATGKEVYRLALQTREQHIRRDKATSNICTAQALLANMAAMFAIYHGSHGLEHIARRVHNATLILSEGLKRAGHQLQHDLFFDTLKIQCGCSVKEVLGRAAQRQINFRLFEDGTLGISLDETVNEKDLDDLLWIFGCESSAELVAESMGEECRGIPGSVFKRTSPFLTHQVFNSYHSETNIVRYMKKLENKDISLVHSMIPLGSCTMKLNSSSELAPITWKEFANIHPFVPLDQAQGYQQLFRELEKDLCELTGYDQVCFQPNSGAQGEYAGLATIRAYLNQKGEGHRTVCLIPKSAHGTNPASAHMAGMKIQPVEVDKYGNIDAVHLKAMVDKHKENLAAIMITYPSTNGVFEENISDVCDLIHQHGGQVYLDGANMNAQVGICRPGDFGSDVSHLNLHKTFCIPHGGGGPGMGPIGVKKHLAPFLPNHPVISLKRNEDACPVGTVSAAPWGSSSILPISWAYIKMMGGKGLKQATETAILNANYMAKRLETHYRILFRGARGYVGHEFILDTRPFKKSANIEAVDVAKRLQDYGFHAPTMSWPVAGTLMVEPTESEDKAELDRFCDAMISIRQEIADIEEGRIDPRVNPLKMSPHSLTCVTSSHWDRPYSREVAAFPLPFVKPENKFWPTIARIDDIYGDQHLVCTCPPMEVYESPFSEQKRASS

SEQ ID NO: 35544 - protein, 295 aa, Homo sapiens
  Payload ID: 7026
  Gene Symbol: GNMT
  Gene Name: glycine N-methyltransferase
  Uniprot ID: Q14749
  ENSP ID: ENSP00000361894
MVDSVYRTRSLGVAAEGLPDQYADGEAARVWQLYIGDTRSRTAEYKAWLLGLLRQHGCQRVLDVACGTGVDSIMLVEEGFSVTSVDASDKMLKYALKERWNRRHEPAFDKWVIEEANWMTLDKDVPQSAEGGFDAVICLGNSFAHLPDCKGDQSEHRLALKNIASMVRAGGLLVIDHRNYDHILSTGCAPPGKNIYYKSDLTKDVTTSVLIVNNKAHMVTLDYTVQVPGAGQDGSPGLSKFRLSYYPHCLASFTELLQAAFGGKCQHSVLGDFKPYKPGQTYIPCYFIHVLKRTD

SEQ ID NO: 35545 - protein, 449 aa, Homo sapiens
  Payload ID: 7027
  Gene Symbol: GLRA1
  Gene Name: glycine receptor, alpha 1
  Uniprot ID: P23415
  ENSP ID: ENSP00000274576
MYSFNTLRLYLWETIVFFSLAASKEAEAARSAPKPMSPSDFLDKLMGRTSGYDARIRPNFKGPPVNVSCNIFINSFGSIAETTMDYRVNIFLRQQWNDPRLAYNEYPDDSLDLDPSMLDSIWKPDLFFANEKGAHFHEITTDNKLLRISRNGNVLYSIRITLTLACPMDLKNFPMDVQTCIMQLESFGYTMNDLIFEWQEQGAVQVADGLTLPQFILKEEKDLRYCTKHYNTGKFTCIEARFHLERQMGYYLIQMYIPSLLIVILSWISFWINMDAAPARVGLGITTVLTMTTQSSGSRASLPKVSYVKAIDIWMAVCLLFVFSALLEYAAVNFVSRQHKELLRFRRKRRHHKEDEAGEGRFNFSAYGMGPACLQAKDGISVKGANNSNTTNPPPAPSKSPEEMRKLFIQRAKKIDKISRIGFPMAFLIFNMFYWIIYKIVRREDVHNQ

SEQ ID NO: 35546 - protein, 457 aa, Homo sapiens
  Payload ID: 7027
  Gene Symbol: GLRA1
  Gene Name: glycine receptor, alpha 1
  Uniprot ID: P23415
  ENSP ID: ENSP00000411593
MYSFNTLRLYLWETIVFFSLAASKEAEAARSAPKPMSPSDFLDKLMGRTSGYDARIRPNFKGPPVNVSCNIFINSFGSIAETTMDYRVNIFLRQQWNDPRLAYNEYPDDSLDLDPSMLDSIWKPDLFFANEKGAHFHEITTDNKLLRISRNGNVLYSIRITLTLACPMDLKNFPMDVQTCIMQLESFGYTMNDLIFEWQEQGAVQVADGLTLPQFILKEEKDLRYCTKHYNTGKFTCIEARFHLERQMGYYLIQMYIPSLLIVILSWISFWINMDAAPARVGLGITTVLTMTTQSSGSRASLPKVSYVKAIDIWMAVCLLFVFSALLEYAAVNFVSRQHKELLRFRRKRRHHKSPMLNLFQEDEAGEGRFNFSAYGMGPACLQAKDGISVKGANNSNTTNPPPAPSKSPEEMRKLFIQRAKKIDKISRIGFPMAFLIFNMFYWIIYKIVRREDVHNQ

SEQ ID NO: 35547 - protein, 37 aa, Homo sapiens
  Payload ID: 7027
  Gene Symbol: GLRA1
  Gene Name: glycine receptor, alpha 1
  ENSP ID: ENSP00000430595
MYSFNTLRLYLWETIVFFRSPSERELQHFHQQLWFHC

SEQ ID NO: 35548 - protein, 452 aa, Homo sapiens [sequence omitted]

SEQ ID NO: 35549 - protein, 452 aa, Homo sapiens
  Payload ID: 7028
  Gene Symbol: GLRA2
  Gene Name: glycine receptor, alpha 2
  Uniprot ID: P23416
  ENSP ID: ENSP00000347123
MNRQLVNILTALFAFFLETNHFRTAFCKDHDSRSGKQPSQTLSPSDFLDKLMGRTSGYDARIRPNFKGPPVNVTCNIFINSFGSIAETTMDYRVNIFLRQQWNDSRLAYSEYPDDSLDLDPSMLDSIWKPDLFFANEKGANFHDVTTDNKLLRISKNGKVLYSIRLTLTLSCPMDLKNFPMDVQTCTMQLESFGYTMNDLIFEWLSDGPVQVAEGLTLPQFILKEEKELGYCTKHYNTGKFTCIEVKFHLERQMGYYLIQMYIPSLLIVILSWVSFWINMDAAPARVALGITTVLTMTTQSSGSRASLPKVSYVKAIDIWMAVCLLFVFAALLEYAAVNFVSRQHKEFLRLRRRQKRQNKEEDVTRESRFNFSGYGMGHCLQVKDGTAVKATPANPLPQPPKDGDAIKKKFVDRAKRIDTISRAAFPLAFLIFNIFYWITYKIIRHEDVHKK

SEQ ID NO: 35550 - protein, 363 aa, Homo sapiens
  Payload ID: 7028
  Gene Symbol: GLRA2
  Gene Name: glycine receptor, alpha 2
  Uniprot ID: P23416
  ENSP ID: ENSP00000387756
MDYRVNIFLRQQWNDSRLAYSEYPDDSLDLDPSMLDSIWKPDLFFANEKGANFHDVTTDNKLLRISKNGKVLYSIRLTLTLSCPMDLKNFPMDVQTCTMQLESFGYTMNDLIFEWLSDGPVQVAEGLTLPQFILKEEKELGYCTKHYNTGKFTCIEVKFHLERQMGYYLIQMYIPSLLIVILSWVSFWINMDAAPARVALGITTVLTMTTQSSGSRASLPKVSYVKAIDIWMAVCLLFVFAALLEYAAVNFVSRQHKEFLRLRRRQKRQNKEEDVTRESRFNFSGYGMGHCLQVKDGTAVKATPANPLPQPPKDGDAIKKKFVDRAKRIDTISRAAFPLAFLIFNIFYWITYKIIRHEDVHKK

SEQ ID NO: 35551 - protein, 215 aa, Homo sapiens
  Payload ID: 7028
  Gene Symbol: GLRA2
  Gene Name: glycine receptor, alpha 2
  ENSP ID: ENSP00000391606
MNLHMRMTAFCKDHDSRSGKQPSQTLSPSDFLDKLMGRTSGYDARIRPNFKGPPVNVTCNIFINSFGSVTETTMDYRVNIFLRQQWNDSRLAYSEYPDDSLDLDPSMLDSIWKPDLFFANEKGANFHDVTTDNKLLRISKNGKVLYSIRLTLTLSCPMDLKNFPMDVQTCTMQLESFGYTMNDLIFEWLSDGPVQVAEGLTLPQFILKEEKELGY

SEQ ID NO: 35552 - protein, 464 aa, Homo sapiens
  Payload ID: 7029
  Gene Symbol: GLRA3
  Gene Name: glycine receptor, alpha 3
  Uniprot ID: O75311
  ENSP ID: ENSP00000274093
MAHVRHFRTLVSGFYFWEAALLLSLVATKETDSARSRSAPMSPSDFLDKLMGRTSGYDARIRPNFKGPPVNVTCNIFINSFGSIAETTMDYRVNIFLRQKWNDPRLAYSEYPDDSLDLDPSMLDSIWKPDLFFANEKGANFHEVTTDNKLLRIFKNGNVLYSIRLTLTLSCPMDLKNFPMDVQTCIMQLESFGYTMNDLIFEWQDEAPVQVAEGLTLPQFLLKEEKDLRYCTKHYNTGKFTCIEVRFHLERQMGYYLIQMYIPSLLIVILSWVSFWINMDAAPARVALGITTVLTMTTQSSGSRASLPKVSYVKAIDIWMAVCLLFVFSALLEYAAVNFVSRQHKELLRFRRKRKNKTEAFALEKFYRFSDMDDEVRESRFSFTAYGMGPCLQAKDGMTPKGPNHPVQVMPKSPDEMRKVFIDRAKKIDTISRACFPLAFLIFNIFYWVIYKILRHEDIHQQQD

SEQ ID NO: 35553 - protein, 449 aa, Homo sapiens
  Payload ID: 7029
  Gene Symbol: GLRA3
  Gene Name: glycine receptor, alpha 3
  Uniprot ID: O75311
  ENSP ID: ENSP00000345284
MAHVRHFRTLVSGFYFWEAALLLSLVATKETDSARSRSAPMSPSDFLDKLMGRTSGYDARIRPNFKGPPVNVTCNIFINSFGSIAETTMDYRVNIFLRQKWNDPRLAYSEYPDDSLDLDPSMLDSIWKPDLFFANEKGANFHEVTTDNKLLRIFKNGNVLYSIRLTLTLSCPMDLKNFPMDVQTCIMQLESFGYTMNDLIFEWQDEAPVQVAEGLTLPQFLLKEEKDLRYCTKHYNTGKFTCIEVRFHLERQMGYYLIQMYIPSLLIVILSWVSFWINMDAAPARVALGITTVLTMTTQSSGSRASLPKVSYVKAIDIWMAVCLLFVFSALLEYAAVNFVSRQHKELLRFRRKRKNKDDEVRESRFSFTAYGMGPCLQAKDGMTPKGPNHPVQVMPKSPDEMRKVFIDRAKKIDTISRACFPLAFLIFNIFYWVIYKILRHEDIHQQQD

SEQ ID NO: 35554 - protein, 417 aa, Homo sapiens
  Payload ID: 7030
  Gene Symbol: GLRA4
  Gene Name: glycine receptor, alpha 4
  Uniprot ID: Q5JXX5
  ENSP ID: ENSP00000361700
MTTLVPATLSFLLLWTLPGQVLLRVALAKEEVKSGTKGSQPMSPSDFLDKLMGRTSGYDARIRPNFKGPPVNVTCNIFINSFSSITKTTMDYRVNVFLRQQWNDPRLSYREYPDDSLDLDPSMLDSIWKPDLFFANEKGANFHEVTTDNKLLRIFKNGNVLYSIRLTLILSCLMDLKNFPMDIQTCTMQLESFGYTMKDLVFEWLEDAPAVQVAEGLTLPQFILRDEKDLGCCTKHYNTGKFTCIEVKFHLERQMGYYLIQMYIPSLLIVILSWVSFWINMDAAPARVGLGITTVLTMTTQSSGSRASLPKVSYVKAIDIWMAVCLLFVFAALLEYAAINFVSRQHKEFIRLRRRQRRQRLEEDIIQESRFYFRGYGLGHCLQARDGGPMEGSGIYSPQPPAPLLREGETTRKLYVD

SEQ ID NO: 35555 - protein, 44 aa, Homo sapiens
  Payload ID: 7030
  Gene Symbol: GLRA4
  Gene Name: glycine receptor, alpha 4
  ENSP ID: ENSP00000412480
MTTLVPATLSFLLLWTLPGQVLLSRQVAGGQKQQQHLASVDILW

SEQ ID NO: 35556 - protein, 497 aa, Homo sapiens
  Payload ID: 7031
  Gene Symbol: GLRB
  Gene Name: glycine receptor, beta
  Uniprot ID: P48167
  ENSP ID: ENSP00000264428
MKFLLTTAFLILISLWVEEAYSKEKSSKKGKGKKKQYLCPSQQSAEDLARVPANSTSNILNRLLVSYDPRIRPNFKGIPVDVVVNIFINSFGSIQETTMDYRVNIFLRQKWNDPRLKLPSDFRGSDALTVDPTMYKCLWKPDLFFANEKSANFHDVTQENILLFIFRDGDVLVSMRLSITLSCPLDLTLFPMDTQRCKMQLESFGYTTDDLRFIWQSGDPVQLEKIALPQFDIKKEDIEYGNCTKYYKGTGYYTCVEVIFTLRRQVGFYMMGVYAPTLLIVVLSWLSFWINPDASAARVPLGIFSVLSLASECTTLAAELPKVSYVKALDVWLIACLLFGFASLVEYAVVQVMLNNPKRVEAEKARIAKAEQADGKGGNVAKKNTVNGTGTPVHISTLQVGETRCKKVCTSKSDLRSNDFSIVGSLPRDFELSNYDCYGKPIEVNNGLGKSQAKNNKKPPPAKPVIPTAAKRIDLYARALFPFCFLFFNVIYWSIYL

SEQ ID NO: 35557 - protein, 46 aa, Homo sapiens
  Payload ID: 7031
  Gene Symbol: GLRB
  Gene Name: glycine receptor, beta
  ENSP ID: ENSP00000421044
MKFLLTTAFLILISLWVEEAYSKEKSSKKGKGKKKQYLCPSERLYH

SEQ ID NO: 35558 - protein, 46 aa, Homo sapiens; identical to SEQ ID NO: 35557
  Payload ID: 7031
  Gene Symbol: GLRB
  Gene Name: glycine receptor, beta
  ENSP ID: ENSP00000422039

SEQ ID NO: 35559 - protein, 56 aa, Homo sapiens
  Payload ID: 7031
  Gene Symbol: GLRB
  Gene Name: glycine receptor, beta
  ENSP ID: ENSP00000425433
MKFLLTTAFLILISLWVEEAYSKEKSSKKGKGKKKQYLCPSLVRPDAKKFVLLSLI

SEQ ID NO: 35560 - protein, 497 aa, Homo sapiens; identical to SEQ ID NO: 35556
  Payload ID: 7031
  Gene Symbol: GLRB
  Gene Name: glycine receptor, beta
  Uniprot ID: P48167
  ENSP ID: ENSP00000427186

SEQ ID NO: 35561 - protein, 303 aa, Homo sapiens
  Payload ID: 7031
  Gene Symbol: GLRB
  Gene Name: glycine receptor, beta
  Uniprot ID: P48167
  ENSP ID: ENSP00000441873
MKFLLTTAFLILISLWVEEAYSKEKSSKKGKGKKKQYLCPSQQSAEDLARVPANSTSNILNRLLVSYDPRIRPNFKGIPVDVVVNIFINSFGSIQETTMDYRVNIFLRQKWNDPRLKLPSDFRGSDALTVDPTMYKCLWKPDLFFANEKSANFHDVTQENILLFIFRDGDVLVSMRLSITLSCPLDLTLFPMDTQRCKMQLESFGYTTDDLRFIWQSGDPVQLEKIALPQFDIKKEDIEYGNCTKYYKGTGYYTCVEVIFTLRRQVGFYMMGVYAPTLLIVVLSWLSFWINPDASAARVPLGW

SEQ ID NO: 35562 - protein, 163 aa, Homo sapiens
  Payload ID: 7032
  Gene Symbol: GLYAT
  Gene Name: glycine-N-acyltransferase
  Uniprot ID: Q6IB77
  ENSP ID: ENSP00000278400
MMLPLQGAQMLQMLEKSLRKSLPASLKVYGTVFHINHGNPFNLKAVVDKWPDFNTVVVCPQEQDMTDDLDHYTNTYQIYSKDPQNCQEFLGSPELINWKQHLQIQSSQPSLNEAIQNLAAIKSFKVKQTQRILYMAAETAKELTPFLLKSKILSPNGGKPKAM

SEQ ID NO: 35563 - protein, 296 aa, Homo sapiens
  Payload ID: 7032
  Gene Symbol: GLYAT
  Gene Name: glycine-N-acyltransferase
  Uniprot ID: Q6IB77
  ENSP ID: ENSP00000340200
MMLPLQGAQMLQMLEKSLRKSLPASLKVYGTVFHINHGNPFNLKAVVDKWPDFNTVVVCPQEQDMTDDLDHYTNTYQIYSKDPQNCQEFLGSPELINWKQHLQIQSSQPSLNEAIQNLAAIKSFKVKQTQRILYMAAETAKELTPFLLKSKILSPNGGKPKAINQEMFKLSSMDVTHAHLVNKFWHFGGNERSQRFIERCIQTFPTCCLLGPEGTPVCWDLMDQTGEMRMAGTLPEYRLHGLVTYVIYSHAQKLGKLGFPVYSHVDYSNEAMQKMSYTLQHVPIPRSWNQWNCVPL

SEQ ID NO: 35564 - protein, 296 aa, Homo sapiens; identical to SEQ ID NO: 35563
  Payload ID: 7032
  Gene Symbol: GLYAT
  Gene Name: glycine-N-acyltransferase
  Uniprot ID: Q6IB77
  ENSP ID: ENSP00000431688

SEQ ID NO: 35565 - protein, 71 aa, Homo sapiens
  Payload ID: 7032
  Gene Symbol: GLYAT
  Gene Name: glycine-N-acyltransferase
  ENSP ID: ENSP00000468512
  MOD_RES (1)..(1): Any amino acid
XQIYSKDPQNCQEFLGSPELINWKQHLQIQSLIGSQCYKQRATAGFCLRVCHDPSCPSGDGNTCWKVAEIT

SEQ ID NO: 35566 - protein, 296 aa, Homo sapiens; identical to SEQ ID NO: 35563
  Payload ID: 7032
  Gene Symbol: GLYAT
  Gene Name: glycine-N-acyltransferase
  Uniprot ID: Q6IB77
  ENSP ID: ENSP00000484592

SEQ ID NO: 35567 - protein, 333 aa, Homo sapiens
  Payload ID: 7033
  Gene Symbol: GLYATL1
  Gene Name: glycine-N-acyltransferase-like 1
  Uniprot ID: Q969I3
  ENSP ID: ENSP00000300079
MFKLCSNKMVSQEGSEVELLVSPGARSEHGRYLQDPIVSIDLSEWLRIIEFLLQGLKVYGSVYHINHGNPFNMEVLVDSWPEYQMVIIRPQKQEMTDDMDSYTNVYRMFSKEPQKSEEVLKNCEIVNWKQRLQIQGLQESLGEGIRVATFSKSVKVEHSRALLLVTEDILKLNASSKSKLGSWAETGHPDDEFESETPNFKYAQLDVSYSGLVNDNWKRGKNERSLHYIKRCIEDLPAACMLGPEGVPVSWVTMDPSCEVGMAYSMEKYRRTGNMARVMVRYMKYLRQKNIPFYISVLEENEDSRRFVGQFGFFEASCEWHQWTCYPQNLVPF

SEQ ID NO: 35568 - protein, 302 aa, Homo sapiens
  Payload ID: 7033
  Gene Symbol: GLYATL1
  Gene Name: glycine-N-acyltransferase-like 1
  Uniprot ID: Q969I3
  ENSP ID: ENSP00000322223
MILLNNSHKLLALYKSLARSIPESLKVYGSVYHINHGNPFNMEVLVDSWPEYQMVIIRPQKQEMTDDMDSYTNVYRMFSKEPQKSEEVLKNCEIVNWKQRLQIQGLQESLGEGIRVATFSKSVKVEHSRALLLVTEDILKLNASSKSKLGSWAETGHPDDEFESETPNFKYAQLDVSYSGLVNDNWKRGKNERSLHYIKRCIEDLPAACMLGPEGVPVSWVTMDPSCEVGMAYSMEKYRRTGNMARVMVRYMKYLRQKNIPFYISVLEENEDSRRFVGQFGFFEASCEWHQWTCYPQNLVPF

SEQ ID NO: 35569 - protein, 50 aa, Homo sapiens
  Payload ID: 7033
  Gene Symbol: GLYATL1
  Gene Name: glycine-N-acyltransferase-like 1
  ENSP ID: ENSP00000431640
MVSQEGSEVELLVSPGARSEHGRYLQDPIVSIDLSEWLRIIEFLLQGLKV

SEQ ID NO: 35570 - protein, 50 aa, Homo sapiens; identical to SEQ ID NO: 35569
  Payload ID: 7033
  Gene Symbol: GLYATL1
  Gene Name: glycine-N-acyltransferase-like 1
  ENSP ID: ENSP00000432225

SEQ ID NO: 35571 - protein, 68 aa, Homo sapiens
  Payload ID: 7033
  Gene Symbol: GLYATL1
  Gene Name: glycine-N-acyltransferase-like 1
  ENSP ID: ENSP00000433716
MILLNNSHKLLALYKSLARSIPESLKVYGSVYHINHGNPFNMEVLVDSWPEYQMVIIRPQKQEMTDDM

SEQ ID NO: 35572 - protein, 173 aa, Homo sapiens
  Payload ID: 7033
  Gene Symbol: GLYATL1
  Gene Name: glycine-N-acyltransferase-like 1
  ENSP ID: ENSP00000434652
MVSQEGSEVELLVSPGARSEHGRYLQDPIVSIDLSEWLRIIEFLLQGLKVYGSVYHINHGNPFNMEVLVDSWPEYQMVIIRPQKQEMTDDMDSYTNVYRMFSKEPQKSEEVLKNCEIVNWKQRLQIQGLQESLGEGIRVATFSKSVKVEHSRALLLVTEDILKLNASSKSKLG

SEQ ID NO: 35573 - protein, 73 aa, Homo sapiens
  Payload ID: 7033
  Gene Symbol: GLYATL1
  Gene Name: glycine-N-acyltransferase-like 1
  ENSP ID: ENSP00000434661
MFKLCSNKMVSQEGSEVELLVSPGARSEHGRYLQDPIVSIDLSEWLRIIGVWLCVSHQSREPLQHGGAGGFLA

SEQ ID NO: 35574 - protein, 58 aa, Homo sapiens
  Payload ID: 7033
  Gene Symbol: GLYATL1
  Gene Name: glycine-N-acyltransferase-like 1
  ENSP ID: ENSP00000434757
MFKLCSNKMVSQEGSEVELLVSPGARSEHGRYLQDPIVSIDLSEWLRIIEFLLQGLKV

SEQ ID NO: 35575 - protein, 79 aa, Homo sapiens
  Payload ID: 7033
  Gene Symbol: GLYATL1
  Gene Name: glycine-N-acyltransferase-like 1
  ENSP ID: ENSP00000436116
MILLNNSHKLLALYKSLARSIPESLKVYGSVYHINHGNPFNMEVLVDSWPEYQMVIIRPQKQEMTDDMDSYTNVYRMFS

SEQ ID NO: 35576 - protein, 50 aa, Homo sapiens; identical to SEQ ID NO: 35569
  Payload ID: 7033
  Gene Symbol: GLYATL1
  Gene Name: glycine-N-acyltransferase-like 1
  ENSP ID: ENSP00000437155

SEQ ID NO: 35577 - protein, 302 aa, Homo sapiens; identical to SEQ ID NO: 35568
  Payload ID: 7033
  Gene Symbol: GLYATL1
  Gene Name: glycine-N-acyltransferase-like 1
  Uniprot ID: Q969I3
  ENSP ID: ENSP00000479741

SEQ ID NO: 35578 - protein, 302 aa, Homo sapiens
  Payload ID: 7034
  Gene Symbol: GLYATL1P3
  Gene Name: glycine-N-acyltransferase-like 1 pseudogene 3
  ENSP ID: ENSP00000488958
MILLNNSERLLALFKSLARSIPESLKVYGSLFHINHGNPFNMEVLVDSWPEYQMVIIRPQKQEMTDDMDSYTNVYRVFSKDPQKSQEVLKNSEIINWKQKLQIQGFQESLGEGIRAAAFSNSVKVEHSRALLFVTEDILKLYATNKSKLGSWAETGHPDDELESETPNFKYAQLNVSYSGLVNDNWKLGMNKRSLRYIKRCLGALPAACMLGPEGVPVSWVTMDPSCEIGMGYSVEKYRRRGNGTRLIMRCMKYLCQKNIPFYGSVLEENQGVIRKTSALGFLEASCQWHQWNCYPQNLVPL

SEQ ID NO: 35579 - protein, 294 aa, Homo sapiens
  Payload ID: 7035
  Gene Symbol: GLYATL2
  Gene Name: glycine-N-acyltransferase-like 2
  Uniprot ID: Q8WU03
  ENSP ID: ENSP00000287275
MLVLHNSQKLQILYKSLEKSIPESIKVYGAIFNIKDKNPFNMEVLVDAWPDYQIVITRPQKQEMKDDQDHYTNTYHIFTKAPDKLEEVLSYSNVISWEQTLQIQGCQEGLDEAIRKVATSKSVQVDYMKTILFIPELPKKHKTSSNDKMELFEVDDDNKEGNFSNMFLDASHAGLVNEHWAFGKNERSLKYIERCLQDFLGFGVLGPEGQLVSWIVMEQSCELRMGYTVPKYRHQGNMLQIGYHLEKYLSQKEIPFYFHVADNNEKSLQALNNLGFKICPCGWHQWKCTPKKYC

SEQ ID NO: 35580 - protein, 294 aa, Homo sapiens; identical to SEQ ID NO: 35579
  Payload ID: 7035
  Gene Symbol: GLYATL2
  Gene Name: glycine-N-acyltransferase-like 2
  Uniprot ID: Q8WU03
  ENSP ID: ENSP00000434277

SEQ ID NO: 35581 - protein, 288 aa, Homo sapiens
  Payload ID: 7036
  Gene Symbol: GLYATL3
  Gene Name: glycine-N-acyltransferase-like 3
  Uniprot ID: Q5SZD4
  ENSP ID: ENSP00000360240
MLVLNCSTKLLILEKMLKSCFPESLKVYGAVMNINRGNPFQKEVVLDSWPDFKAVITRRQREAETDNLDHYTNAYAVFYKDVRAYRQLLEECDVFNWDQVFQIQGLQSELYDVSKAVANSKQLNIKLTSFKAVHFSPVSSLPDTSFLKGPSPRLTYLSVANADLLNRTWSRGGNEQCLRYIANLISCFPSVCVRDEKGNPVSWSITDQFATMCHGYTLPEHRRKGYSRLVALTLARKLQSRGFPSQGNVLDDNTASISLLKSLHAEFLPCRFHRLILTPATFSGLPHL

SEQ ID NO: 35582 - protein, 156 aa, Homo sapiens
  Payload ID: 7036
  Gene Symbol: GLYATL3
  Gene Name: glycine-N-acyltransferase-like 3
  ENSP ID: ENSP00000440029
MLVLNCSTKLLILEKMLKSCFPESLKVYGAVMNINRGNPFQKEVVLDSWPDFKAVITRRQREAETDNLDHYTNAYAVFYKDVRAYRQLLEECDVFNWDQVFQIQGLQSELYDVSKAVANSKQLNIKLTSFKAVHFSPVSSLPDTSFLKGPSPRLTY

SEQ ID NO: 35583 - protein, 673 aa, Homo sapiens
  Payload ID: 7037
  Gene Symbol: GYS1
  Gene Name: glycogen synthase 1 (muscle)
  Uniprot ID: P13807
  ENSP ID: ENSP00000263276
MPLNRTLSMSSLPGLEDWEDEFDLENAVLFEVAWEVANKVGGIYTVLQTKAKVTGDEWGDNYFLVGPYTEQGVRTQVELLEAPTPALKRTLDSMNSKGCKFLAQSEEKPHVVAHFHEWLAGVGLCLCRARRLPVATIFTTHATLLGRYLCAGAVDFYNNLENFNVDKEAGERQIYHRYCMERAAAHCAHVFTTVSQITAIEAQHLLKRKPDIVTPNGLNVKKFSAMHEFQNLHAQSKARIQEFVRGHFYGHLDFNLDKTLYFFIAGRYEFSNKGADVFLEALARLNYLLRVNGSEQTVVAFFIMPARTNNFNVETLKGQAVRKQLWDTANTVKEKFGRKLYESLLVGSLPDMNKMLDKEDFTMMKRAIFATQRQSFPPVCTHNMLDDSSDPILTTIRRIGLFNSSADRVKVIFHPEFLSSTSPLLPVDYEEFVRGCHLGVFPSYYEPWGYTPAECTVMGIPSISTNLSGFGCFMEEHIADPSAYGIYILDRRFRSLDDSCSQLTSFLYSFCQQSRRQRIIQRNRTERLSDLLDWKYLGRYYMSARHMALSKAFPEHFTYEPNEADAAQGYRYPRPASVPPSPSLSRHSSPHQSEDEEDPRNGPLEEDGERYDEDEEAAKDRRNIRAPEWPRRASCTSSTSGSKRNSVDTATSSSLSTPSEPLSPTSSLGEERN

SEQ ID NO: 35584 - protein, 737 aa, Homo sapiens
  Payload ID: 7037
  Gene Symbol: GYS1
  Gene Name: glycogen synthase 1 (muscle)
  Uniprot ID: P13807
  ENSP ID: ENSP00000317904
MPLNRTLSMSSLPGLEDWEDEFDLENAVLFEVAWEVANKVGGIYTVLQTKAKVTGDEWGDNYFLVGPYTEQGVRTQVELLEAPTPALKRTLDSMNSKGCKVYFGRWLIEGGPLVVLLDVGASAWALERWKGELWDTCNIGVPWYDREANDAVLFGFLTTWFLGEFLAQSEEKPHVVAHFHEWLAGVGLCLCRARRLPVATIFTTHATLLGRYLCAGAVDFYNNLENFNVDKEAGERQIYHRYCMERAAAHCAHVFTTVSQITAIEAQHLLKRKPDIVTPNGLNVKKFSAMHEFQNLHAQSKARIQEFVRGHFYGHLDFNLDKTLYFFIAGRYEFSNKGADVFLEALARLNYLLRVNGSEQTVVAFFIMPARTNNFNVETLKGQAVRKQLWDTANTVKEKFGRKLYESLLVGSLPDMNKMLDKEDFTMMKRAIFATQRQSFPPVCTHNMLDDSSDPILTTIRRIGLFNSSADRVKVIFHPEFLSSTSPLLPVDYEEFVRGCHLGVFPSYYEPWGYTPAECTVMGIPSISTNLSGFGCFMEEHIADPSAYGIYILDRRFRSLDDSCSQLTSFLYSFCQQSRRQRIIQRNRTERLSDLLDWKYLGRYYMSARHMALSKAFPEHFTYEPNEADAAQGYRYPRPASVPPSPSLSRHSSPHQSEDEEDPRNGPLEEDGERYDEDEEAAKDRRNIRAPEWPRRASCTSSTSGSKRNSVDTATSSSLSTPSEPLSPTSSLGEERN

SEQ ID NO: 35585 - protein, 113 aa, Homo sapiens
  Payload ID: 7037
  Gene Symbol: GYS1
  Gene Name: glycogen synthase 1 (muscle)
  ENSP ID: ENSP00000470072
  MOD_RES (1)..(1): Any amino acid
XIYILDRRFRSLDDSCSQLTSFLYSFCQQSRRQRIIQRNRTERLSDLLDWKYLGRVGPPLSYPLLANQQLLARGLWCRVQGLILLVTVAVPLSNEPGRSRWWLMVVIPALWEA

SEQ ID NO: 35586 - protein, 703 aa, Homo sapiens
  Payload ID: 7038
  Gene Symbol: GYS2
  Gene Name: glycogen synthase 2 (liver)
  Uniprot ID: P54840
  ENSP ID: ENSP00000261195
MLRGRSLSVTSLGGLPQWEVEELPVEELLLFEVAWEVTNKVGGIYTVIQTKAKTTADEWGENYFLIGPYFEHNMKTQVEQCEPVNDAVRRAVDAMNKHGCQVHFGRWLIEGSPYVVLFDIGYSAWNLDRWKGDLWEACSVGIPYHDREANDMLIFGSLTAWFLKEVTDHADGKYVVAQFHEWQAGIGLILSRARKLPIATIFTTHATLLGRYLCAANIDFYNHLDKFNIDKEAGERQIYHRYCMERASVHCAHVFTTVSEITAIEAEHMLKRKPDVVTPNGLNVKKFSAVHEFQNLHAMYKARIQDFVRGHFYGHLDFDLEKTLFLFIAGRYEFSNKGADIFLESLSRLNFLLRMHKSDITVMVFFIMPAKTNNFNVETLKGQAVRKQLWDVAHSVKEKFGKKLYDALLRGEIPDLNDILDRDDLTIMKRAIFSTQRQSLPPVTTHNMIDDSTDPILSTIRRIGLFNNRTDRVKVILHPEFLSSTSPLLPMDYEEFVRGCHLGVFPSYYEPWGYTPAECTVMGIPSVTTNLSGFGCFMQEHVADPTAYGIYIVDRRFRSPDDSCNQLTKFLYGFCKQSRRQRIIQRNRTERLSDLLDWRYLGRYYQHARHLTLSRAFPDKFHVELTSPPTTEGFKYPRPSSVPPSPSGSQASSPQSSDVEDEVEDERYDEEEEAERDRLNIKSPFSLSHVPHGKKKLHGEYKN

SEQ ID NO: 35587 - protein, 483 aa, Homo sapiens
  Payload ID: 7039
  Gene Symbol: GSK3A
  Gene Name: glycogen synthase kinase 3 alpha
  Uniprot ID: P49840
  ENSP ID: ENSP00000222330
MSGGGPSGGGPGGSGRARTSSFAEPGGGGGGGGGGPGGSASGPGGTGGGKASVGAMGGGVGASSSGGGPGGSGGGGSGGPGAGTSFPPPGVKLGRDSGKVTTVVATLGQGPERSQEVAYTDIKVIGNGSFGVVYQARLAETRELVAIKKVLQDKRFKNRELQIMRKLDHCNIVRLRYFFYSSGEKKDELYLNLVLEYVPETVYRVARHFTKAKLTIPILYVKVYMYQLFRSLAYIHSQGVCHRDIKPQNLLVDPDTAVLKLCDFGSAKQLVRGEPNVSYICSRYYRAPELIFGATDYTSSIDVWSAGCVLAELLLGQPIFPGDSGVDQLVEIIKVLGTPTREQIREMNPNYTEFKFPQIKAHPWTKVFKSRTPPEAIALCSSLLEYTPSSRLSPLEACAHSFFDELRCLGTQLPNNRPLPPLFNFSAGELSIQPSLNAILIPPHLRSPAGTTTLTPSSQALTETPTSSDWQSTDATPTLTNSS

SEQ ID NO: 35588 - protein, 401 aa, Homo sapiens
  Payload ID: 7039
  Gene Symbol: GSK3A
  Gene Name: glycogen synthase kinase 3 alpha
  ENSP ID: ENSP00000381301
MGQWIVYPLCSPGDSGKVTTVVATLGQGPERSQEVAYTDIKVIGNGSFGVVYQARLAETRELVAIKKVLQDKRFKNRELQIMRKLDHCNIVRLRYFFYSSGEKKDELYLNLVLEYVPETVYRVARHFTKAKLTIPILYVKVYMYQLFRSLAYIHSQGVCHRDIKPQNLLVDPDTAVLKLCDFGSAKQLVRGEPNVSYICSRYYRAPELIFGATDYTSSIDVWSAGCVLAELLLGQPIFPGDSGVDQLVEIIKVLGTPTREQIREMNPNYTEFKFPQIKAHPWTKVFKSRTPPEAIALCSSLLEYTPSSRLSPLEACAHSFFDELRCLGTQLPNNRPLPPLFNFSAGELSIQPSLNAILIPPHLRSPAGTTTLTPSSQALTETPTSSDWQSTDATPTLTNSS

SEQ ID NO: 35589 - protein, 483 aa, Homo sapiens; identical to SEQ ID NO: 35587
  Payload ID: 7039
  Gene Symbol: GSK3A
  Gene Name: glycogen synthase kinase 3 alpha
  Uniprot ID: P49840
  ENSP ID: ENSP00000412663

SEQ ID NO: 35590 - protein, 420 aa, Homo sapiens
  Payload ID: 7040
  Gene Symbol: GSK3B
  Gene Name: glycogen synthase kinase 3 beta
  Uniprot ID: P49841
  ENSP ID: ENSP00000264235
MSGRPRTTSFAESCKPVQQPSAFGSMKVSRDKDGSKVTTVVATPGQGPDRPQEVSYTDTKVIGNGSFGVVYQAKLCDSGELVAIKKVLQDKRFKNRELQIMRKLDHCNIVRLRYFFYSSGEKKDEVYLNLVLDYVPETVYRVARHYSRAKQTLPVIYVKLYMYQLFRSLAYIHSFGICHRDIKPQNLLLDPDTAVLKLCDFGSAKQLVRGEPNVSYICSRYYRAPELIFGATDYTSSIDVWSAGCVLAELLLGQPIFPGDSGVDQLVEIIKVLGTPTREQIREMNPNYTEFKFPQIKAHPWTKVFRPRTPPEAIALCSRLLEYTPTARLTPLEACAHSFFDELRDPNVKLPNGRDTPALFNFTTQELSSNPPLATILIPPHARIQAAASTPTNATAASDANTGDRGQTNNAASASASNST

SEQ ID NO: 35591 - protein, 433 aa, Homo sapiens
  Payload ID: 7040
  Gene Symbol: GSK3B
  Gene Name: glycogen synthase kinase 3 beta
  Uniprot ID: P49841
  ENSP ID: ENSP00000324806
MSGRPRTTSFAESCKPVQQPSAFGSMKVSRDKDGSKVTTVVATPGQGPDRPQEVSYTDTKVIGNGSFGVVYQAKLCDSGELVAIKKVLQDKRFKNRELQIMRKLDHCNIVRLRYFFYSSGEKKDEVYLNLVLDYVPETVYRVARHYSRAKQTLPVIYVKLYMYQLFRSLAYIHSFGICHRDIKPQNLLLDPDTAVLKLCDFGSAKQLVRGEPNVSYICSRYYRAPELIFGATDYTSSIDVWSAGCVLAELLLGQPIFPGDSGVDQLVEIIKVLGTPTREQIREMNPNYTEFKFPQIKAHPWTKDSSGTGHFTSGVRVFRPRTPPEAIALCSRLLEYTPTARLTPLEACAHSFFDELRDPNVKLPNGRDTPALFNFTTQELSSNPPLATILIPPHARIQAAASTPTNATAASDANTGDRGQTNNAASASASNST

SEQ ID NO: 35592 - protein, 333 aa, Homo sapiens
  Payload ID: 7041
  Gene Symbol: GYG1
  Gene Name: glycogenin 1
  Uniprot ID: P46976
  ENSP ID: ENSP00000296048
MTDQAFVTLTTNDAYAKGALVLGSSLKQHRTTRRLVVLATPQVSDSMRKVLETVFDEVIMVDVLDSGDSAHLTLMKRPELGVTLTKLHCWSLTQYSKCVFMDADTLVLANIDDLFDREELSAAPDPGWPDCFNSGVFVYQPSVETYNQLLHLASEQGSFDGGDQGILNTFFSSWATTDIRKHLPFIYNLSSISIYSYLPAFKVFGASAKVVHFLGRVKPWNYTYDPKTKSVKSEAHDPNMTHPEFLILWWNIFTTNVLPLLQQFGLVKDTCSYVNVEDVSGAISHLSLGEIPAMAQPFVSSEERKERWEQGQADYMGADSFDNIKRKLDTYLQ

SEQ ID NO: 35593 - protein, 350 aa, Homo sapiens
  Payload ID: 7041
  Gene Symbol: GYG1
  Gene Name: glycogenin 1
  Uniprot ID: P46976
  ENSP ID: ENSP00000340736
MTDQAFVTLTTNDAYAKGALVLGSSLKQHRTTRRLVVLATPQVSDSMRKVLETVFDEVIMVDVLDSGDSAHLTLMKRPELGVTLTKLHCWSLTQYSKCVFMDADTLVLANIDDLFDREELSAAPDPGWPDCFNSGVFVYQPSVETYNQLLHLASEQGSFDGGDQGILNTFFSSWATTDIRKHLPFIYNLSSISIYSYLPAFKVFGASAKVVHFLGRVKPWNYTYDPKTKSVKSEAHDPNMTHPEFLILWWNIFTTNVLPLLQQFGLVKDTCSYVNVLSDLVYTLAFSCGFCRKEDVSGAISHLSLGEIPAMAQPFVSSEERKERWEQGQADYMGADSFDNIKRKLDTYLQ

SEQ ID NO: 35594 - protein, 60 aa, Homo sapiens
  Payload ID: 7041
  Gene Symbol: GYG1
  Gene Name: glycogenin 1
  ENSP ID: ENSP00000417671
MRKVLETVFDEVIMVDVLDSGDSAHLTLMKRPELGVTLTKLHCWSLTQYSKCVFMDADTL

SEQ ID NO: 35595 - protein, 110 aa, Homo sapiens
  Payload ID: 7041
  Gene Symbol: GYG1
  Gene Name: glycogenin 1
  ENSP ID: ENSP00000418297
MRKVLETVFDEVIMVDVLDSGDSAHLTLMKRPELGVTLTKLHCWSLTQYSKCVFMDADTLVLANIDDLFDREELSAAPDPGWPDCFNSGVFVYQPSVETYNQLLHLASEQ

SEQ ID NO: 35596 - protein, 193 aa, Homo sapiens
  Payload ID: 7041
  Gene Symbol: GYG1
  Gene Name: glycogenin 1
  ENSP ID: ENSP00000419499
MTDQAFVTLTTNDAYAKGALVLGSSLKQHRTTRRLVVLATPQVSDSMRKVLETVFDEVIMVDVLDSGDSAHLTLMKRPELGVTLTKLHCWSLTQYSKCVFMDADTLVLANIDDLFDREELSAAPDPGWPDCFNSGVFVYQPSVETYNQLLHLASEQGLVQVPKLCISWDESNHGIILMIPKQKVSKVRPMIPT

SEQ ID NO: 35597 - protein, 265 aa, Homo sapiens
  Payload ID: 7041
  Gene Symbol: GYG1
  Gene Name: glycogenin 1
  ENSP ID: ENSP00000420247
MTDQAFVTLTTNDAYAKGALVLGSSLKQHRTTRRLVVLATPQVSDSMRKVLETVFDEVIMVDVLDSGDSAHLTLMKRPELGVTLTKLHCWSLTQYSKCVFMDADTLVLANIDDLFDREELSAAPDPGWPDCFNSGVFVYQPSVETYNQLLHLASEQGGDQGILNTFFSSWATTDIRKHLPFIYNLSSISIYSYLPAFKVFGASAKVVHFLGRVKPWNYTYDPKTKSVKSEAHDPNMTHPEFLILWWNIFTTNVLPLLQQFGLVKD

SEQ ID NO: 35598 - protein, 279 aa, Homo sapiens
  Payload ID: 7041
  Gene Symbol: GYG1
  Gene Name: glycogenin 1
  Uniprot ID: P46976
  ENSP ID: ENSP00000420683
MTDQAFVTLTTNDAYAKGALVLGSSLKQHRTTRRLVVLATPQVSDSMRKVLETVFDEVIMVDVLDSGDSAHLTLMKRPELGVTLTKLHCWSLTQYSKCVFMDADTLVLANIDDLFDREELSAAPDPGWPDCFNSGVFVYQPSVETYNQLLHLASEQGSFDGGDQGILNTFFSSWATTDIRKHLPFIYNLSSISIYSYLPAFKVKMSQEPYHICPLGRSQLWHSRLYPRKNGRNDGNRARLIIWEQIPLTTSRGNLTLTSSRNTAFFCEHIHFTSLVSDT

SEQ ID NO: 35599 - protein, 193 aa, Homo sapiens; identical to SEQ ID NO: 35596
  Payload ID: 7041
  Gene Symbol: GYG1
  Gene Name: glycogenin 1
  ENSP ID: ENSP00000486061

SEQ ID NO: 35600 - protein, 244 aa, Homo sapiens
  Payload ID: 7042
  Gene Symbol: GYG2
  Gene Name: glycogenin 2
  ENSP ID: ENSP00000370549
  MOD_RES (1)..(1): Any amino acid
XLQHAMEHGSFDGADQGLLNSFFRNWSTTDIHKHLPFIYNLSSNTMYTYSPAFKQFGSSAKVVHFLGSMKPWNYKYNPQSGSVLEQGSASSSQHQAAFLHLWWTVYQNNVLPLYKSVQAGEARASPGHTLCHSDVGGPCADSASGVGEPCENSTPSAGVPCANSPLGSNQPAQGLPEPTQIVDETLSLPEGRRSEDMIACPETETPAVITCDPLSQPSPQPADFTETETILVDLAVSVSQISIE

SEQ ID NO: 35601 - protein, 501 aa, Homo sapiens
  Payload ID: 7042
  Gene Symbol: GYG2
  Gene Name: glycogenin 2
  Uniprot ID: O15488
  ENSP ID: ENSP00000370555
MSETEFHHGAQAGLELLRSSNSPTSASQSAGMTVTDQAFVTLATNDIYCQGALVLGQSLRRHRLTRKLVVLITPQVSSLLRVILSKVFDEVIEVNLIDSADYIHLAFLKRPELGLTLTKLHCWTLTHYSKCVFLDADTLVLSNVDELFDRGEFSAAPDPGWPDCFNSGVFVFQPSLHTHKLLLQHAMEHGSFDGADQGLLNSFFRNWSTTDIHKHLPFIYNLSSNTMYTYSPAFKQFGSSAKVVHFLGSMKPWNYKYNPQSGSVLEQGSASSSQHQAAFLHLWWTVYQNNVLPLYKSVQAGEARASPGHTLCHSDVGGPCADSASGVGEPCENSTPSAGVPCANSPLGSNQPAQGLPEPTQIVDETLSLPEGRRSEDMIACPETETPAVITCDPLSQPSPQPADFTETETILQPANKVESVSSEETFEPSQELPAEALRDPSLQDALEVDLAVSVSQISIEEKVKELSPEEERRKWEEGRIDYMGKDAFARIQEKLDRFLQ

SEQ ID NO: 35602 - protein, 470 aa, Homo sapiens
  Payload ID: 7042
  Gene Symbol: GYG2
  Gene Name: glycogenin 2
  Uniprot ID: O15488
  ENSP ID: ENSP00000381786
MSVTDQAFVTLATNDIYCQGALVLGQSLRRHRLTRKLVVLITPQVSSLLRVILSKVFDEVIEVNLIDSADYIHLAFLKRPELGLTLTKLHCWTLTHYSKCVFLDADTLVLSNVDELFDRGEFSAAPDPGWPDCFNSGVFVFQPSLHTHKLLLQHAMEHGSFDGADQGLLNSFFRNWSTTDIHKHLPFIYNLSSNTMYTYSPAFKQFGSSAKVVHFLGSMKPWNYKYNPQSGSVLEQGSASSSQHQAAFLHLWWTVYQNNVLPLYKSVQAGEARASPGHTLCHSDVGGPCADSASGVGEPCENSTPSAGVPCANSPLGSNQPAQGLPEPTQIVDETLSLPEGRRSEDMIACPETETPAVITCDPLSQPSPQPADFTETETILQPANKVESVSSEETFEPSQELPAEALRDPSLQDALEVDLAVSVSQISIEEKVKELSPEEERRKWEEGRIDYMGKDAFARIQEKLDRFLQ

SEQ ID NO: 35603 - protein, 137 aa, Homo sapiens
  Payload ID: 7042
  Gene Symbol: GYG2
  Gene Name: glycogenin 2
  ENSP ID: ENSP00000430764
MSVTDQAFVTLATNDIYCQGALVLGQSLRRHRLTRKLVVLITPQVSSLLRVILSKVFDEVIEVNLIDSADYIHLAFLKRPELGLTLTKLHCWTLTHYSKCVFLDADTLVLSNVDELFDRGEFSAAPDPGWPDCFNSG

SEQ ID NO: 35604 - protein, 430 aa, Homo sapiens
  Payload ID: 7042
  Gene Symbol: GYG2
  Gene Name: glycogenin 2
  Uniprot ID: O15488
  ENSP ID: ENSP00000487294
MSETEFHHGAQAGLELLRSSNSPTSASQSAGMTVTDQAFVTLATNDIYCQGALVLGQSLRRHRLTRKLVVLITPQVSSLLRVILSKVFDEVIEVNLIDSADYIHLAFLKRPELGLTLTKLHCWTLTHYSKCVFLDADTLVLSNVDELFDRGEFSAAPDPGWPDCFNSGVFVFQPSLHTHKLLLQHAMEHGSFDGADQGLLNSFFRNWSTTDIHKHLPFIYNLSSNTMYTYSPAFKQFGSSAKVVHFLGSMKPWNYKYNPQSGSVLEQGSASSSQHQAAFLHLWWTVYQNNVLPLYKSVQAGEARASPGHTLCHSDVGGPCADSASGVGEPCENSTPSAGVPCANSPLGSNQPAQGLPEPTQIVDETLSLPEGRRSEDVDLAVSVSQISIEEKVKELSPEEERRKWEEGRIDYMGKDAFARIQEKLDRFLQ

SEQ ID NO: 35605 - protein, 209 aa, Homo sapiens
  Payload ID: 7043
  Gene Symbol: GLTP
  Gene Name: glycolipid transfer protein
  Uniprot ID: Q9NZD2
  ENSP ID: ENSP00000315263
MALLAEHLLKPLPADKQIETGPFLEAVSHLPPFFDCLGSPVFTPIKADISGNITKIKAVYDTNPAKFRTLQNILEVEKEMYGAEWPKVGATLALMWLKRGLRFIQVFLQSICDGERDENHPNLIRVNATKAYEMALKKYHGWIVQKIFQAALYAAPYKSDFLKALSKGQNVTEEECLEKIRLFLVNYTATIDVIYEMYTQMNAELNYKV

SEQ ID NO: 35606 - protein, 67 aa, Homo sapiens
  Payload ID: 7043
  Gene Symbol: GLTP
  Gene Name: glycolipid transfer protein
  ENSP ID: ENSP00000438128
MALLAEHLLKPLPADKQIETGPFLEAVSHLPPFFDCLGSPVFTPIKADISGNITMRKLRLRGVEGLA

SEQ ID NO: 35607 - protein, 183 aa, Homo sapiens
  Payload ID: 7043
  Gene Symbol: GLTP
  Gene Name: glycolipid transfer protein
  ENSP ID: ENSP00000440136
  MOD_RES (1)..(1): Any amino acid
XDRDRALPRGGVPPAALLRLPWVPSVYSHQGRHKRQHHENQSCVRHQPSQVPDPAEHPGGGERNVWSRVAQSRGHTGADVAEKSICDGERDENHPNLIRVNATKAYEMALKKYHGWIVQKIFQAALYAAPYKSDFLKALSKGQNVTEEECLEKIRLFLVNYTATIDVIYEMYTQMNAELNYKV

SEQ ID NO: 35608 - protein, 67 aa, Homo sapiens; identical to SEQ ID NO: 35606
  Payload ID: 7043
  Gene Symbol: GLTP
  Gene Name: glycolipid transfer protein
  ENSP ID: ENSP00000441537

SEQ ID NO: 35609 - protein, 190 aa, Homo sapiens
  Payload ID: 7043
  Gene Symbol: GLTP
  Gene Name: glycolipid transfer protein
  ENSP ID: ENSP00000445919
MALLAEHLLKPLPADKQIETGPFLEAVSHLPPFFDCLGSPVFTPIKADISGNITKIKAVYDTNPAKFRTLQNILEVEKEIGLRFIQVFLQSICDGERDENHPNLIRVNATKAYEMALKKYHGWIVQKIFQAALYAAPYKSDFLKALSKGQNVTEEECLEKIRLFLVNYTATIDVIYEMYTQMNAELNYKV

SEQ ID NO: 35610 - protein, 67 aa, Homo sapiens; identical to SEQ ID NO: 35606
  Payload ID: 7043
  Gene Symbol: GLTP
  Gene Name: glycolipid transfer protein
  ENSP ID: ENSP00000481582

SEQ ID NO: 35611 - protein, 291 aa, Homo sapiens
  Payload ID: 7044
  Gene Symbol: GLTPD2
  Gene Name: glycolipid transfer protein domain containing 2
  Uniprot ID: A6NH11
  ENSP ID: ENSP00000328070
MGVAARPPALRHWFSHSIPLAIFALLLLYLSVRSLGARSGCGPRAQPCVPGETAPFQVRQESGTLEAPERKQPPCLGPRGMLGRMMRRFHASLKPEGDVGLSPYLAGWRALVEFLTPLGSVFAFATREAFTKVTDLEARVHGPDAEHYWSLVAMAAWERRAGLLEQPGAAPRDPTRSSGSRTLLLLHRALRWSQLCLHRVATGALGGPDAGVQCSDAYRAALGPHHPWLVRQTARLAFLAFPGRRRLLELACPGATEAEARAALVRAAGTLEDVYNRTQSLLAERGLLQLA

SEQ ID NO: 35612 - protein, 117 aa, Homo sapiens
  Payload ID: 7045
  Gene Symbol: GYPA
  Gene Name: glycophorin A (MNS blood group)
  Uniprot ID: P02724
  ENSP ID: ENSP00000324483
MYGKIIFVLLLSDTHKRDTYAATPRAHEVSEISVRTVYPPEEETGERVQLAHHFSEPEITLIIFGVMAGVIGTILLISYGIRRLIKKSPSDVKPLPSPDTDVPLSSVEIENPETSDQ

SEQ ID NO: 35613 - protein, 150 aa, Homo sapiens
  Payload ID: 7045
  Gene Symbol: GYPA
  Gene Name: glycophorin A (MNS blood group)
  ENSP ID: ENSP00000354003
MYGKIIFVLLLSEIVSISALSTTEVAMHTSTSSSVTKSYISSQTNDTHKRDTYAATPRAHEVSEISVRTVYPPEEETGERVQLAHHFSEPEITLIIFGVMAGVIGTILLISYGIRRLIKKSPSDVKPLPSPDTDVPLSSVEIENPETSDQ

SEQ ID NO: 35614 - protein, 105 aa, Homo sapiens
  Payload ID: 7045
  Gene Symbol: GYPA
  Gene Name: glycophorin A (MNS blood group)
  ENSP ID: ENSP00000421243
MYGKIIFVLLLSEIVSISALSTTEVAMHTSTSSSVTKSYISSQTNEITLIIFGVMAGVIGTILLISYGIRRLIKKSPSDVKPLPSPDTDVPLSSVEIENPETSDQ

SEQ ID NO: 35615 - protein, 85 aa, Homo sapiens
  Payload ID: 7045
  Gene Symbol: GYPA
  Gene Name: glycophorin A (MNS blood group)
  ENSP ID: ENSP00000425193
MYGKIIFVLLLSGERVQLAHHFSEPEITLIIFGVMAGVIGTILLISYGIRRLIKKSPSDVKPLPSPDTDVPLSSVEIENPETSDQ

SEQ ID NO: 35616 - protein, 118 aa, Homo sapiens
  Payload ID: 7045
  Gene Symbol: GYPA
  Gene Name: glycophorin A (MNS blood group)
  ENSP ID: ENSP00000425549
MYGKIIFVLLLSEIVSISALSTTEVAMHTSTSSSVTKSYISSQTNGERVQLAHHFSEPEITLIIFGVMAGVIGTILLISYGIRRLIKKSPSDVKPLPSPDTDVPLSSVEIENPETSDQ

SEQ ID NO: 35617 - protein, 42 aa, Homo sapiens
  Payload ID: 7045
  Gene Symbol: GYPA
  Gene Name: glycophorin A (MNS blood group)
  ENSP ID: ENSP00000425719
MYGKIIFVLLLSGDGANPENSGKRGQKAEGRARAKILKQQKL

SEQ ID NO: 35618 - protein, 137 aa, Homo sapiens
  Payload ID: 7045
  Gene Symbol: GYPA
  Gene Name: glycophorin A (MNS blood group)
  ENSP ID: ENSP00000426130
MYGKIIFVLLLSEIVSISALSTTEVAMHTSTSSSVTKSYISSQTNDTHKRDTYAATPRAHEVSEISVRTVYPPEEETEITLIIFGVMAGVIGTILLISYGIRRLIKKSPSDVKPLPSPDTDVPLSSVEIENPETSDQ

SEQ ID NO: 35619 - protein, 148 aa, Homo sapiens
  Payload ID: 7045
  Gene Symbol: GYPA
  Gene Name: glycophorin A (MNS blood group)
  ENSP ID: ENSP00000445398
MLDTSFITPQEIVSISALSTTEVAMHTSTSSSVTKSYISSQTNDTHKRDTYAATPRAHEVSEISVRTVYPPEEETGERVQLAHHFSEPEITLIIFGVMAGVIGTILLISYGIRRLIKKSPSDVKPLPSPDTDVPLSSVEIENPETSDQ

SEQ ID NO: 35620 - protein, 148 aa, Homo sapiens; identical to SEQ ID NO: 35619
  Payload ID: 7045
  Gene Symbol: GYPA
  Gene Name: glycophorin A (MNS blood group)
  ENSP ID: ENSP00000478329

SEQ ID NO: 35621 - protein, 62 aa, Homo sapiens
  Payload ID: 7046
  Gene Symbol: GYPB
  Gene Name: glycophorin B (MNS blood group)
  ENSP ID: ENSP00000394200
MYGKIIFVLLLSEIVSISALSTTEVAMHTSTSSSVTKSYISSQTNGETGQLVHRFTVPVFAD

SEQ ID NO: 35622 - protein, 45 aa, Homo sapiens
  Payload ID: 7046
  Gene Symbol: GYPB
  Gene Name: glycophorin B (MNS blood group)
  ENSP ID: ENSP00000421974
MYGKIIFVLLLSGNFEHSAEGPSWLPLRRSPSTSTPLHLGAIPLI

SEQ ID NO: 35623 - protein, 42 aa, Homo sapiens
  Payload ID: 7046
  Gene Symbol: GYPB
  Gene Name: glycophorin B (MNS blood group)
  ENSP ID: ENSP00000422726
MYGKIIFVLLLSGDGANPENSGRRGQKAEGRARAKILKQEKL

SEQ ID NO: 35624 - protein, 45 aa, Homo sapiens; identical to SEQ ID NO: 35622
  Payload ID: 7046
  Gene Symbol: GYPB
  Gene Name: glycophorin B (MNS blood group)
  ENSP ID: ENSP00000423025

SEQ ID NO: 35625 - protein, 45 aa, Homo sapiens; identical to SEQ ID NO: 35622
  Payload ID: 7046
  Gene Symbol: GYPB
  Gene Name: glycophorin B (MNS blood group)
  ENSP ID: ENSP00000423055

SEQ ID NO: 35626 - protein, 19 aa, Homo sapiens
  Payload ID: 7046
  Gene Symbol: GYPB
  Gene Name: glycophorin B (MNS blood group)
  ENSP ID: ENSP00000424025
MYGKIIFVLLLSGHPTMLC

SEQ ID NO: 35627 - protein, 58 aa, Homo sapiens
  Payload ID: 7046
  Gene Symbol: GYPB
  Gene Name: glycophorin B (MNS blood group)
  Uniprot ID: P06028
  ENSP ID: ENSP00000425244
MYGKIIFVLLLSGETGQLVHRFTVPAPVVIILIILCVMAGIIGTILLISYSIRRLIKA

SEQ ID NO: 35628 - protein, 91 aa, Homo sapiens
  Payload ID: 7046
  Gene Symbol: GYPB
  Gene Name: glycophorin B (MNS blood group)
  Uniprot ID: P06028
  ENSP ID: ENSP00000427690
MYGKIIFVLLLSEIVSISALSTTEVAMHTSTSSSVTKSYISSQTNGETGQLVHRFTVPAPVVIILIILCVMAGIIGTILLISYSIRRLIKA

SEQ ID NO: 35629 - protein, 128 aa, Homo sapiens
  Payload ID: 7047
  Gene Symbol: GYPC
  Gene Name: glycophorin C (Gerbich blood group)
  Uniprot ID: P04921
  ENSP ID: ENSP00000259254
MWSTRSPNSTAWPLSLEPDPGMASASTTMHTTTIAEPDPGMSGWPDGRMETSTPTIMDIVVIAGVIAAVAIVLVSLLFVMLRYMYRHKGTYHTNEAKGTEFAESADAALQGDPALQDAGDSSRKEYFI

SEQ ID NO: 35630 - protein, 107 aa, Homo sapiens
  Payload ID: 7047
  Gene Symbol: GYPC
  Gene Name: glycophorin C (Gerbich blood group)
  Uniprot ID: P04921
  ENSP ID: ENSP00000349354
MASASTTMHTTTIAEPDPGMSGWPDGRMETSTPTIMDIVVIAGVIAAVAIVLVSLLFVMLRYMYRHKGTYHTNEAKGTEFAESADAALQGDPALQDAGDSSRKEYFI

SEQ ID NO: 35631 - protein, 109 aa, Homo sapiens
  Payload ID: 7047
  Gene Symbol: GYPC
  Gene Name: glycophorin C (Gerbich blood group)
  Uniprot ID: P04921
  ENSP ID: ENSP00000386904
MWSTRSPNSTAWPLSLEPDPGMSGWPDGRMETSTPTIMDIVVIAGVIAAVAIVLVSLLFVMLRYMYRHKGTYHTNEAKGTEFAESADAALQGDPALQDAGDSSRKEYFI

SEQ ID NO: 35632 - protein, 78 aa, Homo sapiens
  Payload ID: 7048
  Gene Symbol: GYPE
  Gene Name: glycophorin E (MNS blood group)
  Uniprot ID: P15421
  ENSP ID: ENSP00000351430
MYGKIIFVLLLSGIVSISASSTTGVAMHTSTSSSVTKSYISSQTNGITLINWWAMARVIFEVMLVVVGMIILISYCIR

SEQ ID NO: 35633 - protein, 78 aa, Homo sapiens; identical to SEQ ID NO: 35632
  Payload ID: 7048
  Gene Symbol: GYPE
  Gene Name: glycophorin E (MNS blood group)
  Uniprot ID: P15421
  ENSP ID: ENSP00000400698

SEQ ID NO: 35634 - protein, 59 aa, Homo sapiens
  Payload ID: 7048
  Gene Symbol: GYPE
  Gene Name: glycophorin E (MNS blood group)
  ENSP ID: ENSP00000426746
MYGKIIFVLLLSGIVSISASSTTGVAMHTSTSSSVTKSYISSQTNGCVIGNIICSDKSK

SEQ ID NO: 35635 - protein, 560 aa, Homo sapiens
  Payload ID: 7049
  Gene Symbol: GPNMB
  Gene Name: glycoprotein (transmembrane) nmb
  Uniprot ID: Q14956
  ENSP ID: ENSP00000258733
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMANSALISVGCLAIFVTVISLLVYKKHKEYNPIENSPGNVVRSKGLSVFLNRAKAVFFPGNQEKDPLLKNQEFKGVS

SEQ ID NO: 35636 - protein, 572 aa, Homo sapiens
  Payload ID: 7049
  Gene Symbol: GPNMB
  Gene Name: glycoprotein (transmembrane) nmb
  Uniprot ID: Q14956
  ENSP ID: ENSP00000371420
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLATTLKSYDSNTPGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMANSALISVGCLAIFVTVISLLVYKKHKEYNPIENSPGNVVRSKGLSVFLNRAKAVFFPGNQEKDPLLKNQEFKGVS

SEQ ID NO: 35637 - protein, 206 aa, Homo sapiens
  Payload ID: 7049
  Gene Symbol: GPNMB
  Gene Name: glycoprotein (transmembrane) nmb
  ENSP ID: ENSP00000386476
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGWLLQTPKLLLYLSLKFQPSLFLLYN

SEQ ID NO: 35638 - protein, 534 aa, Homo sapiens
  Payload ID: 7050
  Gene Symbol: GP2
  Gene Name: glycoprotein 2 (zymogen granule membrane)
  Uniprot ID: P55259
  ENSP ID: ENSP00000304044
MPHLMERMVGSGLLWLALVSCILTQASAVQRGYGNPIEASSYGLDLDCGAPGTPEAHVCFDPCQNYTLLDEPFRSTENSAGSQGCDKNMSGWYRFVGEGGVRMSETCVQVHRCQTDAPMWLNGTHPALGDGITNHTACAHWSGNCCFWKTEVLVKACPGGYHVYRLEGTPWCNLRYCTDPSTVEDKCEKACRPEEECLALNSTWGCFCRQDLNSSDVHSLQPQLDCGPREIKVKVDKCLLGGLGLGEEVIAYLRDPNCSSILQTEERNWVSVTSPVQASACRNILERNQTHAIYKNTLSLVNDFIIRDTILNINFQCAYPLDMKVSLQAALQPIVSSLNVSVDGNGEFIVRMALFQDQNYTNPYEGDAVELSVESVLYVGAILEQGDTSRFNLVLRNCYATPTEDKADLVKYFIIRNSCSNQRDSTIHVEENGQSSESRFSVQMFMFAGHYDLVFLHCEIHLCDSLNEQCQPSCSRSQVRSEVPAIDLARVLDLGPITRRGAQSPGVMNGTPSTAGFLVAWPMVLLTVLLAWLF

SEQ ID NO: 35639 - protein, 387 aa, Homo sapiens
  Payload ID: 7050
  Gene Symbol: GP2
  Gene Name: glycoprotein 2 (zymogen granule membrane)
  Uniprot ID: P55259
  ENSP ID: ENSP00000343861
MPHLMERMVGSGLLWLALVSCILTQASAVQRDPSTVEDKCEKACRPEEECLALNSTWGCFCRQDLNSSDVHSLQPQLDCGPREIKVKVDKCLLGGLGLGEEVIAYLRDPNCSSILQTEERNWVSVTSPVQASACRNILERNQTHAIYKNTLSLVNDFIIRDTILNINFQCAYPLDMKVSLQAALQPIVSSLNVSVDGNGEFIVRMALFQDQNYTNPYEGDAVELSVESVLYVGAILEQGDTSRFNLVLRNCYATPTEDKADLVKYFIIRNSCSNQRDSTIHVEENGQSSESRFSVQMFMFAGHYDLVFLHCEIHLCDSLNEQCQPSCSRSQVRSEVPAIDLARVLDLGPITRRGAQSPGVMNGTPSTAGFLVAWPMVLLTVLLAWLF

SEQ ID NO: 35640 - protein, 390 aa, Homo sapiens
  Payload ID: 7050
  Gene Symbol: GP2
  Gene Name: glycoprotein 2 (zymogen granule membrane)
  Uniprot ID: P55259
  ENSP ID: ENSP00000370765
MPHLMERMVGSGLLWLALVSCILTQASAVQRVPRDPSTVEDKCEKACRPEEECLALNSTWGCFCRQDLNSSDVHSLQPQLDCGPREIKVKVDKCLLGGLGLGEEVIAYLRDPNCSSILQTEERNWVSVTSPVQASACRNILERNQTHAIYKNTLSLVNDFIIRDTILNINFQCAYPLDMKVSLQAALQPIVSSLNVSVDGNGEFIVRMALFQDQNYTNPYEGDAVELSVESVLYVGAILEQGDTSRFNLVLRNCYATPTEDKADLVKYFIIRNSCSNQRDSTIHVEENGQSSESRFSVQMFMFAGHYDLVFLHCEIHLCDSLNEQCQPSCSRSQVRSEVPAIDLARVLDLGPITRRGAQSPGVMNGTPSTAGFLVAWPMVLLTVLLAWLF

SEQ ID NO: 35641 - protein, 537 aa, Homo sapiens
  Payload ID: 7050
  Gene Symbol: GP2
  Gene Name: glycoprotein 2 (zymogen granule membrane)
  Uniprot ID: P55259
  ENSP ID: ENSP00000370767
MPHLMERMVGSGLLWLALVSCILTQASAVQRGYGNPIEASSYGLDLDCGAPGTPEAHVCFDPCQNYTLLDEPFRSTENSAGSQGCDKNMSGWYRFVGEGGVRMSETCVQVHRCQTDAPMWLNGTHPALGDGITNHTACAHWSGNCCFWKTEVLVKACPGGYHVYRLEGTPWCNLRYCTVPRDPSTVEDKCEKACRPEEECLALNSTWGCFCRQDLNSSDVHSLQPQLDCGPREIKVKVDKCLLGGLGLGEEVIAYLRDPNCSSILQTEERNWVSVTSPVQASACRNILERNQTHAIYKNTLSLVNDFIIRDTILNINFQCAYPLDMKVSLQAALQPIVSSLNVSVDGNGEFIVRMALFQDQNYTNPYEGDAVELSVESVLYVGAILEQGDTSRFNLVLRNCYATPTEDKADLVKYFIIRNSCSNQRDSTIHVEENGQSSESRFSVQMFMFAGHYDLVFLHCEIHLCDSLNEQCQPSCSRSQVRSEVPAIDLARVLDLGPITRRGAQSPGVMNGTPSTAGFLVAWPMVLLTVLLAWLF

SEQ ID NO: 35642 - protein, 128 aa, Homo sapiens
  Payload ID: 7050
  Gene Symbol: GP2
  Gene Name: glycoprotein 2 (zymogen granule membrane)
  ENSP ID: ENSP00000460059
MPHLMERMVGSGLLWLALVSCILTQASAVQRGYGNPIEASSYGLDLDCGAPGTPEAHVCFDPCQNYTLLDEPFRSTENSAGSQGCDKNMSGWYRFVGEGGVRMSETCVQVHRCQTDAPMWLNGTHPAL

SEQ ID NO: 35643 - protein, 42 aa, Homo sapiens
  Payload ID: 7050
  Gene Symbol: GP2
  Gene Name: glycoprotein 2 (zymogen granule membrane)
  ENSP ID: ENSP00000460124
  MOD_RES (1)..(1): Any amino acid
XERMVGSGLLWLALVSCILTQASAVQRGKYSAHLASQMSRKT

SEQ ID NO: 35644 - protein, 145 aa, Homo sapiens
  Payload ID: 7050
  Gene Symbol: GP2
  Gene Name: glycoprotein 2 (zymogen granule membrane)
  ENSP ID: ENSP00000460466
MPHLMERMVGSGLLWLALVSCILTQASAVQRDPSTVEDKCEKACRPEEECLALNSTWGCFCRQDLNSSDVHSLQPQLDCGPREIKVKVDKCLLGGLGLGEEVIAYLRDPNCSSILQTEERNWVSVTSPVQASACRNILERNQTHA

SEQ ID NO: 35645 - protein, 163 aa, Homo sapiens
  Payload ID: 7050
  Gene Symbol: GP2
  Gene Name: glycoprotein 2 (zymogen granule membrane)
  ENSP ID: ENSP00000461061
MPHLMERMVGSGLLWLALVSCILTQASAVQRGEGGVRMSETCVQVHRCQTDAPMWLNGTHPALGDGITNHTACAHWSGNCCFWKTEVLVKACPGGYHVYRLEGTPWCNLRYCTDPSTVEDKCEKACRPEEECLALNSTWGCFCRQDLNSSDVHSLQPQLDCGP

SEQ ID NO: 35646 - protein, 141 aa, Homo sapiens
  Payload ID: 7050
  Gene Symbol: GP2
  Gene Name: glycoprotein 2 (zymogen granule membrane)
  ENSP ID: ENSP00000461632
MSGWYRFVGEGGVRMSETCVQVHRCQTDAPMWLNGTHPALGDGITNHTACAHWSGNCCFWKTEVLVKACPGGYHVYRLEGTPWCNLRYCTDPSTVEDKCEKACRPEEECLALNSTWGCFCRQDLNSSDVHSLQPQLDCGPR

SEQ ID NO: 35647 - protein, 319 aa, Homo sapiens
  Payload ID: 7051
  Gene Symbol: GPA33
  Gene Name: glycoprotein A33 (transmembrane)
  Uniprot ID: Q99795
  ENSP ID: ENSP00000356842
MVGKMWPVLWTLCAVRVTVDAISVETPQDVLRASQGKSVTLPCTYHTSTSSREGLIQWDKLLLTHTERVVIWPFSNKNYIHGELYKNRVSISNNAEQSDASITIDQLTMADNGTYECSVSLMSDLEGNTKSRVRLLVLVPPSKPECGIEGETIIGNNIQLTCQSKEGSPTPQYSWKRYNILNQEQPLAQPASGQPVSLKNISTDTSGYYICTSSNEEGTQFCNITVAVRSPSMNVALYVGIAVGVVAALIIIGIIIYCCCCRGKDDNTEDKEDARPNREAYEEPPEQLRELSREREEEDDYRQEEQRSTGRESPDHLDQ

SEQ ID NO: 35648 - protein, 81 aa, Homo sapiens
  Payload ID: 7051
  Gene Symbol: GPA33
  Gene Name: glycoprotein A33 (transmembrane)
  ENSP ID: ENSP00000431195
MVGKMWPVLWTLCAEHLGNKSTHRRNLRLPHDLRIHSQGDRRCHLCGNSAGRSSGFAGKECHPALHLPHFHLQSRGTYSMG

SEQ ID NO: 35649 - protein, 66 aa, Homo sapiens
  Payload ID: 7051
  Gene Symbol: GPA33
  Gene Name: glycoprotein A33 (transmembrane)
  ENSP ID: ENSP00000488407
MADNGTYECSVSLMSDLEGNTKSRVRLLVLVPPSKPECGIEGETIIGNNIQLTCQSKEGSPTPQYS

SEQ ID NO: 35650 - protein, 129 aa, Homo sapiens
  Payload ID: 7052
  Gene Symbol: GPHA2
  Gene Name: glycoprotein hormone alpha 2
  Uniprot ID: Q96T91
  ENSP ID: ENSP00000279168
MPMASPQTLVLYLLVLAVTEAWGQEAVIPGCHLHPFNVTVRSDRQGTCQGSHVAQACVGHCESSAFPSRYSVLVASGYRHNITSVSQCCTISGLKKVKVQLQCVGSRREELEIFTARACQCDMCRLSRY

SEQ ID NO: 35651 - protein, 118 aa, Homo sapiens
  Payload ID: 7052
  Gene Symbol: GPHA2
  Gene Name: glycoprotein hormone alpha 2
  ENSP ID: ENSP00000431352
MPMASPQTLVLYLLVLAVTEAWGQEAVIPGCHLHPFNVTVRSDRQGTCQGSHVAQACVGHCESSAFPSRYSVLVASGYRHNITSVSQCCTISGLKKVRRARARWMDAGVAGRPERWRS

SEQ ID NO: 35652 - protein, 129 aa, Homo sapiens; identical to SEQ ID NO: 35650
  Payload ID: 7052
  Gene Symbol: GPHA2
  Gene Name: glycoprotein hormone alpha 2
  Uniprot ID: Q96T91
  ENSP ID: ENSP00000432918

SEQ ID NO: 35653 - protein, 130 aa, Homo sapiens
  Payload ID: 7053
  Gene Symbol: GPHB5
  Gene Name: glycoprotein hormone beta 5
  Uniprot ID: Q86YW7
  ENSP ID: ENSP00000478993
MKLAFLFLGPMALLLLAGYGCVLGASSGNLRTFVGCAVREFTFLAKKPGCRGLRITTDACWGRCETWEKPILEPPYIEAHHRVCTYNETKQVTVKLPNCAPGVDPFYTYPVAIRCDCGACSTATTECETI

SEQ ID NO: 35654 - protein, 130 aa, Homo sapiens; identical to SEQ ID NO: 35653
  Payload ID: 7053
  Gene Symbol: GPHB5
  Gene Name: glycoprotein hormone beta 5
  Uniprot ID: Q86YW7
  ENSP ID: ENSP00000479431

SEQ ID NO: 35655 - protein, 116 aa, Homo sapiens
  Payload ID: 7054
  Gene Symbol: CGA
  Gene Name: glycoprotein hormones, alpha polypeptide
  ENSP ID: ENSP00000358595
MQLSFWSHCRCFCMFSIPLLMCRVRDQICDCPECTLQENPFFSQPGAPILQCMGCCFSRAYPTPLRSKKTMLVQKNVTSESTCCVAKSYNRVTVMGGFKVENHTACHCSTCYYHKS

SEQ ID NO: 35656 - protein, 147 aa, Homo sapiens
  Payload ID: 7054
  Gene Symbol: CGA
  Gene Name: glycoprotein hormones, alpha polypeptide
  ENSP ID: ENSP00000482232
MDYYRKYAAIFLVTLSVFLHVLHSAPDVQETGFHHVAQAALKLLSSSNPPTKASQSARITDCPECTLQENPFFSQPGAPILQCMGCCFSRAYPTPLRSKKTMLVQKNVTSESTCCVAKSYNRVTVMGGFKVENHTACHCSTCYYHKS

SEQ ID NO: 35657 - protein, 116 aa, Homo sapiens
  Payload ID: 7054
  Gene Symbol: CGA
  Gene Name: glycoprotein hormones, alpha polypeptide
  Uniprot ID: P01215
  ENSP ID: ENSP00000486024
MDYYRKYAAIFLVTLSVFLHVLHSAPDVQDCPECTLQENPFFSQPGAPILQCMGCCFSRAYPTPLRSKKTMLVQKNVTSESTCCVAKSYNRVTVMGGFKVENHTACHCSTCYYHKS

SEQ ID NO: 35658 - protein, 62 aa, Homo sapiens
  Payload ID: 7054
  Gene Symbol: CGA
  Gene Name: glycoprotein hormones, alpha polypeptide
  ENSP ID: ENSP00000486666
MDYYRKYAAIFLVTLSVFLHVLHSAPDVQDCPECTLQENPFFSQPGAPILQCMGCCFSRAYP

SEQ ID NO: 35659 - protein, 101 aa, Homo sapiens
  Payload ID: 7054
  Gene Symbol: CGA
  Gene Name: glycoprotein hormones, alpha polypeptide
  ENSP ID: ENSP00000487300
MDYYRKYAAIFLVTLSVFLHVLHSAPDVQDCPECTLQENPFFSQPGAPILQCMGCCFSRAYPTPLRSKKTMLVQKNVTSESTCCVAKSYNRVRTSRSPEAF

SEQ ID NO: 35660 - protein, 652 aa, Homo sapiens
  Payload ID: 7055
  Gene Symbol: GP1BA
  Gene Name: glycoprotein Ib (platelet), alpha polypeptide
  Uniprot ID: P07359
  ENSP ID: ENSP00000329380
MPLLLLLLLLPSPLHPHPICEVSKVASHLEVNCDKRNLTALPPDLPKDTTILHLSENLLYTFSLATLMPYTRLTQLNLDRCELTKLQVDGTLPVLGTLDLSHNQLQSLPLLGQTLPALTVLDVSFNRLTSLPLGALRGLGELQELYLKGNELKTLPPGLLTPTPKLEKLSLANNNLTELPAGLLNGLENLDTLLLQENSLYTIPKGFFGSHLLPFAFLHGNPWLCNCEILYFRRWLQDNAENVYVWKQGVDVKAMTSNVASVQCDNSDKFPVYKYPGKGCPTLGDEGDTDLYDYYPEEDTEGDKVRATRTVVKFPTKAHTTPWGLFYSWSTASLDSQMPSSLHPTQESTKEQTTFPPRWTPNFTLHMESITFSKTPKSTTEPTPSPTTSEPVPEPAPNMTTLEPTPSPTTPEPTSEPAPSPTTPEPTSEPAPSPTTPEPTSEPAPSPTTPEPTPIPTIATSPTILVSATSLITPKSTFLTTTKPVSLLESTKKTIPELDQPPKLRGVLQGHLESSRNDPFLHPDFCCLLPLGFYVLGLFWLLFASVVLILLLSWVGHVKPQALDSGQGAALTTATQTTHLELQRGRQVTVPRAWLLFLRGSLPTFRSSLFLWVRPNGRVGPLVAGRRPSALSQGRGQDLLSTVSIRYSGHSL

SEQ ID NO: 35661 - protein, 626 aa, Homo sapiens
  Payload ID: 7055
  Gene Symbol: GP1BA
  Gene Name: glycoprotein Ib (platelet), alpha polypeptide
  ENSP ID: ENSP00000484439
MPLLLLLLLLPSPLHPHPICEVSKVASHLEVNCDKRNLTALPPDLPKDTTILHLSENLLYTFSLATLMPYTRLTQLNLDRCELTKLQVDGTLPVLGTLDLSHNQLQSLPLLGQTLPALTVLDVSFNRLTSLPLGALRGLGELQELYLKGNELKTLPPGLLTPTPKLEKLSLANNNLTELPAGLLNGLENLDTLLLQENSLYTIPKGFFGSHLLPFAFLHGNPWLCNCEILYFRRWLQDNAENVYVWKQGVDVKAMTSNVASVQCDNSDKFPVYKYPGKGCPTLGDEGDTDLYDYYPEEDTEGDKVRATRTVVKFPTKAHTTPWGLFYSWSTASLDSQMPSSLHPTQESTKEQTTFPPRWTPNFTLHMESITFSKTPKSTTEPTPSPTTSEPVPEPAPNMTTLEPTPSPTTPEPTSEPAPSPTTPEPTPIPTIATSPTILVSATSLITPKSTFLTTTKPVSLLESTKKTIPELDQPPKLRGVLQGHLESSRNDPFLHPDFCCLLPLGFYVLGLFWLLFASVVLILLLSWVGHVKPQALDSGQGAALTTATQTTHLELQRGRQVTVPRAWLLFLRGSLPTFRSSLFLWVRPNGRVGPLVAGRRPSALSQGRGQDLLSTVSIRYSGHSL

SEQ ID NO: 35662 - protein, 206 aa, Homo sapiens
  Payload ID: 7056
  Gene Symbol: GP1BB
  Gene Name: glycoprotein Ib (platelet), beta polypeptide
  Uniprot ID: P13224
  ENSP ID: ENSP00000383382
MGSGPRGALSLLLLLLAPPSRPAAGCPAPCSCAGTLVDCGRRGLTWASLPTAFPVDTTELVLTGNNLTALPPGLLDALPALRTAHLGANPWRCDCRLVPLRAWLAGRPERAPYRDLRCVAPPALRGRLLPYLAEDELRAACAPGPLCWGALAAQLALLGLGLLHALLLVLLLCRLRRLRARARARAAARLSLTDPLVAERAGTDES

SEQ ID NO: 35663 - protein, 330 aa, Homo sapiens
  Payload ID: 7057
  Gene Symbol: GINM1
  Gene Name: glycoprotein integral membrane 1
  Uniprot ID: Q9NU53
  ENSP ID: ENSP00000356389
MEGAPPGSLALRLLLFVALPASGWLTTGAPEPPPLSGAPQDGIRINVTTLKDDGDISKQQVVLNITYESGQVYVNDLPVNSGVTRISCQTLIVKNENLENLEEKEYFGIVSVRILVHEWPMTSGSSLQLIVIQEEVVEIDGKQVQQKDVTEIDILVKNRGVLRHSNYTLPLEESMLYSISRDSDILFTLPNLSKKESVSSLQTTSQYLIRNVETTVDEDVLPGKLPETPLRAEPPSSYKVMCQWMEKFRKDLCRFWSNVFPVFFQFLNIMVVGITGAAVVITILKVFFPVSEYKGILQLDKVDVIPVTAINLYPDGPEKRAENLEDKTCI

SEQ ID NO: 35664 - protein, 125 aa, Homo sapiens
  Payload ID: 7057
  Gene Symbol: GINM1
  Gene Name: glycoprotein integral membrane 1
  ENSP ID: ENSP00000407343
LQLIVIQEEVVEIDGKQVQQKDVTEIDILVKNRGVLRHSNYTLPLEESMLYSISRDSDILFTLPNLSKKESVSSLQTTSQYLIRNVETTVDEDVLPGKLPETPLRAEPPSSYKVLETVDSAPFRL

SEQ ID NO: 35665 - protein, 177 aa, Homo sapiens
  Payload ID: 7058
  Gene Symbol: GP9
  Gene Name: glycoprotein IX (platelet)
  Uniprot ID: P14770
  ENSP ID: ENSP00000303942
MPAWGALFLLWATAEATKDCPSPCTCRALETMGLWVDCRGHGLTALPALPARTRHLLLANNSLQSVPPGAFDHLPQLQTLDVTQNPWHCDCSLTYLRLWLEDRTPEALLQVRCASPSLAAHGPLGRLTGYQLGSCGWQLQASWVRPGVLWDVALVAVAALGLALLAGLLCATTEALD

SEQ ID NO: 35666 - protein, 278 aa, Homo sapiens
  Payload ID: 7059
  Gene Symbol: GPM6A
  Gene Name: glycoprotein M6A
  Uniprot ID: P51674
  ENSP ID: ENSP00000280187
MEENMEEGQTQKGCFECCIKCLGGIPYASLIATILLYAGVALFCGCGHEALSGTVNILQTYFEMARTAGDTLDVFTMIDIFKYVIYGIAAAFFVYGILLMVEGFFTTGAIKDLYGDFKITTCGRCVSAWFIMLTYLFMLAWLGVTAFTSLPVYMYFNLWTICRNTTLVEGANLCLDLRQFGIVTIGEEKKICTVSENFLRMCESTELNMTFHLFIVALAGAGAAVIAMVHYLMVLSANWAYVKDACRMQKYEDIKSKEEQELHDIHSTRSKERLNAYT

SEQ ID NO: 35667 - protein, 278 aa, Homo sapiens; identical to SEQ ID NO: 35666
  Payload ID: 7059
  Gene Symbol: GPM6A
  Gene Name: glycoprotein M6A
  Uniprot ID: P51674
  ENSP ID: ENSP00000377268

SEQ ID NO: 35668 - protein, 98 aa, Homo sapiens
  Payload ID: 7059
  Gene Symbol: GPM6A
  Gene Name: glycoprotein M6A
  ENSP ID: ENSP00000421373
MARTAGDTLDVFTMIDIFKYVIYGIAAAFFVYGILLMVEGFFTTGAIKDLYGDFKITTCGRCVSAWFIMLTYLFMLAWLGVTAFTSLPVYMYFNLWTI

SEQ ID NO: 35669 - protein, 41 aa, Homo sapiens
  Payload ID: 7059
  Gene Symbol: GPM6A
  Gene Name: glycoprotein M6A
  ENSP ID: ENSP00000421407
MARTAGDTLDVFTMIDIFKYVIYGIAAAFFVYGILLMVEGF

SEQ ID NO: 35670 - protein, 267 aa, Homo sapiens
  Payload ID: 7059
  Gene Symbol: GPM6A
  Gene Name: glycoprotein M6A
  Uniprot ID: P51674
  ENSP ID: ENSP00000421578
MGCFECCIKCLGGIPYASLIATILLYAGVALFCGCGHEALSGTVNILQTYFEMARTAGDTLDVFTMIDIFKYVIYGIAAAFFVYGILLMVEGFFTTGAIKDLYGDFKITTCGRCVSAWFIMLTYLFMLAWLGVTAFTSLPVYMYFNLWTICRNTTLVEGANLCLDLRQFGIVTIGEEKKICTVSENFLRMCESTELNMTFHLFIVALAGAGAAVIAMVHYLMVLSANWAYVKDACRMQKYEDIKSKEEQELHDIHSTRSKERLNAYT

SEQ ID NO: 35671 - protein, 49 aa, Homo sapiens
  Payload ID: 7059
  Gene Symbol: GPM6A
  Gene Name: glycoprotein M6A
  ENSP ID: ENSP00000422712
MARTAGDTLDVFTMIDIFKYVIYGIAAAFFVYGILLMVEGFFTTGAIKD

SEQ ID NO: 35672 - protein, 218 aa, Homo sapiens
  Payload ID: 7059
  Gene Symbol: GPM6A
  Gene Name: glycoprotein M6A
  ENSP ID: ENSP00000422959
MPTLGCFECCIKCLGGIPYASLIATILLYAGVALFCGCGHEALSGTVNILQTYFEMARTAGDTLDVFTMIDIFKYVIYGIAAAFFVYGILLMVEGFFTTGAIKDLYGDFKITTCGRCVSAWFIMLTYLFMLAWLGVTAFTSLPVYMYFNLWTICRNTTLVEGANLCLDLRQFGIVTIGEEKKICTVSENFLRMCESTELNMTFHLFIVALAGAGAAVI

SEQ ID NO: 35673 - protein, 129 aa, Homo sapiens
  Payload ID: 7059
  Gene Symbol: GPM6A
  Gene Name: glycoprotein M6A
  ENSP ID: ENSP00000423122
MEENMEEGQTQKGCFECCIKCLGGIPYASLIATILLYAGVALFCGCGHEALSGTVNILQTYFEMARTAGDTLDVFTMIDIFKYVIYGIAAAFFVYGILLMVEGFFTTGAIKDLYGDFKITTCGRCVSAW

SEQ ID NO: 35674 - protein, 271 aa, Homo sapiens
  Payload ID: 7059
  Gene Symbol: GPM6A
  Gene Name: glycoprotein M6A
  Uniprot ID: P51674
  ENSP ID: ENSP00000423984
MTDLEGCFECCIKCLGGIPYASLIATILLYAGVALFCGCGHEALSGTVNILQTYFEMARTAGDTLDVFTMIDIFKYVIYGIAAAFFVYGILLMVEGFFTTGAIKDLYGDFKITTCGRCVSAWFIMLTYLFMLAWLGVTAFTSLPVYMYFNLWTICRNTTLVEGANLCLDLRQFGIVTIGEEKKICTVSENFLRMCESTELNMTFHLFIVALAGAGAAVIAMVHYLMVLSANWAYVKDACRMQKYEDIKSKEEQELHDIHSTRSKERLNAYT

SEQ ID NO: 35675 - protein, 105 aa, Homo sapiens
  Payload ID: 7059
  Gene Symbol: GPM6A
  Gene Name: glycoprotein M6A
  ENSP ID: ENSP00000424075
MARTAGDTLDVFTMIDIFKYVIYGIAAAFFVYGILLMVEGFFTTGAIKDLYGDFKITTCGRCVSAWFIMLTYLFMLAWLGVTAFTSLPVYMYFNLWTICRNTTLV

SEQ ID NO: 35676 - protein, 82 aa, Homo sapiens
  Payload ID: 7059
  Gene Symbol: GPM6A
  Gene Name: glycoprotein M6A
  ENSP ID: ENSP00000424125
MARTAGDTLDVFTMIDIFKYVIYGIAAAFFVYGILLMVEGFFTTGAIKDLYGDFKITTCGRCVSAWFIMLTYLFMLAWLGVT

SEQ ID NO: 35677 - protein, 87 aa, Homo sapiens
  Payload ID: 7059
  Gene Symbol: GPM6A
  Gene Name: glycoprotein M6A
  ENSP ID: ENSP00000424443
MARTAGDTLDVFTMIDIFKYVIYGIAAAFFVYGILLMVEGFFTTGAIKDLYGDFKITTCGRCFIMLTYLFMLAWLGVTAFTSLPVYM

SEQ ID NO: 35678 - protein, 89 aa, Homo sapiens
  Payload ID: 7059
  Gene Symbol: GPM6A
  Gene Name: glycoprotein M6A
  ENSP ID: ENSP00000425409
MARTAGDTLDVFTMIDIFKYVIYGIAAAFFVYGILLMVEGFFTTGAIKDLYGDFKITTCGRCVSAWFIMLTYLFMLAWLGVTAFTSLPV

SEQ ID NO: 35679 - protein, 66 aa, Homo sapiens
  Payload ID: 7059
  Gene Symbol: GPM6A
  Gene Name: glycoprotein M6A
  ENSP ID: ENSP00000425463
MTDLEGCFECCIKCLGGIPYASLIATILLYAGVALFCGCGHEALSGTVNILQTYFEMARTAGDTLD

SEQ ID NO: 35680 - protein, 43 aa, Homo sapiens
  Payload ID: 7059
  Gene Symbol: GPM6A
  Gene Name: glycoprotein M6A
  ENSP ID: ENSP00000425925
MARTAGDTLDVFTMIDIFKYVIYGIAAAFFVYGILLMVEGFFT

SEQ ID NO: 35681 - protein, 10 aa, Homo sapiens
  Payload ID: 7059
  Gene Symbol: GPM6A
  Gene Name: glycoprotein M6A
  ENSP ID: ENSP00000426352
MEENMEEGQT

SEQ ID NO: 35682 - protein, 117 aa, Homo sapiens
  Payload ID: 7059
  Gene Symbol: GPM6A
  Gene Name: glycoprotein M6A
  ENSP ID: ENSP00000426821
MARTAGDTLDVFTMIDIFKYVIYGIAAAFFVYGILLMVEGFFTTGAIKDLYGDFKITTCGRCVSAWFIMLTYLFMLAWLGVTAFTSLPVYMYFNLWTICRNTTLVEGANLCLDLRQF

SEQ ID NO: 35683 - protein, 119 aa, Homo sapiens
  Payload ID: 7059
  Gene Symbol: GPM6A
  Gene Name: glycoprotein M6A
  ENSP ID: ENSP00000426984
MARTAGDTLDVFTMIDIFKYVIYGIAAAFFVYGILLMVEGFFTTGAIKDLYGDFKITTCGRCVSAWFIMLTYLFMLAWLGVTAFTSLPVYMYFNLWTICRNTTLVEGANLCLDLRQFGK

SEQ ID NO: 35684 - protein, 328 aa, Homo sapiens
  Payload ID: 7060
  Gene Symbol: GPM6B
  Gene Name: glycoprotein M6B
  Uniprot ID: Q13491
  ENSP ID: ENSP00000316861
MKPAMETAAEENTEQSQERKVNSRAEMEIGRYHWMYPGSKNHQYHPVPTLGDRASPLSSPGCFECCIKCLGGVPYASLVATILCFSGVALFCGCGHVALAGTVAILEQHFSTNASDHALLSEVIQLMQYVIYGIASFFFLYGIILLAEGFYTTSAVKELHGEFKTTACGRCISGMFVFLTYVLGVAWLGVFGFSAVPVFMFYNIWSTCEVIKSPQTNGTTGVEQICVDIRQYGIIPWNAFPGKICGSALENICNTNEFYMSYHLFIVACAGAGATVIALIHFLMILSSNWAYLKDASKMQAYQDIKAKEEQELQDIQSRSKEQLNSYT

SEQ ID NO: 35685 - protein, 305 aa, Homo sapiens
  Payload ID: 7060
  Gene Symbol: GPM6B
  Gene Name: glycoprotein M6B
  Uniprot ID: Q13491
  ENSP ID: ENSP00000347258
MKPAMETAAEENTEQSQERKVNSRAEMEIGRYHWMYPGSKNHQYHPVPTLGDRASPLSSPGCFECCIKCLGGVPYASLVATILCFSGVALFCGCGHVALAGTVAILEQHFSTNASDHALLSEVIQLMQYVIYGIASFFFLYGIILLAEGFYTTSAVKELHGEFKTTACGRCISGMFVFLTYVLGVAWLGVFGFSAVPVFMFYNIWSTCEVIKSPQTNGTTGVEQICVDIRQYGIIPWNAFPGKICGSALENICNTNEFYMSYHLFIVACAGAGATVIALLIYMMATTYNYAVLKFKSREDCCTKF

SEQ ID NO: 35686 - protein, 265 aa, Homo sapiens
  Payload ID: 7060
  Gene Symbol: GPM6B
  Gene Name: glycoprotein M6B
  Uniprot ID: Q13491
  ENSP ID: ENSP00000349420
MKPAMETAAEENTEQSQERKGCFECCIKCLGGVPYASLVATILCFSGVALFCGCGHVALAGTVAILEQHFSTNASDHALLSEVIQLMQYVIYGIASFFFLYGIILLAEGFYTTSAVKELHGEFKTTACGRCISGMFVFLTYVLGVAWLGVFGFSAVPVFMFYNIWSTCEVIKSPQTNGTTGVEQICVDIRQYGIIPWNAFPGKICGSALENICNTNEFYMSYHLFIVACAGAGATVIALLIYMMATTYNYAVLKFKSREDCCTKF

SEQ ID NO: 35687 - protein, 179 aa, Homo sapiens
  Payload ID: 7060
  Gene Symbol: GPM6B
  Gene Name: glycoprotein M6B
  ENSP ID: ENSP00000381402
MQYVIYGIASFFFLYGIILLAEGFYTTSAVKELHGEFKTTACGRCISGMFVFLTYVLGVAWLGVFGFSAVPVFMFYNIWSTCEVIKSPQTNGTTGVEQICVDIRQYGIIPWNAFPGKICGSALENICNTNEFYMSYHLFIVACAGAGATVIALLIYMMATTYNYAVLKFKSREDCCTKF

SEQ ID NO: 35688 - protein, 246 aa, Homo sapiens
  Payload ID: 7060
  Gene Symbol: GPM6B
  Gene Name: glycoprotein M6B
  Uniprot ID: Q13491
  ENSP ID: ENSP00000389915
MGCFECCIKCLGGVPYASLVATILCFSGVALFCGCGHVALAGTVAILEQHFSTNASDHALLSEVIQLMQYVIYGIASFFFLYGIILLAEGFYTTSAVKELHGEFKTTACGRCISGMFVFLTYVLGVAWLGVFGFSAVPVFMFYNIWSTCEVIKSPQTNGTTGVEQICVDIRQYGIIPWNAFPGKICGSALENICNTNEFYMSYHLFIVACAGAGATVIALLIYMMATTYNYAVLKFKSREDCCTKF

SEQ ID NO: 35689 - protein, 94 aa, Homo sapiens
  Payload ID: 7060
  Gene Symbol: GPM6B
  Gene Name: glycoprotein M6B
  ENSP ID: ENSP00000418199
MQYVIYGIASFFFLYGIILLAEGFYTTSAVKELHGEFKTTACGRCISGMFVFLTYVLGVAWLGVFGFSAVPVFMFYNIWSTCEVIKSPQTNGTT

SEQ ID NO: 35690 - protein, 107 aa, Homo sapiens
  Payload ID: 7060
  Gene Symbol: GPM6B
  Gene Name: glycoprotein M6B
  ENSP ID: ENSP00000418594
MKPAMETAAEENTEQSQERKGCFECCIKCLGGVPYASLVATILCFSGVALFCGCGHVALAGTVAILEQHFSTNASDHALLSEVIQLMQYVIYGIASFFFLYGIILLA

SEQ ID NO: 35691 - protein, 76 aa, Homo sapiens
  Payload ID: 7060
  Gene Symbol: GPM6B
  Gene Name: glycoprotein M6B
  ENSP ID: ENSP00000419779
MQYVIYGIASFFFLYGIILLAEGFYTTSAVKELHGEFKTTACGRCISGMFVFLTYVLGVAWLGVFGFSAVPVFMFY

SEQ ID NO: 35692 - protein, 302 aa, Homo sapiens
  Payload ID: 7060
  Gene Symbol: GPM6B
  Gene Name: glycoprotein M6B
  ENSP ID: ENSP00000419904
MEIGRYHWMYPGSKNHQYHPVPTLGDRASPLSSPGCFECCIKCLGGVPYASLVATILCFSGVALFCGCGHVALAGTVAILEQHFSTNASDHALLSEVIQLMQYVIYGIASFFFLYGIILLAEGFYTTSAVKELHGEFKTTACGRCISGMFVFLTYVLGVAWLGVFGFSAVPVFMFYNIWSTCEVIKSPQTNGTTGVEQICVDIRQYGIIPWNAFPGKICGSALENICNTNEFYMSYHLFIVACAGAGATVIALIHFLMILSSNWAYLKDASKMQAYQDIKAKEEQELQDIQSRSKEQLNSYT

SEQ ID NO: 35693 - protein, 560 aa, Homo sapiens
  Payload ID: 7061
  Gene Symbol: GP5
  Gene Name: glycoprotein V (platelet)
  Uniprot ID: P40197
  ENSP ID: ENSP00000383931
MLRGTLLCAVLGLLRAQPFPCPPACKCVFRDAAQCSGGDVARISALGLPTNLTHILLFGMGRGVLQSQSFSGMTVLQRLMISDSHISAVAPGTFSDLIKLKTLRLSRNKITHLPGALLDKMVLLEQLFLDHNALRGIDQNMFQKLVNLQELALNQNQLDFLPASLFTNLENLKLLDLSGNNLTHLPKGLLGAQAKLERLLLHSNRLVSLDSGLLNSLGALTELQFHRNHIRSIAPGAFDRLPNLSSLTLSRNHLAFLPSALFLHSHNLTLLTLFENPLAELPGVLFGEMGGLQELWLNRTQLRTLPAAAFRNLSRLRYLGVTLSPRLSALPQGAFQGLGELQVLALHSNGLTALPDGLLRGLGKLRQVSLRRNRLRALPRALFRNLSSLESVQLDHNQLETLPGDVFGALPRLTEVLLGHNSWRCDCGLGPFLGWLRQHLGLVGGEEPPRCAGPGAHAGLPLWALPGGDAECPGPRGPPPRPAADSSSEAPVHPALAPNSSEPWVWAQPVTTGKGQDHSPFWGFYFLLLAVQAMITVIIVFAMIKIGQLFRKLIRERALG

SEQ ID NO: 35694 - protein, 620 aa, Homo sapiens
  Payload ID: 7062
  Gene Symbol: GP6
  Gene Name: glycoprotein VI (platelet)
  Uniprot ID: Q9HCN6
  ENSP ID: ENSP00000308782
MSPSPTALFCLGLCLGRVPAQSGPLPKPSLQALPSSLVPLEKPVTLRCQGPPGVDLYRLEKLSSSRYQDQAVLFIPAMKRSLAGRYRCSYQNGSLWSLPSDQLELVATGVFAKPSLSAQPGPAVSSGGDVTLQCQTRYGFDQFALYKEGDPAPYKNPERWYRASFPIITVTAAHSGTYRCYSFSSRDPYLWSAPSDPLELVVTGTSVTPSRLPTEPPSPVAEFSEATAELTVSFTNEVFTTETSRSITASPKESDSPAGESCPPVLHQGQPGPDMPRGCDPNNPGGVSGRGLAQPEEAPAAQGQGCAEAASAPPAPPADPEIKRGSGWRPTGCSQPRVMFMTAEPQARSYPREGSWHGRRLKDWRVWSVEAGGQRLQLWKRGHAASSWCSIREPFGQCLSVCLPLCLRAPSIWDGRNLWRPHPPPCTLWMTWYPGWTTYWPLSSTSLIWAPDGSLRFPALRVDSVPSSVQNPPVLPFGPLCSCLVFPRNSHPHSISHCGLTNLLSSLRTGLAGSLGMSFIFLSVKLARCPLPFTLENKISLCNMVKPHLYQQNKKTQKLARCGGASLYSQQLRGLRWENGLSLGGRGCSELRSHHCTLARVTKPDFVSKNTGMNMSITLI

SEQ ID NO: 35695 - protein, 321 aa, Homo sapiens
  Payload ID: 7062
  Gene Symbol: GP6
  Gene Name: glycoprotein VI (platelet)
  Uniprot ID: Q9HCN6
  ENSP ID: ENSP00000334552
MSPSPTALFCLGLCLGRVPAQSGPLPKPSLQALPSSLVPLEKPVTLRCQGPPGVDLYRLEKLSSSRYQDQAVLFIPAMKRSLAGRYRCSYQNGSLWSLPSDQLELVATGVFAKPSLSAQPGPAVSSGGDVTLQCQTRYGFDQFALYKEGDPAPYKNPERWYRASFPIITVTAAHSGTYRCYSFSSRDPYLWSAPSDPLELVVTEFSEATAELTVSFTNEVFTTETSRSITASPKESDSPAGPARQYYTKGNLVRICLGAVILIILAGFLAEDWHSRRKRLRHRGRAVQRPLPPLPPLPLTRKSNGGQDGGRQDVHSRGLCS

SEQ ID NO: 35696 - protein, 339 aa, Homo sapiens
  Payload ID: 7062
  Gene Symbol: GP6
  Gene Name: glycoprotein VI (platelet)
  Uniprot ID: Q9HCN6
  ENSP ID: ENSP00000394922
MSPSPTALFCLGLCLGRVPAQSGPLPKPSLQALPSSLVPLEKPVTLRCQGPPGVDLYRLEKLSSSRYQDQAVLFIPAMKRSLAGRYRCSYQNGSLWSLPSDQLELVATGVFAKPSLSAQPGPAVSSGGDVTLQCQTRYGFDQFALYKEGDPAPYKNPERWYRASFPIITVTAAHSGTYRCYSFSSRDPYLWSAPSDPLELVVTGTSVTPSRLPTEPPSPVAEFSEATAELTVSFTNEVFTTETSRSITASPKESDSPAGPARQYYTKGNLVRICLGAVILIILAGFLAEDWHSRRKRLRHRGRAVQRPLPPLPPLPLTRKSNGGQDGGRQDVHSRGLCS

SEQ ID NO: 35697 - protein, 117 aa, Homo sapiens
  Payload ID: 7062
  Gene Symbol: GP6
  Gene Name: glycoprotein VI (platelet)
  ENSP ID: ENSP00000464922
MKRSLAGRYRCSYQNGSLWSLPSDQLELVATGVFAKPSLSAQPGPAVSSGGDVTLQCQTRYGFDQFALYKEGDPAPYKNPERWYRASFPIITVTAAHSGTYRCYSFSSRDPYLWSAP

SEQ ID NO: 35698 - protein, 620 aa, Homo sapiens; identical to SEQ ID NO: 35694
  Payload ID: 7062
  Gene Symbol: GP6
  Gene Name: glycoprotein VI (platelet)
  ENSP ID: ENSP00000478025

SEQ ID NO: 35699 - protein, 321 aa, Homo sapiens; identical to SEQ ID NO: 35695
  Payload ID: 7062
  Gene Symbol: GP6
  Gene Name: glycoprotein VI (platelet)
  Uniprot ID: Q9HCN6
  ENSP ID: ENSP00000478674

SEQ ID NO: 35700 - protein, 321 aa, Homo sapiens; identical to SEQ ID NO: 35695
  Payload ID: 7062
  Gene Symbol: GP6
  Gene Name: glycoprotein VI (platelet)
  Uniprot ID: Q9HCN6
  ENSP ID: ENSP00000478709

SEQ ID NO: 35701 - protein, 321 aa, Homo sapiens; identical to SEQ ID NO: 35695
  Payload ID: 7062
  Gene Symbol: GP6
  Gene Name: glycoprotein VI (platelet)
  Uniprot ID: Q9HCN6
  ENSP ID: ENSP00000478918

SEQ ID NO: 35702 - protein, 620 aa, Homo sapiens; identical to SEQ ID NO: 35694
  Payload ID: 7062
  Gene Symbol: GP6
  Gene Name: glycoprotein VI (platelet)
  ENSP ID: ENSP00000479034

SEQ ID NO: 35703 - protein, 321 aa, Homo sapiens; identical to SEQ ID NO: 35695
  Payload ID: 7062
  Gene Symbol: GP6
  Gene Name: glycoprotein VI (platelet)
  ENSP ID: ENSP00000479513

SEQ ID NO: 35704 - protein, 620 aa, Homo sapiens; identical to SEQ ID NO: 35694
  Payload ID: 7062
  Gene Symbol: GP6
  Gene Name: glycoprotein VI (platelet)
  Uniprot ID: Q9HCN6
  ENSP ID: ENSP00000479668

SEQ ID NO: 35705 - protein, 321 aa, Homo sapiens; identical to SEQ ID NO: 35695
  Payload ID: 7062
  Gene Symbol: GP6
  Gene Name: glycoprotein VI (platelet)
  Uniprot ID: Q9HCN6
  ENSP ID: ENSP00000479873

SEQ ID NO: 35706 - protein, 620 aa, Homo sapiens; identical to SEQ ID NO: 35694
  Payload ID: 7062
  Gene Symbol: GP6
  Gene Name: glycoprotein VI (platelet)
  ENSP ID: ENSP00000479975

SEQ ID NO: 35707 - protein, 321 aa, Homo sapiens; identical to SEQ ID NO: 35695
  Payload ID: 7062
  Gene Symbol: GP6
  Gene Name: glycoprotein VI (platelet)
  ENSP ID: ENSP00000480178

SEQ ID NO: 35708 - protein, 620 aa, Homo sapiens; identical to SEQ ID NO: 35694
  Payload ID: 7062
  Gene Symbol: GP6
  Gene Name: glycoprotein VI (platelet)
  ENSP ID: ENSP00000480243

SEQ ID NO: 35709 - protein, 620 aa, Homo sapiens; identical to SEQ ID NO: 35694
  Payload ID: 7062
  Gene Symbol: GP6
  Gene Name: glycoprotein VI (platelet)
  ENSP ID: ENSP00000481075

SEQ ID NO: 35710 - protein, 321 aa, Homo sapiens; identical to SEQ ID NO: 35695
  Payload ID: 7062
  Gene Symbol: GP6
  Gene Name: glycoprotein VI (platelet)
  ENSP ID: ENSP00000481125

SEQ ID NO: 35711 - protein, 620 aa, Homo sapiens; identical to SEQ ID NO: 35694
  Payload ID: 7062
  Gene Symbol: GP6
  Gene Name: glycoprotein VI (platelet)
  Uniprot ID: Q9HCN6
  ENSP ID: ENSP00000481524

SEQ ID NO: 35712 - protein, 321 aa, Homo sapiens; identical to SEQ ID NO: 35695
  Payload ID: 7062
  Gene Symbol: GP6
  Gene Name: glycoprotein VI (platelet)
  ENSP ID: ENSP00000481583

SEQ ID NO: 35713 - protein, 620 aa, Homo sapiens; identical to SEQ ID NO: 35694
  Payload ID: 7062
  Gene Symbol: GP6
  Gene Name: glycoprotein VI (platelet)
  Uniprot ID: Q9HCN6
  ENSP ID: ENSP00000482601

SEQ ID NO: 35714 - protein, 339 aa, Homo sapiens; identical to SEQ ID NO: 35696
  Payload ID: 7062
  Gene Symbol: GP6
  Gene Name: glycoprotein VI (platelet)
  Uniprot ID: Q9HCN6
  ENSP ID: ENSP00000483314

SEQ ID NO: 35715 - protein, 321 aa, Homo sapiens; identical to SEQ ID NO: 35695
  Payload ID: 7062
  Gene Symbol: GP6
  Gene Name: glycoprotein VI (platelet)
  ENSP ID: ENSP00000483612

SEQ ID NO: 35716 - protein, 117 aa, Homo sapiens; identical to SEQ ID NO: 35697
  Payload ID: 7062
  Gene Symbol: GP6
  Gene Name: glycoprotein VI (platelet)
  ENSP ID: ENSP00000483807

SEQ ID NO: 35717 - protein, 620 aa, Homo sapiens; identical to SEQ ID NO: 35694
  Payload ID: 7062
  Gene Symbol: GP6
  Gene Name: glycoprotein VI (platelet)
  Uniprot ID: Q9HCN6
  ENSP ID: ENSP00000484029

SEQ ID NO: 35718 - protein, 406 aa, Homo sapiens
  Payload ID: 7063
  Gene Symbol: GLMP
  Gene Name: glycosylated lysosomal membrane protein
  Uniprot ID: Q8WWB7
  ENSP ID: ENSP00000354553
MRGSVECTWGWGHCAPSPLLLWTLLLFAAPFGLLGEKTRQVSLEVIPNWLGPLQNLLHIRAVGTNSTLHYVWSSLGPLAVVMVATNTPHSTLSVNWSLLLSPEPDGGLMVLPKDSIQFSSALVFTRLLEFDSTNVSDTAAKPLGRPYPPYSLADFSWNNITDSLDPATLSATFQGHPMNDPTRTFANGSLAFRVQAFSRSSRPAQPPRLLHTADTCQLEVALIGASPRGNRSLFGLEVATLGQGPDCPSMQEQHSIDDEYAPAVFQLDQLLWGSLPSGFAQWRPVAYSQKPGGRESALPCQASPLHPALAYSLPQSPIVRAFFGSQNNFCAFNLTFGASTGPGYWDQHYLSWSMLLGVGFPPVDGLSPLVLGIMAVALGAPGLMLLGGGLVLLLHHKKYSEYQSIN

SEQ ID NO: 35719 - protein, 183 aa, Homo sapiens [sequence omitted]

SEQ ID NO: 35720 - protein, 75 aa, Homo sapiens
  Payload ID: 7063
  Gene Symbol: GLMP
  Gene Name: glycosylated lysosomal membrane protein
  ENSP ID: ENSP00000476260
FNLTFGASTGPGYWDQHYLSWSMLLGVGFPPVDGLSPLVLGIMAVALGAPGLMLLGGGLVLLLHHKKYSEYQSIN

SEQ ID NO: 35721 - protein, 130 aa, Homo sapiens
  Payload ID: 7063
  Gene Symbol: GLMP
  Gene Name: glycosylated lysosomal membrane protein
  ENSP ID: ENSP00000477180
MRGSVECTWGWGHCAPSPLLLWTLLLFAAPFGLLGEKTRQVSLEVIPNWLGPLQNLLHIRAVGTNSTLHYVWSSLGPLAVVMVATNTPHSTLSVNWSLLLSPEPDGGLMVLPKDSIQFSSALVFTRGSCC

SEQ ID NO: 35722 - protein, 111 aa, Homo sapiens
  Payload ID: 7063
  Gene Symbol: GLMP
  Gene Name: glycosylated lysosomal membrane protein
  ENSP ID: ENSP00000477187
  MOD_RES (1)..(1): Any amino acid
XPSMQEQHSIDDEYAPAVFQSPIVRAFFGSQNNFCAFNLTFGASTGPGYWDQHYLSWSMLLGVGFPPVDGLSPLVLGIMAVALGAPGLMLLGGGLVLLLHHKKYSEYQSIN

SEQ ID NO: 35723 - protein, 89 aa, Homo sapiens
  Payload ID: 7063
  Gene Symbol: GLMP
  Gene Name: glycosylated lysosomal membrane protein
  ENSP ID: ENSP00000477253
MRGSVECTWGWGHCAPSPLLLWTLLLFAAPFGLLGEKTRQVRRLGENQGEECRGESSSQLEGGTKDWGKAFGKTISSILLGRFLLEQHH

SEQ ID NO: 35724 - protein, 320 aa, Homo sapiens
  Payload ID: 7063
  Gene Symbol: GLMP
  Gene Name: glycosylated lysosomal membrane protein
  ENSP ID: ENSP00000479149
MRGSVECTWGWGHCAPSPLLLWTLLLFAAPFGLLGEKTRQLLEFDSTNVSDTAAKPLGRPYPPYSLADFSWNNITDSLDPATLSATFQGHPMNDPTRTFANGSLAFRVQAFSRSSRPAQPPRLLHTADTCQLEVALIGASPRGNRSLFGLEVATLGQGPDCPSMQEQHSIDDEYAPAVFQLDQLLWGSLPSGFAQWRPVAYSQKPGGRESALPCQASPLHPALAYSLPQSPIVRAFFGSQNNFCAFNLTFGASTGPGYWDQHYLSWSMLLGVGFPPVDGLSPLVLGIMAVALGAPGLMLLGGGLVLLLHHKKYSEYQSIN

SEQ ID NO: 35725 - protein, 325 aa, Homo sapiens
  Payload ID: 7063
  Gene Symbol: GLMP
  Gene Name: glycosylated lysosomal membrane protein
  Uniprot ID: Q8WWB7
  ENSP ID: ENSP00000480936
MVATNTPHSTLSVNWSLLLSPEPDGGLMVLPKDSIQFSSALVFTRLLEFDSTNVSDTAAKPLGRPYPPYSLADFSWNNITDSLDPATLSATFQGHPMNDPTRTFANGSLAFRVQAFSRSSRPAQPPRLLHTADTCQLEVALIGASPRGNRSLFGLEVATLGQGPDCPSMQEQHSIDDEYAPAVFQLDQLLWGSLPSGFAQWRPVAYSQKPGGRESALPCQASPLHPALAYSLPQSPIVRAFFGSQNNFCAFNLTFGASTGPGYWDQHYLSWSMLLGVGFPPVDGLSPLVLGIMAVALGAPGLMLLGGGLVLLLHHKKYSEYQSIN

SEQ ID NO: 35726 - protein, 331 aa, Homo sapiens
  Payload ID: 7063
  Gene Symbol: GLMP
  Gene Name: glycosylated lysosomal membrane protein
  ENSP ID: ENSP00000483691
MRGSVECTWGWGHCAPSPLLLWTLLLFAAPFGLLGEKTRQVSLEVIPNWLGPLQNLLHIRAVGTNSTLHYVWSSLGPLAVVMVATNTPHSTLSVNWSLLLSPEPDGGLMVLPKDSIQFSSALVFTRLLEFDSTNVSDTAAKPLGRPYPPYSLADFSWNNITDSLDPATLSATFQGHPMNDPTRTFANGSLAFRVQAFSRSSRPAQPPRLLHTADTCQLEVALIGASPRGNRSLFGLEVATLGQGPDCPSMQEQHSIDDEYAPAVFQVDAPGCGLPSSGRLVPTSPGHHGSGPGCPRAHAARGRLGSAAAPQEVLRVPVHKLRPALWREGHY

SEQ ID NO: 35727 - protein, 621 aa, Homo sapiens
  Payload ID: 7064
  Gene Symbol: GPAA1
  Gene Name: glycosylphosphatidylinositol anchor attachment 1
  Uniprot ID: O43292
  ENSP ID: ENSP00000347206
MGLLSDPVRRRALARLVLRLNAPLCVLSYVAGIAWFLALVFPPLTQRTYMSENAMGSTMVEEQFAGGDRARAFARDFAAHRKKSGALPVAWLERTMRSVGLEVYTQSFSRKLPFPDETHERYMVSGTNVYGILRAPRAASTESLVLTVPCGSDSTNSQAVGLLLALAAHFRGQIYWAKDIVFLVTEHDLLGTEAWLEAYHDVNVTGMQSSPLQGRAGAIQAAVALELSSDVVTSLDVAVEGLNGQLPNLDLLNLFQTFCQKGGLLCTLQGKLQPEDWTSLDGPLQGLQTLLLMVLRQASGRPHGSHGLFLRYRVEALTLRGINSFRQYKYDLVAVGKALEGMFRKLNHLLERLHQSFFLYLLPGLSRFVSIGLYMPAVGFLLLVLGLKALELWMQLHEAGMGLEEPGGAPGPSVPLPPSQGVGLASLVAPLLISQAMGLALYVLPVLGQHVATQHFPVAEAEAVVLTLLAIYAAGLALPHNTHRVVSTQAPDRGWMALKLVALIYLALQLGCIALTNFSLGFLLATTMVPTAALAKPHGPRTLYAALLVLTSPAATLLGSLFLWRELQEAPLSLAEGWQLFLAALAQGVLEHHTYGALLFPLLSLGLYPCWLLFWNVLFWK

SEQ ID NO: 35728 - protein, 561 aa, Homo sapiens
  Payload ID: 7064
  Gene Symbol: GPAA1
  Gene Name: glycosylphosphatidylinositol anchor attachment 1
  Uniprot ID: O43292
  ENSP ID: ENSP00000354316
MGLLSDPVRRRALARLVLRLNAPLWALPVAWLERTMRSVGLEVYTQSFSRKLPFPDETHERYMVSGTNVYGILRAPRAASTESLVLTVPCGSDSTNSQAVGLLLALAAHFRGQIYWAKDIVFLVTEHDLLGTEAWLEAYHDVNVTGMQSSPLQGRAGAIQAAVALELSSDVVTSLDVAVEGLNGQLPNLDLLNLFQTFCQKGGLLCTLQGKLQPEDWTSLDGPLQGLQTLLLMVLRQASGRPHGSHGLFLRYRVEALTLRGINSFRQYKYDLVAVGKALEGMFRKLNHLLERLHQSFFLYLLPGLSRFVSIGLYMPAVGFLLLVLGLKALELWMQLHEAGMGLEEPGGAPGPSVPLPPSQGVGLASLVAPLLISQAMGLALYVLPVLGQHVATQHFPVAEAEAVVLTLLAIYAAGLALPHNTHRVVSTQAPDRGWMALKLVALIYLALQLGCIALTNFSLGFLLATTMVPTAALAKPHGPRTLYAALLVLTSPAATLLGSLFLWRELQEAPLSLAEGWQLFLAALAQGVLEHHTYGALLFPLLSLGLYPCWLLFWNVLFWK

SEQ ID NO: 35729 - protein, 98 aa, Homo sapiens
  Payload ID: 7064
  Gene Symbol: GPAA1
  Gene Name: glycosylphosphatidylinositol anchor attachment 1
  ENSP ID: ENSP00000431233
MGLLSDPVRRRALARLVLRLNAPLWALPVAWLERTMRWCRAPTCTASCGPRVLPAPSRLCSPCPVALTLPTARLWGCCWHWLPTSGGRFIGPKISSSW

SEQ ID NO: 35730 - protein, 273 aa, Homo sapiens
  Payload ID: 7064
  Gene Symbol: GPAA1
  Gene Name: glycosylphosphatidylinositol anchor attachment 1
  ENSP ID: ENSP00000434485
MGLLSDPVRRRALARLVLRLNAPLCVLSYVAGIAWFLALVFPPLTQRTYMSENAMGSTMVEEQFAGGDRARAFARDFAAHRKKSGQAVGLLLALAAHFRGQIYWAKDIVFLVTEHDLLGTEAWLEAYHDVNVTGMQSSPLQGRAGAIQAAVALELSSDVVTSLDVAVEGLNGQLPNLDLLNLFQTFCQKGGLLCTLQGKLQPEDWTSLDGPLQGLQTLLLMVLRQASGRPHGSHGLFLRYRVEALTLRGINSFRQYKYDLVAVGKALEGMFRK

SEQ ID NO: 35731 - protein, 260 aa, Homo sapiens [sequence omitted]

SEQ ID NO: 35732 - protein, 158 aa, Homo sapiens
  Payload ID: 7064
  Gene Symbol: GPAA1
  Gene Name: glycosylphosphatidylinositol anchor attachment 1
  ENSP ID: ENSP00000435024
MGLLSDPVRRRALARLVLRLNAPLCVLSYVAGIAWFLALVFPPLTQRTYMSENAMGSTMVEEQFAGGDRARAFARDFAAHRKKSGALPVAWLERTMRWCRAPTCTASCGPRVLPAPSRLCSPCPVALTLPTARLWGCCWHWLPTSGGRFIGPKISSSW

SEQ ID NO: 35733 - protein, 234 aa, Homo sapiens
  Payload ID: 7064
  Gene Symbol: GPAA1
  Gene Name: glycosylphosphatidylinositol anchor attachment 1
  ENSP ID: ENSP00000435119
MGLLSDPVRRRALARLVLRLNAPLCVLSYVAGIAWFLALVFPPLTQRTYMSENAMGSTMVEEQFAGGDRARAFARDFAAHRKKSGALPVAWLERTMRSVGLEVYTQSFSRKLPFPDETHERYMVSGTNVYGILRAPRAASTESLVLTVPCGSDSTNSQAVGLLLALAAHFRGQIYWAKDIVFLVTEHDLLGTEAWLEAYHDVNVTALIHLLLQACSRLPCRAELGPFRQPWPWS

SEQ ID NO: 35734 - protein, 81 aa, Homo sapiens
  Payload ID: 7064
  Gene Symbol: GPAA1
  Gene Name: glycosylphosphatidylinositol anchor attachment 1
  ENSP ID: ENSP00000435132
MSENAMGSTMVEEQFAGGDRARAFARDFAAHRKKSGALPVAWLERTMRSVGLEVYTQSFSRKLPFPDETHERYMVSGTNVY

SEQ ID NO: 35735 - protein, 184 aa, Homo sapiens
  Payload ID: 7065
  Gene Symbol: GPIHBP1
  Gene Name: glycosylphosphatidylinositol anchored high density lipoprotein binding protein 1
  Uniprot ID: Q8IV16
  ENSP ID: ENSP00000480053
MKALGAVLLALLLFGRPGRGQTQQEEEEEDEDHGPDDYDEEDEDEVEEEETNRLPGGRSRVLLRCYTCKSLPRDERCNLTQNCSHGQTCTTLIAHGNTESGLLTTHSTWCTDSCQPITKTVEGTQVTMTCCQSSLCNVPPWQSSRVQDPTGKGAGGPRGSSETVGAALLLNLLAGLGAMGARRP

SEQ ID NO: 35736 - protein, 158 aa, Homo sapiens
  Payload ID: 7066
  Gene Symbol: GML
  Gene Name: glycosylphosphatidylinositol anchored molecule like
  Uniprot ID: Q99445
  ENSP ID: ENSP00000220940
MLLFALLLAMELPLVAASATMRAQWTYSLRCHDCAVINDFNCPNIRVCPYHIRRCMTISIRINSRELLVYKNCTNNCTFVYAAEQPPEAPGKIFKTNSFYWVCCCNSMVCNAGGPTNLERDMLPDEVTEEELPEGTVRLGVSKLLLSFASIIVSNILP

SEQ ID NO: 35737 - protein, 118 aa, Homo sapiens
  Payload ID: 7066
  Gene Symbol: GML
  Gene Name: glycosylphosphatidylinositol anchored molecule like
  ENSP ID: ENSP00000430799
MLLFALLLAMELPLVAASATMRAQWTYSLRCHDCAVINDFNCPNIRVCPYHIRRCMTISIQLSSGDRAAVCPGPHPTFFQPGAWIPTQVTDSKHQPLPAHLTRRHPLHGPGNILPSAI

SEQ ID NO: 35738 - protein, 840 aa, Homo sapiens
  Payload ID: 7067
  Gene Symbol: GPLD1
  Gene Name: glycosylphosphatidylinositol specific phospholipase D1
  Uniprot ID: P80108
  ENSP ID: ENSP00000230036
MSAFRLWPGLLIMLGSLCHRGSPCGLSTHVEIGHRALEFLQLHNGRVNYRELLLEHQDAYQAGIVFPDCFYPSICKGGKFHDVSESTHWTPFLNASVHYIRENYPLPWEKDTEKLVAFLFGITSHMAADVSWHSLGLEQGFLRTMGAIDFHGSYSEAHSAGDFGGDVLSQFEFNFNYLARRWYVPVKDLLGIYEKLYGRKVITENVIVDCSHIQFLEMYGEMLAVSKLYPTYSTKSPFLVEQFQEYFLGGLDDMAFWSTNIYHLTSFMLENGTSDCNLPENPLFIACGGQQNHTQGSKMQKNDFHRNLTTSLTESVDRNINYTERGVFFSVNSWTPDSMSFIYKALERNIRTMFIGGSQLSQKHVSSPLASYFLSFPYARLGWAMTSADLNQDGHGDLVVGAPGYSRPGHIHIGRVYLIYGNDLGLPPVDLDLDKEAHRILEGFQPSGRFGSALAVLDFNVDGVPDLAVGAPSVGSEQLTYKGAVYVYFGSKQGGMSSSPNITISCQDIYCNLGWTLLAADVNGDSEPDLVIGSPFAPGGGKQKGIVAAFYSGPSLSDKEKLNVEAANWTVRGEEDFSWFGYSLHGVTVDNRTLLLVGSPTWKNASRLGHLLHIRDEKKSLGRVYGYFPPNGQSWFTISGDKAMGKLGTSLSSGHVLMNGTLKQVLLVGAPTYDDVSKVAFLTVTLHQGGATRMYALTSDAQPLLLSTFSGDRRFSRFGGVLHLSDLDDDGLDEIIMAAPLRIADVTSGLIGGEDGRVYVYNGKETTLGDMTGKCKSWITPCPEEKAQYVLISPEASSRFGSSLITVRSKAKNQVVIAAGRSSLGARLSGALHVYSLGSD

SEQ ID NO: 35739 - protein, 266 aa, Homo sapiens
  Payload ID: 7068
  Gene Symbol: GLT1D1
  Gene Name: glycosyltransferase 1 domain containing 1
  Uniprot ID: Q96MS3
  ENSP ID: ENSP00000281703
MRLLFLAVLRPHTGNAVTAQRVRAHLEAAGHVCVLKDAFDFESRSEIANLILAENCEAALALHLYRGGRLLQGHRIPFGVIFGGTDVNEDANQAEKNTVMGRVLEEARFAVAFTESMKEMAQAQWVDPVFTREVKAKVKRAAGVRLIGEMPQEDLHAVVKNCFAVVNSSVSEGMSAAILEAMDLEVPVLARNIPGNAAVVKHEVTGLLFSNPQEFVHLAKRLVSDPALEKEIVVNGREYVRMYHSWQVERDTYQQLIRKLEGSTED

SEQ ID NO: 35740 - protein, 346 aa, Homo sapiens
  Payload ID: 7068
  Gene Symbol: GLT1D1
  Gene Name: glycosyltransferase 1 domain containing 1
  Uniprot ID: Q96MS3
  ENSP ID: ENSP00000394692
MRLLFLAVLRPHTGNAVTAQRVRAHLEAAGHVCVLKDAFDFESRSEIANLILAENCEAALALHLYRGGRLLQGHRIPFGVIFGGTDVNEDANQAEKNTVMGRVLEEARFAVAFTESMKEMAQAQWPHAKGKVYVQSQGIATTPNAAFNWNTFLQRSEINQSADNLHIFLLICGLRQVKDPLYLVDAFSAWHQEEPNVHLVIVGPEVDPVFTREVKAKVKRAAGVRLIGEMPQEDLHAVVKNCFAVVNSSVSEGMSAAILEAMDLEVPVLARNIPGNAAVVKHEVTGLLFSNPQEFVHLAKRLVSDPALEKEIVVNGREYVRMYHSWQVERDTYQQLIRKLEGSTED

SEQ ID NO: 35741 - protein, 120 aa, Homo sapiens
  Payload ID: 7068
  Gene Symbol: GLT1D1
  Gene Name: glycosyltransferase 1 domain containing 1
  ENSP ID: ENSP00000399374
VLRPHTGNAVTAQRVRAHLEAAGHVCVLKDAFDFESRSEIANLILAENCEAALALHLYRGGRLLQGHRIPFGVIFGGTDVNEDANQAEKNTVMGRVLEEARFAVAFTESMKEMAQAQWVC

SEQ ID NO: 35742 - protein, 152 aa, Homo sapiens
  Payload ID: 7068
  Gene Symbol: GLT1D1
  Gene Name: glycosyltransferase 1 domain containing 1
  Uniprot ID: Q96MS3
  ENSP ID: ENSP00000411992
MRLLFLAVLRPHTGNAVTAQRVRAHLEAAGHVCVLKDAFDFESRSEIANLILAENCEAALALHLYRGGRLLQGHRIPFGVIFGGTDVNEDANQAEKNTVMGRVLEEASRMLRVRSMSRVKELQQHQTPLLTGIPFFNALRLTKVLIICTYFF

SEQ ID NO: 35743 - protein, 351 aa, Homo sapiens
  Payload ID: 7068
  Gene Symbol: GLT1D1
  Gene Name: glycosyltransferase 1 domain containing 1
  ENSP ID: ENSP00000438158
MLTARCLSDDTLAHLEAAGHVCVLKDAFDFESRSEIANLILAENCEAALALHLYRGGRLLQGHRIPFGVIFGGTDVNEDANQAEKNTVMGRVLEEARFAVAFTESMKEMAQAQWKARQISLAVTSAVPVQPHAKGKVYVQSQGIATTPNAAFNWNTFLQRSEINQSADNLHIFLLICGLRQVKDPLYLVDAFSAWHQEEPNVHLVIVGPEVDPVFTREVKAKVKRAAGVRLIGEMPQEDLHAVVKNCFAVVNSSVSEGMSAAILEAMDLEVPVLARNIPGNAAVVKHEVTGLLFSNPQEFVHLAKRLVSDPALEKEIVVNGREYVRMYHSWQVERDTYQQLIRKLEGSTED

SEQ ID NO: 35744 - protein, 152 aa, Homo sapiens; identical to SEQ ID NO: 35742
  Payload ID: 7068
  Gene Symbol: GLT1D1
  Gene Name: glycosyltransferase 1 domain containing 1
  Uniprot ID: Q96MS3
  ENSP ID: ENSP00000445064

SEQ ID NO: 35745 - protein, 276 aa, Homo sapiens
  Payload ID: 7069
  Gene Symbol: GLT6D1
  Gene Name: glycosyltransferase 6 domain containing 1
  Uniprot ID: Q7Z4J2
  ENSP ID: ENSP00000360829
MNSKRMLLLVLFAFSLMLVERYFRNHQVEELRLSDWFHPRKRPDVITKTDWLAPVLWEGTFDRRVLEKHYRRRNITVGLAVFATGRFAEEYLRPFLHSANKHFMTGYRVIFYIMVDAFFKLPDIEPSPLRTFKAFKVGTERWWLDGPLVHVKSLGEHIASHIQDEVDFLFSMAANQVFQNEFGVETLGPLVAQLHAWWYFRNTKNFPYERRPTSAACIPFGQGDFYYGNLMVGGTPHNILDFIKEYLNGVIHDIKNGLNSTYEKHLNKYFYLNKPT

SEQ ID NO: 35746 - protein, 307 aa, Homo sapiens
  Payload ID: 7069
  Gene Symbol: GLT6D1
  Gene Name: glycosyltransferase 6 domain containing 1
  ENSP ID: ENSP00000483037
MNSKRMLLLVLFAFSLMLVERYFRNHQVEELRLSDWFHPRKRPDVITKTDWLAPVLWEGTFDRRVLEKHYRRRNITVGLAVFATGRFAEEYLRPFLHSANKHFMTGYRVIFYIMVDAFFKLPDIEPSPLRTFKAFKVGTERWWLDGPLVHVKSLGEHIASHIQDEVDFLFSMAANQVFQNEFGVETLGPLVAQLHAWWYFRNTKNFPYERRPTSAACIPFGQGDFYYGNLMVGGTPHNILDFIKEYLNGVIHDIKNGLNSTYEKHLNKYFYLNKPTLLSPAYSWDLAFSPPPQIQYVKVAHDSQRKL

SEQ ID NO: 35747 - protein, 371 aa, Homo sapiens
  Payload ID: 7070
  Gene Symbol: GLT8D1
  Gene Name: glycosyltransferase 8 domain containing 1
  Uniprot ID: Q68CQ7
  ENSP ID: ENSP00000266014
MSFRKVNIIILVLAVALFLLVLHHNFLSLSSLLRNEVTDSGIVGPQPIDFVPNALRHAVDGRQEEIPVVIAASEDRLGGAIAAINSIQHNTRSNVIFYIVTLNNTADHLRSWLNSDSLKSIRYKIVNFDPKLLEGKVKEDPDQGESMKPLTFARFYLPILVPSAKKAIYMDDDVIVQGDILALYNTALKPGHAAAFSEDCDSASTKVVIRGAGNQYNYIGYLDYKKERIRKLSMKASTCSFNPGVFVANLTEWKRQNITNQLEKWMKLNVEEGLYSRTLAGSITTPPLLIVFYQQHSTIDPMWNVRHLGSSAGKRYSPQFVKAAKLLHWNGHLKPWGRTASYTDVWEKWYIPDPTGKFNLIRRYTEISNIK

SEQ ID NO: 35748 - protein, 371 aa, Homo sapiens; identical to SEQ ID NO: 35747
  Payload ID: 7070
  Gene Symbol: GLT8D1
  Gene Name: glycosyltransferase 8 domain containing 1
  Uniprot ID: Q68CQ7
  ENSP ID: ENSP00000378263

SEQ ID NO: 35749 - protein, 226 aa, Homo sapiens
  Payload ID: 7070
  Gene Symbol: GLT8D1
  Gene Name: glycosyltransferase 8 domain containing 1
  ENSP ID: ENSP00000385730
MDDDVIVQGDILALYNTALKPGHAAAFSEDCDSASTKVVIRGAGNQYNYIGYLDYKKERIRKLSMKASTCSFNPGVFVANLTEWKRQNITNQLEKWMKLNVEEGLYSRTLAGSITTPPLLIVFYQQHSTIDPMWNPPPWFQCWKTIFTSVCKGCQVTHWNGHLKPWGRTASYTCLGKMVYSRPNRQIQPNPKIYRDLKHKVKQNLNCKQAFLRKSWKIACVGSNSC

SEQ ID NO: 35750 - protein, 116 aa, Homo sapiens
  Payload ID: 7070
  Gene Symbol: GLT8D1
  Gene Name: glycosyltransferase 8 domain containing 1
  ENSP ID: ENSP00000417551
MSFRKVNIIILVLAVALFLLVLHHNFLSLSSLLRNEVTDSGIVGPQPIDFVPNALRHAVDGRQEEIPVVIAASEDRLGGAIAAINSIQHNTRSNVIFYIVTLNNTADHLRSWLNSD

SEQ ID NO: 35751 - protein, 174 aa, Homo sapiens
  Payload ID: 7070
  Gene Symbol: GLT8D1
  Gene Name: glycosyltransferase 8 domain containing 1
  ENSP ID: ENSP00000417713
MSFRKVNIIILVLAVALFLLVLHHNFLSLSSLLRNEVTDSGIVGPQPIDFVPNALRHAVDGRQEEIPVVIAASEDRLGGAIAAINSIQHNTRSNVIFYIVTLNNTADHLRSWLNSDSLKSIRYKIVNFDPKLLEGKVKEDPDQGESMKPLTFARFYLPILVPSAKKAIYMDDDV

SEQ ID NO: 35752 - protein, 30 aa, Homo sapiens
  Payload ID: 7070
  Gene Symbol: GLT8D1
  Gene Name: glycosyltransferase 8 domain containing 1
  ENSP ID: ENSP00000417858
MSFRKVNIIILVLAVALFLLVLHHNFLSLS

SEQ ID NO: 35753 - protein, 23 aa, Homo sapiens
  Payload ID: 7070
  Gene Symbol: GLT8D1
  Gene Name: glycosyltransferase 8 domain containing 1
  ENSP ID: ENSP00000418300
VKEDPDQGESMKPVIFLPFTIQH

SEQ ID NO: 35754 - protein, 371 aa, Homo sapiens; identical to SEQ ID NO: 35747
  Payload ID: 7070
  Gene Symbol: GLT8D1
  Gene Name: glycosyltransferase 8 domain containing 1
  Uniprot ID: Q68CQ7
  ENSP ID: ENSP00000418853

SEQ ID NO: 35755 - protein, 63 aa, Homo sapiens
  Payload ID: 7070
  Gene Symbol: GLT8D1
  Gene Name: glycosyltransferase 8 domain containing 1
  ENSP ID: ENSP00000419094
MSFRKVNIIILVLAVALFLLVLHHNFLSLSSLLRNEVTDSGIVGPQPIDFVPNALRHAVDGRQ

SEQ ID NO: 35756 - protein, 371 aa, Homo sapiens; identical to SEQ ID NO: 35747
  Payload ID: 7070
  Gene Symbol: GLT8D1
  Gene Name: glycosyltransferase 8 domain containing 1
  Uniprot ID: Q68CQ7
  ENSP ID: ENSP00000419612

SEQ ID NO: 35757 - protein, 89 aa, Homo sapiens
  Payload ID: 7070
  Gene Symbol: GLT8D1
  Gene Name: glycosyltransferase 8 domain containing 1
  ENSP ID: ENSP00000420286
MSFRKVNIIILVLAVALFLLVLHHNFLSLSSLLRNEVTDSGIVGPQPIDFVPNALRHAVDGRQEEIPVVIAASEDRLGGAIAAINSIQH

SEQ ID NO: 35758 - protein, 62 aa, Homo sapiens
  Payload ID: 7070
  Gene Symbol: GLT8D1
  Gene Name: glycosyltransferase 8 domain containing 1
  ENSP ID: ENSP00000420462
MSFRKVNIIILVLAVALFLLVLHHNFLSLSSLLRNEVTDSGIVGPQPIDFVPNALRHAVDGR

SEQ ID NO: 35759 - protein, 349 aa, Homo sapiens
  Payload ID: 7071
  Gene Symbol: GLT8D2
  Gene Name: glycosyltransferase 8 domain containing 2
  Uniprot ID: Q9H1C3
  ENSP ID: ENSP00000354053
MALLRKINQVLLFLLIVTLCVILYKKVHKGTVPKNDADDESETPEELEEEIPVVICAAAGRMGATMAAINSIYSNTDANILFYVVGLRNTLTRIRKWIEHSKLREINFKIVEFNPMVLKGKIRPDSSRPELLQPLNFVRFYLPLLIHQHEKVIYLDDDVIVQGDIQELYDTTLALGHAAAFSDDCDLPSAQDINRLVGLQNTYMGYLDYRKKAIKDLGISPSTCSFNPGVIVANMTEWKHQRITKQLEKWMQKNVEENLYSSSLGGGVATSPMLIVFHGKYSTINPLWHIRHLGWNPDARYSEHFLQEAKLLHWNGRHKPWDFPSVHNDLWESWFVPDPAGIFKLNHHS

SEQ ID NO: 35760 - protein, 66 aa, Homo sapiens
  Payload ID: 7071
  Gene Symbol: GLT8D2
  Gene Name: glycosyltransferase 8 domain containing 2
  ENSP ID: ENSP00000446810
MGATMAAINSIYSNTDANILFYVVGLRNTLTRIRKWIEHSKLREINFKIVEFNPMVLKGKIRPDSS

SEQ ID NO: 35761 - protein, 349 aa, Homo sapiens; identical to SEQ ID NO: 35759
  Payload ID: 7071
  Gene Symbol: GLT8D2
  Gene Name: glycosyltransferase 8 domain containing 2
  Uniprot ID: Q9H1C3
  ENSP ID: ENSP00000447450

SEQ ID NO: 35762 - protein, 83 aa, Homo sapiens
  Payload ID: 7071
  Gene Symbol: GLT8D2
  Gene Name: glycosyltransferase 8 domain containing 2
  ENSP ID: ENSP00000448065
MALLRKINQVLLFLLIVTLCVILYKKVHKGTVPKNDAESHSVAPAQIQWHNSSSLQPRPPGLKQSSGLSTPGSWNYRIPVLLG

SEQ ID NO: 35763 - protein, 349 aa, Homo sapiens; identical to SEQ ID NO: 35759
  Payload ID: 7071
  Gene Symbol: GLT8D2
  Gene Name: glycosyltransferase 8 domain containing 2
  Uniprot ID: Q9H1C3
  ENSP ID: ENSP00000449750

SEQ ID NO: 35764 - protein, 721 aa, Homo sapiens
  Payload ID: 7072
  Gene Symbol: GYLTL1B
  Gene Name: glycosyltransferase-like 1B
  Uniprot ID: Q8N3Y3
  ENSP ID: ENSP00000324570
MLPRGRPRALGAAALLLLLLLLGFLLFGGDLGCERREPGGRAGAPGCFPGPLMPRVPPDGRLRRAAALDGDPGAGPGDHNRSDCGPQPPPPPKCELLHVAIVCAGHNSSRDVITLVKSMLFYRKNPLHLHLVTDAVARNILETLFHTWMVPAVRVSFYHADQLKPQVSWIPNKHYSGLYGLMKLVLPSALPAELARVIVLDTDVTFASDISELWALFAHFSDTQAIGLVENQSDWYLGNLWKNHRPWPALGRGFNTGVILLRLDRLRQAGWEQMWRLTARRELLSLPATSLADQDIFNAVIKEHPGLVQRLPCVWNVQLSDHTLAERCYSEASDLKVIHWNSPKKLRVKNKHVEFFRNFYLTFLEYDGNLLRRELFVCPSQPPPGAEQLQQALAQLDEEDPCFEFRQQQLTVHRVHVTFLPHEPPPPRPHDVTLVAQLSMDRLQMLEALCRHWPGPMSLALYLTDAEAQQFLHFVEASPVLAARQDVAYHVVYREGPLYPVNQLRNVALAQALTPYVFLSDIDFLPAYSLYDYLRASIEQLGLGSRRKAALVVPAFETLRYRFSFPHSKVELLALLDAGTLYTFRYHEWPRGHAPTDYARWREAQAPYRVQWAANYEPYVVVPRDCPRYDPRFVGFGWNKVAHIVELDAQEYELLVLPEAFTIHLPHAPSLDISRFRSSPTYRDCLQALKDEFHQDLSRHHGAAALKYLPALQQPQSPARG

SEQ ID NO: 35765 - protein, 721 aa, Homo sapiens; identical to SEQ ID NO: 35764
  Payload ID: 7072
  Gene Symbol: GYLTL1B
  Gene Name: glycosyltransferase-like 1B
  Uniprot ID: Q8N3Y3
  ENSP ID: ENSP00000385235

SEQ ID NO: 35766 - protein, 690 aa, Homo sapiens
  Payload ID: 7072
  Gene Symbol: GYLTL1B
  Gene Name: glycosyltransferase-like 1B
  ENSP ID: ENSP00000431932
MLPRGRPRALGAAALLLLLLLLGFLLFDGRLRRAAALDGDPGAGPGDHNRSDCGPQPPPPPKCELLHVAIVCAGHNSSRDVITLVKSMLFYRKNPLHLHLVTDAVARNILETLFHTWMVPAVRVSFYHADQLKPQVSWIPNKHYSGLYGLMKLVLPSALPAELARVIVLDTDVTFASDISELWALFAHFSDTQAIGLVENQSDWYLGNLWKNHRPWPALGRGFNTGVILLRLDRLRQAGWEQMWRLTARRELLSLPATSLADQDIFNAVIKEHPGLVQRLPCVWNVQLSDHTLAERCYSEASDLKVIHWNSPKKLRVKNKHVEFFRNFYLTFLEYDGNLLRRELFVCPSQPPPGAEQLQQALAQLDEEDPCFEFRQQQLTVHRVHVTFLPHEPPPPRPHDVTLVAQLSMDRLQMLEALCRHWPGPMSLALYLTDAEAQQFLHFVEASPVLAARQDVAYHVVYREGPLYPVNQLRNVALAQALTPYVFLSDIDFLPAYSLYDYLRASIEQLGLGSRRKAALVVPAFETLRYRFSFPHSKVELLALLDAGTLYTFRYHEWPRGHAPTDYARWREAQAPYRVQWAANYEPYVVVPRDCPRYDPRFVGFGWNKVAHIVELDAQEYELLVLPEAFTIHLPHAPSLDISRFRSSPTYRDCLQALKDEFHQDLSRHHGAAALKYLPALQQPQSPARG

SEQ ID NO: 35767 - protein, 721 aa, Homo sapiens; identical to SEQ ID NO: 35764
  Payload ID: 7072
  Gene Symbol: GYLTL1B
  Gene Name: glycosyltransferase-like 1B
  Uniprot ID: Q8N3Y3
  ENSP ID: ENSP00000432869

SEQ ID NO: 35768 - protein, 158 aa, Homo sapiens
  Payload ID: 7072
  Gene Symbol: GYLTL1B
  Gene Name: glycosyltransferase-like 1B
  ENSP ID: ENSP00000433328
WNSPKKLRVKNKHVEFFRNFYLTFLEYDGNLLRRELFVCPSQPPPGAEQLQQALAQLDEEDPCFEFRQQQLTVHRVHVTFLPHEPPPPRPHDVTLVAQLSMDRTWPTMWCTVRGPYTPSTSFATWPWPRPSRLTSSSVTLTSCLPILSTTTSGPPLSS

SEQ ID NO: 35769 - protein, 109 aa, Homo sapiens
  Payload ID: 7072
  Gene Symbol: GYLTL1B
  Gene Name: glycosyltransferase-like 1B
  ENSP ID: ENSP00000434325
  MOD_RES (1)..(1): Any amino acid
XLLDAGTLYTFRNMSSWCCPRPSPSICPTLQAWTSPASAPAPPIVTASRPSRTNSTRTCPATMGLLPSNTSQPCSSPRALPEAEAGPALPLILALGRHQGNLPSAIPAI

SEQ ID NO: 35770 - protein, 257 aa, Homo sapiens
  Payload ID: 7072
  Gene Symbol: GYLTL1B
  Gene Name: glycosyltransferase-like 1B
  ENSP ID: ENSP00000445044
MWCTVRAPIPRQPASQRGLGQALTPYVFLSDIDFLPAYSLYDYLRASIEQLGLGSRRKAALVVPAFETLRYRFSFPHSKVELLALLDAGTLYTFRYHEWPRGHAPTDYARWREAQAPYRVQWAANYEPYVVVPRDCPRYDPRFVGFGWNKVAHIVELDAQEYELLVLPEAFTIHLPHAPSLDISASAPAPPIVTASRPSRTNSTRTCPATMGLLPSNTSQPCSSPRALPEAEAGPALPLILALGRHQGNLPSAIPAI

SEQ ID NO: 35771 - protein, 376 aa, Homo sapiens
  Payload ID: 7073
  Gene Symbol: GTDC1
  Gene Name: glycosyltransferase-like domain containing 1
  Uniprot ID: Q4AE62
  ENSP ID: ENSP00000241391
MSILIIEAFYGGSHKQLVDLLQEELGDCVVYTLPAKKWHWRARTSALYFSQTIPISEHYRTLFASSVLNLTELAALRPDLGKLKKILYFHENQLIYPVKKCQERDFQYGYNQILSCLVADVVVFNSVFNMESFLTSMGKFMKLIPDHRPKDLESIIRPKCQVIYFPIRFPDVSRFMPKHKTTHLKKMLGLKGNGGAVLSMALPFQPEQRDSEDLLKNFNSECDTHCGLDTARQEYLGNSLRQESDLKKSTSSDNSSSHHGENKQNLTVDPCDILGGVDNQQRLLHIVWPHRWEHDKDPESFFKVLMHLKDLGLNFHVSVLGETFTDVPGWKLCTVGVTHFVLKIWFIPKYFQLNICILHLNSFQKGSRISARDQIL

SEQ ID NO: 35772 - protein, 458 aa, Homo sapiens
  Payload ID: 7073
  Gene Symbol: GTDC1
  Gene Name: glycosyltransferase-like domain containing 1
  Uniprot ID: Q4AE62
  ENSP ID: ENSP00000339750
MSILIIEAFYGGSHKQLVDLLQEELGDCVVYTLPAKKWHWRARTSALYFSQTIPISEHYRTLFASSVLNLTELAALRPDLGKLKKILYFHENQLIYPVKKCQERDFQYGYNQILSCLVADVVVFNSVFNMESFLTSMGKFMKLIPDHRPKDLESIIRPKCQVIYFPIRFPDVSRFMPKHKTTHLKKMLGLKGNGGAVLSMALPFQPEQRDSEDLLKNFNSECDTHCGLDTARQEYLGNSLRQESDLKKSTSSDNSSSHHGENKQNLTVDPCDILGGVDNQQRLLHIVWPHRWEHDKDPESFFKVLMHLKDLGLNFHVSVLGETFTDVPDIFSEAKKALGSSVLHWGYLPSKDDYFQVLCMADVVISTAKHEFFGVAMLEAVYCGCYPLCPKDLVYPEIFPAEYLYSTPEQLSKRLQNFCKRPDIIRKHLYKGEIAPFSWAALHGKFRSLLTTEPREDL

SEQ ID NO: 35773 - protein, 373 aa, Homo sapiens
  Payload ID: 7073
  Gene Symbol: GTDC1
  Gene Name: glycosyltransferase-like domain containing 1
  Uniprot ID: Q4AE62
  ENSP ID: ENSP00000376606
MSILIIEAFYGGSHKQLVDLLQEELGDCVVYTLPAKKWHWRARTSALYFSQTIPISEHYRTLFASSVLNLTELAALRPDLGKLKKILYFHENQLIYPVKKCQERDFQYGYNQILSCLVADVVVFNSVFNMESFLTSMGKFMKLIPDHRPKDLESIIRPKCQVIYFPIRFPDVSRFMPKHKTTHLKKMLGLKGNGGAVLSMALPFQPEQRDSEDLLKNFNSECDTHCGLDTARQEYLGNSLRQESDLKKSTSSDNSSSHHGENKQNLTVDPCDILGGVDNQQRLLHIVWPHRWLEAVYCGCYPLCPKDLVYPEIFPAEYLYSTPEQLSKRLQNFCKRPDIIRKHLYKGEIAPFSWAALHGKFRSLLTTEPREDL

SEQ ID NO: 35774 - protein, 458 aa, Homo sapiens; identical to SEQ ID NO: 35772
  Payload ID: 7073
  Gene Symbol: GTDC1
  Gene Name: glycosyltransferase-like domain containing 1
  Uniprot ID: Q4AE62
  ENSP ID: ENSP00000376608

SEQ ID NO: 35775 - protein, 376 aa, Homo sapiens; identical to SEQ ID NO: 35771
  Payload ID: 7073
  Gene Symbol: GTDC1
  Gene Name: glycosyltransferase-like domain containing 1
  Uniprot ID: Q4AE62
  ENSP ID: ENSP00000376610

SEQ ID NO: 35776 - protein, 458 aa, Homo sapiens; identical to SEQ ID NO: 35772
  Payload ID: 7073
  Gene Symbol: GTDC1
  Gene Name: glycosyltransferase-like domain containing 1
  Uniprot ID: Q4AE62
  ENSP ID: ENSP00000386581

SEQ ID NO: 35777 - protein, 340 aa, Homo sapiens
  Payload ID: 7073
  Gene Symbol: GTDC1
  Gene Name: glycosyltransferase-like domain containing 1
  ENSP ID: ENSP00000386691
MSILIIEAFYGGSHKQLVDLLQEELGDCVVYTLPAKKWHWRARTSALYFSQTIPISEHYRTLFASSVLNLTELAALRPDLGKLKKILYFHENQLIYPVKKCQERDFQYGYNQILSCLVADVVVFNSVFNMESFLTSMGKFMKLIPDHRPKDLESIIRPKCQVIYFPIRFPDVSREHDKDPESFFKVLMHLKDLGLNFHVSVLGETFTDVPDIFSEAKKALGSSVLHWGYLPSKDDYFQVLCMADVVISTAKHEFFGVAMLEAVYCGCYPLCPKDLVYPEIFPAEYLYSTPEQLSKRLQNFCKRPDIIRKHLYKGEIAPFSWAALHGKFRSLLTTEPREDL

SEQ ID NO: 35778 - protein, 66 aa, Homo sapiens
  Payload ID: 7073
  Gene Symbol: GTDC1
  Gene Name: glycosyltransferase-like domain containing 1
  ENSP ID: ENSP00000395932
MSILIIEAFYGGSHKQLVDLLQEELGDCVVYTLPAKKWHWRARTSALYFSQTIPISEHYRQSEITN

SEQ ID NO: 35779 - protein, 99 aa, Homo sapiens
  Payload ID: 7073
  Gene Symbol: GTDC1
  Gene Name: glycosyltransferase-like domain containing 1
  ENSP ID: ENSP00000400661
MSILIIEAFYGGSHKQLVDLLQEELGDCVVYTLPAKKWHWRARTSALYFSQTIPISEHYRTLFASSVLNLTELAALRPDLGKLKKILYFHENQLIYPVK

SEQ ID NO: 35780 - protein, 66 aa, Homo sapiens; identical to SEQ ID NO: 35778
  Payload ID: 7073
  Gene Symbol: GTDC1
  Gene Name: glycosyltransferase-like domain containing 1
  ENSP ID: ENSP00000401137

SEQ ID NO: 35781 - protein, 173 aa, Homo sapiens
  Payload ID: 7073
  Gene Symbol: GTDC1
  Gene Name: glycosyltransferase-like domain containing 1
  ENSP ID: ENSP00000403869
MSILIIEAFYGGSHKQLVDLLQEELGDCVVYTLPAKKWHWRARTSALYFSQTIPISEHYRTLFASSVLNLTELAALRPDLGKLKKILYFHENQLIYPVKKCQERDFQYGYNQILSCLVADVVVFNSVFNMESFLTSMGKFMKLIPDHRPKDLESIIRPKCQVIYFPIRFPDVS

SEQ ID NO: 35782 - protein, 329 aa, Homo sapiens
  Payload ID: 7073
  Gene Symbol: GTDC1
  Gene Name: glycosyltransferase-like domain containing 1
  Uniprot ID: Q4AE62
  ENSP ID: ENSP00000437964
MESFLTSMGKFMKLIPDHRPKDLESIIRPKCQVIYFPIRFPDVSRFMPKHKTTHLKKMLGLKGNGGAVLSMALPFQPEQRDSEDLLKNFNSECDTHCGLDTARQEYLGNSLRQESDLKKSTSSDNSSSHHGENKQNLTVDPCDILGGVDNQQRLLHIVWPHRWEHDKDPESFFKVLMHLKDLGLNFHVSVLGETFTDVPDIFSEAKKALGSSVLHWGYLPSKDDYFQVLCMADVVISTAKHEFFGVAMLEAVYCGCYPLCPKDLVYPEIFPAEYLYSTPEQLSKRLQNFCKRPDIIRKHLYKGEIAPFSWAALHGKFRSLLTTEPREDL

SEQ ID NO: 35783 - protein, 458 aa, Homo sapiens; identical to SEQ ID NO: 35772
  Payload ID: 7073
  Gene Symbol: GTDC1
  Gene Name: glycosyltransferase-like domain containing 1
  Uniprot ID: Q4AE62
  ENSP ID: ENSP00000438323

SEQ ID NO: 35784 - protein, 426 aa, Homo sapiens
  Payload ID: 7073
  Gene Symbol: GTDC1
  Gene Name: glycosyltransferase-like domain containing 1
  Uniprot ID: Q4AE62
  ENSP ID: ENSP00000484990
MLTLHVWIWFGFMPCPNLMQNYNHQCCRTLFASSVLNLTELAALRPDLGKLKKILYFHENQLIYPVKKCQERDFQYGYNQILSCLVADVVVFNSVFNMESFLTSMGKFMKLIPDHRPKDLESIIRPKCQVIYFPIRFPDVSRFMPKHKTTHLKKMLGLKGNGGAVLSMALPFQPEQRDSEDLLKNFNSECDTHCGLDTARQEYLGNSLRQESDLKKSTSSDNSSSHHGENKQNLTVDPCDILGGVDNQQRLLHIVWPHRWEHDKDPESFFKVLMHLKDLGLNFHVSVLGETFTDVPDIFSEAKKALGSSVLHWGYLPSKDDYFQVLCMADVVISTAKHEFFGVAMLEAVYCGCYPLCPKDLVYPEIFPAEYLYSTPEQLSKRLQNFCKRPDIIRKHLYKGEIAPFSWAALHGKFRSLLTTEPREDL

SEQ ID NO: 35785 - protein, 739 aa, Homo sapiens
  Payload ID: 7074
  Gene Symbol: GARS
  Gene Name: glycyl-tRNA synthetase
  Uniprot ID: P41250
  ENSP ID: ENSP00000373918
MPSPRPVLLRGARAALLLLLPPRLLARPSLLLRRSLSAASCPPISLPAAASRSSMDGAGAEEVLAPLRLAVRQQGDLVRKLKEDKAPQVDVDKAVAELKARKRVLEAKELALQPKDDIVDRAKMEDTLKRRFFYDQAFAIYGGVSGLYDFGPVGCALKNNIIQTWRQHFIQEEQILEIDCTMLTPEPVLKTSGHVDKFADFMVKDVKNGECFRADHLLKAHLQKLMSDKKCSVEKKSEMESVLAQLDNYGQQELADLFVNYNVKSPITGNDLSPPVSFNLMFKTFIGPGGNMPGYLRPETAQGIFLNFKRLLEFNQGKLPFAAAQIGNSFRNEISPRSGLIRVREFTMAEIEHFVDPSEKDHPKFQNVADLHLYLYSAKAQVSGQSARKMRLGDAVEQGVINNTVLGYFIGRIYLYLTKVGISPDKLRFRQHMENEMAHYACDCWDAESKTSYGWIEIVGCADRSCYDLSCHARATKVPLVAEKPLKEPKTVNVVQFEPSKGAIGKAYKKDAKLVMEYLAICDECYITEMEMLLNEKGEFTIETEGKTFQLTKDMINVKRFQKTLYVEEVVPNVIEPSFGLGRIMYTVFEHTFHVREGDEQRTFFSFPAVVAPFKCSVLPLSQNQEFMPFVKELSEALTRHGVSHKVDDSSGSIGRRYARTDEIGVAFGVTIDFDTVNKTPHTATLRDRDSMRQIRAEISELPSIVQDLANGNITWADVEARYPLFEGQETGKKETIEE

SEQ ID NO: 35786 - protein, 79 aa, Homo sapiens
  Payload ID: 7074
  Gene Symbol: GARS
  Gene Name: glycyl-tRNA synthetase
  ENSP ID: ENSP00000392677
MPSPRPVLLRGARAALLLLLPPRLLARPSLLLRRSLSAASCPPISLPAAASRSSMDGAGAEEVLAPLRLAVRQQAVWNQ

SEQ ID NO: 35787 - protein, 77 aa, Homo sapiens
  Payload ID: 7074
  Gene Symbol: GARS
  Gene Name: glycyl-tRNA synthetase
  ENSP ID: ENSP00000415447
VVQFEPSKGAIGKAYKKDAKLVMEYLAICDECYITEMEMLLNEKGEFTIETEGKTFQLTKDMINVKRFQKTLYEQIL

SEQ ID NO: 35788 - protein, 79 aa, Homo sapiens; identical to SEQ ID NO: 35786
  Payload ID: 7074
  Gene Symbol: GARS
  Gene Name: glycyl-tRNA synthetase
  ENSP ID: ENSP00000485931

SEQ ID NO: 35789 - protein, 313 aa, Homo sapiens
  Payload ID: 7075
  Gene Symbol: GLOD4
  Gene Name: glyoxalase domain containing 4
  Uniprot ID: Q9HC38
  ENSP ID: ENSP00000301328
MAARRALHFVFKVGNRFQTARFYRDVLGMKVESCSVARLECSGAISAHCSDYTRITEDSFSKPYDGKWSKTMVGFGPEDDHFVAELTYNYGVGDYKLGNDFMGITLASSQAVSNARKLEWPLTEVAEGVFETEAPGGYKFYLQNRSLPQSDPVLKVTLAVSDLQKSLNYWCNLLGMKIYEKDEEKQRALLGYADNQCKLELQGVKGGVDHAAAFGRIAFSCPQKELPDLEDLMKRENQKILTPLVSLDTPGKATVQVVILADPDGHEICFVGDEAFRELSKMDPEGSKLLDDAMAADKSDEWFAKHNKPKASG

SEQ ID NO: 35790 - protein, 298 aa, Homo sapiens
  Payload ID: 7075
  Gene Symbol: GLOD4
  Gene Name: glyoxalase domain containing 4
  Uniprot ID: Q9HC38
  ENSP ID: ENSP00000301329
MAARRALHFVFKVGNRFQTARFYRDVLGMKVLRHEEFEEGCKAACNGPYDGKWSKTMVGFGPEDDHFVAELTYNYGVGDYKLGNDFMGITLASSQAVSNARKLEWPLTEVAEGVFETEAPGGYKFYLQNRSLPQSDPVLKVTLAVSDLQKSLNYWCNLLGMKIYEKDEEKQRALLGYADNQCKLELQGVKGGVDHAAAFGRIAFSCPQKELPDLEDLMKRENQKILTPLVSLDTPGKATVQVVILADPDGHEICFVGDEAFRELSKMDPEGSKLLDDAMAADKSDEWFAKHNKPKASG

SEQ ID NO: 35791 - protein, 502 aa, Homo sapiens [sequence omitted]

SEQ ID NO: 35792 - protein, 59 aa, Homo sapiens
  Payload ID: 7075
  Gene Symbol: GLOD4
  Gene Name: glyoxalase domain containing 4
  ENSP ID: ENSP00000458796
MAARRALHFVFKVGNRFQTARFYRDVLGMKVLRHEEFEEGCKAACNGYDTLFLKISFRL

SEQ ID NO: 35793 - protein, 115 aa, Homo sapiens
  Payload ID: 7075
  Gene Symbol: GLOD4
  Gene Name: glyoxalase domain containing 4
  ENSP ID: ENSP00000458849
  MOD_RES (1)..(1): Any amino acid
XCNLLGMKIYEKDEEKQRALLGYADNQLPDLEDLMKRENQKILTPLVSLDTPGKATVQVVILADPDGHEICFVGDEAFRELSKMDPEGSKLLDDAMAADKSDEWFAKHNKPKASG

SEQ ID NO: 35794 - protein, 76 aa, Homo sapiens
  Payload ID: 7075
  Gene Symbol: GLOD4
  Gene Name: glyoxalase domain containing 4
  ENSP ID: ENSP00000459446
MAARRALHFVFKVGNRFQTARFYRDVLGMKALRGVQLQERGELPLGIIGLGEGPNTISPRGVPTHVLSFKPLVNVY

SEQ ID NO: 35795 - protein, 52 aa, Homo sapiens
  Payload ID: 7075
  Gene Symbol: GLOD4
  Gene Name: glyoxalase domain containing 4
  ENSP ID: ENSP00000459557
MAARRALHFVFKVGNRFQTARFYRDVLGMKVESCSVARLECSGAISAHCSAA

SEQ ID NO: 35796 - protein, 58 aa, Homo sapiens
  Payload ID: 7075
  Gene Symbol: GLOD4
  Gene Name: glyoxalase domain containing 4
  ENSP ID: ENSP00000460423
  MOD_RES (1)..(1): Any amino acid
XMKKMKKSKGLCWAMLITSVSWSYRASRVGWTMQQLLEELPSLAPRKRTDEGRVLSSV

SEQ ID NO: 35797 - protein, 227 aa, Homo sapiens
  Payload ID: 7075
  Gene Symbol: GLOD4
  Gene Name: glyoxalase domain containing 4
  ENSP ID: ENSP00000460634
MAARRALHFVFKVGNRFQTARFYRDVLGMKVLRHEEFEEGCKAACNGPYDGKWSKTMVGFGPEDDHFVAELTYNYGVGDYKLGNDFMGITLASSQAVSNARKLEWPLTEVAEGVFETEAPGGYKFYLQNRSLPQSDPVLKVTLAVSDLQKSLNYWCNLLGMKIYEKDEEKQRALLGYADNQCKLELQGVKGGVDHAAAFGRIAFSCPQKEAMAADKSDEWFAKHNKP

SEQ ID NO: 35798 - protein, 36 aa, Homo sapiens
  Payload ID: 7075
  Gene Symbol: GLOD4
  Gene Name: glyoxalase domain containing 4
  ENSP ID: ENSP00000461829
MAARRALHFVFKVGNRFQTARFYRDVLGMKSVLKTL

SEQ ID NO: 35799 - protein, 36 aa, Homo sapiens
  Payload ID: 7075
  Gene Symbol: GLOD4
  Gene Name: glyoxalase domain containing 4
  ENSP ID: ENSP00000461837
MAARRALHFVFKVGNRFQTARFYRDVLGMKALTTPG

SEQ ID NO: 35800 - protein, 68 aa, Homo sapiens
  Payload ID: 7075
  Gene Symbol: GLOD4
  Gene Name: glyoxalase domain containing 4
  ENSP ID: ENSP00000466922
  MOD_RES (1)..(1): Any amino acid
XFYRDVLGMKVQAGADRGWRARLEPAPEPALAEGGENGCVVNLSRRVSDLRPCAVFSFRSVASCRWGS

SEQ ID NO: 35801 - protein, 36 aa, Homo sapiens; identical to SEQ ID NO: 35799
  Payload ID: 7075
  Gene Symbol: GLOD4
  Gene Name: glyoxalase domain containing 4
  ENSP ID: ENSP00000486254

SEQ ID NO: 35802 - protein, 36 aa, Homo sapiens; identical to SEQ ID NO: 35798
  Payload ID: 7075
  Gene Symbol: GLOD4
  Gene Name: glyoxalase domain containing 4
  ENSP ID: ENSP00000486778

SEQ ID NO: 35803 - protein, 160 aa, Homo sapiens
  Payload ID: 7076
  Gene Symbol: GLOD5
  Gene Name: glyoxalase domain containing 5
  Uniprot ID: A6NK44
  ENSP ID: ENSP00000302552
MLRHLPSRLPVKMWGRTLEKQSWRDSSQTPPPCLIRRLDHIVMTVKSIKDTTMFYSKILGMEVMTFKEDRKALCFGDQKFNLHEVGKEFEPKAAHPVPGSLDICLITEVPLEEMIQHLKACDVPIEEGPVPRTGAKGPIMSIYFRDPDRNLIEVSNYISS

SEQ ID NO: 35804 - protein, 127 aa, Homo sapiens
  Payload ID: 7076
  Gene Symbol: GLOD5
  Gene Name: glyoxalase domain containing 5
  ENSP ID: ENSP00000409523
  MOD_RES (1)..(1): Any amino acid
XIRRLDHIVMTVKSIKDTTMFYSKILGMEVMTFKEDRKALCFGDQKFNLHEVGKEFEPKAAHPVPGSLDICLITEVPLEEMIQHLKACDVPIEEGPVPRTGAKGPIMSIYFRDPDRNLIEVSNYISS

SEQ ID NO: 35805 - protein, 184 aa, Homo sapiens
  Payload ID: 7077
  Gene Symbol: GLO1
  Gene Name: glyoxalase I
  Uniprot ID: Q04760
  ENSP ID: ENSP00000362463
MAEPQPPSGGLTDEAALSCCSDADPSTKDFLLQQTMLRVKDPKKSLDFYTRVLGMTLIQKCDFPIMKFSLYFLAYEDKNDIPKEKDEKIAWALSRKATLELTHNWGTEDDETQSYHNGNSDPRGFGHIGIAVPDVYSACKRFEELGVKFVKKPDDGKMKGLAFIQDPDGYWIEILNPNKMATLM

SEQ ID NO: 35806 - protein, 553 aa, Homo sapiens
  Payload ID: 7078
  Gene Symbol: GLYR1
  Gene Name: glyoxylate reductase 1 homolog (Arabidopsis)
  Uniprot ID: Q49A26
  ENSP ID: ENSP00000322716
MAAVSLRLGDLVWGKLGRYPPWPGKIVNPPKDLKKPRGKKCFFVKFFGTEDHAWIKVEQLKPYHAHKEEMIKINKGKRFQQAVDAVEEFLRRAKGKDQTSSHNSSDDKNRRNSSEERSRPNSGDEKRKLSLSEGKVKKNMGEGKKRVSSGSSERGSKSPLKRAQEQSPRKRGRPPKDEKDLTIPESSTVKGMMAGPMAAFKWQPTASEPVKDADPHFHHFLLSQTEKPAVCYQAITKKLKICEEETGSTSIQAADSTAVNGSITPTDKKIGFLGLGLMGSGIVSNLLKMGHTVTVWNRTAEKCDLFIQEGARLGRTPAEVVSTCDITFACVSDPKAAKDLVLGPSGVLQGIRPGKCYVDMSTVDADTVTELAQVIVSRGGRFLEAPVSGNQQLSNDGMLVILAAGDRGLYEDCSSCFQAMGKTSFFLGEVGNAAKMMLIVNMVQGSFMATIAEGLTLAQVTGQSQQTLLDILNQGQLASIFLDQKCQNILQGNFKPDFYLKYIQKDLRLAIALGDAVNHPTPMAAAANEVYKRAKALDQSDNDMSAVYRAYIH

SEQ ID NO: 35807 - protein, 472 aa, Homo sapiens
  Payload ID: 7078
  Gene Symbol: GLYR1
  Gene Name: glyoxylate reductase 1 homolog (Arabidopsis)
  Uniprot ID: Q49A26
  ENSP ID: ENSP00000390276
MAAVSLRLGDLVWGKLGRYPPWPGKIVNPPKDLKKPRGKKCFFVKFFGTEDHAWIKVEQLKPYHAHKEEMIKINKGKRFQQAVDAVEEFLRRAKGKDQDLTIPESSTVKGMMAGPMAAFKWQPTASEPVKDADPHFHHFLLSQTEKPAVCYQAITKKLKICEEETGSTSIQAADSTAVNGSITPTDKKIGFLGLGLMGSGIVSNLLKMGHTVTVWNRTAEKCDLFIQEGARLGRTPAEVVSTCDITFACVSDPKAAKDLVLGPSGVLQGIRPGKCYVDMSTVDADTVTELAQVIVSRGGRFLEAPVSGNQQLSNDGMLVILAAGDRGLYEDCSSCFQAMGKTSFFLGEVGNAAKMMLIVNMVQGSFMATIAEGLTLAQVTGQSQQTLLDILNQGQLASIFLDQKCQNILQGNFKPDFYLKYIQKDLRLAIALGDAVNHPTPMAAAANEVYKRAKALDQSDNDMSAVYRAYIH

SEQ ID NO: 35808 - protein, 37 aa, Homo sapiens
  Payload ID: 7078
  Gene Symbol: GLYR1
  Gene Name: glyoxylate reductase 1 homolog (Arabidopsis)
  ENSP ID: ENSP00000465490
EGARLGRTPAEVVSTCDITFACVSDPKAAKDLIEIRK

SEQ ID NO: 35809 - protein, 52 aa, Homo sapiens
  Payload ID: 7078
  Gene Symbol: GLYR1
  Gene Name: glyoxylate reductase 1 homolog (Arabidopsis)
  ENSP ID: ENSP00000466127
MAAVSLRLGDLVWGKLGRYPPWPGKIVNPPKDLKKPRGKKCFFVKFFGTEDQ

SEQ ID NO: 35810 - protein, 524 aa, Homo sapiens
  Payload ID: 7078
  Gene Symbol: GLYR1
  Gene Name: glyoxylate reductase 1 homolog (Arabidopsis)
  ENSP ID: ENSP00000466570
  MOD_RES (1)..(1): Any amino acid
XGKLGRYPPWPGKIVNPPKDLKKPRGKKCFFVKFFGTEDHAWIKVEQLKPYHAHKEEMIKINKGKRFQQAVDAVEEFLRRAKGKDQTSSHNSSDDKNRRNSSEERSRPNSGDEKRKLSLSEGKVKKNMGEGKKRVSSGSSERGSKSPLKRAQEQSPRKRGRPPKDEKDLTIPESSTVKGMMAGPMAAFKWQPTASEPVKDADPHFHHFLLSQTEKETGSTSIQAADSTAVNGSITPTDKKIGFLGLGLMGSGIVSNLLKMGHTVTVWNRTAEKCDLFIQEGARLGRTPAEVVSTCDITFACVSDPKAAKDLVLGPSGVLQGIRPGKCYVDMSTVDADTVTELAQVIVSRGGRFLEAPVSGNQQLSNDGMLVILAAGDRGLYEDCSSCFQAMGKTSFFLGEVGNAAKMMLIVNMVQGSFMATIAEGLTLAQVTGQSQQTLLDILNQGQLASIFLDQKCQNILQGNFKPDFYLKYIQKDLRLAIALGDAVNHPTPMAAAANEVYKRAKALDQSDNDMSAVYRAYIH

SEQ ID NO: 35811 - protein, 171 aa, Homo sapiens
  Payload ID: 7078
  Gene Symbol: GLYR1
  Gene Name: glyoxylate reductase 1 homolog (Arabidopsis)
  ENSP ID: ENSP00000467541
TSSHNSSDDKNRRNSSEERSRPNSGDEKRKLSLSEGKVKKNMGEGKKRVSSGSSERGSKSPLKRAQEQSPRKRGRPPKDEKDLTIPESSTVKGMMAGPMAAFKWQPTASEPVKDADPHFHHFLLSQTEKPAVCYQAITKKLKICEEETGSTSIQAADSTAVNGSITPTDKK

SEQ ID NO: 35812 - protein, 185 aa, Homo sapiens
  Payload ID: 7078
  Gene Symbol: GLYR1
  Gene Name: glyoxylate reductase 1 homolog (Arabidopsis)
  ENSP ID: ENSP00000467751
MAAVSLRLGDLVWGKLGRYPPWPGKIVNPPKDLKKPRGKKCFFVKFFGTEDHAWIKVEQLKPYHAHKEEMIKINKGKRFQQAVDAVEEFLRRAKGKDQDLTIPESSTVKGMMAGPMAAFKWQPTASEPVKDADPHFHHFLLSQTEKETGSTSIQAADSTAVNGSITPTDKKIGFLGLGLMGSGIV

SEQ ID NO: 35813 - protein, 547 aa, Homo sapiens
  Payload ID: 7078
  Gene Symbol: GLYR1
  Gene Name: glyoxylate reductase 1 homolog (Arabidopsis)
  Uniprot ID: Q49A26
  ENSP ID: ENSP00000468328
MAAVSLRLGDLVWGKLGRYPPWPGKIVNPPKDLKKPRGKKCFFVKFFGTEDHAWIKVEQLKPYHAHKEEMIKINKGKRFQQAVDAVEEFLRRAKGKDQTSSHNSSDDKNRRNSSEERSRPNSGDEKRKLSLSEGKVKKNMGEGKKRVSSGSSERGSKSPLKRAQEQSPRKRGRPPKDEKDLTIPESSTVKGMMAGPMAAFKWQPTASEPVKDADPHFHHFLLSQTEKPAVCYQAITKKLKICEEETGSTSIQAADSTAVNGSITPTDKKIGFLGLGLMGSGIVSNLLKMGHTVTVWNRTAEKEGARLGRTPAEVVSTCDITFACVSDPKAAKDLVLGPSGVLQGIRPGKCYVDMSTVDADTVTELAQVIVSRGGRFLEAPVSGNQQLSNDGMLVILAAGDRGLYEDCSSCFQAMGKTSFFLGEVGNAAKMMLIVNMVQGSFMATIAEGLTLAQVTGQSQQTLLDILNQGQLASIFLDQKCQNILQGNFKPDFYLKYIQKDLRLAIALGDAVNHPTPMAAAANEVYKRAKALDQSDNDMSAVYRAYIH

SEQ ID NO: 35814 - protein, 328 aa, Homo sapiens
  Payload ID: 7079
  Gene Symbol: GRHPR
  Gene Name: glyoxylate reductase/hydroxypyruvate reductase
  Uniprot ID: Q9UBQ7
  ENSP ID: ENSP00000313432
MRPVRLMKVFVTRRIPAEGRVALARAADCEVEQWDSDEPIPAKELERGVAGAHGLLCLLSDHVDKRILDAAGANLKVISTMSVGIDHLALDEIKKRGIRVGYTPDVLTDTTAELAVSLLLTTCRRLPEAIEEVKNGGWTSWKPLWLCGYGLTQSTVGIIGLGRIGQAIARRLKPFGVQRFLYTGRQPRPEEAAEFQAEFVSTPELAAQSDFIVVACSLTPATEGLCNKDFFQKMKETAVFINISRGDVVNQDDLYQALASGKIAAAGLDVTSPEPLPTNHPLLTLKNCVILPHIGSATHRTRNTMSLLAANNLLAGLRGEPMPSELKL

SEQ ID NO: 35815 - protein, 252 aa, Homo sapiens
  Payload ID: 7079
  Gene Symbol: GRHPR
  Gene Name: glyoxylate reductase/hydroxypyruvate reductase
  Uniprot ID: Q9UBQ7
  ENSP ID: ENSP00000432021
MLGGVPTLCGTGNETWTLLALGQAIARRLKPFGVQRFLYTGRQPRPEEAAEFQAEFVSTPELAAQSDFIVVACSLTPATEGLCNKDFFQKMKETAVFINISRYPRATLPSKPGEEPSPLLPSGDFLPRGLLVRPQAELAGFHKPNNQLRNSWEYTRPPYREEEPSEWAWPVCFSAVAPTRRGLAHSSVASGSVPREPLQAHYPPPQRAGLEDLKGPLEAASHTAEPGFVWLWFSDTLNLMLLGGQTLKLTWS

SEQ ID NO: 35816 - protein, 358 aa, Homo sapiens
  Payload ID: 7079
  Gene Symbol: GRHPR
  Gene Name: glyoxylate reductase/hydroxypyruvate reductase
  ENSP ID: ENSP00000475569
MRPVRLMKVFVTRRIPAEGRVALARAADCEVEQWDSDEPIPAKELERGVAGAHGLLCLLSDHVDKRILDAAGANLKVISTMSVGIDHLALDEIKKRGIRVGYTPDVLTDTTAELAVSLLLTTCRRLPEAIEEVKNGGWTSWKPLWLCGYGLTQSTVGIIGLGRIGQAIARRLKPFGVQRFLYTGRQPRPEEAAEFQAEFVSTPELAAQSDFIVVACSLTPATEGLCNKDFFQKMKETAVFINISRGDVVNQDDLYQALASGKIAAAGLDVTSPEPLPTNHPLLTLKNCGPGIQLTAWGLLQKAGLGLRRGQSGHEAAAATAASTKSKHWAAAMSYCQQEGKDAIICDVKRPCSSKQHS

SEQ ID NO: 35817 - protein, 558 aa, Homo sapiens
  Payload ID: 7080
  Gene Symbol: GPC1
  Gene Name: glypican 1
  Uniprot ID: P35052
  ENSP ID: ENSP00000264039
MELRARGWWLLCAAAALVACARGDPASKSRSCGEVRQIYGAKGFSLSDVPQAEISGEHLRICPQGYTCCTSEMEENLANRSHAELETALRDSSRVLQAMLATQLRSFDDHFQHLLNDSERTLQATFPGAFGELYTQNARAFRDLYSELRLYYRGANLHLEETLAEFWARLLERLFKQLHPQLLLPDDYLDCLGKQAEALRPFGEAPRELRLRATRAFVAARSFVQGLGVASDVVRKVAQVPLGPECSRAVMKLVYCAHCLGVPGARPCPDYCRNVLKGCLANQADLDAEWRNLLDSMVLITDKFWGTSGVESVIGSVHTWLAEAINALQDNRDTLTAKVIQGCGNPKVNPQGPGPEEKRRRGKLAPRERPPSGTLEKLVSEAKAQLRDVQDFWISLPGTLCSEKMALSTASDDRCWNGMARGRYLPEVMGDGLANQINNPEVEVDITKPDMTIRQQIMQLKIMTNRLRSAYNGNDVDFQDASDDGSGSGSGDGCLDDLCSRKVSRKSSSSRTPLTHALPGLSEQEGQKTSAASCPQPPTFLLPLLLFLALTVARPRWR

SEQ ID NO: 35818 - protein, 162 aa, Homo sapiens
  Payload ID: 7080
  Gene Symbol: GPC1
  Gene Name: glypican 1
  ENSP ID: ENSP00000389276
MEENLANRSHAELETALRDSSRVLQAMLATQLRSFDDHFQHLLNDSERTLQATFPGAFGELYTQNARAFRDLYSELRLYYRGANLHLEETLAEFWARLLERLFKQLHPQLLLPDDYLDCLGKQAEALRPFGEAPRELRLRATRAFVAARSFVQGLGVASDVV

SEQ ID NO: 35819 - protein, 281 aa, Homo sapiens
  Payload ID: 7080
  Gene Symbol: GPC1
  Gene Name: glypican 1
  ENSP ID: ENSP00000390242
  MOD_RES (1)..(1): Any amino acid
XAHCLGVPGARPCPDYCRNVLKGCLANQADLDAEWRNLLDSMVLITDKFWGTSGVESVIGSVHTWLAEAINALQDNRDTLTAKDPAVSLQVIQGCGNPKVNPQGPGPEEKRRRGKLAPRERPPSGTLEKLVSEAKAQLRDVQDFWISLPGTLCSEKMALSTASDDRCWNGMARGRYLPEVMGDGLANQINNPEVEVDITKPDMTIRQQIMQLKIMTNRLRSAYNGNDVDFQDASDDGSGSGSGDGCLDDLCSRKVSRKSSSSRTPLTHALPGLSEQEGQKT

SEQ ID NO: 35820 - protein, 294 aa, Homo sapiens
  Payload ID: 7080
  Gene Symbol: GPC1
  Gene Name: glypican 1
  ENSP ID: ENSP00000392629
MEENLANRSHAELETALRDSSRVLQAMLATQLRSFDDHFQHLLNDSERTLQATFPGAFGELYTQNARAFRDLYSELRLYYRGANLHLEETLAEFWARLLERLFKQLHPQLLLPDDYLDCLGKQAEALRPFGEAPRELRLRATRAFVAARSFVQGLGVASDVVRKVAQVPLGPECSRAVMKLVYCAHCLGVPGARPCPDYCRNVLKGCLANQADLDAEWRNLLDSMVLITDKFWGTSGVESVIGSVHTWLAEAINALQDNRDTLTAKVIQGCGNPKVNPQGPGPEEKRRRGKLAP

SEQ ID NO: 35821 - protein, 156 aa, Homo sapiens
  Payload ID: 7080
  Gene Symbol: GPC1
  Gene Name: glypican 1
  ENSP ID: ENSP00000410251
MHDLKGEHLRICPQGYTCCTSEMEENLANRSHAELETALRDSSRVLQAMLATQLRSFDDHFQHLLNDSERTLQATFPGAFGELYTQNARAFRDLYSELRLYYRGANLHLEETLAEFWARLLERLFKQLHPQLLLPDDYLDCLGKQAEALRPFGEAP

SEQ ID NO: 35822 - protein, 486 aa, Homo sapiens
  Payload ID: 7080
  Gene Symbol: GPC1
  Gene Name: glypican 1
  ENSP ID: ENSP00000415077
MEENLANRSHAELETALRDSSRVLQAMLATQLRSFDDHFQHLLNDSERTLQATFPGAFGELYTQNARAFRDLYSELRLYYRGANLHLEETLAEFWARLLERLFKQLHPQLLLPDDYLDCLGKQAEALRPFGEAPRELRLRATRAFVAARSFVQGLGVASDVVRKVAQVPLGPECSRAVMKLVYCAHCLGVPGARPCPDYCRNVLKGCLANQADLDAEWRNLLDSMVLITDKFWGTSGVESVIGSVHTWLAEAINALQDNRDTLTAKVIQGCGNPKVNPQGPGPEEKRRRGKLAPRERPPSGTLEKLVSEAKAQLRDVQDFWISLPGTLCSEKMALSTASDDRCWNGMARGRYLPEVMGDGLANQINNPEVEVDITKPDMTIRQQIMQLKIMTNRLRSAYNGNDVDFQDASDDGSGSGSGDGCLDDLCSRKVSRKSSSSRTPLTHALPGLSEQEGQKTSAASCPQPPTFLLPLLLFLALTVARPRWR

SEQ ID NO: 35823 - protein, 579 aa, Homo sapiens
  Payload ID: 7081
  Gene Symbol: GPC2
  Gene Name: glypican 2
  Uniprot ID: Q8N158
  ENSP ID: ENSP00000292377
MSALRPLLLLLLPLCPGPGPGPGSEAKVTRSCAETRQVLGARGYSLNLIPPALISGEHLRVCPQEYTCCSSETEQRLIRETEATFRGLVEDSGSFLVHTLAARHRKFDEFFLEMLSVAQHSLTQLFSHSYGRLYAQHALIFNGLFSRLRDFYGESGEGLDDTLADFWAQLLERVFPLLHPQYSFPPDYLLCLSRLASSTDGSLQPFGDSPRRLRLQITRTLVAARAFVQGLETGRNVVSEALKVPVSEGCSQALMRLIGCPLCRGVPSLMPCQGFCLNVVRGCLSSRGLEPDWGNYLDGLLILADKLQGPFSFELTAESIGVKISEGLMYLQENSAKVSAQVFQECGPPDPVPARNRRAPPPREEAGRLWSMVTEEERPTTAAGTNLHRLVWELRERLARMRGFWARLSLTVCGDSRMAADASLEAAPCWTGAGRGRYLPPVVGGSPAEQVNNPELKVDASGPDVPTRRRRLQLRAATARMKTAALGHDLDGQDADEDASGSGGGQQYADDWMAGAVAPPARPPRPPYPPRRDGSGGKGGGGSARYNQGRSRSGGASIGFHTQTILILSLSALALLGPR

SEQ ID NO: 35824 - protein, 134 aa, Homo sapiens
  Payload ID: 7081
  Gene Symbol: GPC2
  Gene Name: glypican 2
  ENSP ID: ENSP00000488396
MSALRPLLLLLLPLCPGPGPGPGSEAKVTRSCAETRQVLGARGYSLNLIPPALISGEHLRVCPQEYTCCSSETEQRLIRETEATFRGLVEDSGSFLVHTLAARHRKFDDNPDPGGCPSLCAGPGDWKKCGQRSA

SEQ ID NO: 35825 - protein, 580 aa, Homo sapiens
  Payload ID: 7082
  Gene Symbol: GPC3
  Gene Name: glypican 3
  Uniprot ID: P51654
  ENSP ID: ENSP00000359854
MAGTVRTACLVVAMLLSLDFPGQAQPPPPPPDATCHQVRSFFQRLQPGLKWVPETPVPGSDLQVCLPKGPTCCSRKMEEKYQLTARLNMEQLLQSASMELKFLIIQNAAVFQEAFEIVVRHAKNYTNAMFKNNYPSLTPQAFEFVGEFFTDVSLYILGSDINVDDMVNELFDSLFPVIYTQLMNPGLPDSALDINECLRGARRDLKVFGNFPKLIMTQVSKSLQVTRIFLQALNLGIEVINTTDHLKFSKDCGRMLTRMWYCSYCQGLMMVKPCGGYCNVVMQGCMAGVVEIDKYWREYILSLEELVNGMYRIYDMENVLLGLFSTIHDSIQYVQKNAGKLTTTIGKLCAHSQQRQYRSAYYPEDLFIDKKVLKVAHVEHEETLSSRRRELIQKLKSFISFYSALPGYICSHSPVAENDTLCWNGQELVERYSQKAARNGMKNQFNLHELKMKGPEPVVSQIIDKLKHINQLLRTMSMPKGRVLDKNLDEEGFESGDCGDDEDECIGGSGDGMIKVKNQLRFLAELAYDLDVDDAPGNSQQATPKDNEISTFHNLGNVHSPLKLLTSMAISVVCFFFLVH

SEQ ID NO: 35826 - protein, 603 aa, Homo sapiens
  Payload ID: 7082
  Gene Symbol: GPC3
  Gene Name: glypican 3
  Uniprot ID: P51654
  ENSP ID: ENSP00000377836
MAGTVRTACLVVAMLLSLDFPGQAQPPPPPPDATCHQVRSFFQRLQPGLKWVPETPVPGSDLQVCLPKGPTCCSRKMEEKYQLTARLNMEQLLQSASMELKFLIIQNAAVFQEAFEIVVRHAKNYTNAMFKNNYPSLTPQAFEFVGEFFTDVSLYILGSDINVDDMVNELFDSLFPVIYTQLMNPGLPDSALDINECLRGARRDLKVFGNFPKLIMTQVSKSLQVTRIFLQALNLGIEVINTTDHLKFSKDCGRMLTRMWYCSYCQGLMMVKPCGGYCNVVMQGCMAGVVEIDKYWREYILSLEELVNGMYRIYDMENVLLGLFSTIHDSIQYVQKNAGKLTTTETEKKIWHFKYPIFFLCIGLDLQIGKLCAHSQQRQYRSAYYPEDLFIDKKVLKVAHVEHEETLSSRRRELIQKLKSFISFYSALPGYICSHSPVAENDTLCWNGQELVERYSQKAARNGMKNQFNLHELKMKGPEPVVSQIIDKLKHINQLLRTMSMPKGRVLDKNLDEEGFESGDCGDDEDECIGGSGDGMIKVKNQLRFLAELAYDLDVDDAPGNSQQATPKDNEISTFHNLGNVHSPLKLLTSMAISVVCFFFLVH

SEQ ID NO: 35827 - protein, 256 aa, Homo sapiens
  Payload ID: 7082
  Gene Symbol: GPC3
  Gene Name: glypican 3
  ENSP ID: ENSP00000385307
  MOD_RES (1)..(1): Any amino acid
XKPCGGYCNVVMQGCMAGVVEIDKYWREYILSLEELVNGMYRIYDMENVLLGLFSTIHDSIQYVQKNAGKLTTTIGKLCAHSQQRQYRSAYYPEDLFIDKKVLKVAHVEHEETLSSRRRELIQKLKSFISFYSALPGYICSHSPVAENDTLCWNGQELVERYSQKAARNGMKNQFNLHELKMKGPEPVVSQIIDKLKHINQLLRTMSMPKGRVLDKNLDEEGFESGDCGDDEDECIGGSGDGMIKVKNQLRFLAGN

SEQ ID NO: 35828 - protein, 526 aa, Homo sapiens
  Payload ID: 7082
  Gene Symbol: GPC3
  Gene Name: glypican 3
  Uniprot ID: P51654
  ENSP ID: ENSP00000486325
MAGTVRTACLVVAMLLSLDFPGQAQPPPPPPDATCHQVRSFFQRLQPGLKWVPETPVPEAFEIVVRHAKNYTNAMFKNNYPSLTPQAFEFVGEFFTDVSLYILGSDINVDDMVNELFDSLFPVIYTQLMNPGLPDSALDINECLRGARRDLKVFGNFPKLIMTQVSKSLQVTRIFLQALNLGIEVINTTDHLKFSKDCGRMLTRMWYCSYCQGLMMVKPCGGYCNVVMQGCMAGVVEIDKYWREYILSLEELVNGMYRIYDMENVLLGLFSTIHDSIQYVQKNAGKLTTTIGKLCAHSQQRQYRSAYYPEDLFIDKKVLKVAHVEHEETLSSRRRELIQKLKSFISFYSALPGYICSHSPVAENDTLCWNGQELVERYSQKAARNGMKNQFNLHELKMKGPEPVVSQIIDKLKHINQLLRTMSMPKGRVLDKNLDEEGFESGDCGDDEDECIGGSGDGMIKVKNQLRFLAELAYDLDVDDAPGNSQQATPKDNEISTFHNLGNVHSPLKLLTSMAISVVCFFFLVH

SEQ ID NO: 35829 - protein, 556 aa, Homo sapiens
  Payload ID: 7083
  Gene Symbol: GPC4
  Gene Name: glypican 4
  Uniprot ID: O75487
  ENSP ID: ENSP00000359864
MARFGLPALLCTLAVLSAALLAAELKSKSCSEVRRLYVSKGFNKNDAPLHEINGDHLKICPQGSTCCSQEMEEKYSLQSKDDFKSVVSEQCNHLQAVFASRYKKFDEFFKELLENAEKSLNDMFVKTYGHLYMQNSELFKDLFVELKRYYVVGNVNLEEMLNDFWARLLERMFRLVNSQYHFTDEYLECVSKYTEQLKPFGDVPRKLKLQVTRAFVAARTFAQGLAVAGDVVSKVSVVNPTAQCTHALLKMIYCSHCRGLVTVKPCYNYCSNIMRGCLANQGDLDFEWNNFIDAMLMVAERLEGPFNIESVMDPIDVKISDAIMNMQDNSVQVSQKVFQGCGPPKPLPAGRISRSISESAFSARFRPHHPEERPTTAAGTSLDRLVTDVKEKLKQAKKFWSSLPSNVCNDERMAAGNGNEDDCWNGKGKSRYLFAVTGNGLANQGNNPEVQVDTSKPDILILRQIMALRVMTSKMKNAYNGNDVDFFDISDESSGEGSGSGCEYQQCPSEFDYNATDHAGKSANEKADSAGVRPGAQAYLLTVFCILFLVMQREWR

SEQ ID NO: 35830 - protein, 572 aa, Homo sapiens
  Payload ID: 7084
  Gene Symbol: GPC5
  Gene Name: glypican 5
  Uniprot ID: P78333
  ENSP ID: ENSP00000366267
MDAQTWPVGFRCLLLLALVGSARSEGVQTCEEVRKLFQWRLLGAVRGLPDSPRAGPDLQVCISKKPTCCTRKMEERYQIAARQDMQQFLQTSSSTLKFLISRNAAAFQETLETLIKQAENYTSILFCSTYRNMALEAAASVQEFFTDVGLYLFGADVNPEEFVNRFFDSLFPLVYNHLINPGVTDSSLEYSECIRMARRDVSPFGNIPQRVMGQMGRSLLPSRTFLQALNLGIEVINTTDYLHFSKECSRALLKMQYCPHCQGLALTKPCMGYCLNVMRGCLAHMAELNPHWHAYIRSLEELSDAMHGTYDIGHVLLNFHLLVNDAVLQAHLNGQKLLEQVNRICGRPVRTPTQSPRCSFDQSKEKHGMKTTTRNSEETLANRRKEFINSLRLYRSFYGGLADQLCANELAAADGLPCWNGEDIVKSYTQRVVGNGIKAQSGNPEVKVKGIDPVINQIIDKLKHVVQLLQGRSPKPDKWELLQLGSGGGMVEQVSGDCDDEDGCGGSGSGEVKRTLKITDWMPDDMNFSDVKQIHQTDTGSTLDTTGAGCAVATESMTFTLISVVMLLPGIW

SEQ ID NO: 35831 - protein, 51 aa, Homo sapiens
  Payload ID: 7084
  Gene Symbol: GPC5
  Gene Name: glypican 5
  ENSP ID: ENSP00000480653
  MOD_RES (1)..(1): Any amino acid
XMPDDMNFSDVKQIHQTDTGSTLDTTGAGCAVATESMTFTLISVVMLLPGI

SEQ ID NO: 35832 - protein, 320 aa, Homo sapiens [sequence omitted]

SEQ ID NO: 35833 - protein, 555 aa, Homo sapiens
  Payload ID: 7085
  Gene Symbol: GPC6
  Gene Name: glypican 6
  Uniprot ID: Q9Y625
  ENSP ID: ENSP00000366246
MPSWIGAVILPLLGLLLSLPAGADVKARSCGEVRQAYGAKGFSLADIPYQEIAGEHLRICPQEYTCCTTEMEDKLSQQSKLEFENLVEETSHFVRTTFVSRHKKFDEFFRELLENAEKSLNDMFVRTYGMLYMQNSEVFQDLFTELKRYYTGGNVNLEEMLNDFWARLLERMFQLINPQYHFSEDYLECVSKYTDQLKPFGDVPRKLKIQVTRAFIAARTFVQGLTVGREVANRVSKVSPTPGCIRALMKMLYCPYCRGLPTVRPCNNYCLNVMKGCLANQADLDTEWNLFIDAMLLVAERLEGPFNIESVMDPIDVKISEAIMNMQENSMQVSAKVFQGCGQPKPAPALRSARSAPENFNTRFRPYNPEERPTTAAGTSLDRLVTDIKEKLKLSKKVWSALPYTICKDESVTAGTSNEEECWNGHSKARYLPEIMNDGLTNQINNPEVDVDITRPDTFIRQQIMALRVMTNKLKNAYNGNDVNFQDTSDESSGSGSGSGCMDDVCPTEFEFVTTEAPAVDPDRREVDSSAAQRGHSLLSWSLTCIVLALQRLCR

SEQ ID NO: 35834 - protein, 263 aa, Homo sapiens
  Payload ID: 7085
  Gene Symbol: GPC6
  Gene Name: glypican 6
  ENSP ID: ENSP00000477667
DAMLLVAERLEGPFNIESVMDPIDVKISEAIMNMQENSMQVSAKVFQGCGQPKPAPALRSARSAPENFNTRFRPYNPEERPTTAAGTSLDRLVTDIKEKLKLSKKVWSALPYTICKDESVTAGTSNEEECWNGHSKARYLPEIMNDGLTNQINNPEVDVDITRPDTFIRQQIMALRVMTNKLKNAYNGNDVNFQDTSDESSGSGSGSGCMDDVCPTEFEFVTTEAPAVDPDRREVDSSAAQRGHSLLSWSLTCIVLALQRLCR

SEQ ID NO: 35835 - protein, 193 aa, Homo sapiens
  Payload ID: 7086
  Gene Symbol: GM2A
  Gene Name: GM2 ganglioside activator
  Uniprot ID: P17900
  ENSP ID: ENSP00000349687
MQSLMQAPLLIALGLLLAAPAQAHLKKPSQLSSFSWDNCDEGKDPAVIRSLTLEPDPIIVPGNVTLSVMGSTSVPLSSPLKVDLVLEKEVAGLWIKIPCTDYIGSCTFEHFCDVLDMLIPTGEPCPEPLRTYGLPCHCPFKEGTYSLPKSEFVVPDLELPSWLTTGNYRIESVLSSSGKRLGCIKIAASLKGI

SEQ ID NO: 35836 - protein, 146 aa, Homo sapiens
  Payload ID: 7086
  Gene Symbol: GM2A
  Gene Name: GM2 ganglioside activator
  ENSP ID: ENSP00000429100
MSWVEAAGVSSTALEDRIVAKHEEVPEVSVQYEEKFQNHHKLPSQLSSFSWDNCDEGKDPAVIRSLTLEPDPIIVPGNVTLSVMGSTSVPLSSPLKVDLVLEKEVAGLWIKIPCTDYIGSCTFEHFCDVLDMLIPTGEPCPEPLRT

SEQ ID NO: 35837 - protein, 104 aa, Homo sapiens
  Payload ID: 7086
  Gene Symbol: GM2A
  Gene Name: GM2 ganglioside activator
  ENSP ID: ENSP00000430541
  MOD_RES (1)..(1): Any amino acid
XKDPAVIRSLTLEPDPIIVPGNVTLSVMGSTSVPLSSPLKVDLVLEKEVAGLWIKIPCTDYIGSCTFEHFCDVLDMLIPTGEPCPEPLRTYGLPCHCPFKEVST

SEQ ID NO: 35838 - protein, 379 aa, Homo sapiens
  Payload ID: 7087
  Gene Symbol: GNAS
  Gene Name: GNAS complex locus
  Uniprot ID: P63092
  ENSP ID: ENSP00000265620
MGCLGNSKTEDQRNEEKAQREANKKIEKQLQKDKQVYRATHRLLLLGAGESGKSTIVKQMRILHVNGFNGDEKATKVQDIKNNLKEAIETIVAAMSNLVPPVELANPENQFRVDYILSVMNVPDFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 35839 - protein, 193 aa, Homo sapiens
  Payload ID: 7087
  Gene Symbol: GNAS
  Gene Name: GNAS complex locus
  ENSP ID: ENSP00000265621
PKASRSLKVKKVPLAEKRRQMRKEALEKRAQKRAEKKRSKLIDKQLQDEKMGYMCTHRLLLLGAGESGKSTIVKQMRILHVNGFNGEGGEEDPQAARSNSDGSEKATKVQDIKNNLKEAIETIVAAMSNLVPPVELANPENQFRVDYILSVMNVPDFDFPPEFYEHAKALWEDEGVRACYERSNEYQLIDCAQ

SEQ ID NO: 35840 - protein, 625 aa, Homo sapiens
  Payload ID: 7087
  Gene Symbol: GNAS
  Gene Name: GNAS complex locus
  Uniprot ID: P84996
  ENSP ID: ENSP00000302237
MARPVDPQRSPDPTFRSSTRHSGKLEPMEATAHLLRKQCPSRLNSPAWEASGLHWSSLDSPVGSMQALRPSAQHSWSPEPSVVPDQAWEDTALHQKKLCPLSLTSLPREAAVNFSYRSQTLLQEAQVLQGSPELLPRSPKPSGLQRLAPEEATALPLRRLCHLSLMEKDLGTTAHPRGFPELSHKSTAAASSRQSRPRVRSASLPPRTRLPSGSQAPSAAHPKRLSDLLLTSRAAAPGWRSPDPRSRLAAPPLGSTTLPSTWTAPQSRLTARPSRSPEPQIRESEQRDPQLRRKQQRWKEPLMPRREEKYPLRGTDPLPPGQPQRIPLPGQPLQPQPILTPGQPQKIPTPGQHQPILTPGHSQPIPTPGQPLPPQPIPTPGRPLTPQPIPTPGRPLTPQPIQMPGRPLRLPPPLRLLRPGQPMSPQLRQTQGLPLPQPLLPPGQPKSAGRPLQPLPPGPDARSISDPPAPRSRLPIRLLRGLLARLPGGASPRAAAAAACTTMKGWPAATMTPAETSPTMGPPDASAGFSIGEIAAAESPSATYSATFSCKPSGAASVDLRVPSPKPRALSRSRRYPWRRSADRCAKKPWRSGPRSAQRRNAVSSSTNNSRTKRWATCVRTACCF

SEQ ID NO: 35841 - protein, 158 aa, Homo sapiens
  Payload ID: 7087
  Gene Symbol: GNAS
  Gene Name: GNAS complex locus
  ENSP ID: ENSP00000304472
MGCLGNSKTEDQRNEEKAQREANKKIEKQLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 35842 - protein, 245 aa, Homo sapiens
  Payload ID: 7087
  Gene Symbol: GNAS
  Gene Name: GNAS complex locus
  Uniprot ID: O95467
  ENSP ID: ENSP00000323571
MDRRSRAQQWRRARHNYNDLCPPIGRRAATALLWLSCSIALLRALATSNARAQQRAAAQQRRSFLNAHHRSGAQVFPESPESESDHEHEEADLELSLPECLEYEEEFDYETESETESEIESETDFETEPETAPTTEPETEPEDDRGPVVPKHSTFGQSLTQRLHALKLRSPDASPSRAPPSTQEPQSPREGEELKPEDKDPRDPEESKEPKEEKQRRRCKPKKPTRRDASPESPSKKGPIPIRRH

SEQ ID NO: 35843 - protein, 61 aa, Homo sapiens
  Payload ID: 7087
  Gene Symbol: GNAS
  Gene Name: GNAS complex locus
  ENSP ID: ENSP00000345971
QRNEEKAQREANKKIEKQLQKDKQVYRATHRLLLLGAGESGKSTIVKQMRILHVNGFNGEI

SEQ ID NO: 35844 - protein, 395 aa, Homo sapiens
  Payload ID: 7087
  Gene Symbol: GNAS
  Gene Name: GNAS complex locus
  Uniprot ID: P63092
  ENSP ID: ENSP00000346328
MGCLGNSKTEDQRNEEKAQREANKKIEKQLQKDKQVYRATHRLLLLGAGESGKSTIVKQMRILHVNGFNGEGGEEDPQAARSNSDGSEKATKVQDIKNNLKEAIETIVAAMSNLVPPVELANPENQFRVDYILSVMNVPDFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 35845 - protein, 245 aa, Homo sapiens; identical to SEQ ID NO: 35842
  Payload ID: 7087
  Gene Symbol: GNAS
  Gene Name: GNAS complex locus
  Uniprot ID: O95467
  ENSP ID: ENSP00000360115

SEQ ID NO: 35846 - protein, 87 aa, Homo sapiens
  Payload ID: 7087
  Gene Symbol: GNAS
  Gene Name: GNAS complex locus
  ENSP ID: ENSP00000360122
MGCLGNSKTEDQRNEEKAQREANKKIEKQLQKDKQVYRATHRLLLLGAGESGKSTIVKQMRILHVNGFNGEGGEEDPQAARSNSDGI

SEQ ID NO: 35847 - protein, 394 aa, Homo sapiens
  Payload ID: 7087
  Gene Symbol: GNAS
  Gene Name: GNAS complex locus
  Uniprot ID: P63092
  ENSP ID: ENSP00000360126
MGCLGNSKTEDQRNEEKAQREANKKIEKQLQKDKQVYRATHRLLLLGAGESGKSTIVKQMRILHVNGFNGEGGEEDPQAARSNSDGEKATKVQDIKNNLKEAIETIVAAMSNLVPPVELANPENQFRVDYILSVMNVPDFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 35848 - protein, 380 aa, Homo sapiens
  Payload ID: 7087
  Gene Symbol: GNAS
  Gene Name: GNAS complex locus
  Uniprot ID: P63092
  ENSP ID: ENSP00000360136
MGCLGNSKTEDQRNEEKAQREANKKIEKQLQKDKQVYRATHRLLLLGAGESGKSTIVKQMRILHVNGFNGDSEKATKVQDIKNNLKEAIETIVAAMSNLVPPVELANPENQFRVDYILSVMNVPDFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 35849 - protein, 245 aa, Homo sapiens; identical to SEQ ID NO: 35842
  Payload ID: 7087
  Gene Symbol: GNAS
  Gene Name: GNAS complex locus
  Uniprot ID: O95467
  ENSP ID: ENSP00000360139

SEQ ID NO: 35850 - protein, 720 aa, Homo sapiens [sequence omitted]

SEQ ID NO: 35851 - protein, 1037 aa, Homo sapiens
  Payload ID: 7087
  Gene Symbol: GNAS
  Gene Name: GNAS complex locus
  Uniprot ID: Q5JWF2
  ENSP ID: ENSP00000360141
MGVRNCLYGNNMSGQRDIPPEIGEQPEQPPLEAPGAAAPGAGPSPAEEMETEPPHNEPIPVENDGEACGPPEVSRPNFQVLNPAFREAGAHGSYSPPPEEAMPFEAEQPSLGGFWPTLEQPGFPSGVHAGLEAFGPALMEPGAFSGARPGLGGYSPPPEEAMPFEFDQPAQRGCSQLLLQVPDLAPGGPGAAGVPGAPPEEPQALRPAKAGSRGGYSPPPEETMPFELDGEGFGDDSPPPGLSRVIAQVDGSSQFAAVAASSAVRLTPAANAPPLWVPGAIGSPSQEAVRPPSNFTGSSPWMEISGPPFEIGSAPAGVDDTPVNMDSPPIALDGPPIKVSGAPDKRERAERPPVEEEAAEMEGAADAAEGGKVPSPGYGSPAAGAASADTAARAAPAAPADPDSGATPEDPDSGTAPADPDSGAFAADPDSGAAPAAPADPDSGAAPDAPADPDSGAAPDAPADPDAGAAPEAPAAPAAAETRAAHVAPAAPDAGAPTAPAASATRAAQVRRAASAAPASGARRKIHLRPPSPEIQAADPPTPRPTRASAWRGKSESSRGRRVYYDEGVASSDDDSSGDESDDGTSGCLRWFQHRRNRRRRKPQRNLLRNFLVQAFGGCFGRSESPQPKASRSLKVKKVPLAEKRRQMRKEALEKRAQKRAEKKRSKLIDKQLQDEKMGYMCTHRLLLLGAGESGKSTIVKQMRILHVNGFNGEGGEEDPQAARSNSDGEKATKVQDIKNNLKEAIETIVAAMSNLVPPVELANPENQFRVDYILSVMNVPDFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 35852 - protein, 1023 aa, Homo sapiens
  Payload ID: 7087
  Gene Symbol: GNAS
  Gene Name: GNAS complex locus
  Uniprot ID: Q5JWF2
  ENSP ID: ENSP00000360143
MGVRNCLYGNNMSGQRDIPPEIGEQPEQPPLEAPGAAAPGAGPSPAEEMETEPPHNEPIPVENDGEACGPPEVSRPNFQVLNPAFREAGAHGSYSPPPEEAMPFEAEQPSLGGFWPTLEQPGFPSGVHAGLEAFGPALMEPGAFSGARPGLGGYSPPPEEAMPFEFDQPAQRGCSQLLLQVPDLAPGGPGAAGVPGAPPEEPQALRPAKAGSRGGYSPPPEETMPFELDGEGFGDDSPPPGLSRVIAQVDGSSQFAAVAASSAVRLTPAANAPPLWVPGAIGSPSQEAVRPPSNFTGSSPWMEISGPPFEIGSAPAGVDDTPVNMDSPPIALDGPPIKVSGAPDKRERAERPPVEEEAAEMEGAADAAEGGKVPSPGYGSPAAGAASADTAARAAPAAPADPDSGATPEDPDSGTAPADPDSGAFAADPDSGAAPAAPADPDSGAAPDAPADPDSGAAPDAPADPDAGAAPEAPAAPAAAETRAAHVAPAAPDAGAPTAPAASATRAAQVRRAASAAPASGARRKIHLRPPSPEIQAADPPTPRPTRASAWRGKSESSRGRRVYYDEGVASSDDDSSGDESDDGTSGCLRWFQHRRNRRRRKPQRNLLRNFLVQAFGGCFGRSESPQPKASRSLKVKKVPLAEKRRQMRKEALEKRAQKRAEKKRSKLIDKQLQDEKMGYMCTHRLLLLGAGESGKSTIVKQMRILHVNGFNGDSEKATKVQDIKNNLKEAIETIVAAMSNLVPPVELANPENQFRVDYILSVMNVPDFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 35853 - protein, 166 aa, Homo sapiens
  Payload ID: 7087
  Gene Symbol: GNAS
  Gene Name: GNAS complex locus
  ENSP ID: ENSP00000392000
PESESDHEHEEADLELSLPECLEYEEEFDYETESETESEIESETDFETEPETAPTTEPETEPEDDRGPVVPKHSTFGQSLTQRLHALKLRSPDASPSRAPPSTQEPQSPREGEELKPEDKDPRDPEESKEPKEEKQRRRCKPKKPTRRDASPESPSKKGPIPIRRH

SEQ ID NO: 35854 - protein, 93 aa, Homo sapiens
  Payload ID: 7087
  Gene Symbol: GNAS
  Gene Name: GNAS complex locus
  ENSP ID: ENSP00000412356
  MOD_RES (1)..(1): Any amino acid
XVPLAEKRRQMRKEALEKRAQKRAEKKRSKLIDKQLQDEKMGYMCTHRLLLLGAGESGKSTIVKQMRILHVNGFNGEGGEEDPQAARSNSDGI

SEQ ID NO: 35855 - protein, 199 aa, Homo sapiens
  Payload ID: 7087
  Gene Symbol: GNAS
  Gene Name: GNAS complex locus
  ENSP ID: ENSP00000412424
  MOD_RES (1)..(1): Any amino acid
XAFGGCFGRSESPQPKASRSLKVKKVPLAEKRRQMRKEALEKRAQKRAEKKRSKLIDKQLQDEKMGYMCTHRLLLLGAGESGKSTIVKQMRILHVNGFNGDEKATKVQDIKNNLKEAIETIVAAMSNLVPPVELANPENQFRVDYILSVMNVPDFDFPPEFYEHAKALWEDEGVRACYERSNEYQLIDCAQYFLDKIDV

SEQ ID NO: 35856 - protein, 113 aa, Homo sapiens
  Payload ID: 7087
  Gene Symbol: GNAS
  Gene Name: GNAS complex locus
  ENSP ID: ENSP00000416234
  MOD_RES (1)..(1): Any amino acid
XTTEPETEPEDDRGPVVPKHSTFGQSLTQRLHALKLRSPDASPSRAPPSTQEPQSPREGEELKPEDKDPRDPEESKEPKEEKQRRRCKPKKPTRRDASPESPSKKGPIPIRRH

SEQ ID NO: 35857 - protein, 160 aa, Homo sapiens
  Payload ID: 7087
  Gene Symbol: GNAS
  Gene Name: GNAS complex locus
  ENSP ID: ENSP00000474219
MRILHVNGFNGEGGEEDPQAARSNSDGEKATKVQDIKNNLKEAIETIVAAMSNLVPPVELANPENQFRVDYILSVMNVPDFDFPPEFYEHAKALWEDEGVRACYERSNEYQLIDCAQYFLDKIDVIKQADYVPSDQDLLRCRVLTSGIFETKFQVDKVNF

SEQ ID NO: 35858 - protein, 120 aa, Homo sapiens
  Payload ID: 7087
  Gene Symbol: GNAS
  Gene Name: GNAS complex locus
  ENSP ID: ENSP00000474802
MRILHVNGFNGEGGEEDPQAARSNSDGEKATKVQDIKNNLKEAIETIVAAMSNLVPPVELANPENQFRVDYILSVMNVPDFDFPPEFYEHAKALWEDEGVRACYERSNEYQLIDCAQYFL

SEQ ID NO: 35859 - protein, 75 aa, Homo sapiens
  Payload ID: 7088
  Gene Symbol:
  Gene Name: GNG4
  ENSP ID: ENSP00000489027
MKEGMSNNSTTSISQARKAVEQLKMEACMDRVKVSQAAADLLAYCEAHVREDPLIIPVPASENPFREKKFFCTIL

SEQ ID NO: 35860 - protein, 75 aa, Homo sapiens; identical to SEQ ID NO: 35859
  Payload ID: 7088
  Gene Symbol:
  Gene Name: GNG4
  ENSP ID: ENSP00000489194

SEQ ID NO: 35861 - protein, 75 aa, Homo sapiens; identical to SEQ ID NO: 35859
  Payload ID: 7088
  Gene Symbol:
  Gene Name: GNG4
  ENSP ID: ENSP00000489228

SEQ ID NO: 35862 - protein, 75 aa, Homo sapiens; identical to SEQ ID NO: 35859
  Payload ID: 7088
  Gene Symbol:
  Gene Name: GNG4
  ENSP ID: ENSP00000489307

SEQ ID NO: 35863 - protein, 75 aa, Homo sapiens; identical to SEQ ID NO: 35859
  Payload ID: 7088
  Gene Symbol:
  Gene Name: GNG4
  ENSP ID: ENSP00000489454

SEQ ID NO: 35864 - protein, 1859 aa, Homo sapiens
  Payload ID: 7089
  Gene Symbol: GBF1
  Gene Name: golgi brefeldin A resistant guanine nucleotide exchange factor 1
  Uniprot ID: Q92538
  ENSP ID: ENSP00000359000
MVDKNIYIIQGEINIVVGAIKRNARWSTHTPLDEERDPLLHSFGHLKEVLNSITELSEIEPNVFLRPFLEVIRSEDTTGPITGLALTSVNKFLSYALIDPTHEGTAEGMENMADAVTHARFVGTDPASDEVVLMKILQVLRTLLLTPVGAHLTNESVCEIMQSCFRICFEMRLSELLRKSAEHTLVDMVQLLFTRLPQFKEEPKNYVGTNMKKLKMRAGGMSDSSKWKKQKRSPRPPRHMTKVTPGSELPTPNGTTLSSNLTGGMPFIDVPTPISSASSEAASAVVSPSTDSGLEFSSQTTSKEDLTDLEQPGSPGYSTATEPGSSELGVPEQPDLQEGTHVEKSQSASVESIPEVLEECTSPADHSDSASVHDMDYVNPRGVRFTQSSQKEGTALVPYGLPCIRELFRFLISLTNPHDRHNSEVMIHMGLHLLTVALESAPVAQCQTLLGLIKDEMCRHLFQLLSIERLNLYAASLRVCFLLFESMREHLKFQMEMYIKKLMEIITVENPKMPYEMKEMALEAIVQLWRIPSFVTELYINYDCDYYCSNLFEELTKLLSKNAFPVSGQLYTTHLLSLDALLTVIDSTEAHCQAKVLNSLTQQEKKETARPSCEIVDGTREASNTERTASDGKAVGMASDIPGLHLPGGGRLPPEHGKSGCSDLEEAVDSGADKKFARKPPRFSCLLPDPRELIEIKNKKKLLITGTEQFNQKPKKGIQFLQEKGLLTIPMDNTEVAQWLRENPRLDKKMIGEFVSDRKNIDLLESFVSTFSFQGLRLDEALRLYLEAFRLPGEAPVIQRLLEAFTERWMNCNGSPFANSDACFSLAYAVIMLNTDQHNHNVRKQNAPMTLEEFRKNLKGVNGGKDFEQDILEDMYHAIKNEEIVMPEEQTGLVRENYVWNVLLHRGATPEGIFLRVPTASYDLDLFTMTWGPTIAALSYVFDKSLEETIIQKAISGFRKCAMISAHYGLSDVFDNLIISLCKFTALSSESIENLPSVFGSNPKAHIAAKTVFHLAHRHGDILREGWKNIMEAMLQLFRAQLLPKAMIEVEDFVDPNGKISLQREETPSNRGESTVLSFVSWLTLSGPEQSSVRGPSTENQEAKRVALECIKQCDPEKMITESKFLQLESLQELMKALVSVTPDEETYDEEDAAFCLEMLLRIVLENRDRVGCVWQTVRDHLYHLCVQAQDFCFLVERAVVGLLRLAIRLLRREEISAQVLLSLRILLLMKPSVLSRVSHQVAYGLHELLKTNAANIHSGDDWATLFTLLECIGSGVKPPAALQATARADAPDAGAQSDSELPSYHQNDVSLDRGYTSDSEVYTDHGRPGKIHRSATDADVVNSGWLVVGKDDVDNSKPGPSRPGPSPLINQYSLTVGLDLGPHDTKSLLKCVESLSFIVRDAAHITPDNFELCVKTLRIFVEASLNGGCKSQEKRGKSHKYDSKGNRFKKKSKEGSMLRRPRTSSQHASRGGQSDDDEDEGVPASYHTVSLQVSQDLLDLMHTLHTRAASIYSSWAEEQRHLETGGQKIEADSRTLWAHCWCPLLQGIACLCCDARRQVRMQALTYLQRALLVHDLQKLDALEWESCFNKVLFPLLTKLLENISPADVGGMEETRMRASTLLSKVFLQHLSPLLSLSTFAALWLTILDFMDKYMHAGSSDLLSEAIPESLKNMLLVMDTAEIFHSADARGGGPSALWEITWERIDCFLPHLRDELFKQTVIQDPMPMEPQGQKPLASAHLTSAAGDTRTPGHPPPPEIPSELGACDFEKPESPRAASSSSPGSPVASSPSRLSPTPDGPPPLAQPPLILQPLASPLQVGVPPMTLPIILNPALIEATSPVPLLATPRPTDPIPTSEVN

SEQ ID NO: 35865 - protein, 1203 aa, Homo sapiens
  Payload ID: 7090
  Gene Symbol: GLG1
  Gene Name: golgi glycoprotein 1
  Uniprot ID: Q92896
  ENSP ID: ENSP00000205061
MAACGRVRRMFRLSAALHLLLLFAAGAEKLPGQGVHSQGQGPGANFVSFVGQAGGGGPAGQQLPQLPQSSQLQQQQQQQQQQQQPQPPQPPFPAGGPPARRGGAGAGGGWKLAEEESCREDVTRVCPKHTWSNNLAVLECLQDVREPENEISSDCNHLLWNYKLNLTTDPKFESVAREVCKSTITEIKECADEPVGKGYMVSCLVDHRGNITEYQCHQYITKMTAIIFSDYRLICGFMDDCKNDINILKCGSIRLGEKDAHSQGEVVSCLEKGLVKEAEEREPKIQVSELCKKAILRVAELSSDDFHLDRHLYFACRDDRERFCENTQAGEGRVYKCLFNHKFEESMSEKCREALTTRQKLIAQDYKVSYSLAKSCKSDLKKYRCNVENLPRSREARLSYLLMCLESAVHRGRQVSSECQGEMLDYRRMLMEDFSLSPEIILSCRGEIEHHCSGLHRKGRTLHCLMKVVRGEKGNLGMNCQQALQTLIQETDPGADYRIDRALNEACESVIQTACKHIRSGDPMILSCLMEHLYTEKMVEDCEHRLLELQYFISRDWKLDPVLYRKCQGDASRLCHTHGWNETSEFMPQGAVFSCLYRHAYRTEEQGRRLSRECRAEVQRILHQRAMDVKLDPALQDKCLIDLGKWCSEKTETGQELECLQDHLDDLVVECRDIVGNLTELESEDIQIEALLMRACEPIIQNFCHDVADNQIDSGDLMECLIQNKHQKDMNEKCAIGVTHFQLVQMKDFRFSYKFKMACKEDVLKLCPNIKKKVDVVICLSTTVRNDTLQEAKEHRVSLKCRRQLRVEELEMTEDIRLEPDLYEACKSDIKNFCSAVQYGNAQIIECLKENKKQLSTRCHQKVFKLQETEMMDPELDYTLMRVCKQMIKRFCPEADSKTMLQCLKQNKNSELMDPKCKQMITKRQITQNTDYRLNPMLRKACKADIPKFCHGILTKAKDDSELEGQVISCLKLRYADQRLSSDCEDQIRIIIQESALDYRLDPQLQLHCSDEISSLCAEEAAAQEQTGQVEECLKVNLLKIKTELCKKEVLNMLKESKADIFVDPVLHTACALDIKHHCAAITPGRGRQMSCLMEALEDKRVRLQPECKKRLNDRIEMWSYAAKVAPADGFSDLAMQVMTSPSKNYILSVISGSICILFLIGLMCGRITKRVTRELKDRLQYRSETMAYKGLVWSQDVTGSPA

SEQ ID NO: 35866 - protein, 1179 aa, Homo sapiens
  Payload ID: 7090
  Gene Symbol: GLG1
  Gene Name: golgi glycoprotein 1
  Uniprot ID: Q92896
  ENSP ID: ENSP00000405984
MAACGRVRRMFRLSAALHLLLLFAAGAEKLPGQGVHSQGQGPGANFVSFVGQAGGGGPAGQQLPQLPQSSQLQQQQQQQQQQQQPQPPQPPFPAGGPPARRGGAGAGGGWKLAEEESCREDVTRVCPKHTWSNNLAVLECLQDVREPENEISSDCNHLLWNYKLNLTTDPKFESVAREVCKSTITEIKECADEPVGKGYMVSCLVDHRGNITEYQCHQYITKMTAIIFSDYRLICGFMDDCKNDINILKCGSIRLGEKDAHSQGEVVSCLEKGLVKEAEEREPKIQVSELCKKAILRVAELSSDDFHLDRHLYFACRDDRERFCENTQAGEGRVYKCLFNHKFEESMSEKCREALTTRQKLIAQDYKVSYSLAKSCKSDLKKYRCNVENLPRSREARLSYLLMCLESAVHRGRQVSSECQGEMLDYRRMLMEDFSLSPEIILSCRGEIEHHCSGLHRKGRTLHCLMKVVRGEKGNLGMNCQQALQTLIQETDPGADYRIDRALNEACESVIQTACKHIRSGDPMILSCLMEHLYTEKMVEDCEHRLLELQYFISRDWKLDPVLYRKCQGDASRLCHTHGWNETSEFMPQGAVFSCLYRHAYRTEEQGRRLSRECRAEVQRILHQRAMDVKLDPALQDKCLIDLGKWCSEKTETGQELECLQDHLDDLVVECRDIVGNLTELESEDIQIEALLMRACEPIIQNFCHDVADNQIDSGDLMECLIQNKHQKDMNEKCAIGVTHFQLVQMKDFRFSYKFKMACKEDVLKLCPNIKKKVDVVICLSTTVRNDTLQEAKEHRVSLKCRRQLRVEELEMTEDIRLEPDLYEACKSDIKNFCSAVQYGNAQIIECLKENKKQLSTRCHQKVFKLQETEMMDPELDYTLMRVCKQMIKRFCPEADSKTMLQCLKQNKNSELMDPKCKQMITKRQITQNTDYRLNPMLRKACKADIPKFCHGILTKAKDDSELEGQVISCLKLRYADQRLSSDCEDQIRIIIQESALDYRLDPQLQLHCSDEISSLCAEEAAAQEQTGQVEECLKVNLLKIKTELCKKEVLNMLKESKADIFVDPVLHTACALDIKHHCAAITPGRGRQMSCLMEALEDKRVRLQPECKKRLNDRIEMWSYAAKVAPADGFSDLAMQVMTSPSKNYILSVISGSICILFLIGLMCGRITKRVTRELKDR

SEQ ID NO: 35867 - protein, 1192 aa, Homo sapiens
  Payload ID: 7090
  Gene Symbol: GLG1
  Gene Name: golgi glycoprotein 1
  Uniprot ID: Q92896
  ENSP ID: ENSP00000406946
MAACGRVRRMFRLSAALHLLLLFAAGAEKLPGQGVHSQGQGPGANFVSFVGQAGGGGPAGQQLPQLPQSSQLQQQQQQQQQQQQPQPPQPPFPAGGPPARRGGAGAGGGWKLAEEESCREDVTRVCPKHTWSNNLAVLECLQDVRELLWNYKLNLTTDPKFESVAREVCKSTITEIKECADEPVGKGYMVSCLVDHRGNITEYQCHQYITKMTAIIFSDYRLICGFMDDCKNDINILKCGSIRLGEKDAHSQGEVVSCLEKGLVKEAEEREPKIQVSELCKKAILRVAELSSDDFHLDRHLYFACRDDRERFCENTQAGEGRVYKCLFNHKFEESMSEKCREALTTRQKLIAQDYKVSYSLAKSCKSDLKKYRCNVENLPRSREARLSYLLMCLESAVHRGRQVSSECQGEMLDYRRMLMEDFSLSPEIILSCRGEIEHHCSGLHRKGRTLHCLMKVVRGEKGNLGMNCQQALQTLIQETDPGADYRIDRALNEACESVIQTACKHIRSGDPMILSCLMEHLYTEKMVEDCEHRLLELQYFISRDWKLDPVLYRKCQGDASRLCHTHGWNETSEFMPQGAVFSCLYRHAYRTEEQGRRLSRECRAEVQRILHQRAMDVKLDPALQDKCLIDLGKWCSEKTETGQELECLQDHLDDLVVECRDIVGNLTELESEDIQIEALLMRACEPIIQNFCHDVADNQIDSGDLMECLIQNKHQKDMNEKCAIGVTHFQLVQMKDFRFSYKFKMACKEDVLKLCPNIKKKVDVVICLSTTVRNDTLQEAKEHRVSLKCRRQLRVEELEMTEDIRLEPDLYEACKSDIKNFCSAVQYGNAQIIECLKENKKQLSTRCHQKVFKLQETEMMDPELDYTLMRVCKQMIKRFCPEADSKTMLQCLKQNKNSELMDPKCKQMITKRQITQNTDYRLNPMLRKACKADIPKFCHGILTKAKDDSELEGQVISCLKLRYADQRLSSDCEDQIRIIIQESALDYRLDPQLQLHCSDEISSLCAEEAAAQEQTGQVEECLKVNLLKIKTELCKKEVLNMLKESKADIFVDPVLHTACALDIKHHCAAITPGRGRQMSCLMEALEDKRVRLQPECKKRLNDRIEMWSYAAKVAPADGFSDLAMQVMTSPSKNYILSVISGSICILFLIGLMCGRITKRVTRELKDRLQYRSETMAYKGLVWSQDVTGSPA

SEQ ID NO: 35868 - protein, 698 aa, Homo sapiens
  Payload ID: 7090
  Gene Symbol: GLG1
  Gene Name: golgi glycoprotein 1
  ENSP ID: ENSP00000454218
MAACGRVRRMFRLSAALHLLLLFAAGAEKLPGQGVHSQGQGPGANFVSFVGQAGGGGPAGQQLPQLPQSSQLQQQQQQQQQQQQPQPPQPPFPAGGPPARRGGAGAGGGWKLAEEESCREDVTRVCPKHTWSNNLAVLECLQDVREPENEISSDCNHLLWNYKLNLTTDPKFESVAREVCKSTITEIKECADEPVGKGYMVSCLVDHRGNITEYQCHQYITKMTAIIFSDYRLICGFMDDCKNDINILKCGSIRLGEKDAHSQGEVVSCLEKGLVKEAEEREPKIQVSELCKKAILRVAELSSDDFHLDRHLYFACRDDRERFCENTQAGEGRVYKCLFNHKFEESMSEKCREALTTRQKLIAQDYKVSYSLAKSCKSDLKKYRCNVENLPRSREARLSYLLMCLESAVHRGRQVSSECQGEMLDYRRMLMEDFSLSPEIILSCRGEIEHHCSGLHRKGRTLHCLMKVVRGEKGNLGMNCQQALQTLIQETDPGADYRIDRALNEACESVIQTACKHIRSGDPMILSCLMEHLYTEKMVEDCEHRLLELQYFISRDWKLDPVLYRKCQGDASRLCHTHGWNETSEFMPQGAVFSCLYRHAYRTEEQGRRLSRECRAEVQRILHQRAMDVKLDPALQDKCLIDLGKWCSEKTETGQELECLQDHLDDLVVECRDIVGNLTELESEAEREYVFKNLPFKV

SEQ ID NO: 35869 - protein, 74 aa, Homo sapiens
  Payload ID: 7090
  Gene Symbol: GLG1
  Gene Name: golgi glycoprotein 1
  ENSP ID: ENSP00000455927
MVSCLVDHRGNITEYQCHQYITKMTAIIFSDYRLICGFMDDCKNDINILKCGSIRLGEKDAHSQGEVVSCLEKG

SEQ ID NO: 35870 - protein, 305 aa, Homo sapiens
  Payload ID: 7090
  Gene Symbol: GLG1
  Gene Name: golgi glycoprotein 1
  ENSP ID: ENSP00000455950
MAACGRVRRMFRLSAALHLLLLFAAGAEKLPGQGVHSQGQGPGANFVSFVGQAGGGGPAGQQLPQLPQSSQLQQQQQQQQQQQQPQPPQPPFPAGGPPARRGGAGAGGGWKLAEEESCREDVTRVCPKHTWSNNLAVLECLQDVREPENEISSDCNHLLWNYKLNLTTDPKFESVAREVCKSTITEIKECADEPVGKGYMVSCLVDHRGNITEYQCHQYITKMTAIIFSDYRLICGFMDDCKNDINILKCGSIRLGEKDAHSQDTPTALRNREGGSHGSAELKSKGSYTSVPWMSSWILPSRISA

SEQ ID NO: 35871 - protein, 152 aa, Homo sapiens
  Payload ID: 7090
  Gene Symbol: GLG1
  Gene Name: golgi glycoprotein 1
  ENSP ID: ENSP00000456195
MAACGRVRRMFRLSAALHLLLLFAAGAEKLPGQGVHSQGQGPGANFVSFVGQPPFPAGGPPARRGGAGAGGGWKLAEEESCREDVTRVCPKHTWSNNLAVLECLQDVREPENEISSDCNHLLWNYKLNLTTDPKFESVAREVCKSTITEIKE

SEQ ID NO: 35872 - protein, 698 aa, Homo sapiens; identical to SEQ ID NO: 35868
  Payload ID: 7090
  Gene Symbol: GLG1
  Gene Name: golgi glycoprotein 1
  ENSP ID: ENSP00000487234

SEQ ID NO: 35873 - protein, 668 aa, Homo sapiens
  Payload ID: 7091
  Gene Symbol: GOLIM4
  Gene Name: golgi integral membrane protein 4
  ENSP ID: ENSP00000309893
MGNGMCSRKQKRIFQTLLLLTVVFGFLYGAMLYYELQTQLRKAEAVALKYQQHQESLSAQLQVVYEHRSRLEKSLQKERLEHKKAKEDFLVYKLEAQETLNKGRQDSNSRYSALNVQHQMLKSQHEELKKQHSDLEEEHRKQGEDFSRTFNDHKQKYLQLQQEKEQELSKLKETVYNLREENRQLRKAHQDIHTQLQDVKTQVAEYKQLKDTLNRIPSLRKPDPAEQQNVTQVAHSPQGYNTAREKPTREVQEVSRNNDVWQNHEAVPGRAEDTKLYAPTHKEAEFQAPPEPIQQEVERREPEEHQVEEEHRKALEEEEMEQVGQAEHLEEEHDPSPEEQDREWKEQHEQREAANLLEGHARAEVYPSAKPMIKFQSPYEEQLEQQRLAVQQVEEAQQLREHQEALHQQRLQGHLLRQQEQQQQQVAREMALQRQAELEEGRPQHQEQLRQQAHYDAMDNDIVQGAEDQGIQGEEGAYERDNQHQDEAEGDPGNRHEPREQGPREADPESEADRAAVEDINPADDPNNQGEDEFEEAEQVREENLPDENEEQKQSNQKQENTEVEEHLVMAGNPDQQEDNVDEQYQEEAEEEVQEDLTEEKKRELEHNAEETYGENDENTDDKNNDGEEQEVRDDNRPKGREEHYEEEEEEEEDGAAVAEKSHRRAEM

SEQ ID NO: 35874 - protein, 696 aa, Homo sapiens
  Payload ID: 7091
  Gene Symbol: GOLIM4
  Gene Name: golgi integral membrane protein 4
  Uniprot ID: O00461
  ENSP ID: ENSP00000417354
MGNGMCSRKQKRIFQTLLLLTVVFGFLYGAMLYYELQTQLRKAEAVALKYQQHQESLSAQLQVVYEHRSRLEKSLQKERLEHKKAKEDFLVYKLEAQETLNKGRQDSNSRYSALNVQHQMLKSQHEELKKQHSDLEEEHRKQGEDFSRTFNDHKQKYLQLQQEKEQELSKLKETVYNLREENRQLRKAHQDIHTQLQDVKQQHKNLLSEHEQLVVTLEDHKSALAAAQTQVAEYKQLKDTLNRIPSLRKPDPAEQQNVTQVAHSPQGYNTAREKPTREVQEVSRNNDVWQNHEAVPGRAEDTKLYAPTHKEAEFQAPPEPIQQEVERREPEEHQVEEEHRKALEEEEMEQVGQAEHLEEEHDPSPEEQDREWKEQHEQREAANLLEGHARAEVYPSAKPMIKFQSPYEEQLEQQRLAVQQVEEAQQLREHQEALHQQRLQGHLLRQQEQQQQQVAREMALQRQAELEEGRPQHQEQLRQQAHYDAMDNDIVQGAEDQGIQGEEGAYERDNQHQDEAEGDPGNRHEPREQGPREADPESEADRAAVEDINPADDPNNQGEDEFEEAEQVREENLPDENEEQKQSNQKQENTEVEEHLVMAGNPDQQEDNVDEQYQEEAEEEVQEDLTEEKKRELEHNAEETYGENDENTDDKNNDGEEQEVRDDNRPKGREEHYEEEEEEEEDGAAVAEKSHRRAEM

SEQ ID NO: 35875 - protein, 401 aa, Homo sapiens
  Payload ID: 7092
  Gene Symbol: GOLM1
  Gene Name: golgi membrane protein 1
  Uniprot ID: Q8NBJ4
  ENSP ID: ENSP00000373363
MMGLGNGRRSMKSPPLVLAALVACIIVLGFNYWIASSRSVDLQTRIMELEGRVRRAAAERGAVELKKNEFQGELEKQREQLDKIQSSHNFQLESVNKLYQDEKAVLVNNITTGERLIRVLQDQLKTLQRNYGRLQQDVLQFQKNQTNLERKFSYDLSQCINQMKEVKEQCEERIEEVTKKGNEAVASRDLSENNDQRQQLQALSEPQPRLQAAGLPHTEVPQGKGNVLGNSKSQTPAPSSEVVLDSKRQVEKEETNEIQVVNEEPQRDRLPQEPGREQVVEDRPVGGRGFGGAGELGQTPQVQAALSVSQENPEMEGPERDQLVIPDGQEEEQEAAGEGRNQQKLRGEDDYNMDENEAESETDKQAALAGNDRNIDVFNVEDQKRDTINLLDQREKRNHTL

SEQ ID NO: 35876 - protein, 401 aa, Homo sapiens; identical to SEQ ID NO: 35875
  Payload ID: 7092
  Gene Symbol: GOLM1
  Gene Name: golgi membrane protein 1
  Uniprot ID: Q8NBJ4
  ENSP ID: ENSP00000373364

SEQ ID NO: 35877 - protein, 105 aa, Homo sapiens
  Payload ID: 7092
  Gene Symbol: GOLM1
  Gene Name: golgi membrane protein 1
  ENSP ID: ENSP00000417504
MMGLGNGRRSMKSPPLVLAALVACIIVLGFNYWIASSRSVDLQTRIMELEGRVRRAAAERGAVELKKNEFQGELEKQREQLDKIQSSHNFQLESVNKLYQDEKTS

SEQ ID NO: 35878 - protein, 80 aa, Homo sapiens
  Payload ID: 7092
  Gene Symbol: GOLM1
  Gene Name: golgi membrane protein 1
  ENSP ID: ENSP00000418155
MMGLGNGRRSMKSPPLVLAALVACIIVLGFNYWIASSRSVDLQTRIMELEGRVRRAAAERGAVELKKNEFQGELEKQREQ

SEQ ID NO: 35879 - protein, 121 aa, Homo sapiens
  Payload ID: 7092
  Gene Symbol: GOLM1
  Gene Name: golgi membrane protein 1
  ENSP ID: ENSP00000419076
MMGLGNGRRSMKSPPLVLAALVACIIVLGFNYWIASSRSVDLQTRIMELEGRVRRAAAERGAVELKKNEFQGELEKQREQLDKIQSSHNFQLESVNKLYQDEKAVLVNNITTGERLIRVLQ

SEQ ID NO: 35880 - protein, 298 aa, Homo sapiens
  Payload ID: 7093
  Gene Symbol: GOLPH3
  Gene Name: golgi phosphoprotein 3 (coat-protein)
  Uniprot ID: Q9H4A6
  ENSP ID: ENSP00000265070
MTSLTQRSSGLVQRRTEASRNAADKERAAGGGAGSSEDDAQSRRDEQDDDDKGDSKETRLTLMEEVLLLGLKDREGYTSFWNDCISSGLRGCMLIELALRGRLQLEACGMRRKSLLTRKVICKSDAPTGDVLLDEALKHVKETQPPETVQNWIELLSGETWNPLKLHYQLRNVRERLAKNLVEKGVLTTEKQNFLLFDMTTHPLTNNNIKQRLIKKVQEAVLDKWVNDPHRMDRRLLALIYLAHASDVLENAFAPLLDEQYDLATKRVRQLLDLDPEVECLKANTNEVLWAVVAAFTK

SEQ ID NO: 35881 - protein, 93 aa, Homo sapiens
  Payload ID: 7093
  Gene Symbol: GOLPH3
  Gene Name: golgi phosphoprotein 3 (coat-protein)
  ENSP ID: ENSP00000426752
MTSLTQRSSGLVQRRTEASRNAADKERAAGGGAGSSEDDAQSRRDEQDDDDKGDSKETRLTLMEEVLLLGLKDREVRARRAGRGAAARGPGAR

SEQ ID NO: 35882 - protein, 285 aa, Homo sapiens
  Payload ID: 7094
  Gene Symbol: GOLPH3L
  Gene Name: golgi phosphoprotein 3-like
  Uniprot ID: Q9H4A5
  ENSP ID: ENSP00000271732
MTTLTHRARRTEISKNSEKKMESEEDSNWEKSPDNEDSGDSKDIRLTLMEEVLLLGLKDKEGYTSFWNDCISSGLRGGILIELAMRGRIYLEPPTMRKKRLLDRKVLLKSDSPTGDVLLDETLKHIKATEPTETVQTWIELLTGETWNPFKLQYQLRNVRERIAKNLVEKGILTTEKQNFLLFDMTTHPVTNTTEKQRLVKKLQDSVLERWVNDPQRMDKRTLALLVLAHSSDVLENVFSSLTDDKYDVAMNRAKDLVELDPEVEGTKPSATEMIWAVLAAFNKS

SEQ ID NO: 35883 - protein, 269 aa, Homo sapiens
  Payload ID: 7094
  Gene Symbol: GOLPH3L
  Gene Name: golgi phosphoprotein 3-like
  ENSP ID: ENSP00000410476
MTTLTHRARRTEISKNSEKKMESEEDSNWEKSPDNEDSGDSKDIRLTLMEEVLLLGLKDKEANINSWITRWLTPVIPALWGAEGYTSFWNDCISSGLRGGILIELAMRGRIYLEPPTMRKKRLLDRKVLLKSDSPTGDVLLDETLKHIKATEPTETVQTWIELLTGETWNPFKLQYQLRNVRERIAKNLVEKGILTTEKQNFLLFDMTTHPVTNTTEKQRLVKKLQDSVLERWVNDPQRMDKRTLALLVLAHSSDVLENVFSSLTDDKY

SEQ ID NO: 35884 - protein, 440 aa, Homo sapiens
  Payload ID: 7095
  Gene Symbol: GORASP1
  Gene Name: golgi reassembly stacking protein 1, 65kDa
  Uniprot ID: Q9BQQ3
  ENSP ID: ENSP00000313869
MGLGVSAEQPAGGAEGFHLHGVQENSPAQQAGLEPYFDFIITIGHSRLNKENDTLKALLKANVEKPVKLEVFNMKTMRVREVEVVPSNMWGGQGLLGASVRFCSFRRASEQVWHVLDVEPSSPAALAGLRPYTDYVVGSDQILQESEDFFTLIESHEGKPLKLMVYNSKSDSCREVTVTPNAAWGGEGSLGCGIGYGYLHRIPTQPPSYHKKPPGTPPPSALPLGAPPPDALPPGPTPEDSPSLETGSRQSDYMEALLQAPGSSMEDPLPGPGSPSHSAPDPDGLPHFMETPLQPPPPVQRVMDPGFLDVSGISLLDNSNASVWPSLPSSTELTTTAVSTSGPEDICSSSSSHERGGEATWSGSEFEVSFLDSPGAQAQADHLPQLTLPDSLTSAASPEDGLSAELLEAQAEEEPASTEGLDTGTEAEGLDSQAQISTTE

SEQ ID NO: 35885 - protein, 316 aa, Homo sapiens
  Payload ID: 7095
  Gene Symbol: GORASP1
  Gene Name: golgi reassembly stacking protein 1, 65kDa
  ENSP ID: ENSP00000392020
MGLGVSAEQPAGGAEGFHLHGVQENSPAQQAGLEPYFDFIITIGHSRLNKENDTLKALLKANVEKPVKLEVFNMKTMRVREVEVVPSNMWGGQGLLGASVRFCSFRRASEQVWHVLDVEPSSPAALAGLRPYTDYVVGSDQILQESEDFFTLIESHEGKPLKLMVYNSKSDSCREVTVTPNAAWGGEGSPPATTRSHLAPHHLLLYHLVPHHLMLYHLDPPPRTLLPWRQVPGRVTTWRPCCRHLAPPWRIPFLGLGVPATVLQTLMDFPISWRLLFSPHLQCSELWTQASWTCREFLSWTTAMPVCGPACPLPQN

SEQ ID NO: 35886 - protein, 193 aa, Homo sapiens
  Payload ID: 7095
  Gene Symbol: GORASP1
  Gene Name: golgi reassembly stacking protein 1, 65kDa
  ENSP ID: ENSP00000392993
MHHYQSGRTRALSTHLRSPAAGRSPCWAWEESQPRRGQSRGPGLTEWTQLRGSPSARVLPVVQENSPAQQAGLEPYFDFIITIGHSRLNKENDTLKALLKANVEKPVKLEVFNMKTMRVREVEVVPSNMWGGQGLLGASVRFCSFRRASEQVWHVLDVEPSSPAALAGLRPYTDYVVGSDQILQESEDFFTLI

SEQ ID NO: 35887 - protein, 141 aa, Homo sapiens
  Payload ID: 7095
  Gene Symbol: GORASP1
  Gene Name: golgi reassembly stacking protein 1, 65kDa
  ENSP ID: ENSP00000395241
YFDFIITIGHSRLNKENDTLKALLKANVEKPVKLEVFNMKTMRVREVEVVPSNMWGGQGLLGASVRFCSFRRASEQVWHVLESLATCLQQKQQCSGCSCSQGCGTIFTCCPCRPAPLHRLCGWFGPDSPGVRGLLYAHRVS

SEQ ID NO: 35888 - protein, 285 aa, Homo sapiens
  Payload ID: 7095
  Gene Symbol: GORASP1
  Gene Name: golgi reassembly stacking protein 1, 65kDa
  ENSP ID: ENSP00000395709
MGLGVSAEQPAGGAEGFHLHGDVEPSSPAALAGLRPYTDYVVGSDQILQEPPSYHKKPPGTPPPSALPLGAPPPDALPPGPTPEDSPSLETGSRQSDYMEALLQAPGSSMEDPLPGPGSPSHSAPDPDGLPHFMETPLQPPPPVQRVMDPGFLDVSGISLLDNSNASVWPSLPSSTELTTTAVSTSGPEDICSSSSSHERGGEATWSGSEFEVSFLDSPGAQAQADHLPQLTLPDSLTSAASPEDGLSAELLEAQAEEEPASTEGLDTGTEAEGLDSQAQISTTE

SEQ ID NO: 35889 - protein, 215 aa, Homo sapiens
  Payload ID: 7095
  Gene Symbol: GORASP1
  Gene Name: golgi reassembly stacking protein 1, 65kDa
  Uniprot ID: Q9BQQ3
  ENSP ID: ENSP00000403167
MGLGVSAEQPAGGAEGFHLHGVQENSPAQQAGLEPYFDFIITIGHSRLNKENDTLKALLKANVEKPVKLEVFNMKTMRVREVEVVPSNMWGGQGLLGASVRFCSFRRASEQVWHVLDVEPSSPAALAGLRPYTDYVVGSDQILQESEDFFTLIESHEGKPLKLMVYNSKSDSCRESGMWHWLWVSTPDPNSAPQLPQEATWHPTTFCSTTWCPTT

SEQ ID NO: 35890 - protein, 246 aa, Homo sapiens
  Payload ID: 7095
  Gene Symbol: GORASP1
  Gene Name: golgi reassembly stacking protein 1, 65kDa
  Uniprot ID: Q9BQQ3
  ENSP ID: ENSP00000403552
MKTMRVREVEVVPSNMWGGQGLLGASVRFCSFRRASEQVWHVLDVEPSSPAALAGLRPYTDYVVGSDQILQESEDFFTLIESHEGKPLKLMVYNSKSDSCREVTVTPNAAWGGEGSLGCGIGYGYLHRIPTQPPSYHKKPPGTPPPSALPLGAPPPDALPPGPTPEDSPSLETGSRQSDYMEALLQAPGSSMEDPLPGPGSPSHSAPDPDGLPHFMETPLQPPPPVQRVMDPAMPVCGPACPLPQN

SEQ ID NO: 35891 - protein, 69 aa, Homo sapiens
  Payload ID: 7095
  Gene Symbol: GORASP1
  Gene Name: golgi reassembly stacking protein 1, 65kDa
  ENSP ID: ENSP00000405976
MKTMRVREVEVVPSNMWGGQGLLGASVRFCSFRRASEQVWHVLDVEPSSPAALAGLRPYTDYVVGSDQI

SEQ ID NO: 35892 - protein, 88 aa, Homo sapiens
  Payload ID: 7095
  Gene Symbol: GORASP1
  Gene Name: golgi reassembly stacking protein 1, 65kDa
  ENSP ID: ENSP00000411104
MGLGVSAEQPAGGAEGFHLHGENSPAQQAGLEPYFDFIITIGHSRLNKENDTLKALLKANVEKPVKLEVFNMKTMRVREVEVVPSNMW

SEQ ID NO: 35893 - protein, 345 aa, Homo sapiens
  Payload ID: 7095
  Gene Symbol: GORASP1
  Gene Name: golgi reassembly stacking protein 1, 65kDa
  ENSP ID: ENSP00000419123
MGLGVSAEQPAGGAEGFHLHGDVEPSSPAALAGLRPYTDYVVGSDQILQESEDFFTLIESHEGKPLKLMVYNSKSDSCREVTVTPNAAWGGEGSLGCGIGYGYLHRIPTQPPSYHKKPPGTPPPSALPLGAPPPDALPPGPTPEDSPSLETGSRQSDYMEALLQAPGSSMEDPLPGPGSPSHSAPDPDGLPHFMETPLQPPPPVQRVMDPGFLDVSGISLLDNSNASVWPSLPSSTELTTTAVSTSGPEDICSSSSSHERGGEATWSGSEFEVSFLDSPGAQAQADHLPQLTLPDSLTSAASPEDGLSAELLEAQAEEEPASTEGLDTGTEAEGLDSQAQISTTE

SEQ ID NO: 35894 - protein, 452 aa, Homo sapiens
  Payload ID: 7096
  Gene Symbol: GORASP2
  Gene Name: golgi reassembly stacking protein 2, 55kDa
  Uniprot ID: Q9H8Y8
  ENSP ID: ENSP00000234160
MGSSQSVEIPGGGTEGYHVLRVQENSPGHRAGLEPFFDFIVSINGSRLNKDNDTLKDLLKANVEKPVKMLIYSSKTLELRETSVTPSNLWGGQGLLGVSIRFCSFDGANENVWHVLEVESNSPAALAGLRPHSDYIIGADTVMNESEDLFSLIETHEAKPLKLYVYNTDTDNCREVIITPNSAWGGEGSLGCGIGYGYLHRIPTRPFEEGKKISLPGQMAGTPITPLKDGFTEVQLSSVNPPSLSPPGTTGIEQSLTGLSISSTPPAVSSVLSTGVPTVPLLPPQVNQSLTSVPPMNPATTLPGLMPLPAGLPNLPNLNLNLPAPHIMPGVGLPELVNPGLPPLPSMPPRNLPGIAPLPLPSEFLPSFPLVPESSSAASSGELLSSLPPTSNAPSDPATTTAKADAASSLTVDVTPPTAKAPTTVEDRVGDSTPVSEKPVSAAVDANASESP

SEQ ID NO: 35895 - protein, 73 aa, Homo sapiens
  Payload ID: 7096
  Gene Symbol: GORASP2
  Gene Name: golgi reassembly stacking protein 2, 55kDa
  ENSP ID: ENSP00000398191
MGSSQSVEIPGGGTEGYHVLRLPKLGRARRQRLQSGDCEGSLCAFLGEGSGPAVRRRGLRRQVLNHLGAGRVA

SEQ ID NO: 35896 - protein, 23 aa, Homo sapiens
  Payload ID: 7096
  Gene Symbol: GORASP2
  Gene Name: golgi reassembly stacking protein 2, 55kDa
  ENSP ID: ENSP00000399889
MGSSQSVEIPGGGTEGYHVLRHQ

SEQ ID NO: 35897 - protein, 38 aa, Homo sapiens
  Payload ID: 7096
  Gene Symbol: GORASP2
  Gene Name: golgi reassembly stacking protein 2, 55kDa
  ENSP ID: ENSP00000401808
MGSSQSVEIPGGGTEGYHVLRERDPDPQSGGGACGGRC

SEQ ID NO: 35898 - protein, 32 aa, Homo sapiens
  Payload ID: 7096
  Gene Symbol: GORASP2
  Gene Name: golgi reassembly stacking protein 2, 55kDa
  ENSP ID: ENSP00000413945
MGSSQSVEIPGGGTEGYHVLRVQENSPGHRAE

SEQ ID NO: 35899 - protein, 250 aa, Homo sapiens
  Payload ID: 7097
  Gene Symbol: GOSR1
  Gene Name: golgi SNAP receptor complex member 1
  Uniprot ID: O95249
  ENSP ID: ENSP00000225724
MAAGTSSYWEDLRKQARQLENELDLKLVSFSKLCTSYSHSSTRDGRRDRYSSDTTPLLNGSSQDRMFETMAIEIEQLLARLTGVNDKMAEYTNSAGVPSLNAALMHTLQRHRDILQDYTHEFHKTKANFMAIRERENLMGSVRKDIESYKSGSGVNNRRTELFLKEHDHLRNSDRLIEETISIAMATKENMTSQRGMLKSIHSKMNTLANRFPAVNSLIQRINLRKRRDSLILGGVIGICTILLLLYAFH

SEQ ID NO: 35900 - protein, 174 aa, Homo sapiens
  Payload ID: 7097
  Gene Symbol: GOSR1
  Gene Name: golgi SNAP receptor complex member 1
  ENSP ID: ENSP00000396977
MAAGTSSYWEDLRKQARQLENELDLKLVSFSKLCTSYSHSSTRDGRRDSSDTTPLLNGSSQDRMFETMAIEIEQLLARLTGVNDKMAEYTNSAGVPSLNAALMHTLQRHRDILQDYTHEFHKTKANFMAIRERENLMGSVRKDIESYKSGSGVNNRRTELFLKEHDHLRKGFQW

SEQ ID NO: 35901 - protein, 248 aa, Homo sapiens
  Payload ID: 7097
  Gene Symbol: GOSR1
  Gene Name: golgi SNAP receptor complex member 1
  ENSP ID: ENSP00000414441
MAAGTSSYWEDLRKQARQLENELDLKLVSFSKLCTSYSHSSTRDGRRDSSDTTPLLNGSSQDRMFETMAIEIEQLLARLTGVNDKMAEYTNSAGVPSLNAALMHTLQRHRDILQDYTHEFHKTKANFMAIRERENLMGSVRKDIESYKSGSGVNNRRTELFLKEHDHLRNSDRLIEETISIAMATKENMTSQRGMLKSIHSKMNTLANRFPAVNSLIQRINLRKRRDSLILGGVIGICTILLLLYAFH

SEQ ID NO: 35902 - protein, 255 aa, Homo sapiens
  Payload ID: 7097
  Gene Symbol: GOSR1
  Gene Name: golgi SNAP receptor complex member 1
  ENSP ID: ENSP00000414956
  MOD_RES (1)..(1): Any amino acid
XGPAVTGKVRARRPPDLRKQARQLENELDLKLVSFSKLCTSYSHSSTRDGRRDRYSSDTTPLLNGSSQDRMFETMAIEIEQLLARLTGVNDKMAEYTNSAGVPSLNAALMHTLQRHRDILQDYTHEFHKTKANFMAIRERENLMGSVRKDIESYKSGSGVNNRRTELFLKEHDHLRNSDRLIEETISIAMATKENMTSQRGMLKSIHSKMNTLANRFPAVNSLIQRINLRKRRDSLILGGVIGICTILLLLYAFH

SEQ ID NO: 35903 - protein, 81 aa, Homo sapiens
  Payload ID: 7097
  Gene Symbol: GOSR1
  Gene Name: golgi SNAP receptor complex member 1
  ENSP ID: ENSP00000438330
MAAGTSSYWEDLRKQARQLENELDLKLVSFSKLCTSYSHSSTRDGRRDRYRKNYLENISQEILPQTETGFVELLQPNSPSK

SEQ ID NO: 35904 - protein, 185 aa, Homo sapiens
  Payload ID: 7097
  Gene Symbol: GOSR1
  Gene Name: golgi SNAP receptor complex member 1
  Uniprot ID: O95249
  ENSP ID: ENSP00000462638
MFETMAIEIEQLLARLTGVNDKMAEYTNSAGVPSLNAALMHTLQRHRDILQDYTHEFHKTKANFMAIRERENLMGSVRKDIESYKSGSGVNNRRTELFLKEHDHLRNSDRLIEETISIAMATKENMTSQRGMLKSIHSKMNTLANRFPAVNSLIQRINLRKRRDSLILGGVIGICTILLLLYAFH

SEQ ID NO: 35905 - protein, 236 aa, Homo sapiens
  Payload ID: 7097
  Gene Symbol: GOSR1
  Gene Name: golgi SNAP receptor complex member 1
  ENSP ID: ENSP00000465115
MAAGTSSYWEDLRKQARQLENELDLKLVSFSKLCTSYSHSSTRDGRRDRYSSDTTPLLNGSSQDRMFETMAIEIEQLLARLTGVNDKMAEYTNSAGVPSLNAALMHTLQRHRDILQDYTHEFHKTKANFMAIRERENLMGSVRKDIDGSGVNNRRTELFLKEHDHLRNIAMATKENMTSQRGMLKSIHSKMNTLANRFPAVNSLIQRINLRKRRDSLILGGVIGICTILLLLYAFH

SEQ ID NO: 35906 - protein, 175 aa, Homo sapiens
  Payload ID: 7097
  Gene Symbol: GOSR1
  Gene Name: golgi SNAP receptor complex member 1
  ENSP ID: ENSP00000479971
MAAGTSSYWEDLRKQARQLENELDLKLVSFSKLCTSYSHSSTRDGRRDRYSSDTTPLLNGSSQDRMFETMAIEIEQLLARLTGVNDKMAEYTNSAGVPSLNAALMHTLQRHRDILQVIYWARDVFIITGVWVFFFNPCIGYVHIYLKGQREKSEKINAMLKGLVLLFFGVTIIKF

SEQ ID NO: 35907 - protein, 255 aa, Homo sapiens
  Payload ID: 7097
  Gene Symbol: GOSR1
  Gene Name: golgi SNAP receptor complex member 1
  ENSP ID: ENSP00000482171
MAAGTSSYWEGEARRPPDLRKQARQLENELDLKLVSFSKLCTSYSHSSTRDGRRDSSDTTPLLNGSSQDRMFETMAIEIEQLLARLTGVNDKMAEYTNSAGVPSLNAALMHTLQRHRDILQDYTHEFHKTKANFMAIRERENLMGSVRKDIESYKSGSGVNNRRTELFLKEHDHLRNSDRLIEETISIAMATKENMTSQRGMLKSIHSKMNTLANRFPAVNSLIQRINLRKRRDSLILGGVIGICTILLLLYAFH

SEQ ID NO: 35908 - protein, 213 aa, Homo sapiens
  Payload ID: 7098
  Gene Symbol: GOSR2
  Gene Name: golgi SNAP receptor complex member 2
  Uniprot ID: O14653
  ENSP ID: ENSP00000225567
MDPLFQQTHKQVHEIQSCMGRLETADKQSVHIVENEIQASIDQIFSRLERLEILSSKEPPNKRQNARLRVDQLKYDVQHLQTALRNFQHRRHAREQQERQREELLSRTFTTNDSDTTIPMDESLQFNSSLQKVHNGMDDLILDGHNILDGLRTQRLTLKGTQKKILDIANMLGLSNTVMRLIEKRAFQDKYFMIGTQGSCQTAHFGGRSAGSS

SEQ ID NO: 35909 - protein, 212 aa, Homo sapiens
  Payload ID: 7098
  Gene Symbol: GOSR2
  Gene Name: golgi SNAP receptor complex member 2
  Uniprot ID: O14653
  ENSP ID: ENSP00000377101
MDPLFQQTHKQVHEIQSCMGRLETADKQSVHIVENEIQASIDQIFSRLERLEILSSKEPPNKRQNARLRVDQLKYDVQHLQTALRNFQHRRHAREQQERQREELLSRTFTTNDSDTTIPMDESLQFNSSLQKVHNGMDDLILDGHNILDGLRTQRLTLKGTQKKILDIANMLGLSNTVMRLIEKRAFQDKYFMIGGMLLTCVVMFLVVQYLT

SEQ ID NO: 35910 - protein, 195 aa, Homo sapiens
  Payload ID: 7098
  Gene Symbol: GOSR2
  Gene Name: golgi SNAP receptor complex member 2
  Uniprot ID: O14653
  ENSP ID: ENSP00000394559
MDPLFQQTHKQVHEIQSCMGRLETADKQSVHIVENEIQASIDQIFSRLERLEILSSKEPPNKRQNARLRVDQLKYDVQHLQTALRNFQHRRHAREQQERQREELLSRTFTTNDSDTTIPMDESLQFNSSLQKVHNGMDDLILDGHNILDGLRTQRLTLKVGSLLGDREKASCFSLIQQFSNCVYILITCPQIVIF

SEQ ID NO: 35911 - protein, 199 aa, Homo sapiens
  Payload ID: 7098
  Gene Symbol: GOSR2
  Gene Name: golgi SNAP receptor complex member 2
  ENSP ID: ENSP00000458154
  MOD_RES (1)..(1): Any amino acid
XPLFQQTHKQVHEIQSCMGRLETADKQSVHIENEIQASIDQIFSRLERLEILSSKEPPNKRQNARLRVDQLKYDVQHLQTALRNFQHRRHAREQQERQREELLSRTFTTNDSDTTIPMDESLQFNSSLQKVHNGMDDLILDGHNILDGLRTQRLTLKGTQKKILDIANMLGLSNTVMRLIEKRAFQDKYFMIGGMLLTC

SEQ ID NO: 35912 - protein, 143 aa, Homo sapiens
  Payload ID: 7098
  Gene Symbol: GOSR2
  Gene Name: golgi SNAP receptor complex member 2
  ENSP ID: ENSP00000458911
MDPLFQQTHKQVHEIQSCMGRLETADKQSVHIVENEIQASIDQIFSRLERLEILSSKEPPNKRQNARLRVDQLKYDVQHLQTALRNFQHRRHAREQQERQREELLSRTFTTNVSQARGEGRPALDRSWGLEFRSLSAICFGGV

SEQ ID NO: 35913 - protein, 149 aa, Homo sapiens
  Payload ID: 7098
  Gene Symbol: GOSR2
  Gene Name: golgi SNAP receptor complex member 2
  ENSP ID: ENSP00000460760
MGRLETADKQSVHIVENEIQASIDQIFSRLERLEILSSKEPPNKRQNARLRVDQLKYDVQHLQTALRNFQHRRHAREQQERQREELLSRTFTTNGTQKKILDIANMLGLSNTVMRLIEKRAFQDKYFMIDKEHMFLTRECALFPTHSHH

SEQ ID NO: 35914 - protein, 165 aa, Homo sapiens
  Payload ID: 7098
  Gene Symbol: GOSR2
  Gene Name: golgi SNAP receptor complex member 2
  ENSP ID: ENSP00000461673
MDPLFQQTHKQVHEIQSCMGRLETADKQSVHIVENEIQASIDQIFSRLERLEILSSKEPPNKRQNARLRVDQLKYDVQHLQTALRNFQHRRHAREQQERQREELLSRTFTTNGTQKKILDIANMLGLSNTVMRLIEKRAFQDKYFMIGGMLLTCVVMFLVVQYLT

SEQ ID NO: 35915 - protein, 98 aa, Homo sapiens
  Payload ID: 7098
  Gene Symbol: GOSR2
  Gene Name: golgi SNAP receptor complex member 2
  ENSP ID: ENSP00000461784
GTQKKILDIANMLGLSNTVMRLIEKRAFQDKYFMIETRSHHVAQNGPELLSSRDPPASASRSAGIIGMSHHPDLQIPFELRLGFELWFYQLLAVISDQ

SEQ ID NO: 35916 - protein, 327 aa, Homo sapiens
  Payload ID: 7099
  Gene Symbol: GET4
  Gene Name: golgi to ER traffic protein 4
  Uniprot ID: Q7L5D6
  ENSP ID: ENSP00000265857
MAAAAAMAEQESARNGGRNRGGVQRVEGKLRASVEKGDYYEAHQMYRTLFFRYMSQSKHTEARELMYSGALLFFSHGQQNSAADLSMLVLESLEKAEVEVADELLENLAKVFSLMDPNSPERVTFVSRALKWSSGGSGKLGHPRLHQLLALTLWKEQNYCESRYHFLHSADGEGCANMLVEYSTSRGFRSEVDMFVAQAVLQFLCLKNKSSASVVFTTYTQKHPSIEDGPPFVEPLLNFIWFLLLAVDGGKLTVFTVLCEQYQPSLRRDPMYNEYLDRIGQLFFGVPPKQTSSYGGLLGNLLTSLMGSSEQEDGEESPSDGSPIELD

SEQ ID NO: 35917 - protein, 274 aa, Homo sapiens
  Payload ID: 7099
  Gene Symbol: GET4
  Gene Name: golgi to ER traffic protein 4
  Uniprot ID: Q7L5D6
  ENSP ID: ENSP00000385646
MSQSKHTEARELMYSGALLFFSHGQQNSAADLSMLVLESLEKAEVEVADELLENLAKVFSLMDPNSPERVTFVSRALKWSSGGSGKLGHPRLHQLLALTLWKEQNYCESRYHFLHSADGEGCANMLVEYSTSRGFRSEVDMFVAQAVLQFLCLKNKSSASVVFTTYTQKHPSIEDGPPFVEPLLNFIWFLLLAVDGGKLTVFTVLCEQYQPSLRRDPMYNEYLDRIGQLFFGVPPKQTSSYGGLLGNLLTSLMGSSEQEDGEESPSDGSPIELD

SEQ ID NO: 35918 - protein, 167 aa, Homo sapiens
  Payload ID: 7099
  Gene Symbol: GET4
  Gene Name: golgi to ER traffic protein 4
  ENSP ID: ENSP00000390288
MRFCPWPHWRHREARRVWELVFPECPVPDGSRPPLSQSCPCRTGTRTAGHRVSGPVEAPAVVLGYMSQSKHTEARELMYSGALLFFSHGQQNSAADLSMLVLESLEKAEVEVADELLENLAKVFSLMDPNSPERVTFVSRALKWSSGGSGKLGHPRLHQLLALTLWK

SEQ ID NO: 35919 - protein, 158 aa, Homo sapiens
  Payload ID: 7099
  Gene Symbol: GET4
  Gene Name: golgi to ER traffic protein 4
  ENSP ID: ENSP00000407113
MPRARARYPERPQLFLDSSSPRHLPQPPPRPGRPSFLPRCALGHMALELRWAAQCGGPRLTQGRPAENLAKVFSLMDPNSPERVTFVSRALKWSSGGSGKLGHPRLHQLLALTLWKEQNYCESRYHFLHSADGEGCANMLVEYSTSRGFRSEVDMFVA

SEQ ID NO: 35920 - protein, 148 aa, Homo sapiens
  Payload ID: 7099
  Gene Symbol: GET4
  Gene Name: golgi to ER traffic protein 4
  ENSP ID: ENSP00000414097
MSQSKHTEARELMYSGALLFFSHGQQNSAADLSMLVLESLEKAEVEVADELLENLAKVFSLMDPNSPERVTFVSRALKWSSGGSGKLGHPRLHQLLALTLWKEQNYCESRYHFLHSADGEGCANMLVEYSTSRGFRSEVDMFVAQAVL

SEQ ID NO: 35921 - protein, 132 aa, Homo sapiens
  Payload ID: 7100
  Gene Symbol: GOLT1A
  Gene Name: golgi transport 1A
  Uniprot ID: Q6ZVE7
  ENSP ID: ENSP00000308535
MISITEWQKIGVGITGFGIFFILFGTLLYFDSVLLAFGNLLFLTGLSLIIGLRKTFWFFFQRHKLKGTSFLLGGVVIVLLRWPLLGMFLETYGFFSLFKGFFPVAFGFLGNVCNIPFLGALFRRLQGTSSMV

SEQ ID NO: 35922 - protein, 138 aa, Homo sapiens
  Payload ID: 7101
  Gene Symbol: GOLT1B
  Gene Name: golgi transport 1B
  Uniprot ID: Q9Y3E0
  ENSP ID: ENSP00000229314
MISLTDTQKIGMGLTGFGVFFLFFGMILFFDKALLAIGNVLFVAGLAFVIGLERTFRFFFQKHKMKATGFFLGGVFVVLIGWPLIGMIFEIYGFFLLFRGFFPVVVGFIRRVPVLGSLLNLPGIRSFVDKVGESNNMV

SEQ ID NO: 35923 - protein, 128 aa, Homo sapiens
  Payload ID: 7101
  Gene Symbol: GOLT1B
  Gene Name: golgi transport 1B
  ENSP ID: ENSP00000437351
MISLTDTQKIGMGLTGFGVFFLFFGMILFFDKALLAIGNVLFVAGLAFVIGLERTFRFFFQKHKMKATGFFLGGVFVVLIGWPLIGMIFEIYGFFLLFRGFFPVVVGFIRRVPVLGSLLNLPGIRSTT

SEQ ID NO: 35924 - protein, 42 aa, Homo sapiens
  Payload ID: 7101
  Gene Symbol: GOLT1B
  Gene Name: golgi transport 1B
  ENSP ID: ENSP00000440666
MISLTDTQKIGMGLTGFGVFFLFFGMILFFDKALLAIGNKLL

SEQ ID NO: 35925 - protein, 40 aa, Homo sapiens
  Payload ID: 7101
  Gene Symbol: GOLT1B
  Gene Name: golgi transport 1B
  ENSP ID: ENSP00000441878
MISLTDTQKIGMGLTGFGVFFLFFGMILFFDKALLAIGNE

SEQ ID NO: 35926 - protein, 74 aa, Homo sapiens
  Payload ID: 7101
  Gene Symbol: GOLT1B
  Gene Name: golgi transport 1B
  ENSP ID: ENSP00000446231
MKATGFFLGGVFVVLIGWPLIGMIFEIYGFFLLFRGFFPVVVGFIRRVPVLGSLLNLPGIRSFVDKVGESNNMV

SEQ ID NO: 35927 - protein, 42 aa, Homo sapiens; identical to SEQ ID NO: 35924
  Payload ID: 7101
  Gene Symbol: GOLT1B
  Gene Name: golgi transport 1B
  ENSP ID: ENSP00000446405

SEQ ID NO: 35928 - protein, 42 aa, Homo sapiens; identical to SEQ ID NO: 35924
  Payload ID: 7101
  Gene Symbol: GOLT1B
  Gene Name: golgi transport 1B
  ENSP ID: ENSP00000486919

SEQ ID NO: 35929 - protein, 454 aa, Homo sapiens
  Payload ID: 7102
  Gene Symbol: GOPC
  Gene Name: golgi-associated PDZ and coiled-coil motif containing
  Uniprot ID: Q9HD26
  ENSP ID: ENSP00000052569
MSAGGPCPAAAGGGPGGASCSVGAPGGVSMFRWLEVLEKEFDKAFVDVDLLLGEIDPDQADITYEGRQKMTSLSSCFAQLCHKAQSVSQINHKLEAQLVDLKSELTETQAEKVVLEKEVHDQLLQLHSIQLQLHAKTGQSADSGTIKAKLERELEANKKEKMKEAQLEAEVKLLRKENEALRRHIAVLQAEVYGARLAAKYLDKELAGRVQQIQLLGRDMKGPAHDKLWNQLEAEIHLHRHKTVIRACRGRNDLKRPMQAPPGHDQDSLKKSQGVGPIRKVLLLKEDHEGLGISITGGKEHGVPILISEIHPGQPADRCGGLHVGDAILAVNGVNLRDTKHKEAVTILSQQRGEIEFEVVYVAPEVDSDDENVEYEDESGHRYRLYLDELEGGGNPGASCKDTSGEIKVLQGFNKKAVTDTHENGDLGTASETPLDDGASKLDDLHTLYHKKSY

SEQ ID NO: 35930 - protein, 462 aa, Homo sapiens
  Payload ID: 7102
  Gene Symbol: GOPC
  Gene Name: golgi-associated PDZ and coiled-coil motif containing
  Uniprot ID: Q9HD26
  ENSP ID: ENSP00000357484
MSAGGPCPAAAGGGPGGASCSVGAPGGVSMFRWLEVLEKEFDKAFVDVDLLLGEIDPDQADITYEGRQKMTSLSSCFAQLCHKAQSVSQINHKLEAQLVDLKSELTETQAEKVVLEKEVHDQLLQLHSIQLQLHAKTGQSADSGTIKAKLSGPSVEELERELEANKKEKMKEAQLEAEVKLLRKENEALRRHIAVLQAEVYGARLAAKYLDKELAGRVQQIQLLGRDMKGPAHDKLWNQLEAEIHLHRHKTVIRACRGRNDLKRPMQAPPGHDQDSLKKSQGVGPIRKVLLLKEDHEGLGISITGGKEHGVPILISEIHPGQPADRCGGLHVGDAILAVNGVNLRDTKHKEAVTILSQQRGEIEFEVVYVAPEVDSDDENVEYEDESGHRYRLYLDELEGGGNPGASCKDTSGEIKVLQGFNKKAVTDTHENGDLGTASETPLDDGASKLDDLHTLYHKKSY

SEQ ID NO: 35931 - protein, 407 aa, Homo sapiens
  Payload ID: 7102
  Gene Symbol: GOPC
  Gene Name: golgi-associated PDZ and coiled-coil motif containing
  ENSP ID: ENSP00000445690
MSAGGPCPAAAGGGPGGASCSVGAPGGVSMFRWLEVLEKEFDKAFVDVDLLLGEIDPDQADITYEGRQKMTSLSSCFAQLCHKAQSVSQINHKLEAQLVDLKSELTETQAEKVVLEKEVHDQLLQLHSIQLQLHAKTGQSADSGTIKAKLSGPSVEELERELEANKKEKMKEAQLEAEVKLLRKENEALRRHIAVLQAEVYGARLAAKYLDKELAGRVQQIQLLGRDMKGPAHDKLWNQLEAEIHLHRHKTVIRACRGRNDLKRPMQAPPGHDQDSLKKSQGVGPIRKVLLLKEDHEGLGISITRGEIEFEVVYVAPEVDSDDENVEYEDESGHRYRLYLDELEGGGNPGASCKDTSGEIKVLQGFNKKAVTDTHENGDLGTASETPLDDGASKLDDLHTLYHKKSY

SEQ ID NO: 35932 - protein, 552 aa, Homo sapiens
  Payload ID: 7103
  Gene Symbol: GGA1
  Gene Name: golgi-associated, gamma adaptin ear containing, ARF binding protein 1
  Uniprot ID: Q9UJY5
  ENSP ID: ENSP00000321288
MEPAMEPETLEARINRATNPLNKELDWASINGFCEQLNEDFEGPPLATRLLAHKIQSPQEWEAIQALTVLETCMKSCGKRFHDEVGKFRFLNELIKVVSPKYLGSRTSEKVKNKILELLYSWTVGLPEEVKIAEAYQMLKKQGIVKSDPKLPDDTTFPLPPPRPKNVIFEDEEKSKMLARLLKSSHPEDLRAANKLIKEMVQEDQKRMEKISKRVNAIEEVNNNVKLLTEMVMSHSQGGAAAGSSEDLMKELYQRCERMRPTLFRLASDTEDNDEALGLSDPTPPSGPSLDGTGWNSFQSSDATEPPAPALAQAPSMESRPPAQTSLPASSGLDDLDLLGKTLLQQSLPPESQQVRWEKQQPTPRLTLRDLQNKSSSCSSPSSSATSLLHTVSPEPPRPPQQPVPTELSLASITVPLESIKPSNILPVTVYDQHGFRILFHFARDPLPGRSDVLVVVVSMLSTAPQPIRNIVFQSAVPKVMKVKLQPPSGTELPAFNPIVHPSAITQVLLLANPQKEKVRLRYKLTFTMGDQTYNEMGDVDQFPPPETWGSL

SEQ ID NO: 35933 - protein, 639 aa, Homo sapiens
  Payload ID: 7103
  Gene Symbol: GGA1
  Gene Name: golgi-associated, gamma adaptin ear containing, ARF binding protein 1
  Uniprot ID: Q9UJY5
  ENSP ID: ENSP00000341344
MEPAMEPETLEARINRATNPLNKELDWASINGFCEQLNEDFEGPPLATRLLAHKIQSPQEWEAIQALTVLETCMKSCGKRFHDEVGKFRFLNELIKVVSPKYLGSRTSEKVKNKILELLYSWTVGLPEEVKIAEAYQMLKKQGIVKSDPKLPDDTTFPLPPPRPKNVIFEDEEKSKMLARLLKSSHPEDLRAANKLIKEMVQEDQKRMEKISKRVNAIEEVNNNVKLLTEMVMSHSQGGAAAGSSEDLMKELYQRCERMRPTLFRLASDTEDNDEALAEILQANDNLTQVINLYKQLVRGEEVNGDATAGSIPGSTSALLDLSGLDLPPAGTTYPAMPTRPGEQASPEQPSASVSLLDDELMSLGLSDPTPPSGPSLDGTGWNSFQSSDATEPPAPALAQAPSMESRPPAQTSLPASSGLDDLDLLGKTLLQQSLPPESQQVRWEKQQPTPRLTLRDLQNKSSSCSSPSSSATSLLHTVSPEPPRPPQQPVPTELSLASITVPLESIKPSNILPVTVYDQHGFRILFHFARDPLPGRSDVLVVVVSMLSTAPQPIRNIVFQSAVPKVMKVKLQPPSGTELPAFNPIVHPSAITQVLLLANPQKEKVRLRYKLTFTMGDQTYNEMGDVDQFPPPETWGSL

SEQ ID NO: 35934 - protein, 656 aa, Homo sapiens
  Payload ID: 7103
  Gene Symbol: GGA1
  Gene Name: golgi-associated, gamma adaptin ear containing, ARF binding protein 1
  Uniprot ID: Q9UJY5
  ENSP ID: ENSP00000371175
MEPAMEPETLEARINRATNPLNKELDWASINGFCEQLNEDFEGPPLATRLLAHKIQSPQEWEAIQALTVRRGEATIRPPPCDDTKVLETCMKSCGKRFHDEVGKFRFLNELIKVVSPKYLGSRTSEKVKNKILELLYSWTVGLPEEVKIAEAYQMLKKQGIVKSDPKLPDDTTFPLPPPRPKNVIFEDEEKSKMLARLLKSSHPEDLRAANKLIKEMVQEDQKRMEKISKRVNAIEEVNNNVKLLTEMVMSHSQGGAAAGSSEDLMKELYQRCERMRPTLFRLASDTEDNDEALAEILQANDNLTQVINLYKQLVRGEEVNGDATAGSIPGSTSALLDLSGLDLPPAGTTYPAMPTRPGEQASPEQPSASVSLLDDELMSLGLSDPTPPSGPSLDGTGWNSFQSSDATEPPAPALAQAPSMESRPPAQTSLPASSGLDDLDLLGKTLLQQSLPPESQQVRWEKQQPTPRLTLRDLQNKSSSCSSPSSSATSLLHTVSPEPPRPPQQPVPTELSLASITVPLESIKPSNILPVTVYDQHGFRILFHFARDPLPGRSDVLVVVVSMLSTAPQPIRNIVFQSAVPKVMKVKLQPPSGTELPAFNPIVHPSAITQVLLLANPQKEKVRLRYKLTFTMGDQTYNEMGDVDQFPPPETWGSL

SEQ ID NO: 35935 - protein, 105 aa, Homo sapiens
  Payload ID: 7103
  Gene Symbol: GGA1
  Gene Name: golgi-associated, gamma adaptin ear containing, ARF binding protein 1
  ENSP ID: ENSP00000384030
MEPAMEPETLEARINRATNPLNKELDWASINGFCEQLNEDFEGPPLATRLLAHKIQSPQEWEAIQALTVLETCMKSCGKRFHDEVGKFRFLNELIKVVSPKGTLL

SEQ ID NO: 35936 - protein, 566 aa, Homo sapiens
  Payload ID: 7103
  Gene Symbol: GGA1
  Gene Name: golgi-associated, gamma adaptin ear containing, ARF binding protein 1
  Uniprot ID: Q9UJY5
  ENSP ID: ENSP00000385287
MKSCGKRFHDEVGKFRFLNELIKVVSPKYLGSRTSEKVKNKILELLYSWTVGLPEEVKIAEAYQMLKKQGIVKSDPKLPDDTTFPLPPPRPKNVIFEDEEKSKMLARLLKSSHPEDLRAANKLIKEMVQEDQKRMEKISKRVNAIEEVNNNVKLLTEMVMSHSQGGAAAGSSEDLMKELYQRCERMRPTLFRLASDTEDNDEALAEILQANDNLTQVINLYKQLVRGEEVNGDATAGSIPGSTSALLDLSGLDLPPAGTTYPAMPTRPGEQASPEQPSASVSLLDDELMSLGLSDPTPPSGPSLDGTGWNSFQSSDATEPPAPALAQAPSMESRPPAQTSLPASSGLDDLDLLGKTLLQQSLPPESQQVRWEKQQPTPRLTLRDLQNKSSSCSSPSSSATSLLHTVSPEPPRPPQQPVPTELSLASITVPLESIKPSNILPVTVYDQHGFRILFHFARDPLPGRSDVLVVVVSMLSTAPQPIRNIVFQSAVPKVMKVKLQPPSGTELPAFNPIVHPSAITQVLLLANPQKEKVRLRYKLTFTMGDQTYNEMGDVDQFPPPETWGSL

SEQ ID NO: 35937 - protein, 246 aa, Homo sapiens
  Payload ID: 7103
  Gene Symbol: GGA1
  Gene Name: golgi-associated, gamma adaptin ear containing, ARF binding protein 1
  ENSP ID: ENSP00000390416
MTPGTANRATNPLNKELDWASINGFCEQLNEDFEGPPLATRLLAHKIQSPQEWEAIQALTVLETCMKSCGKRFHDEVGKFRFLNELIKVVSPKYLGSRTSEKVKNKILELLYSWTVGLPEEVKIAEAYQMLKKQGIVKSDPKLPDDTTFPLPPPRPKNVIFEDEEKSKMLARLLKSSHPEDLRAANKLIKEMVQEDQKRMEKISKRVNAIEEVNNNVKLLTEMVMSHSQGGAAAGSSEDLMKELYQ

SEQ ID NO: 35938 - protein, 17 aa, Homo sapiens
  Payload ID: 7103
  Gene Symbol: GGA1
  Gene Name: golgi-associated, gamma adaptin ear containing, ARF binding protein 1
  ENSP ID: ENSP00000395901
MKSCGKRFHDEVGKFRF

SEQ ID NO: 35939 - protein, 40 aa, Homo sapiens
  Payload ID: 7103
  Gene Symbol: GGA1
  Gene Name: golgi-associated, gamma adaptin ear containing, ARF binding protein 1
  ENSP ID: ENSP00000400159
MKSCGKRFHDEVGKFRFLNELIKVVSPKYLGSRTSEKVKN

SEQ ID NO: 35940 - protein, 38 aa, Homo sapiens
  Payload ID: 7103
  Gene Symbol: GGA1
  Gene Name: golgi-associated, gamma adaptin ear containing, ARF binding protein 1
  ENSP ID: ENSP00000402930
MKSCGKRFHDEVGKFRFLNELIKVVSPKYLGSRTSEKV

SEQ ID NO: 35941 - protein, 108 aa, Homo sapiens
  Payload ID: 7103
  Gene Symbol: GGA1
  Gene Name: golgi-associated, gamma adaptin ear containing, ARF binding protein 1
  ENSP ID: ENSP00000403534
MKSCGKRFHDEVGKFRFLNELIKVVSPKYLGSRTSEKVKNKILELLYSWTVGLPEEVKIAEAYQMLKKQGIVKSDPKLPDDTTFPLPPPRPKNVIFEDEEKSKMLARL

SEQ ID NO: 35942 - protein, 59 aa, Homo sapiens
  Payload ID: 7103
  Gene Symbol: GGA1
  Gene Name: golgi-associated, gamma adaptin ear containing, ARF binding protein 1
  ENSP ID: ENSP00000404453
MKSCGKRFHDEVGKFRFLNELIKVVSPKYLGSRTSEKVKNKILELLYSWTVGLPEEVKI

SEQ ID NO: 35943 - protein, 108 aa, Homo sapiens; identical to SEQ ID NO: 35941
  Payload ID: 7103
  Gene Symbol: GGA1
  Gene Name: golgi-associated, gamma adaptin ear containing, ARF binding protein 1
  ENSP ID: ENSP00000411373

SEQ ID NO: 35944 - protein, 28 aa, Homo sapiens
  Payload ID: 7103
  Gene Symbol: GGA1
  Gene Name: golgi-associated, gamma adaptin ear containing, ARF binding protein 1
  ENSP ID: ENSP00000411727
MKSCGKRFHDEVGKFRFLNELIKVVSPK

SEQ ID NO: 35945 - protein, 108 aa, Homo sapiens; identical to SEQ ID NO: 35941
  Payload ID: 7103
  Gene Symbol: GGA1
  Gene Name: golgi-associated, gamma adaptin ear containing, ARF binding protein 1
  ENSP ID: ENSP00000414413

SEQ ID NO: 35946 - protein, 70 aa, Homo sapiens
  Payload ID: 7103
  Gene Symbol: GGA1
  Gene Name: golgi-associated, gamma adaptin ear containing, ARF binding protein 1
  ENSP ID: ENSP00000416153
MKSCGKRFHDEVGKFRFLNELIKVVSPKYLGSRTSEKVKNKILELLYSWTVGLPEEVKIAEAYQMLKKQG

SEQ ID NO: 35947 - protein, 613 aa, Homo sapiens
  Payload ID: 7104
  Gene Symbol: GGA2
  Gene Name: golgi-associated, gamma adaptin ear containing, ARF binding protein 2
  Uniprot ID: Q9UJY4
  ENSP ID: ENSP00000311962
MAATAVAAAVAGTESAQGPPGPAASLELWLNKATDPSMSEQDWSAIQNFCEQVNTDPNGPTHAPWLLAHKIQSPQEKEALYALTVLEMCMNHCGEKFHSEVAKFRFLNELIKVLSPKYLGSWATGKVKGRVIEILFSWTVWFPEDIKIRDAYQMLKKQGIIKQDPKLPVDKILPPPSPWPKSSIFDADEEKSKLLTRLLKSNHPEDLQAANRLIKNLVKEEQEKSEKVSKRVSAVEEVRSHVKVLQEMLSMYRRPGQAPPDQEALQVVYERCEKLRPTLFRLASDTTDDDDALAEILQANDLLTQGVLLYKQVMEGRVTFGNRVTSSLGDIPVSRVFQNPAGCMKTCPLIDLEVDNGPAQMGTVVPSLLHQDLAALGISDAPVTGMVSGQNCCEEKRNPSSSTLPGGGVQNPSADRNLLDLLSAQPAPCPLNYVSQKSVPKEVPPGTKSSPGWSWEAGPLAPSPSSQNTPLAQVFVPLESVKPSSLPPLIVYDRNGFRILLHFSQTGAPGHPEVQVLLLTMMSTAPQPVWDIMFQVAVPKSMRVKLQPASSSKLPAFSPLMPPAVISQMLLLDNPHKEPIRLRYKLTFNQGGQPFSEVGEVKDFPDLAVLGAA

SEQ ID NO: 35948 - protein, 223 aa, Homo sapiens
  Payload ID: 7104
  Gene Symbol: GGA2
  Gene Name: golgi-associated, gamma adaptin ear containing, ARF binding protein 2
  ENSP ID: ENSP00000454455
MAATAVAAAVAGTESAQGPPGPAASLELWLNKATDPSMSEQDWSAIQNFCEQVNTDPNGPTHAPWLLAHKIQSPQEKEALYALTVLEMCMNHCGEKFHSEVAKFRFLNELIKVLSPKYLGSWATGKVKGRVIEILFSWTVWFPEDIKIRDAYQMLKKQGIIKQDPKLPVDKILPPPSPWPKSSIFDADEEKSKLLTRLLKSNHPEDLQAAVLKVAVVYGITPF

SEQ ID NO: 35949 - protein, 59 aa, Homo sapiens
  Payload ID: 7104
  Gene Symbol: GGA2
  Gene Name: golgi-associated, gamma adaptin ear containing, ARF binding protein 2
  ENSP ID: ENSP00000454469
MAATAVAAAVAGTESAQGPPGPAASLELWLNKATDPSMSEQDWSAIQNFCEQVNTDPNG

SEQ ID NO: 35950 - protein, 49 aa, Homo sapiens
  Payload ID: 7104
  Gene Symbol: GGA2
  Gene Name: golgi-associated, gamma adaptin ear containing, ARF binding protein 2
  ENSP ID: ENSP00000455293
MAATAVAAAVAGTESAQGPPGPAASLELWLSDHRPKHVGTGLVSYPEFL

SEQ ID NO: 35951 - protein, 125 aa, Homo sapiens
  Payload ID: 7104
  Gene Symbol: GGA2
  Gene Name: golgi-associated, gamma adaptin ear containing, ARF binding protein 2
  ENSP ID: ENSP00000455331
MVKLPFSLSLQLANSCPSPEDKATDPSMSEQDWSAIQNFCEQVNTDPNGPTHAPWLLAHKIQSPQEKEALYALTVLEMCMNHCGEKFHSEVAKFRFLNELIKVLSPKYLGSWATGKVKGRVIEIL

SEQ ID NO: 35952 - protein, 59 aa, Homo sapiens; identical to SEQ ID NO: 35949
  Payload ID: 7104
  Gene Symbol: GGA2
  Gene Name: golgi-associated, gamma adaptin ear containing, ARF binding protein 2
  ENSP ID: ENSP00000456247

SEQ ID NO: 35953 - protein, 129 aa, Homo sapiens
  Payload ID: 7104
  Gene Symbol: GGA2
  Gene Name: golgi-associated, gamma adaptin ear containing, ARF binding protein 2
  ENSP ID: ENSP00000459414
  MOD_RES (1)..(1): Any amino acid
XAVAGTESAQGPPGPAASLELWLNKATDPSMSEQDWSAIQNFCEQVNTDPNGPTHAPWLLAHKIQSPQEKEALYALTCPHRLEAGLALVPAQSPASDYQPGGEPGTTGFPPSPGGPVSVQVLEMCMNHC

SEQ ID NO: 35954 - protein, 117 aa, Homo sapiens
  Payload ID: 7104
  Gene Symbol: GGA2
  Gene Name: golgi-associated, gamma adaptin ear containing, ARF binding protein 2
  ENSP ID: ENSP00000459560
MAATAVAAAVAGTESAQGPPGPAASLELWLNKATDPSMSEQDWSAIQNFCEQVNTDPNGPTHAPWLLAHKIQSPQEKEALYALTPGGEPGTTGFPPSPGGPVSVQVLEMCMNHCGEK

SEQ ID NO: 35955 - protein, 59 aa, Homo sapiens; identical to SEQ ID NO: 35949
  Payload ID: 7104
  Gene Symbol: GGA2
  Gene Name: golgi-associated, gamma adaptin ear containing, ARF binding protein 2
  ENSP ID: ENSP00000460975

SEQ ID NO: 35956 - protein, 723 aa, Homo sapiens
  Payload ID: 7105
  Gene Symbol: GGA3
  Gene Name: golgi-associated, gamma adaptin ear containing, ARF binding protein 3
  Uniprot ID: Q9NZ52
  ENSP ID: ENSP00000438085
MAEAEGESLESWLNKATNPSNRQEDWEYIIGFCDQINKELEGPQIAVRLLAHKIQSPQEWEALQALTVLEACMKNCGRRFHNEVGKFRFLNELIKVVSPKYLGDRVSEKVKTKVIELLYSWTMALPEEAKIKDAYHMLKRQGIVQSDPPIPVDRTLIPSPPPRPKNPVFDDEEKSKLLAKLLKSKNPDDLQEANKLIKSMVKEDEARIQKVTKRLHTLEEVNNNVRLLSEMLLHYSQEDSSDGDRELMKELFDQCENKRRTLFKLASETEDNDNSLGDILQASDNLSRVINSYKTIIEGQVINGEVATLTLPDSEGNSQCSNQGTLIDLAELDTTNSLSSVLAPAPTPPSSGIPILPPPPQASGPPRSRSSSQAEATLGPSSTSNALSWLDEELLCLGLADPAPNVPPKESAGNSQWHLLQREQSDLDFFSPRPGTAACGASDAPLLQPSAPSSSSSQAPLPPPFPAPVVPASVPAPSAGSSLFSTGVAPALAPKVEPAVPGHHGLALGNSALHHLDALDQLLEEAKVTSGLVKPTTSPLIPTTTPARPLLPFSTGPGSPLFQPLSFQSQGSPPKGPELSLASIHVPLESIKPSSALPVTAYDKNGFRILFHFAKECPPGRPDVLVVVVSMLNTAPLPVKSIVLQAAVPKSMKVKLQPPSGTELSPFSPIQPPAAITQVMLLANPLKEKVRLRYKLTFALGEQLSTEVGEVDQFPPVEQWGNL

SEQ ID NO: 35957 - protein, 690 aa, Homo sapiens
  Payload ID: 7105
  Gene Symbol: GGA3
  Gene Name: golgi-associated, gamma adaptin ear containing, ARF binding protein 3
  Uniprot ID: Q9NZ52
  ENSP ID: ENSP00000446421
MAEAEGESLESWLNKATNPSNRQEDWEYIIGFCDQINKELEGPQIAVRLLAHKIQSPQEWEALQALTYLGDRVSEKVKTKVIELLYSWTMALPEEAKIKDAYHMLKRQGIVQSDPPIPVDRTLIPSPPPRPKNPVFDDEEKSKLLAKLLKSKNPDDLQEANKLIKSMVKEDEARIQKVTKRLHTLEEVNNNVRLLSEMLLHYSQEDSSDGDRELMKELFDQCENKRRTLFKLASETEDNDNSLGDILQASDNLSRVINSYKTIIEGQVINGEVATLTLPDSEGNSQCSNQGTLIDLAELDTTNSLSSVLAPAPTPPSSGIPILPPPPQASGPPRSRSSSQAEATLGPSSTSNALSWLDEELLCLGLADPAPNVPPKESAGNSQWHLLQREQSDLDFFSPRPGTAACGASDAPLLQPSAPSSSSSQAPLPPPFPAPVVPASVPAPSAGSSLFSTGVAPALAPKVEPAVPGHHGLALGNSALHHLDALDQLLEEAKVTSGLVKPTTSPLIPTTTPARPLLPFSTGPGSPLFQPLSFQSQGSPPKGPELSLASIHVPLESIKPSSALPVTAYDKNGFRILFHFAKECPPGRPDVLVVVVSMLNTAPLPVKSIVLQAAVPKSMKVKLQPPSGTELSPFSPIQPPAAITQVMLLANPLKEKVRLRYKLTFALGEQLSTEVGEVDQFPPVEQWGNL

SEQ ID NO: 35958 - protein, 69 aa, Homo sapiens
  Payload ID: 7105
  Gene Symbol: GGA3
  Gene Name: golgi-associated, gamma adaptin ear containing, ARF binding protein 3
  ENSP ID: ENSP00000461963
MAEAEGESLESWLTTTETLPGRPSPDLGSRVIHWVPRAFPLPGSCRYSDPCSPVASEGAGVSVMMCSSS

SEQ ID NO: 35959 - protein, 651 aa, Homo sapiens
  Payload ID: 7105
  Gene Symbol: GGA3
  Gene Name: golgi-associated, gamma adaptin ear containing, ARF binding protein 3
  Uniprot ID: Q9NZ52
  ENSP ID: ENSP00000462081
MKNCGRRFHNEVGKFRFLNELIKVVSPKYLGDRVSEKVKTKVIELLYSWTMALPEEAKIKDAYHMLKRQGIVQSDPPIPVDRTLIPSPPPRPKNPVFDDEEKSKLLAKLLKSKNPDDLQEANKLIKSMVKEDEARIQKVTKRLHTLEEVNNNVRLLSEMLLHYSQEDSSDGDRELMKELFDQCENKRRTLFKLASETEDNDNSLGDILQASDNLSRVINSYKTIIEGQVINGEVATLTLPDSEGNSQCSNQGTLIDLAELDTTNSLSSVLAPAPTPPSSGIPILPPPPQASGPPRSRSSSQAEATLGPSSTSNALSWLDEELLCLGLADPAPNVPPKESAGNSQWHLLQREQSDLDFFSPRPGTAACGASDAPLLQPSAPSSSSSQAPLPPPFPAPVVPASVPAPSAGSSLFSTGVAPALAPKVEPAVPGHHGLALGNSALHHLDALDQLLEEAKVTSGLVKPTTSPLIPTTTPARPLLPFSTGPGSPLFQPLSFQSQGSPPKGPELSLASIHVPLESIKPSSALPVTAYDKNGFRILFHFAKECPPGRPDVLVVVVSMLNTAPLPVKSIVLQAAVPKSMKVKLQPPSGTELSPFSPIQPPAAITQVMLLANPLKEKVRLRYKLTFALGEQLSTEVGEVDQFPPVEQWGNL

SEQ ID NO: 35960 - protein, 64 aa, Homo sapiens
  Payload ID: 7105
  Gene Symbol: GGA3
  Gene Name: golgi-associated, gamma adaptin ear containing, ARF binding protein 3
  ENSP ID: ENSP00000462279
  MOD_RES (1)..(1): Any amino acid
XSPLIPTTTPARPLLPFSTGPGSPLFQPLSFQSQGSPPKGPELSLASIHVPLESIKPRVSPRTT

SEQ ID NO: 35961 - protein, 136 aa, Homo sapiens
  Payload ID: 7105
  Gene Symbol: GGA3
  Gene Name: golgi-associated, gamma adaptin ear containing, ARF binding protein 3
  ENSP ID: ENSP00000462473
MALPEEAKIKDAYHMLKRQGIVQSDPPIPVDRTLIPSPPPRPKNPVFDDEEKSKLLAKLLKSKNPDDLQEANKLIKSMVKEDEARIQKVTKRLHTLEEVNNNVRLLSEMLLHYSQEDSSDGDRELMKELFDQCENK

SEQ ID NO: 35962 - protein, 632 aa, Homo sapiens
  Payload ID: 7105
  Gene Symbol: GGA3
  Gene Name: golgi-associated, gamma adaptin ear containing, ARF binding protein 3
  ENSP ID: ENSP00000462629
MKNCGRRFHNEVGKFRFLNELIKVVSPKYLGDRVSEKVKTKVIELLYSWTMALPEEAKIKDAYHMLKRQGIVQSDPPIPVDRTLIPSPPPRPKNPVFDDEEKSKLLAKLLKSKNPDDLQEANKLIKSMVKEDEARIQKVTKRLHTLEEVNNNVRLLSEMLLHYSQEDSSDGDRELMKELFDQCENKRRTLFKLASETEDNDNSLGDILQASDNLSRVINSYKTIIEGQVINGEVATLTLPDSEGNSQCSNQGTLIDLAELDTTNSLSSVLAPAPTPPSSGIPILPPPPQASGPPRSRSSSQAEATLGPSSTSNALSWLDEELLCLGLADPAPNVPPKESAGNSQWHLLQREQSDLDFFSPRPGTAACGASDAPLLQPSAPSSSSSQAPLPPPFPAPVVPASVPAPSAGSSLFSTGVAPALAPKVEPAVPGHHGLALGNSALHHLDALDQLLEEAKVTSGLVKPTTSPLIPTTTPARPLLPFSTGPGSPLFQPLSFQSQGSPPKGPELSLASIHVPLESIKPSSALPVTAYDKNGFRILFHFAKECPPGRPDVLVVVVSMLNTAPLPVKSIVLQAAVPKSMKVKLQPPSGTELSPFSPIQPPAAITQVMLLANPLKWQAVSYGHLGRTWNLAS

SEQ ID NO: 35963 - protein, 110 aa, Homo sapiens
  Payload ID: 7105
  Gene Symbol: GGA3
  Gene Name: golgi-associated, gamma adaptin ear containing, ARF binding protein 3
  ENSP ID: ENSP00000463115
SALPVTAYDKNGFRILFHFAKECPPGRPDVLVVVVSMLNTAPLPVKSIVLQAAVPKSMKVKLQPPSGTELSPFSPIQPPAAITQVMLLANPLKLLLPSPGRWPRKVPGPE

SEQ ID NO: 35964 - protein, 592 aa, Homo sapiens
  Payload ID: 7105
  Gene Symbol: GGA3
  Gene Name: golgi-associated, gamma adaptin ear containing, ARF binding protein 3
  Uniprot ID: Q9NZ52
  ENSP ID: ENSP00000463288
MALPEEAKIKDAYHMLKRQGIVQSDPPIPVDRTLIPSPPPRPKNPVFDDEEKSKLLAKLLKSKNPDDLQEANKLIKSMVKEDEARIQKVTKRLHTLEEVNNNVRLLSEMLLHYSQEDSSDGDRELMKELFDQCENKRRTLFKLASETEDNDNSLGDILQASDNLSRVINSYKTIIEGQVINGEVATLTLPDSEGNSQCSNQGTLIDLAELDTTNSLSSVLAPAPTPPSSGIPILPPPPQASGPPRSRSSSQAEATLGPSSTSNALSWLDEELLCLGLADPAPNVPPKESAGNSQWHLLQREQSDLDFFSPRPGTAACGASDAPLLQPSAPSSSSSQAPLPPPFPAPVVPASVPAPSAGSSLFSTGVAPALAPKVEPAVPGHHGLALGNSALHHLDALDQLLEEAKVTSGLVKPTTSPLIPTTTPARPLLPFSTGPGSPLFQPLSFQSQGSPPKGPELSLASIHVPLESIKPSSALPVTAYDKNGFRILFHFAKECPPGRPDVLVVVVSMLNTAPLPVKSIVLQAAVPKSMKVKLQPPSGTELSPFSPIQPPAAITQVMLLANPLKKQVLSFLGKACLQPWGQAILLTTSCLA

SEQ ID NO: 35965 - protein, 76 aa, Homo sapiens
  Payload ID: 7105
  Gene Symbol: GGA3
  Gene Name: golgi-associated, gamma adaptin ear containing, ARF binding protein 3
  ENSP ID: ENSP00000464268
  MOD_RES (1)..(1): Any amino acid
XTTSPLIPTTTPARPLLPFSTGPGSPLFQPLSFQSQGSPPKGPELSLASIHVPLESIKPINESEVAATFWDRTLSI

SEQ ID NO: 35966 - protein, 152 aa, Homo sapiens
  Payload ID: 7105
  Gene Symbol: GGA3
  Gene Name: golgi-associated, gamma adaptin ear containing, ARF binding protein 3
  ENSP ID: ENSP00000464318
  MOD_RES (1)..(1): Any amino acid
XAEAEGESLESWLNKATNPSNRQEDWEYIIGFCDQINKELEGPQIAVRLLAHKIQSPQEWEALQALTVLEACMKNCGRRFHNEVGKFRFLNELIKVVSPKYLGDRVSEKVKTKVIELLYSWTMALPEEAKIKDAYHMLKRQGLDHRDVALGV

SEQ ID NO: 35967 - protein, 106 aa, Homo sapiens
  Payload ID: 7105
  Gene Symbol: GGA3
  Gene Name: golgi-associated, gamma adaptin ear containing, ARF binding protein 3
  ENSP ID: ENSP00000464365
MAEAEGESLESWLNKATNPSNRQEDWEYIIGFCDQINKELEGPQIAVRLLAHKIQSPQEWEALQALTVLEACMKNCGRRFHNEVGKFRFLNELIKVVSPKRARPWR

SEQ ID NO: 35968 - protein, 158 aa, Homo sapiens
  Payload ID: 7105
  Gene Symbol: GGA3
  Gene Name: golgi-associated, gamma adaptin ear containing, ARF binding protein 3
  ENSP ID: ENSP00000464574
  MOD_RES (1)..(1): Any amino acid
XLIPTTTPARPLLPFSTGPGSPLFQPLSFQSQGSPPKGPELSLASIHVPLESIKPSSALPVTAYDKNGFRILFHFAKECPPGRPDVLVVVVSMLNTAPLPVKSIVLQAAVPKSMKVKLQPPSGTELSPFSPIQPPAAITQVMLLANPLKDLFLSTCVT

SEQ ID NO: 35969 - protein, 69 aa, Homo sapiens; identical to SEQ ID NO: 35958
  Payload ID: 7105
  Gene Symbol: GGA3
  Gene Name: golgi-associated, gamma adaptin ear containing, ARF binding protein 3
  ENSP ID: ENSP00000479464

SEQ ID NO: 35970 - protein, 46 aa, Homo sapiens
  Payload ID: 7105
  Gene Symbol: GGA3
  Gene Name: golgi-associated, gamma adaptin ear containing, ARF binding protein 3
  ENSP ID: ENSP00000481953
MKNCGRRFHNEVGKFRFLNELIKVVSPKYLGDRVSEKVKTKVIELL

SEQ ID NO: 35971 - protein, 153 aa, Homo sapiens
  Payload ID: 7105
  Gene Symbol: GGA3
  Gene Name: golgi-associated, gamma adaptin ear containing, ARF binding protein 3
  ENSP ID: ENSP00000484733
MAEAEGESLESWLNKATNPSNRQEDWEYIIGFCDQINKELEGPQIAVRLLAHKIQSPQEWEALQALTVLEACMKNCGRRFHNEVGKFRFLNELIKVVSPKYLGDRVSEKVKTKVIELLYSWTMALPEEAKIKDAYHMLKRQAFSQAAEKQKPR

SEQ ID NO: 35972 - protein, 518 aa, Homo sapiens
  Payload ID: 7106
  Gene Symbol: GFY
  Gene Name: golgi-associated, olfactory signaling regulator
  Uniprot ID: I3L273
  ENSP ID: ENSP00000459439
MKSFSRILFLVFLLAGLRSKAAPSAPLPLGCGFPDMAHPSETSPLKGASENSKRDRLNPEFPGTPYPEPSKLPHTVSLETFPLDFTEPLNPDLRETPHPESPETPKADSLTTSISESLDMPKTNLSKMAHPESSETPTPGPTEMPHPGSPETPKPNFSKTSRPEFPETPNTDLMQTTPQESPEILQLNATEVSQAELPETSNTNPTKTPDPKSPEKHDLNSTETPNSEFLQALHPDPSKTPHPESHVTHNPSPTEISQTEFPTTYYQNATDVPRTSDPQISTSLYPETPVPFKDDATALNELSLNPKPGTPAAIQPDSPKLPTSDSPGMVELKAPQNSGPKESNVPPPSARIAGPPALPGRPSQLAPATLRAPQRHSRGEGVNTIIVVERVKETGVTLVGRPRGAAGGALCLFFAGTALLIGIFVLLWCLYRRAARQRPFAHHRLPDDGDEPVLHLDAPKDPYDLYFYAPDTWVPSHIATKQPPPTPPLPPKLPPPPRGGRPQRLEALSPATLPNNFV

SEQ ID NO: 35973 - protein, 518 aa, Homo sapiens; identical to SEQ ID NO: 35972
  Payload ID: 7106
  Gene Symbol: GFY
  Gene Name: golgi-associated, olfactory signaling regulator
  Uniprot ID: I3L273
  ENSP ID: ENSP00000478493

SEQ ID NO: 35974 - protein, 767 aa, Homo sapiens
  Payload ID: 7107
  Gene Symbol: GOLGA1
  Gene Name: golgin A1
  Uniprot ID: Q92805
  ENSP ID: ENSP00000362656
MFAKLKKKIAEETAVAQRPGGATRIPRSVSKESVASMGADSGDDFASDGSSSREDLSSQLLRRNEQIRKLEARLSDYAEQVRNLQKIKEKLEIALEKHQDSSMRKFQEQNETFQANRAKMAEGLALALARKDQEWSEKMDQLEKEKNILTAQLQEMKNQSMNLFQRRDEMDELEGFQQQELSKIKHMLLKKEESLGKMEQELEARTRELSRTQEELMNSNQMSSDLSQKLEELQRHYSTLEEQRDHVIASKTGAESKITALEQKEQELQALIQQLSIDLQKVTAETQEKEDVITHLQEKVASLEKRLEQNLSGEEHLQELLKEKTLAEQNLEDTRQQLLAARSSQAKAINTLETRVRELEQTLQASEEQLQQSKGIVAAQETQIQELAAANQESSHVQQQALALEQQFLERTQALEAQIVALERTRAADQTTAEQGMRQLEQENAALKECRNEYERSLQNHQFELKKLKEEWSQREIVSVAMAQALEEVRKQREEFQQQAANLTAIIDEKEQNLREKTEVLLQKEQEILQLERGHNSALLQIHQLQAELEALRTLKAEEAAVVAEQEDLLRLRGPLQAEALSVNESHVTSRAMQDPVFQLPTAGRTPNGEVGAMDLTQLQKEKQDLEQQLLEKNKTIKQMQQRMLELRKTLQKELKIRPDNELFEVREKPGPEMANMAPSVTNNTDLTDAREINFEYLKHVVLKFMSCRESEAFHLIKAVSVLLNFSQEEENMLKETLEYKMSWFGSKPAPKGSIRPSISNPRIPWS

SEQ ID NO: 35975 - protein, 112 aa, Homo sapiens
  Payload ID: 7107
  Gene Symbol: GOLGA1
  Gene Name: golgin A1
  ENSP ID: ENSP00000396966
MFAKLKKKIAEETAVAQRPGGATRIPRSVSKESVASMGADSGDDFASDGSSSREDLSSQLLRRNEQIRKLEARLSDYAEQVRNLQKIKEKLEIALEKHQDSSMRKFQEQNET

SEQ ID NO: 35976 - protein, 151 aa, Homo sapiens
  Payload ID: 7107
  Gene Symbol: GOLGA1
  Gene Name: golgin A1
  ENSP ID: ENSP00000435006
DLSQKLEELQRHYSTLEEQRDHVIASKTGAESKITALEQKEQELQALIQQLSIDLQKVTAETQEKEDVITHLQEKVASLEKRLEQNLSGEEHLQELLKEKTLAEQNLEDTRQQLLAARSSQAKAINTLETRVRELEQTLLWSSSSWSAPRR

SEQ ID NO: 35977 - protein, 168 aa, Homo sapiens
  Payload ID: 7107
  Gene Symbol: GOLGA1
  Gene Name: golgin A1
  ENSP ID: ENSP00000473648
  MOD_RES (1)..(1): Any amino acid
XLQKIKEKLEIALEKHQDSSMRKFQEQNETFQANRAKMAEGLALALARKDQEWSEKMDQLEKEKNILTAQLQEMKNQSMNLFQRRDEMDELEGFQQQELSKIKHMLLKKEESLGKMEQELEARTRELSRTQEELMNSNQMSSDLSQKLEELQRHYSTLEEQRFLLGHC

SEQ ID NO: 35978 - protein, 473 aa, Homo sapiens
  Payload ID: 7108
  Gene Symbol: GOLGA2
  Gene Name: golgin A2
  ENSP ID: ENSP00000409271
MWPQPRLPPRPAMSEETRQSKLAAAKKKLREYQQRNSPGVPTGAKKKKKIKNGSNPETTTSGGCHSPEDIQDILKVLVSDLNRSNGVALPPLDKWKTPKDNAATLQPSDDTVLPGGVPSPGASLTSMAASQNHDADNVPNLMDETKTFSSTESLRQLSQQLNGLVCESATCVNGEGPASSANLKDLESRYQQLAVALDSSYVTNKQLNITIEKLKQQNQEITDQLEEEKKECHQKQGALREQLQVHIQTIGILVSEKAELQTALAHTQHAARQKEGESEDLASRLQYSRRRVGELERALSAVSTQQKKADRYNKELTKERDALRLELYKNTQSNEDLKQEKSELEEKLRVLVTEKAGMQLNLEELQKKLEMTELLLQQFSSRCEAPDANQQLQQAMEERAQLEAHLGQVMESVRQLQMERDKYAENLKGESAMWRQRMQQMSEQVHTLREEKECSMSRVQELETSLAELRNQM

SEQ ID NO: 35979 - protein, 234 aa, Homo sapiens
  Payload ID: 7108
  Gene Symbol: GOLGA2
  Gene Name: golgin A2
  ENSP ID: ENSP00000411598
IQDILKVLVSDLNRSNGVALPPLDKWKTPKDNAATLQPSDDTVLPGGVPSPGASLTSMAASQNHDADNVPNLMDETKTFSSTESLRQLSQQLNGLVCESATCVNGEGPASSANLKDLEKQQNQEITDQLEEEKKECHQKQGALREQLQVHIQTIGILVSEKAELQTALAHTQHAARQKEGESEDLASRLQYSRRRVGELERALSAVSTQQKKADRYNKELTKERDALRLELYKN

SEQ ID NO: 35980 - protein, 1002 aa, Homo sapiens
  Payload ID: 7108
  Gene Symbol: GOLGA2
  Gene Name: golgin A2
  Uniprot ID: Q08379
  ENSP ID: ENSP00000416097
MWPQPRLPPRPAMSEETRQSKLAAAKKKLREYQQRNSPGVPTGAKKKKKIKNGSNPETTTSGGCHSPEDTPKDNAATLQPSDDTVLPGGVPSPGASLTSMAASQNHDADNVPNLMDETKTFSSTESLRQLSQQLNGLVCESATCVNGEGPASSANLKDLESRYQQLAVALDSSYVTNKQLNITIEKLKQQNQEITDQLEEEKKECHQKQGALREQLQVHIQTIGILVSEKAELQTALAHTQHAARQKEGESEDLASRLQYSRRRVGELERALSAVSTQQKKADRYNKELTKERDALRLELYKNTQSNEDLKQEKSELEEKLRVLVTEKAGMQLNLEELQKKLEMTELLLQQFSSRCEAPDANQQLQQAMEERAQLEAHLGQVMESVRQLQMERDKYAENLKGESAMWRQRMQQMSEQVHTLREEKECSMSRVQELETSLAELRNQMAEPPPPEPPAGPSEVEQQLQAEAEHLRKELEGLAGQLQAQVQDNEGLSRLNREQEERLLELERAAELWGEQAEARRQILETMQNDRTTISRALSQNRELKEQLAELQSGFVKLTNENMEITSALQSEQHVKRELGKKLGELQEKLSELKETVELKSQEAQSLQQQRDQYLGHLQQYVAAYQQLTSEKEVLHNQLLLQTQLVDQLQQQEAQGKAVAEMARQELQETQERLEAATQQNQQLRAQLSLMAHPGEGDGLDREEEEDEEEEEEEAVAVPQPMPSIPEDLESREAMVAFFNSAVASAEEEQARLRGQLKEQRVRCRRLAHLLASAQKEPEAAAPAPGTGGDSVCGETHRALQGAMEKLQSRFMELMQEKADLKERVEELEHRCIQLSGETDTIGEYIALYQSQRAVLKERHREKEEYISRLAQDKEEMKVKLLELQELVLRLVGDRNEWHGRFLAAAQNPADEPTSGAPAPQELGAANQQGDLCEVSLAGSVEPAQGEAREGSPRDNPTAQQIMQLLREMQNPRERPGLGSNPCIPFFYRADENDEVKITVI

SEQ ID NO: 35981 - protein, 99 aa, Homo sapiens
  Payload ID: 7108
  Gene Symbol: GOLGA2
  Gene Name: golgin A2
  ENSP ID: ENSP00000473603
MWPQPRLPPRPAMSEETRQSKLAAAKKKLREYQQRNSPGVPTGAKKKKKIKNGSNPETTTSGGCHSPEDVSLGWPGSWGQGAQGAVEGNCYDCGRTVGY

SEQ ID NO: 35982 - protein, 990 aa, Homo sapiens
  Payload ID: 7108
  Gene Symbol: GOLGA2
  Gene Name: golgin A2
  ENSP ID: ENSP00000476265
MSEETRQSKLAAAKKKLREYQQRNSPGVPTGAKKKKKIKNGSNPETTTSGGCHSPEDTPKDNAATLQPSDDTVLPGGVPSPGASLTSMAASQNHDADNVPNLMDETKTFSSTESLRQLSQQLNGLVCESATCVNGEGPASSANLKDLESRYQQLAVALDSSYVTNKQLNITIEKLKQQNQEITDQLEEEKKECHQKQGALREQLQVHIQTIGILVSEKAELQTALAHTQHAARQKEGESEDLASRLQYSRRRVGELERALSAVSTQQKKADRYNKELTKERDALRLELYKNTQSNEDLKQEKSELEEKLRVLVTEKAGMQLNLEELQKKLEMTELLLQQFSSRCEAPDANQQLQQAMEERAQLEAHLGQVMESVRQLQMERDKYAENLKGESAMWRQRMQQMSEQVHTLREEKECSMSRVQELETSLAELRNQMAEPPPPEPPAGPSEVEQQLQAEAEHLRKELEGLAGQLQAQVQDNEGLSRLNREQEERLLELERAAELWGEQAEARRQILETMQNDRTTISRALSQNRELKEQLAELQSGFVKLTNENMEITSALQSEQHVKRELGKKLGELQEKLSELKETVELKSQEAQSLQQQRDQYLGHLQQYVAAYQQLTSEKEVLHNQLLLQTQLVDQLQQQEAQGKAVAEMARQELQETQERLEAATQQNQQLRAQLSLMAHPGEGDGLDREEEEDEEEEEEEAVAVPQPMPSIPEDLESREAMVAFFNSAVASAEEEQARLRGQLKEQRVRCRRLAHLLASAQKEPEAAAPAPGTGGDSVCGETHRALQGAMEKLQSRFMELMQEKADLKERVEELEHRCIQLSGETDTIGEYIALYQSQRAVLKERHREKEEYISRLAQDKEEMKVKLLELQELVLRLVGDRNEWHGRFLAAAQNPADEPTSGAPAPQELGAANQQGDLCEVSLAGSVEPAQGEAREGSPRDNPTAQQIMQLLREMQNPRERPGLGSNPCIPFFYRADENDEVKITVI

SEQ ID NO: 35983 - protein, 1002 aa, Homo sapiens; identical to SEQ ID NO: 35980
  Payload ID: 7108
  Gene Symbol: GOLGA2
  Gene Name: golgin A2
  Uniprot ID: Q08379
  ENSP ID: ENSP00000478799

SEQ ID NO: 35984 - protein, 286 aa, Homo sapiens
  Payload ID: 7108
  Gene Symbol: GOLGA2
  Gene Name: golgin A2
  ENSP ID: ENSP00000481685
MAVPQPMPSIPEDLESREAMVAFFNSAVASAEEEQARLRGQLKEQRVRCRRLAHLLASAQKEPEAAAPAPGTGGDSVCGETHRALQGAMEKLQSRFMELMQEKADLKERVEELEHRCIQLSGETDTIGEYIALYQSQRAVLKERHREKEEYISRLAQDKEEMKVKLLELQELVLRLVGDRNEWHGRFLAAAQNPADEPTSGAPAPQELGAANQQGDLCEVSLAGSVEPAQGEAREGSPRDNPTAQQIMQLLREMQNPRERPGLGSNPCIPFFYRADENDEVKITVI

SEQ ID NO: 35985 - protein, 1498 aa, Homo sapiens
  Payload ID: 7109
  Gene Symbol: GOLGA3
  Gene Name: golgin A3
  Uniprot ID: Q08378
  ENSP ID: ENSP00000204726
MDGASAEQDGLQEDRSHSGPSSLPEAPLKPPGPLVPPDQQDKVQCAEVNRASTEGESPDGPGQGGLCQNGPTPPFPDPPSSLDPTTSPVGPDASPGVAGFHDNLRKSQGTSAEGSVRKEALQSLRLSLPMQETQLCSTDSPLPLEKEEQVRLQARKWLEEQLKQYRVKRQQERSSQPATKTRLFSTLDPELMLNPENLPRASTLAMTKEYSFLRTSVPRGPKVGSLGLPAHPREKKTSKSSKIRSLADYRTEDSNAGNSGGNVPAPDSTKGSLKQNRSSAASVVSEISLSPDTDDRLENTSLAGDSVSEVDGNDSDSSSYSSASTRGTYGILSKTVGTQDTPYMVNGQEIPADTLGQFPSIKDVLQAAAAEHQDQGQEVNGEVRSRRDSICSSVSLESSAAETQEEMLQVLKEKMRLEGQLEALSLEASQALKEKAELQAQLAALSTKLQAQVECSHSSQQRQDSLSSEVDTLKQSCWDLERAMTDLQNMLEAKNASLASSNNDLQVAEEQYQRLMAKVEDMQRSMLSKDNTVHDLRQQMTALQSQLQQVQLERTTLTSKLKASQAEISSLQSVRQWYQQQLALAQEARVRLQGEMAHIQVGQMTQAGLLEHLKLENVSLSQQLTETQHRSMKEKGRIAAQLQGIEADMLDQEAAFMQIQEAKTMVEEDLQRRLEEFEGERERLQRMADSAASLEQQLEQVKLTLLQRDQQLEALQQEHLDLMKQLTLTQEALQSREQSLDALQTHYDELQARLGELQGEAASREDTICLLQNEKIILEAALQAAKSGKEELDRGARRLEEGTEETSETLEKLREELAIKSGQVEHLQQETAALKKQMQKIKEQFLQQKVMVEAYRRDATSKDQLISELKATRKRLDSELKELRQELMQVHGEKRTAEAELSRLHREVAQVRQHMADLEGHLQSAQKERDEMETHLQSLQFDKEQMVAVTEANEALKKQIEELQQEARKAITEQKQKMRRLGSDLTSAQKEMKTKHKAYENAVGILSRRLQEALAAKEAADAELGQLRAQGGSSDSSLALHERIQALEAELQAVSHSKTLLEKELQEVIALTSQELEESREKVLELEDELQESRGFRKKIKRLEESNKKLALELEHEKGKLTGLGQSNAALREHNSILETALAKREADLVQLNLQVQAVLQRKEEEDRQMKHLVQALQASLEKEKEKVNSLKEQVAAAKVEAGHNRRHFKAASLELSEVKKELQAKEHLVQKLQAEADDLQIREGKHSQEIAQFQAELAEARAQLQLLQKQLDEQLSKQPVGNQEMENLKWEVDQKEREIQSLKQQLDLTEQQGRKELEGLQQLLQNVKSELEMAQEDLSMTQKDKFMLQAKVSELKNNMKTLLQQNQQLKLDLRRGAAKTRKEPKGEASSSNPATPIKIPDCPVPASLLEELLRPPPAVSKEPLKNLNSCLQQLKQEMDSLQRQMEEHALTVHESLSSWTPLEPATASPVPPGGHAGPRGDPQRHSQSRASKEGPGE

SEQ ID NO: 35986 - protein, 1390 aa, Homo sapiens
  Payload ID: 7109
  Gene Symbol: GOLGA3
  Gene Name: golgin A3
  Uniprot ID: Q08378
  ENSP ID: ENSP00000409303
MDGASAEQDGLQEDRSHSGPSSLPEAPLKPPGPLVPPDQQDKVQCAEVNRASTEGESPDGPGQGGLCQNGPTPPFPDPPSSLDPTTSPVGPDASPGVAGFHDNLRKSQGTSAEGSVRKEALQSLRLSLPMQETQLCSTDSPLPLEKEEQVRLQARKWLEEQLKQYRVKRQQERSSQPATKTRLFSTLDPELMLNPENLPRASTLAMTKEYSFLRTSVPRGPKVGSLGLPAHPREKKTSKSSKIRSLADYRTEDSNAGNSGGNVPAPDSTKGSLKQNRSSAASVVSEISLSPDTDDRLENTSLAGDSVSEVDGNDSDSSSYSSASTRGTYGILSKTVGTQDTPYMVNGQEIPADTLGQFPSIKDVLQAAAAEHQDQGQEVNGEVRSRRDSICSSVSLESSAAETQEEMLQVLKEKMRLEGQLEALSLEASQALKEKAELQAQLAALSTKLQAQVECSHSSQQRQDSLSSEVDTLKQSCWDLERAMTDLQNMLEAKNASLASSNNDLQVAEEQYQRLMAKVEDMQRSMLSKDNTVHDLRQQMTALQSQLQQVQLERTTLTSKLKASQAEISSLQSVRQWYQQQLALAQEARVRLQGEMAHIQVGQMTQAGLLEHLKLENVSLSQQLTETQHRSMKEKGRIAAQLQGIEADMLDQEAAFMQIQEAKTMVEEDLQRRLEEFEGERERLQRMADSAASLEQQLEQVKLTLLQRDQQLEALQQEHLDLMKQLTLTQEALQSREQSLDALQTHYDELQARLGELQGEAASREDTICLLQNEKIILEAALQAAKSGKEELDRGARRLEEGTEETSETLEKLREELAIKSGQVEHLQQETAALKKQMQKIKEQFLQQKVMVEAYRRDATSKDQLISELKATRKRLDSELKELRQELMQVHGEKRTAEAELSRLHREVAQVRQHMADLEGHLQSAQKERDEMETHLQSLQFDKEQMVAVTEANEALKKQIEELQQEARKAITEQKQKMRRLGSDLTSAQKEMKTKHKAYENAVGILSRRLQEALAAKEAADAELGQLRAQGGSSDSSLALHERIQALEAELQAVSHSKTLLEKELQEVIALTSQELEESREKVLELEDELQESRGFRKKIKRLEESNKKLALELEHEKGKLTGLGQSNAALREHNSILETALAKREADLVQLNLQVQAVLQRKEEEDRQMKHLVQALQASLEKEKEKVNSLKEQVAAAKVEAGHNRRHFKAASLELSEVKKELQAKEHLVQKLQAEADDLQIREGKHSQEIAQFQAELAEARAQLQLLQKQLDEQLSKQPVGNQEMENLKWEVDQKEREIQSLKQQLDLTEQQGRKELEGLQQLLQNVKSELEMAQEDLSMTQKDKFMLQAKVSELKNNMKTLLQQNQQLKLDLRRGAAKTVLRPASLPG

SEQ ID NO: 35987 - protein, 1498 aa, Homo sapiens; identical to SEQ ID NO: 35985
  Payload ID: 7109
  Gene Symbol: GOLGA3
  Gene Name: golgin A3
  Uniprot ID: Q08378
  ENSP ID: ENSP00000410378

SEQ ID NO: 35988 - protein, 1134 aa, Homo sapiens
  Payload ID: 7109
  Gene Symbol: GOLGA3
  Gene Name: golgin A3
  Uniprot ID: Q08378
  ENSP ID: ENSP00000442603
MDGASAEQDGLQEDRSHSGPSSLPEAPLKPPGPLVPPDQQDKVQCAEVNRASTEGESPDGPGQGGLCQNGPTPPFPDPPSSLDPTTSPVGPDASPGVAGFHDNLRKSQGTSAEGSVRKEALQSLRLSLPMQETQLCSTDSPLPLEKEEQVRLQARKWLEEQLKQYRVKRQQERSSQPATKTRLFSTLDPELMLNPENLPRASTLAMTKEYSFLRTSVPRGPKVGSLGLPAHPREKKTSKSSKIRSLADYRTEDSNAGNSGGNVPAPDSTKGSLKQNRSSAASVVSEISLSPDTDDRLENTSLAGDSVSEVDGNDSDSSSYSSASTRGTYGILSKTVGTQDTPYMVNGQEIPADTLGQFPSIKDVLQAAAAEHQDQGQEVNGEVRSRRDSICSSVSLESSAAETQEEMLQVLKEKMRLEGQLEALSLEASQALKEKAELQAQLAALSTKLQAQVECSHSSQQRQDSLSSEVDTLKQSCWDLERAMTDLQNMLEAKNASLASSNNDLQVAEEQYQRLMAKVEDMQRSMLSKDNTVHDLRQQMTALQSQLQQVQLERTTLTSKLKASQAEISSLQSVRQWYQQQLALAQEARVRLQGEMAHIQVGQMTQAGLLEHLKLENVSLSQQLTETQHRSMKEKGRIAAQLQGIEADMLDQEAAFMQIQEAKTMVEEDLQRRLEEFEGERERLQRMADSAASLEQQLEQVKLTLLQRDQQLEALQQEHLDLMKQLTLTQEALQSREQSLDALQTHYDELQARLGELQGEAASREDTICLLQNEKIILEAALQAAKSGKEELDRGARRLEEGTEETSETLEKLREELAIKSGQVEHLQQETAALKKQMQKIKEQFLQQKVMVEAYRRDATSKDQLISELKATRKRLDSELKELRQELMQVHGEKRTAEAELSRLHREVAQVRQHMADLEGHLQSAQKERDEMETHLQSLQFDKEQMVAVTEANEALKKQIEELQQEARKAITEQKQKMRRLGSDLTSAQKEMKTKHKAYENAVGILSRRLQEALAAKEAADAELGQLRAQGGSSDSSLALHERIQALEAELQAVSHSKTLLEKELQEVIALTSQELEESREKVLELEDEVRPGHLLWRQRGAGHVSPGHAATRETRRTKLHRVPSVATFGVATF

SEQ ID NO: 35989 - protein, 84 aa, Homo sapiens
  Payload ID: 7109
  Gene Symbol: GOLGA3
  Gene Name: golgin A3
  ENSP ID: ENSP00000479170
  MOD_RES (1)..(1): Any amino acid
XDLTEQQGRKELEGLQQLLQNVKSELEMAQEDLSMTQKDKFMLQAKVSELKNNMKTLLQQNQQLKLDLRRGAAKTVLRPASLPG

SEQ ID NO: 35990 - protein, 2243 aa, Homo sapiens
  Payload ID: 7110
  Gene Symbol: GOLGA4
  Gene Name: golgin A4
  Uniprot ID: Q13439
  ENSP ID: ENSP00000349305
MFKKLKQKISEEQQQLQQALAPAQASSNSSTPTRMRSRTSSFTEQLDEGTPNRENASTHASKSPDSVNGSEPSIPQSGDTQSFAQKLQLRVPSVESLFRSPIKESLFRSSSKESLVRTSSRESLNRLDLDSSTASFDPPSDMDSEAEDLVGNSDSLNKEQLIQRLRRMERSLSSYRGKYSELVTAYQMLQREKKKLQGILSQSQDKSLRRIAELREELQMDQQAKKHLQEEFDASLEEKDQYISVLQTQVSLLKQRLRNGPMNVDVLKPLPQLEPQAEVFTKEENPESDGEPVVEDGTSVKTLETLQQRVKRQENLLKRCKETIQSHKEQCTLLTSEKEALQEQLDERLQELEKIKDLHMAEKTKLITQLRDAKNLIEQLEQDKGMVIAETKRQMHETLEMKEEEIAQLRSRIKQMTTQGEELREQKEKSERAAFEELEKALSTAQKTEEARRKLKAEMDEQIKTIEKTSEEERISLQQELSRVKQEVVDVMKKSSEEQIAKLQKLHEKELARKEQELTKKLQTREREFQEQMKVALEKSQSEYLKISQEKEQQESLALEELELQKKAILTESENKLRDLQQEAETYRTRILELESSLEKSLQENKNQSKDLAVHLEAEKNKHNKEITVMVEKHKTELESLKHQQDALWTEKLQVLKQQYQTEMEKLREKCEQEKETLLKDKEIIFQAHIEEMNEKTLEKLDVKQTELESLSSELSEVLKARHKLEEELSVLKDQTDKMKQELEAKMDEQKNHHQQQVDSIIKEHEVSIQRTEKALKDQINQLELLLKERDKHLKEHQAHVENLEADIKRSEGELQQASAKLDVFQSYQSATHEQTKAYEEQLAQLQQKLLDLETERILLTKQVAEVEAQKKDVCTELDAHKIQVQDLMQQLEKQNSEMEQKVKSLTQVYESKLEDGNKEQEQTKQILVEKENMILQMREGQKKEIEILTQKLSAKEDSIHILNEEYETKFKNQEKKMEKVKQKAKEMQETLKKKLLDQEAKLKKELENTALELSQKEKQFNAKMLEMAQANSAGISDAVSRLETNQKEQIESLTEVHRRELNDVISIWEKKLNQQAEELQEIHEIQLQEKEQEVAELKQKILLFGCEKEEMNKEITWLKEEGVKQDTTLNELQEQLKQKSAHVNSLAQDETKLKAHLEKLEVDLNKSLKENTFLQEQLVELKMLAEEDKRKVSELTSKLKTTDEEFQSLKSSHEKSNKSLEDKSLEFKKLSEELAIQLDICCKKTEALLEAKTNELINISSSKTNAILSRISHCQHRTTKVKEALLIKTCTVSELEAQLRQLTEEQNTLNISFQQATHQLEEKENQIKSMKADIESLVTEKEALQKEGGNQQQAASEKESCITQLKKELSENINAVTLMKEELKEKKVEISSLSKQLTDLNVQLQNSISLSEKEAAISSLRKQYDEEKCELLDQVQDLSFKVDTLSKEKISALEQVDDWSNKFSEWKKKAQSRFTQHQNTVKELQIQLELKSKEAYEKDEQINLLKEELDQQNKRFDCLKGEMEDDKSKMEKKESNLETELKSQTARIMELEDHITQKTIEIESLNEVLKNYNQQKDIEHKELVQKLQHFQELGEEKDNRVKEAEEKILTLENQVYSMKAELETKKKELEHVNLSVKSKEEELKALEDRLESESAAKLAELKRKAEQKIAAIKKQLLSQMEEKEEQYKKGTESHLSELNTKLQEREREVHILEEKLKSVESSQSETLIVPRSAKNVAAYTEQEEADSQGCVQKTYEEKISVLQRNLTEKEKLLQRVGQEKEETVSSHFEMRCQYQERLIKLEHAEAKQHEDQSMIGHLQEELEEKNKKYSLIVAQHVEKEGGKNNIQAKQNLENVFDDVQKTLQEKELTCQILEQKIKELDSCLVRQKEVHRVEMEELTSKYEKLQALQQMDGRNKPTELLEENTEEKSKSHLVQPKLLSNMEAQHNDLEFKLAGAEREKQKLGKEIVRLQKDLRMLRKEHQQELEILKKEYDQEREEKIKQEQEDLELKHNSTLKQLMREFNTQLAQKEQELEMTIKETINKAQEVEAELLESHQEETNQLLKKIAEKDDDLKRTAKRYEEILDAREEEMTAKVRDLQTQLEELQKKYQQKLEQEENPGNDNTQLAQKTTLISDSKLKEQEFREQIHNLEDRLKKYEKNVYATTVGTPYKGGNLYHTDVSLFGEPTEFEYLRKVLFEYMMGRETKTMAKVITTVLKFPDDQTQKILEREDARLMSWLRSSS

SEQ ID NO: 35991 - protein, 2230 aa, Homo sapiens
  Payload ID: 7110
  Gene Symbol: GOLGA4
  Gene Name: golgin A4
  Uniprot ID: Q13439
  ENSP ID: ENSP00000354486
MFKKLKQKISEEQQQLQQALAPAQASSNSSTPTRMRSRTSSFTEQLDEGTPNRESGDTQSFAQKLQLRVPSVESLFRSPIKESLFRSSSKESLVRTSSRESLNRLDLDSSTASFDPPSDMDSEAEDLVGNSDSLNKEQLIQRLRRMERSLSSYRGKYSELVTAYQMLQREKKKLQGILSQSQDKSLRRIAELREELQMDQQAKKHLQEEFDASLEEKDQYISVLQTQVSLLKQRLRNGPMNVDVLKPLPQLEPQAEVFTKEENPESDGEPVVEDGTSVKTLETLQQRVKRQENLLKRCKETIQSHKEQCTLLTSEKEALQEQLDERLQELEKIKDLHMAEKTKLITQLRDAKNLIEQLEQDKGMVIAETKRQMHETLEMKEEEIAQLRSRIKQMTTQGEELREQKEKSERAAFEELEKALSTAQKTEEARRKLKAEMDEQIKTIEKTSEEERISLQQELSRVKQEVVDVMKKSSEEQIAKLQKLHEKELARKEQELTKKLQTREREFQEQMKVALEKSQSEYLKISQEKEQQESLALEELELQKKAILTESENKLRDLQQEAETYRTRILELESSLEKSLQENKNQSKDLAVHLEAEKNKHNKEITVMVEKHKTELESLKHQQDALWTEKLQVLKQQYQTEMEKLREKCEQEKETLLKDKEIIFQAHIEEMNEKTLEKLDVKQTELESLSSELSEVLKARHKLEEELSVLKDQTDKMKQELEAKMDEQKNHHQQQVDSIIKEHEVSIQRTEKALKDQINQLELLLKERDKHLKEHQAHVENLEADIKRSEGELQQASAKLDVFQSYQSATHEQTKAYEEQLAQLQQKLLDLETERILLTKQVAEVEAQKKDVCTELDAHKIQVQDLMQQLEKQNSEMEQKVKSLTQVYESKLEDGNKEQEQTKQILVEKENMILQMREGQKKEIEILTQKLSAKEDSIHILNEEYETKFKNQEKKMEKVKQKAKEMQETLKKKLLDQEAKLKKELENTALELSQKEKQFNAKMLEMAQANSAGISDAVSRLETNQKEQIESLTEVHRRELNDVISIWEKKLNQQAEELQEIHEIQLQEKEQEVAELKQKILLFGCEKEEMNKEITWLKEEGVKQDTTLNELQEQLKQKSAHVNSLAQDETKLKAHLEKLEVDLNKSLKENTFLQEQLVELKMLAEEDKRKVSELTSKLKTTDEEFQSLKSSHEKSNKSLEDKSLEFKKLSEELAIQLDICCKKTEALLEAKTNELINISSSKTNAILSRISHCQHRTTKVKEALLIKTCTVSELEAQLRQLTEEQNTLNISFQQATHQLEEKENQIKSMKADIESLVTEKEALQKEGGNQQQAASEKESCITQLKKELSENINAVTLMKEELKEKKVEISSLSKQLTDLNVQLQNSISLSEKEAAISSLRKQYDEEKCELLDQVQDLSFKVDTLSKEKISALEQVDDWSNKFSEWKKKAQSRFTQHQNTVKELQIQLELKSKEAYEKDEQINLLKEELDQQNKRFDCLKGEMEDDKSKMEKKESNLETELKSQTARIMELEDHITQKTIEIESLNEVLKNYNQQKDIEHKELVQKLQHFQELGEEKDNRVKEAEEKILTLENQVYSMKAELETKKKELEHVNLSVKSKEEELKALEDRLESESAAKLAELKRKAEQKIAAIKKQLLSQMEEKEEQYKKGTESHLSELNTKLQEREREVHILEEKLKSVESSQSETLIVPRSAKNVAAYTEQEEADSQGCVQKTYEEKISVLQRNLTEKEKLLQRVGQEKEETVSSHFEMRCQYQERLIKLEHAEAKQHEDQSMIGHLQEELEEKNKKYSLIVAQHVEKEGGKNNIQAKQNLENVFDDVQKTLQEKELTCQILEQKIKELDSCLVRQKEVHRVEMEELTSKYEKLQALQQMDGRNKPTELLEENTEEKSKSHLVQPKLLSNMEAQHNDLEFKLAGAEREKQKLGKEIVRLQKDLRMLRKEHQQELEILKKEYDQEREEKIKQEQEDLELKHNSTLKQLMREFNTQLAQKEQELEMTIKETINKAQEVEAELLESHQEETNQLLKKIAEKDDDLKRTAKRYEEILDAREEEMTAKVRDLQTQLEELQKKYQQKLEQEENPGNDNVTIMELQTQLAQKTTLISDSKLKEQEFREQIHNLEDRLKKYEKNVYATTVGTPYKGGNLYHTDVSLFGEPTEFEYLRKVLFEYMMGRETKTMAKVITTVLKFPDDQTQKILEREDARLMFTSPRSGIF

SEQ ID NO: 35992 - protein, 445 aa, Homo sapiens
  Payload ID: 7110
  Gene Symbol: GOLGA4
  Gene Name: golgin A4
  ENSP ID: ENSP00000387633
MFKKLKQKISEEQQQLQQALAPAQASSNSSTPTRMRSRTSSFTEQLDEGTPNRENASTHASKSPDSVNGSEPSIPQSGDTQSFAQKLQLRVPSVESLFRSPIKESLFRSSSKESLVRTSSRESLNRLDLDSSTASFDPPSDMDSEAEDLVGNSDSLNKEQLIQRLRRMERSLSSYRGKYSEGILSQSQDKSLRRIAELRELQMDQQAKKHLQEEFDASLEEKDQYISVLQTQVSLLKQRLRNGPMNVDVLKPLPQLEPQAEVFTKEENPESDGEPVVEDGTSVKTLETLQQRVKRQENLLKRCKETIQSHKEQCTLLTSEKEALQEQLDERLQELEKIKDLHMAEKTKLITQLRDAKNLIEQLEQDKGMVIAETKRQMHETLEMKEEEIAQLRSRIKQMTTQGEELREQKEKSERAAFEELEKALSTAQKTEEARRKLKAEMDEQ

SEQ ID NO: 35993 - protein, 118 aa, Homo sapiens
  Payload ID: 7110
  Gene Symbol: GOLGA4
  Gene Name: golgin A4
  ENSP ID: ENSP00000392907
MFKKLKQKISEEQQQLQQALAPAQASSNSSTPTRMRSRTSSFTEQLDEGTPNRELLAGMIAEPAFLSEYTIFALDSSKHPKTQSDSVNASTHASKSPDSVNGSEPSIPQSGDTQSFAQ

SEQ ID NO: 35994 - protein, 585 aa, Homo sapiens
  Payload ID: 7110
  Gene Symbol: GOLGA4
  Gene Name: golgin A4
  ENSP ID: ENSP00000403009
MFKKLKQKISEEQQQLQQALAPAQASSNSSTPTRMRSRTSSFTEQLDEGTPNRENASTHASKSPDSVNGSEPSIPQEKSQSEYLKISQEKEQQESLALEELELQKKAILTESENKLRDLQQEAETYRTRILELESSLEKSLQENKNQSKDLAVHLEAEKNKHNKEITVMVEKHKTELESLKHQQDALWTEKLQVLKQQYQTEMEKLREKCEQEKETLLKDKEIIFQAHIEEMNEKTLEKLDVKQTELESLSSELSEVLKARHKLEEELSVLKDQTDKMKQELEAKMDEQKNHHQQQVDSIIKEHEVSIQRTEKALKDQINQLELLLKERDKHLKEHQAHVENLEADIKRSEGELQQASAKLDVFQSYQSATHEQTKAYEEQLAQLQQKLLDLETERILLTKQVAEVEAQKKDVCTELDAHKIQVQDLMQQLEKQNSEMEQKVKSLTQVYESKLEDGNKEQEQTKQILVEKENMILQMREGQKKEIEILTQKLSAKEDSIHILNEEYETKFKNQEKKMEKVKQKAKEMQETLKKKLLDQEAKLKKELENTALELSQKEKQFNAKMLEMAQANSAGISDAVSRLETN

SEQ ID NO: 35995 - protein, 2099 aa, Homo sapiens [sequence omitted]

SEQ ID NO: 35996 - protein, 166 aa, Homo sapiens
  Payload ID: 7110
  Gene Symbol: GOLGA4
  Gene Name: golgin A4
  ENSP ID: ENSP00000406894
MFKKLKQKISEEQQQLQQALAPAQASSNSSTPTRMRSRTSSFTEQLDEGTPNRESGDTQSFAQKLQLRVPSVESLFRSPIKESLFRSSSKESLVRTSSRESLNRLDLDSSTASFDPPSDMDSEAEDLVGNSDSLNKEQLIQRLRRMERSLSSYRGKYSESWLRSSS

SEQ ID NO: 35997 - protein, 218 aa, Homo sapiens [sequence omitted]

SEQ ID NO: 35998 - protein, 731 aa, Homo sapiens
  Payload ID: 7111
  Gene Symbol: GOLGA5
  Gene Name: golgin A5
  Uniprot ID: Q8TBA6
  ENSP ID: ENSP00000163416
MSWFVDLAGKAEDLLNRVDQGAATALSRKDNASNIYSKNTDYTELHQQNTDLIYQTGPKSTYISSAADNIRNQKATILAGTANVKVGSRTPVEASHPVENASVPRPSSHFVRRKKSEPDDELLFDFLNSSQKEPTGRVEIRKEKGKTPVFQSSQTSSVSSVNPSVTTIKTIEENSFGSQTHEAASNSDSSHEGQEESSKENVSSNAACPDHTPTPNDDGKSHELSNLRLENQLLRNEVQSLNQEMASLLQRSKETQEELNKARARVEKWNADHSKSDRMTRGLRAQVDDLTEAVAAKDSQLAVLKVRLQEADQLLSTRTEALEALQSEKSRIMQDQSEGNSLQNQALQTFQERLHEADATLKREQESYKQMQSEFAARLNKVEMERQNLAEAITLAERKYSDEKKRVDELQQQVKLYKLNLESSKQELIDYKQKATRILQSKEKLINSLKEGSGFEGLDSSTASSMELEELRHEKEMQREEIQKLMGQIHQLRSELQDMEAQQVNEAESAREQLQDLHDQIAGQKASKQELETELERLKQEFHYIEEDLYRTKNTLQSRIKDRDEEIQKLRNQLTNKTLSNSSQSELENRLHQLTETLIQKQTMLESLSTEKNSLVFQLERLEQQMNSASGSSSNGSSINMSGIDNGEGTRLRNVPVLFNDTETNLAGMYGKVRKAASSIDQFSIRLGIFLRRYPIARVFVIIYMALLHLWVMIVLLTYTPEMHHDQPYGK

SEQ ID NO: 35999 - protein, 117 aa, Homo sapiens
  Payload ID: 7111
  Gene Symbol: GOLGA5
  Gene Name: golgin A5
  ENSP ID: ENSP00000452601
  MOD_RES (1)..(1): Any amino acid
XNKTLSNSSQSELENRLHQLTETLIQKQTMLESLSTEKNSLVFQLERLEQQMNSASGSSSNGSSINMSGIDNGEGTRLRNVPVLFNDTETNLAGMYGKVRKAASSIDQFRLCFTSGS

SEQ ID NO: 36000 - protein, 693 aa, Homo sapiens
  Payload ID: 7112
  Gene Symbol: GOLGA6A
  Gene Name: golgin A6 family, member A
  Uniprot ID: Q9NYA3
  ENSP ID: ENSP00000290438
MWPQPYLPPHPMMLEESRQNKLAAAKKKLKEYQQRKSPGIPAGAKTKKKKTDSSPETTTSGGCHSPGDSQYQELAVALESSSVTISQLNENIESLKQQKKQVEHQLEEAKKTNNEIHKAQMERLETINILTLEKADLKTTLYHTKRAARHFEEESKDLAGRLQYSLQRIQELERALCAVSTQQQEEDRSSSCREAVLQRWLQQTIKERALLNAHVTQVTESLKQVQLERDEYAKHIKGERARWQERMWKMSVEARTLKEEKKRDIHRIQELERSLSELKNQMAEPPSLAPPAVTSVVEQLQDEAKHLRQEVEGLEGKLQSQVENNQALSLLSKEQKQRLQEQEEMLREQEAQRVREQERLCEQNERLREQQKTLQEQGERLRKQEQRLRKQEERLRKEEERLQKQEKRLWDQEERLWKKEERLQKQEERLALSQNHKLDKQLAEPQCSFEDLNNEKKSALQLEQQVKELQEKLDEEHLEAASHQNQQLETQLSLVALPGEGDGGQHLDSEEEEAPRPTPNIPEDLESREATSSFMDLPKEKADGTEQVERRELGFVQPSGVTDGMRESFTVYESQGAVPNTRHQEMEDVIRLAQKEEEMKVKLLELQELVLPLVGNHEGHGKFLIAAQNPADEPTPGAPAPQELGAAGEQDVFYEVSLDNNVEPAPGAAREGSPHDNPTVQQIVQLSPVMQDT

SEQ ID NO: 36001 - protein, 693 aa, Homo sapiens
  Payload ID: 7113
  Gene Symbol: GOLGA6B
  Gene Name: golgin A6 family, member B
  Uniprot ID: A6NDN3
  ENSP ID: ENSP00000408132
MWPQPYLPPHPMMLEESRQNKLAAAKKKLKEYQQRKSPGIPAGAKTKKKKTDSSPETTTSGGGHSPGDSQYQELAVALESSSVTISQLNENIESLKQQKKQVEHQLEEAKKTNNEIHKAQMERLETINILTLEKADLKTTLYHTKRAARHFEEESKDLAGRLQYSLQRIQELERALCAVSTQQQEEDRSSSCREAVLHRRLQQTIKERALLNAHVTQVTESLKQVQLERDEYAKHIKGERARWQERMWKMSVEARTLKEEKKRDIHRIQELERSLSELKNQMAKPPSLAPPAVTSVVEQLQDEAKHLRQEVEGLEGKLQSQVENNQALSLLSKEQKQRLQEQEEMLREQEVQRVREQERLCEQNERLREQQKTLQEQGERLRKQEQRLRKQEERLRKEEERLQKQEKRLWDQEERLWKKEERLQKQEERLALSQNHKLDKQLAEPQCSFEDLNNEKKSALQLEQQVKELQEKLDEEHLEAASQQNQQLETQLSLVALPGEGDGGQHLDSEEEEAPRPTPNIPEDLESREATSSFMDLPKEKADGTEQVERRELGFVQPSGVTDGMRESFTVYESQGAVPNTRHQEMEDVIRLAQKEEEMKVKLLELQELVLPLVGNHEGHGKFLIAAQNPADEPTPGAPAPQELGAAGEQDDFYEVSLDNNVEPAPGAAREGSPHDNPTVQQIVQLSPVMQDT

SEQ ID NO: 36002 - protein, 693 aa, Homo sapiens
  Payload ID: 7114
  Gene Symbol: GOLGA6C
  Gene Name: golgin A6 family, member C
  Uniprot ID: A6NDK9
  ENSP ID: ENSP00000300576
MWPQPYLPPHPMMLEESRQNKLAAAKKKLKEYQQRKSPGIPAGAKTKKKKTDSSPETTTSGGGHSPGDSQYQELAVALESSSVTINQLNENIESLKQQKKQVEHQLEEAKKTNNEIHKAQMEQLETINILTLEKADLKTTLYHTKRAARHFEEESKDLAGRLQYSLQRIQELERALSAVSTQQQEEDRSSSCREAVLQRRLQQTIKERALLNAHVTQVTESLKQVQLERDEYAKHIKGERARWQERMWKMSVEARTLKEEKKRDIHRIQELERSLSELKNQMAEPPSLAPPAVTSVVEQLQDEAKHLRQEVEGLEGKLQSQVENNQALSLLSKEQKQRLQEQEEMLREQEAQRVREQERLCEQNERLREQQKTLQEQGERLRKQEQRLRKQEERLRKEEERLQKQEKRLWDQEERLWKKEERLQKQEERLALSQNHKLDKQLAEPQCSFEDLNNEKKSALQLEQQVKELQEKLDEEHLEAASQRNQQLETQLSLVALPGEGDGGQHLDSEEEEAPRPTPNIPEDLESREATSSFMDLPKEKADGTEQVERRELGFVQPSGVTDGMRESFTVYESQGAVPNTRHQEMEDVIRLAQKEEEMKVKLLELQELVLPLVGNHEGHGKFLIAAQNPADEPTPGAPAPQELGAAGEQDDFYEVSLDNNVEPAPGAAREGSPHDNPPVQQIVQLSPVMQDT

SEQ ID NO: 36003 - protein, 693 aa, Homo sapiens
  Payload ID: 7115
  Gene Symbol: GOLGA6D
  Gene Name: golgin A6 family, member D
  Uniprot ID: P0CG33
  ENSP ID: ENSP00000391085
MWPQPYLPPHPMMLEESRQNKLAAAKKKLKEYQQRKSPGIPAGAKTKKKKTDSSPETTTSGGGHSPGDSQYQELAVALESSSVTINQLNENIESLKQQKKQVEHQLEEAKKTNNEIHKAQMEQLETINILTLEKADLKTTLYHTKRAARHFEEESKDLAGRLQYSLQHIQELERALCAVSTQQQEEDRSSSCREAVLQRRLQQTIKERALLNAHVTQVTESLKQVQLERDEYAKHIKGERARWQERMWKMSVEARTLKEEKKRDIHRIQELERSLSELKNQMAEPPSLAPPAVTSVVEQLQDEAKHLRQEVEGLEGKLQSQVENNQALSLLSKEQKQRLQEQEEMLREQEAQRVREQERLCEQNERLREQQKTLQEQGERLRKQEQRLRKQEERLRKEEERLQKQEKRLWDQEERLWKKEERLQKQEERLALSQNHKLDKQLAEPQCSFEDLNNEKKSALQLEQQVKELQEKLDEEHLEAASQRNQQLETQLSLVALPGEGDGGQHLDSEEEEAPRPTPNIPEDLESREATSSFMDLPKEKADGTEQVERRELGFVQPSGVTDGMRESFTVYESQGAVPNTRHQEMEDVIRLAQKEEEMKVKLLELQELVLPLVGNHEGHGKFLIAAQNPADEPTPGAPAPQELGAAGEQDVFYEVSLDNNVEPAPGVAREGSPHNNPTVQQIVQLSPVMQDT

SEQ ID NO: 36004 - protein, 693 aa, Homo sapiens [sequence omitted]

SEQ ID NO: 36005 - protein, 668 aa, Homo sapiens
  Payload ID: 7116
  Gene Symbol: GOLGA6L1
  Gene Name: golgin A6 family-like 1
  ENSP ID: ENSP00000478478
MLMWPQPHLPTHPHLPTHPHLPTHPHLPTHPHLPTHPHLPTHPHLPTHPMMSKETRQSKLAEAKEQLTDHHPQTNPSVGTAASDTKKKKINNGTNPETTTSGGCHSPEDEQKASHQHQEALRRELEAQVHTIRILTCQKTELQMALYYSQHAVKQLEGEARDLISRLHDSWKFAGELEQALSAVATQKKKADRYIEELTKERDALSLELYRNTITDEELKEKNAKLQEKLQLVESEKSEIQLNVKELKRKLERAKLLLPQQQLQAEADHLGKELQSVSAKLQAQVEENELWNRLNQQQEEKMWRQEEKIQEWEEKIQEQEEKIREQEEKIREQEEKMRRQEEMMWEKEEKMRRQEEMMWEKEEKMRRLEEMMWEKEEKIRELEEKMHEQEKIREQEEKRQEEEKIREQEKRQEQEAKMWRQEEKIREQEEKIREQEKKMWRQEEKIHEQEKIREEEKRQEQEEMWRQEEKIREQEEIWRQKEKMHEQEKIRKQEEKVWRQEEKMHDQEEKIREQEEKMWRQEEKIREQEEKIREQEEKIREQEEMMQEQEEKMGEQEEKMQEQEKMRRQEEKIREQEEKIREQKEKIREQEEKIWEQEEKIREQEEMMQEQEEKMWEQEEKMCEQEEKMQEQEEKMRRQEEKMWEQEVRLRQQEEKMQEHQEHLEAAI

SEQ ID NO: 36006 - protein, 668 aa, Homo sapiens; identical to SEQ ID NO: 36005
  Payload ID: 7116
  Gene Symbol: GOLGA6L1
  Gene Name: golgin A6 family-like 1
  ENSP ID: ENSP00000482864

SEQ ID NO: 36007 - protein, 668 aa, Homo sapiens; identical to SEQ ID NO: 36005
  Payload ID: 7116
  Gene Symbol: GOLGA6L1
  Gene Name: golgin A6 family-like 1
  ENSP ID: ENSP00000483916

SEQ ID NO: 36008 - protein, 474 aa, Homo sapiens
  Payload ID: 7117
  Gene Symbol: GOLGA6L10
  Gene Name: golgin A6 family-like 10
  ENSP ID: ENSP00000478445
MWPQPRLPPHPAMSEKTQQGKLAAAKKKLKAYWQRKSPGIPAGANRKKKVNGSSPDTATSGGYHSPGDSATGVYGEGRASSTTLQDLESQYQELAVALDSSSAIISQLTENINSLVRTSKEEKKHEIHLVQKLGRSLFKLKNQTAEPLAPEPPAGPSKVEQLQDETNHLRKELESVGRQLQAEVENNQMLSLLNRRQEERLREQEERLHEQEERLHEQEERLLREQEERLCEQEERLREQEERLCEQEERLCEQEERLCEQEERLCEQEERLCEQEKLPGQERLLEEVEKLLEQERRQEEQERLLERERLLDEVEELLEQERLRQQDERLWQQETLRELERLRELERLRELERMLELGWEALYEQRAEPRSGFEELNNENKSTLQLEQQVKELEKSGGAEEPRGSESAAAARPVPGAPVPQGAWMCGQAGWTPQEHPGLSGEAVGTGEAAGGAEEAACHSFRAAENRELNITII

SEQ ID NO: 36009 - protein, 522 aa, Homo sapiens
  Payload ID: 7117
  Gene Symbol: GOLGA6L10
  Gene Name: golgin A6 family-like 10
  Uniprot ID: A6NI86
  ENSP ID: ENSP00000479362
MWPQPRLPPHPAMSEKTQQGKLAAAKKKLKAYWQRKSPGIPAGANRKKKVNGSSPDTATSGGYHSPGDSATGIYGEGRASSTTLQDLESQYQELAVALDSSSAIISQLTENINSLVRTSKEEKKHEIHLVQKLGRSLFKLKNQTAEPLAPEPPAGPSKVEQLQDETNHLRKELESVGRQLQAEVENNQMLSLLNRRQEERLREQEERLHEQEERLHEQEERLCEQEERLREQEERLCEQEERLREQEERLCEQEERLREQEERLCEQEERLREQEERLREQEERLCEQEERLCEQEERLREQEERLCEQEERLCEQEERLCEQEKLPGQERLLEEVEKLLEQERRQEEQERLLERERLLDEVEELLEQERLRQQDERLWQQETLRELERLRELERLRELERMLELGWEALYEQRAEPRSGFEELNNENKSTLQLEQQVKELEKSGGAEEPRGSESAAAARPVPGAPVPQGAWMCGQAGWTPQEHPGLSGEAVGTGEAAGGAEEAACHSFRAAENRELNITII

SEQ ID NO: 36010 - protein, 474 aa, Homo sapiens
  Payload ID: 7117
  Gene Symbol: GOLGA6L10
  Gene Name: golgin A6 family-like 10
  ENSP ID: ENSP00000481389
MWPQPRLPPHPAMSEKTQQGKLAAAKKKLKAYWQRKSPGIPAGANRKKKVNGSSPDTATSGGYHSPGDSATGIYGEGRASSTTLQDLESQYQELAVALDSSSAIISQLTENINSLVRTSKEEKKHEIHLVQKLGRSLFKLKNQTAEPLAPEPPAGPSKVEQLQDETNHLRKELESVGRQLQAEVENNQMLSLLNRRQEERLREQEERLHEQEERLHEQEERLLREQEERLCEQEERLREQEERLCEQEERLREQEERLCEQEERLCEQEERLCEQEKLPGQERLLEEVEKLLEQERRQEEQERLLERERLLDEVEELLEQERLRQQDERLWQQETLRELERLRELERLRELERMLELGWEALYEQRAEPRSGFEELNNENKSTLQLEQQVKELEKSGGAEEPRGSESAAAARPVPGAPVPQGAWMCGQAGWTPQEHPGLSGEAVGTGEAAGGAEEAACHSFRAAENRELNITII

SEQ ID NO: 36011 - protein, 475 aa, Homo sapiens
  Payload ID: 7117
  Gene Symbol: GOLGA6L10
  Gene Name: golgin A6 family-like 10
  ENSP ID: ENSP00000483647
MWPQPRLPPHPAMSEKTQQGKLAAAKKKLKAYWQRKSPGIPAGANRKKKVNGSSPDTATSGGYHSPGDSATGIYGEGRASSTTLQDLESQYQELAVALDSSSAIISQLTENINSLVRTSKEEKKHEIHLVQKLGRSLFKLKNQTAEPLAPEPPAGPSKVEQLQDETNHLRKELESVGRQLQAEVENNQMLSLLNRRQEERLREQEERLHEQEERLHEQEERLCEQEEERLCEQEERLREQEERLREQEEERLREQEERLCEQEERLCEQEERLCEQEKLPGQERLLEEVEKLLEQERRQEEQERLLERERLLDEVEELLEQERLRQQDERLWQQETLRELERLRELERLRELERMLELGWEALYEQRAEPRSGFEELNNENKSTLQLEQQVKELEKSGGAEEPRGSESAAAARPVPGAPVPQGAWMCGQAGWTPQEHPGLSGEAVGTGEAAGGAEEAACHSFRAAENRELNITII

SEQ ID NO: 36012 - protein, 439 aa, Homo sapiens
  Payload ID: 7117
  Gene Symbol: GOLGA6L10
  Gene Name: golgin A6 family-like 10
  ENSP ID: ENSP00000484254
MWPQPRLPPHPAMSEKTQQGKLAAAKKKLKAYWQRKSPGIPAGANRKKKVNGSSPDTATSGGYHSPGDSATGIYGEGRASSTTLQDLESQYQELAVALDSSSAIISQLTENINSLVRTSKEEKKHEIHLVQKLGRSLFKLKNQTAEPLAPEPPAGPSKVEQLQDETNHLRKELESVGRQLQAEVENNQMLSLLNRRQEERLREQEERLHEQEERLHEQEERLCEQEERLREQEERLLCEQEKLPGQERLLEEVEKLLEQERRQEEQERLLERERLLDEVEELLEQERLRQQDERLWQQETLRELERLRELERLRELERMLELGWEALYEQRAEPRSGFEELNNENKSTLQLEQQVKELEKSGGAEEPRGSESAAAARPVPGAPVPQGAWMCGQAGWTPQEHPGLSGEAVGTGEAAGGAEEAACHSFRAAENRELNITII

SEQ ID NO: 36013 - protein, 522 aa, Homo sapiens
  Payload ID: 7117
  Gene Symbol: GOLGA6L10
  Gene Name: golgin A6 family-like 10
  ENSP ID: ENSP00000487759
MWPQPRLPPHPAMSEKTQQGKLAAAKKKLKAYWQRKSPGIPAGANRKKKVNGSSPDTATSGGYHSPGDSATGVYGEGRASSTTLQDLESQYQELAVALDSSSAIISQLTENINSLVRTSKEEKKHEIHLVQKLGRSLFKLKNQTAEPLAPEPPAGPSKVEQLQDETNHLRKELESVGRQLQAEVENNQMLSLLNRRQEERLREQEERLHEQEERLHEQEERLCEQEERLREQEERLCEQEERLREQEERLCEQEERLREQEERLCEQEERLREQEERLCEQEERLREQEERLCEQEERLREQEERLCEQEERLCEQEERLCEQEKLPGQERLLEEVEKLLEQERRQEEQERLLERERLLDEVEELLEQERLRQQDERLWQQETLRELERLRELERLRELERMLELGWEALYEQRAEPRSGFEELNNENKSTLQLEQQVKELEKSGGAEEPRGSESAAAARPVPGAPVPQGAWMCGQAGWTPQEHPGLSGEAVGTGEAAGGAEEAACHSFRAAENRELNITII

SEQ ID NO: 36014 - protein, 536 aa, Homo sapiens
  Payload ID: 7117
  Gene Symbol: GOLGA6L10
  Gene Name: golgin A6 family-like 10
  ENSP ID: ENSP00000488730
MWPQPRLPPHPAMSEKTQQGKLAAAKKKLKAYWQRKSPGIPAGANRKKKVNGSSPDTATSGGYHSPGDSATGIYGEGRASSTTLQDLESQYQELAVALDSSSAIISQLTENINSLVRTSKEEKKHEIHLVQKLGRSLFKLKNQTAEPLAPEPPAGPSKVEQLQDETNHLRKELESVGRQLQAEVENNQMLSLLNRRQEERLREQEERLHEQEERLHEQEERLCEQEERLREQEERLCEQEERLREQEERLREQEERLREQEERLHEQEERLHEQEERLCEQEERLREQEERLCEQEERLREQEERLCEQEERLREQEERLCEQEERLCEQEERLCEQEKLPGQERLLEEVEKLLEQERRQEEQERLLERERLLDEVEELLEQERLRQQDERLWQQETLRELERLRELERLRELERMLELGWEALYEQRAEPRSGFEELNNENKSTLQLEQQVKELEKSGGAEEPRGSESAAAARPVPGAPVPQGAWMCGQAGWTPQEHPGLSGEAVGTGEAAGGAEEAACHSFRAAENRELNITII

SEQ ID NO: 36015 - protein, 414 aa, Homo sapiens
  Payload ID: 7118
  Gene Symbol: GOLGA6L2
  Gene Name: golgin A6 family-like 2
  Uniprot ID: Q8N9W4
  ENSP ID: ENSP00000307928
MSEKTRQNKLAEAKKKFTDYRQWNIAGVGTRATDTKKKKINNGTNPETTTSEGCHSPEDTQQNRAQLKEEKKASHQHQEALRREIEAQDHTIRILTCQKTELETALYYSQDAARKFEDGNLGTPSSFNLALSQAFRGSPLGCVSTSLIPGESKDLAGRLHHSWHFAGELQRALSAVSTWHKKADRYIEELTKERDALSLELYRNTITNEELKKKNAELQEKLRLAESEKSEIQLNVKELKRKLERAKFLLPQVQTNTLQEEMWRQEEELREQEKKIRKQEEKMWRQEERLREQEGKMREQEEKMRRQEEMREKEERIRDQKEKMQERLPEHEERCSEPCLPPSKVLCNMSHTGSVEPAGGEAGEGSPQDNPTAQEIMQLFCGMKNAQQCPGLGSTSCIPFFYRGDKRKMKIINI

SEQ ID NO: 36016 - protein, 314 aa, Homo sapiens
  Payload ID: 7118
  Gene Symbol: GOLGA6L2
  Gene Name: golgin A6 family-like 2
  ENSP ID: ENSP00000344626
MWRQEEELREQEKKIRKQEEKMWRQEERLREQEGKMREQEEKMRRQEKRLREQEKELREQEKELREQKKLREQEEQMQEQEEKMWEQEEKMREQEEKMWRQEERLWEQEKQMREQEQKMRDQEERMWEQDERLREKEERMREQEKMWEQVEKMREEKKMQEQEKKTRDQEEKMQEEERIREREKKMREEEETMREQEEKMQKQEENMWEQEEKEWQQQRLPEQKEKLWEQEKMQEQEEKIWEQEEKIRDQEEMWGQEKKMWRQEKMREQEDVGAGGDAREGGEDTRSEREDAGEAARARGAVLRALPPSLQSSL

SEQ ID NO: 36017 - protein, 909 aa, Homo sapiens
  Payload ID: 7118
  Gene Symbol: GOLGA6L2
  Gene Name: golgin A6 family-like 2
  ENSP ID: ENSP00000454407
MWPQPHLPPHPMMSEKTRQNKLAEAKKKFTDYRQWNIAGVGTRATDTKKKKINNGTNPETTTSEGCHSPEDTQQNRAQLKEEKKASHQHQEALRREIEAQDHTIRILTCQKTELETALYYSQDAARKFEDGNLGTPSSFNLALSQAFRGSPLGCVSTSLIPGESKDLAGRLHHSWHFAGELQRALSAVSTWHKKADRYIEELTKERDALSLELYRNTITNEELKKKNAELQEKLRLAESEKSEIQLNVKELKRKLERAKFLLPQVQTNTLQEEMWRQEEELREQEKKIRKQEEKMWRQEERLREQEGKMREQEEKMRRQEKRLREQEKELREQEKELREQKKLREQEEQMQEQEEKMWEQEEKMREQEEKMWRQEERLWEQEKQMREQEQKMRDQEERMWEQDERLREKEERMREQEKMWEQVEKMREEKKMQEQEKKTRDQEEKMQEEERIREREKKMREEEETMREQEEKMQKQEENMWEQEEKEWQQQRLPEQKEKLWEQEKMQEQEEKIWEQEEKIRDQEEMWGQEKKMWRQEKMREQEDVETGGEAAGAGEADVGAGGEDAGSGAEDVGPGGEDVGAGREAAGEGGENAGAEEDVAAGGEDAGGEEDAGAGEEDMGPGGEDARGGEDAGAGEEDAGGGGDDAGAGGEDAGAGREDAGAGGEDVGAGREDAGAGGEDVGAGGEDVGAGRRRCGSSRGCRNRRRSCGNTRRCRSRRSGAEDVGPEGEDVGAGREAAGEGGENAGAEDVAAGGEDAGEEEDAGGEDAGAAREDAGAGGDDVGAGREDAGAGGEDVGAGGEDAGAGGEDAGAGGEDAGPGGEDAGAGGEDAGPGGEDAGAGGEDAGPGGEDVGPGGEDVGAGGEDVGAGGDAREGGEDTRSEREDAGEAARARGAVLRALPPSLQSSL

SEQ ID NO: 36018 - protein, 208 aa, Homo sapiens
  Payload ID: 7118
  Gene Symbol: GOLGA6L2
  Gene Name: golgin A6 family-like 2
  ENSP ID: ENSP00000456523
MWPQPHLPPHPMMSEKTRQNKLAEAKKKFTDYRQWNIAGVGTRATDTKKKKINNGTNPETTTSEGCHSPEDEKKASHQHQEALRREIEAQDHTIRILTCQKTELETALYYSQDAARKFEDGNLGTPSSFNLALSQAFRGSPLGCVSTSLIPGESKDLAGRLHHSWHFAGELQRALSAVSTWHKKADRYIEELTKERDALSLELYRNTI

SEQ ID NO: 36019 - protein, 659 aa, Homo sapiens
  Payload ID: 7119
  Gene Symbol: GOLGA6L22
  Gene Name: golgin A6 family-like 22
  ENSP ID: ENSP00000482663
MLMWPQPHLPTHPHLPTHPHLPTHPPMMSKETRQSKLAEAKEQLTDHHPQTNPSVGTAASDTKKKKINNGTNPETTTSGGCHSPEDEQKASHQHQEALRRELEAQVHTIRILTCQKTELQMALYYSQHAVKQLEGEARDLISRLHDSWKFAGELEQALSAVATQKKKADRYIEELTKERDALSLELYRNTITDEELKEKNAKLQEKLQLVESEKSEIQLNVKELKRKLERAKLLLPQQQLQAEADHLGKELQSVSAKLQAQVEENELWNRLNQQQEEKMWRQEEKIQEWEEKIQEQEEKIREQEEKIREQEEKMRRQEEMMWEKEEKMRRQEEMMWEKEEKMRRQEEMMWEKEEKMRRLEEMMWEKEEKIRELEEKMHEQEKIREQEEKRQEEEKIREQEKRQEQEAKMWRQEEKIREQEEKIREQEKKMWRQEEKIHEQEKIREEEKRQEQEEMWRQEEKIREQEEIWRQKEKMHEQEKIRKQEEKVWRQEEKMHDQEEKIREQEEKMWRQEEKIREQEEKIREQEEKIREQEEMMQEQEEKMGEQEEKMQEQEKMRRQEEKIREQEEKIREQKEKIREQEEKIWEQEEKIREQEEMMQEQEEKMWEQEEKMCEQEEKMQEQEEKMRRQEEKMWEQEVRLRQQEEKMQEHQEHLEAAI

SEQ ID NO: 36020 - protein, 810 aa, Homo sapiens [sequence omitted]

SEQ ID NO: 36021 - protein, 716 aa, Homo sapiens
  Payload ID: 7119
  Gene Symbol: GOLGA6L22
  Gene Name: golgin A6 family-like 22
  ENSP ID: ENSP00000484257
MLMWPQPHLPTHPHLPTHPHLPTHPHLPTHPHLPTHPHLPTHPMMSKETRQSKLAEAKEQLTDHHPQTNPSVGTAASDTKKKKINNGTSPETTTSGGCHSPEDEQKASHQHQEALRRELEAQVHTIRILTCQKTELQMALYYSQHAVKQLEGEARDLISRLHDSWKFAGELEQALSAVTTQKKKADRYIEELTKERDALSLELYRNTITDEELKEKNAKLQEKLQLVESEKSEIQLNVKELKRKLERAKLLLPQQQLQAEADHLGKELQSVSAKLQAQVEENELWNRLNQQQEEKMWRQEEKIQEWEEKIQEQEEKIREQEEKIREQEEKMRRQEEMMWEKEEKMRRQEEMMWEKEEKIRELEEKMHEQEKIREQEEKRQEEEKIREQEKRQEQEAKMWRQEEKIREQEEKIREQEKKMWRQEEKIHEQEKIREEEKRQEQEEMWRQEEKIREQEEIWRQKEKMHEQEEKIRKQEEKVWRQEEKMHDQEEKIREQEEKVWRQEEKIREQEEMWREEEKMHEQEKIWEEEKRQEQEDKMWRQEEKIREQEEKVWRQEEKIREQEEKRQEQEEKMWKQEEKIREQEEKIREQEEKIREQEEKIREQEEMMQEQEEKMGEQEEKMGEQEEKMQEQEEKMRRQEEKIREQEKKIREQEEKIREQEEMMQEQEEKMWEQEEKMCEQEEKMQEQEEKMRRQEEKMWEQEVRLRQQEEKMQEH

SEQ ID NO: 36022 - protein, 632 aa, Homo sapiens
  Payload ID: 7119
  Gene Symbol: GOLGA6L22
  Gene Name: golgin A6 family-like 22
  ENSP ID: ENSP00000486963
MMSKETRQSKLAEAKEQLTDHHPQTNPSVGTAASDTKKKKINNGTNPETTTSGGCHSPEDEQKASHQHQEALRRELEAQVHTIRILTCQKTELQMALYYSQHAVKQLEGEARDLISRLHDSWKFAGELEQALSAVATQKKKADRYIEELTKERDALSLELYRNTITDEELKEKNAKLQEKLQLVESEKSEIQLNVKELKRKLERAKLLLPQQLQAEADHLGKELQSVSAKLQAQVEENELWNRLNQQQEEKMWRQEEKIQEWEEKIQEQEEKIREQEEKIREQEEKMRRQEEMMWEKEEKMRRQEEMMWEKEEKMRRQEEMMWEKEEKMRRLEEMMWEKEEKIRELEEKMHEQEKIREQEEKRQEEEKIREQEKRQEQEAKMWRQEEKIREQEEKIREQEKKMWRQEEKIHEQEKIREEEKRQEQEEMWRQEEKIREQEEIWRQKEKMHEQEKIRKQEEKVWRQEEKMHDQEEKIREQEEKMWRQEEKIREQEEKIREQEEKIREQEEMMQEQEEKMGEQEEKMQEQEKMRRQEEKIREQEEKIREQKEKIREQEEKIWEQEEKIREQEEMMQEQEEKMWEQEEKMCEQEEKMQEQEEKMRRQEEKMWEQEVRLRQQEEKMQEHQEHLEAAI

SEQ ID NO: 36023 - protein, 438 aa, Homo sapiens
  Payload ID: 7120
  Gene Symbol: GOLGA6L4
  Gene Name: golgin A6 family-like 4
  ENSP ID: ENSP00000389305
MWPQPRFPPHPAMSEKTQQGKLAAAKKKLKAYWQRKSPGIPAGANRKKKINGSSPDTATSGGYHSPGDSATGIYGEGRASSTTLEDLESQYQELAVALDSSSAIISQLTENINSLVRTSKEEKKHEIHLVQKLGRSLFKLKNQTAEPLAPEPPAGPSKVEQLQDETNHLRKELESVGRQLQAEVENNQMLSLLNRRQEERLREQEERLREQEERLREQEERLCEQEERLREQEERLCEQEKLPGQERLLEEVEKLLEQERRQEEQERLLERERLLEEVEELLEQERLRQQDERLWQQETLQELERLRELERLRELERMLELGWEALYEQRAEPRSGFEELNNENKSTLQLEQQVKELKKSGGAEEPRGSESAAAARPVAGAPVPQGAWMCGQAGWTPQEHPGLSGEAVGTGEAAGGAGEAACHSFRAAENRELNITII

SEQ ID NO: 36024 - protein, 574 aa, Homo sapiens
  Payload ID: 7120
  Gene Symbol: GOLGA6L4
  Gene Name: golgin A6 family-like 4
  Uniprot ID: A6NEF3
  ENSP ID: ENSP00000421586
MWPQPRFPPHPAMSEKTQQGKLAAAKKKLKAYWQRKSPGIPAGANRKKKINGSSPDTATSGGYHSPGDSATGIYGEGRASSTTLEDLESQYQELAVALDSSSAIISQLTENINSLVRTSKEEKKHEIHLVQKLGRSLFKLKNQTAEPLAPEPPAGPSKVEQLQDETNHLRKELESVGRQLQAEVENNQMLSLLNRRQEERLREQEERLREQEERLREQEDRLHEQEERLREQEERLCEQEERLREHEERLCEQEERLCEQEERLREQEERLHEQEERLREQEERLCEQEERLREQEERLCEQEERLREQEERLCEQEKLPGQERLLEEVEKLLEQERRQEEQERLLERERLLEEVEKLLEQERQQEEQERLLERERLLEEVEKLLEQERRQEEQERLLERERLLDEVEELLDEVEELLEQERLRQQDERLWQQETLQELERLRELERLRELERMLELGWEALYEQRAEPRSGFEELNNENKSTLQLEQQVKELKKSGGAEEPRGSESAAAARPVAGAPVPQGAWMCGQAGWTPQEHPGLSGEAVGTGEAAGGAGEAACHSFRAAENRELNITII

SEQ ID NO: 36025 - protein, 194 aa, Homo sapiens
  Payload ID: 7120
  Gene Symbol: GOLGA6L4
  Gene Name: golgin A6 family-like 4
  ENSP ID: ENSP00000426395
LKAYWQRKSPGIPAGANRKKKINGSSPDTATSGGYHSPGDSATGIYGEGRASSTTLEDLESQYQELAVALDSSSAIISQLTENINSLVRTSKEEKKHEIHLVQKLGRSLFKLKNQTGGAEEPRGSESAAAARPVAGAPVPQGAWMCGQAGWTPQEHPGLSGEAVGTGEAAGGAGEAACHSFRAAENRELNITII

SEQ ID NO: 36026 - protein, 724 aa, Homo sapiens
  Payload ID: 7121
  Gene Symbol: GOLGA6L6
  Gene Name: golgin A6 family-like 6
  ENSP ID: ENSP00000480376
MLMWPQPHLPTHPHLPTHPHLPTHPHLPTHPHLPTHPMMSKETRQSKLAEAKEQLTDHHPQTNPSVGTAASDTKKKKINNGTNPETTTSGGCHSPEDEQKASHQHQEALRRELEAQVHTIRILTCQKTELQMALYYSQHAVKQLEGEARDLISRLHDSWKFAGELEQALSAVATQKKKADRYIEELTKERDALSLELYRNTITDEELKEKNAELQEKLQLVESEKSEIQLNVKELKRKLERAKLLLPQQQLQAEADHLGKELQSVSAKLQAQVEENELWNRLNQQQEEKMWRQEEKIQEWEEKIQEQEEKIREQEEKIREQEEKMRRQEEMMWEKEEKMRRQEEMMWEKEEKMRRQEEMMWEKEEKIRELEEKMHEQEKIREQEEKRQEEEKIREQEKRQEQEAKMWRQEEKIREQEEKIREQEKKMWRQEEKIHEQEKIREEEKRQEQEEMWRQEEKIREQEEIWRQKEKMHEQEEKIRKQEEKVWRQEEKIREQEEKIREQEEKMWRQEEKIREQEEMWREEEKMHEQEKIWEEEKRQEQEDKMWRQEEKIREQEEKVWRQEEKIREQEEKRQEQEEKMWKQEEKIREQEEKIREQEEKIREQEEKIREQEEMTQEQEEKMGEQEEKMCEQEEKMQEQEETMWRQEEKIREQEKKIREQEEKIREQEEMMQEQEEKMWEQEEKMCEQEEKMQEQEEKMRRQEEKMWEQEVRLRQQEEKMQEH

SEQ ID NO: 36027 - protein, 432 aa, Homo sapiens
  Payload ID: 7122
  Gene Symbol: GOLGA6L9
  Gene Name: golgin A6 family-like 9
  Uniprot ID: A6NEM1
  ENSP ID: ENSP00000479589
MWPQPRLPPHPAMSEKTQQGKLAAAKKKLKAYWQRKSPGIPAGANRKKKVNGSSPDTATSGGYHSPGDSATGIYGEGRASSTTLQDLESQYQELAVALDSSSAIISQLTENINSLVRTSKEEKKHEIHLVQKLGRSLFKLKNQTAEPLAPQPPAGPSKVEQLQDETNHLRKELESVGRQLQAEVENNQMLSLLNRRQEERLREQEERLREQEERLCEQEERLCEQEERLREQEERLCEQEKLPGQERLLEEVEKLLKQERRQEEQERLLERERLLDEVEELLEQERLRQQDERLWQQETLRELERLRELERMLELGWEALYEQRAEPRSGFEELNNENKSTLQLEQQVKELEKSGGAEEPRGSESAAAARPVPGAPVPQGAWMCGQAGWTPQEHPGLSGEAVGTGEAAGGAGEAACHSFRAAENRELNITII

SEQ ID NO: 36028 - protein, 432 aa, Homo sapiens
  Payload ID: 7122
  Gene Symbol: GOLGA6L9
  Gene Name: golgin A6 family-like 9
  Uniprot ID: A6NEM1
  ENSP ID: ENSP00000481078
MWPQPRLPPHPAMSEKTQQGKLAAAKKKLKAYWQRKSPGIPAGANRKKKINGSSPDTFTSGGYHSPGDSATGIYGEGRASSTTLQDLESQYQELAVALDSSSAIISQLTENINSLVRTSKEEKKHEIHLVQKLGRSLFKLKNQTAEPLAPQPPAGPSKMEQLQDETNHLRKELESVGRQLQAEVENNQMLSLLNRRQEERLREQEERLREQEERLCEQEERLCEQEERLREQEERLCEQEKLPGQERLLEEVEKLLEQERRQEEQERLLERERLLDEVEELLEQERLRQQDERLWQQETLRELERLRELERMLELGWEALYEQRAEPRSGFEELNNENKSTLQLEQQVKELEKSGGAEEPRGSESAAAARPVAGAPVPQGAWMCGQAGWTPQEHPGLSGEAVGTGEAAGGAGEAACHSFRAAENRELNITII

SEQ ID NO: 36029 - protein, 137 aa, Homo sapiens
  Payload ID: 7123
  Gene Symbol: GOLGA7
  Gene Name: golgin A7
  Uniprot ID: Q7Z5G4
  ENSP ID: ENSP00000350378
MRPQQAPVSGKVFIQRDYSSGTRCQFQTKFPAELENRIDRQQFEETVRTLNNLYAEAEKLGGQSYLEGCLACLTAYTIFLCMETHYEKVLKKVSKYIQEQNEKIYAPQGLLLTDPIERGLRVIEITIYEDRGMSSGR

SEQ ID NO: 36030 - protein, 134 aa, Homo sapiens
  Payload ID: 7123
  Gene Symbol: GOLGA7
  Gene Name: golgin A7
  Uniprot ID: Q7Z5G4
  ENSP ID: ENSP00000386030
MRPQQAPVSGKVFIQRDYSSGTRCQFQTKFPAELENRIDRQQFEETVRTLNNLYAEAEKLGGQSYLEGCLACLTAYTIFLCMETHYEKVLKKVSKYIQEQNEKIYAPQGLLLTDPIERGLRVFRLKLPFMKTEA

SEQ ID NO: 36031 - protein, 137 aa, Homo sapiens; identical to SEQ ID NO: 36029
  Payload ID: 7123
  Gene Symbol: GOLGA7
  Gene Name: golgin A7
  Uniprot ID: Q7Z5G4
  ENSP ID: ENSP00000429329

SEQ ID NO: 36032 - protein, 137 aa, Homo sapiens; identical to SEQ ID NO: 36029
  Payload ID: 7123
  Gene Symbol: GOLGA7
  Gene Name: golgin A7
  Uniprot ID: Q7Z5G4
  ENSP ID: ENSP00000429480

SEQ ID NO: 36033 - protein, 167 aa, Homo sapiens
  Payload ID: 7124
  Gene Symbol: GOLGA7B
  Gene Name: golgin A7 family, member B
  Uniprot ID: Q2TAP0
  ENSP ID: ENSP00000359634
MATEVHNLQELRRSASLATKVFIQRDYSDGTICQFQTKFPPELDSRIERQLFEETVKTLNGFYAEAEKIGGSSYLEGCLACATAYFIFLCMETHYEKVLKKISRYIQEQNEKIFAPRGLLLTDPVERGMRVIEISIYEDRCSSGSSSSGSSSGSGSSSGGGGGAGAR

SEQ ID NO: 36034 - protein, 166 aa, Homo sapiens
  Payload ID: 7124
  Gene Symbol: GOLGA7B
  Gene Name: golgin A7 family, member B
  ENSP ID: ENSP00000471396
SPQVHNLQELRRSASLATKVFIQRDYSDGTICQFQTKFPPELDSRIERQLFEETVKTLNGFYAEAEKIGGSSYLEGCLACATAYFIFLCMETHYEKVLKKISRYIQEQNEKIFAPRGLLLTDPVERGMRVIEISIYEDRCSSGSSSSGSSSGSGSSSGGGGGAGAR

SEQ ID NO: 36035 - protein, 632 aa, Homo sapiens
  Payload ID: 7125
  Gene Symbol: GOLGA8O
  Gene Name: Golgin A8 family member O
  ENSP ID: ENSP00000488291
MAEETQHNKLAAAKKKLKEYWQKNRPRVPAGVNRNRKTNGSIPETATSGGCQPPGDSATGFHREGPTSSATLKDLESPCQERAVVLDSTSVKISRLKNTIKSLKQQKKQVEHQLEEEKKANNERQKAERELEVQIQTLIIQKEELNTDLYHMERSLRYFEEESKDLAVRLQHSLQCKGELERALSAVIATEKKKANQLSSCSKAHTEWELEQSLQDQALLKAQLTQLKESFQQLQLERDECAEHIEGERARWHQRMSKMLQEICTLKKEKQQDMRRVEELERSLSKLKNQMAEPLPPEPPAVPSEVELQHLRKELERVAGELQSQVKNNQHISLLNRRQEERIREQEERLRKQEERLQEQHEKLRQLAKPQSVFEELNNENKSTLQLEQQVKELQEKLGEEHLEAASQQNQQLTAQLNLMALPGEGHGGEHLDSEGEEAPQPMPSVPEDPESREAMSSFMDHLKEKADLSELVKKQELRFIQYWQERCHQKIHHLLSEPGGRAKDAALGGGHHQAGAQGGDEGEAAGAAADGIAAYSNYNNGHRKFLAAAHNSADEPGPGAPAPQELGAADKHGDLREVTLTSSAQGEAREDPLLDKPTAQPIVQDHQEHPGLGSNCCVPLFCWAWLPRRRR

SEQ ID NO: 36036 - protein, 603 aa, Homo sapiens
  Payload ID: 7126
  Gene Symbol: GOLGA8A
  Gene Name: golgin A8 family, member A
  Uniprot ID: A7E2F4
  ENSP ID: ENSP00000352111
MAEETGQSKLAAAKKKFKEYWQRNRPGVPAAAKRNTKANGSSPETAASGGCHSSEASSSASSSLHARQSPCQEQAAVLNSRSIKISRLNDTIKSLKQQKKQVEHQLEEEKKANNEKQKAERELEGQIQRLNTEKKKLNTDLYHMKHSLRYFEEESKDLAGRLQRSSQRIGELEWSLCAVAATQKKKPDGFSSRSKALLKRQLEQSIREQILLKGHVTQLKESLKEVQLERDQYAEQIKGERAQWQQRMRKMSQEVCTLKEEKKHDTHRVEELERSLSRLKNQMAEPLPPDAPAVSSEVELQDLRKELERVAGELQAQVENNQCISLLNRGQKERLREQEERLQEQQERLREREKRLQQLAEPQSDLEELKHENKSALQLEQQVKELQEKLGQVMETLTSAEKEPEAAVPASGTGGESSGLMDLLEEKADLREHVEKLELGFIQYRRERCHQKVHRLLTEPGDSAKDASPGGGHHQAGPGQGGEEGEAAGAAGDGVAACGSYSEGHGKFLAAARNPAAEPSPGAPAPQELGAADKHGDLCEASLTNSVEPAQGEAREGSSQDNPTAQPVVQLLGEMQDHQEHPGLGSNCCVPCFCWAWLPRRRR

SEQ ID NO: 36037 - protein, 631 aa, Homo sapiens
  Payload ID: 7126
  Gene Symbol: GOLGA8A
  Gene Name: golgin A8 family, member A
  Uniprot ID: A7E2F4
  ENSP ID: ENSP00000402791
MLPVDGEERKSEGSDTEGDRTSPCAVSSATLKDLEVGGSGRRCSDPAGQPSNLLPQRGLGAPLPAETAHTQPSPNDRSLYLSPKSSSASSSLHARQSPCQEQAAVLNSRSIKISRLNDTIKSLKQQKKQVEHQLEEEKKANNEKQKAERELEGQIQRLNTEKKKLNTDLYHMKHSLRYFEEESKDLAGRLQRSSQRIGELEWSLCAVAATQKKKPDGFSSRSKALLKRQLEQSIREQILLKGHVTQLKESLKEVQLERDQYAEQIKGERAQWQQRMRKMSQEVCTLKEEKKHDTHRVEELERSLSRLKNQMAEPLPPDAPAVSSEVELQDLRKELERVAGELQAQVENNQCISLLNRGQKERLREQEERLQEQQERLREREKRLQQLAEPQSDLEELKHENKSALQLEQQVKELQEKLGQVMETLTSAEKEPEAAVPASGTGGESSGLMDLLEEKADLREHVEKLELGFIQYRRERCHQKVHRLLTEPGDSAKDASPGGGHHQAGPGQGGEEGEAAGAAGDGVAACGSYSEGHGKFLAAARNPAAEPSPGAPAPQELGAADKHGDLCEASLTNSVEPAQGEAREGSSQDNPTAQPVVQLLGEMQDHQEHPGLGSNCCVPCFCWAWLPRRRR

SEQ ID NO: 36038 - protein, 603 aa, Homo sapiens
  Payload ID: 7127
  Gene Symbol: GOLGA8B
  Gene Name: golgin A8 family, member B
  Uniprot ID: A8MQT2
  ENSP ID: ENSP00000343064
MAEETGQSKLAAAKKKFKEYWQRNRPGVPAAAKRNTKANGSSPETAASGGCHSSEASSSASSSLHARQSPCQEQAAVLNSRSIKISRLNDTIKSLKQQKKQVEHQLEEEKKANNEKQKAERELEGQIQRLNTEKKKLNTDLYHMKHSLRYFEEESKDLAGRLQRSSQRIGELEWSLCAVAATQKKKPDGFSSRSKALLKRQLEQSIREQILLKGHVTQLKESLKEVQLERDQYAEQIKGERAQWQQRMRKMSQEVCTLKEEKKHDTHRVEELERSLSRLKNQMAEPLPPDAPAVSSEVELQDLRKELERVAGELQAQVENNQCISLLNRGQKERLREQEERLQEQQERLREREKRLQQLAEPQSDLEELKHENKSALQLEQQVKELQEKLGQVMETLTSAEKEPEAAVPASGTGGESSGLMDLLEEKADLREHVEKLELGFIQYRRERCHQKVHRLLTEPGDSAKDASPGGGHHQAGPGQGGEEGEAAGAAGDGVAACGSYSEGHGKFLAAARNPAAEPSPGAPAPQELGAADKHGDLCEASLTNSVEPAQGEAREGSSQDNPTAQPVLQLLGEMQDHQEHPGLGSNCCVPCFCWAWLPRRRR

SEQ ID NO: 36039 - protein, 633 aa, Homo sapiens
  Payload ID: 7127
  Gene Symbol: GOLGA8B
  Gene Name: golgin A8 family, member B
  ENSP ID: ENSP00000400063
MLPVDGEERKSEGSDTEGDRTSPCAGPTSSATLKDLEVGGSGWRCSDPAGQPSNLLPQRGLGAPLPAETAHTQPSPNDRSLYLSPKSSSASSSLHARQSPCQEQAAVLNSRSIKISRLNDTIKSLKQQKKQVEHQLEEEKKANNEKQKAERELEGQIQRLNTEKKKLNTDLYHMKHSLRYFEEESKDLAGRLQRSSQRIGELEWSLCAVAATQKKKPDGFSSRSKALLKRQLEQSIREQILLKGHVTQLKESLKEVQLERDQYAEQIKGERAQWQQRMRKMSQEVCTLKEEKKHDTHRVEELERSLSRLKNQMAEPLPPDAPAVSSEVELQDLRKELERVAGELQAQVENNQCISLLNRGQKERLREQEERLQEQQERLREREKRLQQLAEPQSDLEELKHENKSALQLEQQVKELQEKLGQVMETLTSAEKEPEAAVPASGTGGESSGLMDLLEEKADLREHVEKLELGFIQYRRERCHQKVHRLLTEPGDSAKDASPGGGHHQAGPGQGGEEGEAAGAAGDGVAACGSYSEGHGKFLAAARNPAAEPSPGAPAPQELGAADKHGDLCEASLTNSVEPAQGEAREGSSQDNPTAQPVLQLLGEMQDHQEHPGLGSNCCVPCFCWAWLPRRRR

SEQ ID NO: 36040 - protein, 648 aa, Homo sapiens
  Payload ID: 7128
  Gene Symbol: GOLGA8F
  Gene Name: golgin A8 family, member F
  ENSP ID: ENSP00000454322
MWPQARLPPHPAMAEETRQSKLAAAKRKLKEYWQRNSPGVPAGAKRNRKTNGSIHETATSGGCHSPGDSATGIHGESPTSSATLKDLESPCQELAVVPDSRSVKVSQLKNTIKSLKQQNKQVEHQLEEEKKANNEKQKAERELEVQIQRLNIQKGKLNTDLYHTKRSLRYFEEESKDLAVRLQHSLQRKGELERALSAVTATQKKKAERQFSSRSKARMEWKLEQSMREQALLKAQLTQLKESLKEVQLERDEYAEHLKGERARWQQRMRKMSQEVCSLKKEKKHDKYRVEKLERSLSKLKHQMAEPLPPEPPAVPSEVELQHLRKELERVAGELQAQVEYNQRISLLNEGQKERLREQEERLQEQQERLPEQEERLQQLAEPQNSFKELNNENKSVLQLEQQVKELQEKLGKERLEAASQQKQQLTAQLSLMALPGEGDGGGHLDSEGEEAPRPIPSIPQDLESREAMSGFMDHLEEKADLSELVEKEELGFFQYYRERCHQKVYHPITKPGGSAKDAAPGGGHHQAGPGQGGDEGEAAGAAGDGVAAGGDYKGHSKFLVTAQNPAHEPSPGAPAPQELGAAHKHGDLCEVSLTDSVEPVQGEAREGSPHDNPTAQPIVQDHQEHPGLGSNCCVPFFCWAWLPRRRR

SEQ ID NO: 36041 - protein, 430 aa, Homo sapiens
  Payload ID: 7128
  Gene Symbol: GOLGA8F
  Gene Name: golgin A8 family, member F
  Uniprot ID: Q08AF8
  ENSP ID: ENSP00000456138
MEWKLEQSMREQALLKAQLTQLKESLKEVQLERDEYAEHLKGERARWQQRMRKMSQEVCSLKKEKKHDKYRVEKLERSLSKLKHQMAEPLPPEPPAVPSEVELQHLRKELERVAGELQAQVEYNQRISLLNEGQKERLREQEERLQEQQERLPEQEERLQQLAEPQNSFKELNNENKSVLQLEQQVKELQEKLGKERLEAASQQKQQLTAQLSLMALPGEGDGGGHLDSEGEEAPRPIPSIPQDLESREAMSGFMDHLEEKADLSELVEKEELGFFQYYRERCHQKVYHPITKPGGSAKDAAPGGGHHQAGPGQGGDEGEAAGAAGDGVAAGGDYKGHSKFLVTAQNPAHEPSPGAPAPQELGAAHKHGDLCEVSLTDSVEPVQGEAREGSPHDNPTAQPIVQDHQEHPGLGSNCCVPFFCWAWLPRRRR

SEQ ID NO: 36042 - protein, 430 aa, Homo sapiens
  Payload ID: 7128
  Gene Symbol: GOLGA8F
  Gene Name: golgin A8 family, member F
  ENSP ID: ENSP00000483042
MEWKLEQSMREQALLKAQLTQLKESLKEVQLERDEYAEHLKGERARWQQRMRKMSQEVCSLKKEKKHDKYRVEKLERSLSKLKHQMAEPLPPEPPAVPSEVELQHLRKELERVAGELQAQVEYNQRISLLNEGQKERLREQEERLQEQQERLPEQEERLQQLAEPQNSFKELNNENKSVLQLEQQVKELQEKLGKERLEAASQQNQQLTAQLSLMALPGEGDGGGHLDSEGEEAPRPIPSIPQDLESREAMSGFMDHLEEKADLSELVEKEELGFFQYYRERCHQKVYHPITKPGGSAKDAAPGGGHHQAGPGQGGDEGEAAGAAGDGVAAGGDYKGHSKFLVTAQNPAHEPSPGAPAPQELGAAHKHGDLCEVSLTDSVEPVQGEAREGSPHDNPTAQPIVQDHQEHPGLGSNCCVPFFCWAWLPRRRR

SEQ ID NO: 36043 - protein, 648 aa, Homo sapiens
  Payload ID: 7128
  Gene Symbol: GOLGA8F
  Gene Name: golgin A8 family, member F
  ENSP ID: ENSP00000483530
MWPQARLPPHPAMAEETRQSKLAAAKRKLKEYWQRNSPGVPAGAKRNRKTNGSIHETATSGGCHSPGDSATGIHGESPTSSATLKDLESPCQELAVVPDSRSVKVSQLKNTIKSLKQQNKQVEHQLEEEKKANNEKQKAERELEVQIQRLNIQKGKLNTDLYHTKRSLRYFEEESKDLAVRLQHSLQRKGELERALSAVTATQKKKAERQFSSRSKARMEWKLEQSMREQALLKAQLTQLKESLKEVQLERDEYAEHLKGERARWQQRMRKMSQEVCSLKKEKKHDKYRVEKLERSLSKLKHQMAEPLPPEPPAVPSEVELQHLRKELERVAGELQAQVEYNQRISLLNEGQKERLREQEERLQEQQERLPEQEERLQQLAEPQNSFKELNNENKSVLQLEQQVKELQEKLGKERLEAASQQNQQLTAQLSLMALPGEGDGGGHLDSEGEEAPRPIPSIPQDLESREAMSGFMDHLEEKADLSELVEKEELGFFQYYRERCHQKVYHPITKPGGSAKDAAPGGGHHQAGPGQGGDEGEAAGAAGDGVAAGGDYKGHSKFLVTAQNPAHEPSPGAPAPQELGAAHKHGDLCEVSLTDSVEPVQGEAREGSPHDNPTAQPIVQDHQEHPGLGSNCCVPFFCWAWLPRRRR

SEQ ID NO: 36044 - protein, 648 aa, Homo sapiens; identical to SEQ ID NO: 36040
  Payload ID: 7129
  Gene Symbol: GOLGA8G
  Gene Name: golgin A8 family, member G
  ENSP ID: ENSP00000458130

SEQ ID NO: 36045 - protein, 648 aa, Homo sapiens; identical to SEQ ID NO: 36040
  Payload ID: 7129
  Gene Symbol: GOLGA8G
  Gene Name: golgin A8 family, member G
  Uniprot ID: Q08AF8
  ENSP ID: ENSP00000481013

SEQ ID NO: 36046 - protein, 648 aa, Homo sapiens; identical to SEQ ID NO: 36040
  Payload ID: 7129
  Gene Symbol: GOLGA8G
  Gene Name: golgin A8 family, member G
  ENSP ID: ENSP00000482881

SEQ ID NO: 36047 - protein, 632 aa, Homo sapiens
  Payload ID: 7130
  Gene Symbol: GOLGA8H
  Gene Name: golgin A8 family, member H
  Uniprot ID: P0CJ92
  ENSP ID: ENSP00000456894
MAEETQHNKLAAAKKKLKEYWQKNSPRVPAGANRNRKTNGSVPEKATSGGCQPPGDSATGFHREGPTSSATLKDLESPCQERAVVLDSRSVEISQLKNTIKSLKQQKKQVEHQLEEEKKANNKKQKAKRVLEVQIQTLNIQKGKLNTDLYHMKRSLRYFEEKSKDLAVCLQHSLQRKGELESVLSNVMATQKKKANQLSSRSKARTEWKLEQSMREEALLKVQLTQLKESFQQVQLERDECAEHLKGERARWQQRMRKMSQEICTLKKEKQQDMRRVEKLERSLSKLKNQMAEPLPPEPPAVPSEVELQHLRKELERVAGELQAQVKKNQRISLLNQRQEERIQEQEERLRKQEERIQEQHKSLQQLAKPQSVFEEPNNENKNALQLEQQVKELQEKLGEEHLEAASQQNQQLTAQLSLMALPGEGHGGEHLDSEGEEAPRPMPSVPEDPESREAMSSFMDHLEEKADLSELVKKKELCFIHHWRDRCHQKTHHLLSEPGGRAKDAALGGGHHQAGAQGGDEGEAAGAAADGIAAYSNYNNGHRKFLAAAHNSADEPGPGAPAPQELGAADKHGDLCEVSLTSSAQGEAREDPLLDKPTAQPIVQDHQEHPGLGSNCCVPLLCWAWLPRRRR

SEQ ID NO: 36048 - protein, 632 aa, Homo sapiens
  Payload ID: 7131
  Gene Symbol: GOLGA8J
  Gene Name: golgin A8 family, member J
  Uniprot ID: A6NMD2
  ENSP ID: ENSP00000456401
MAEETQHNKLAAAKKKLKEYWQKNSPRVPAGANRNRKTNGSIPEKATSGGCQPPRDSATGFHREGPTSSATLKDLESPCQERAVVLDSRSVEISQLKNTIKSLKQQKKQVEHQLEEEKKANNKKQKAKRVLEVQIQTLNIQKEELNTDLYHMKRSLRYFEEKSKDLAVRLQHSLQRKGELESVLSNVMATQKKKANQLSSRSKARTEWKLEQSMREEALLKVQLTQFKESFQQVQLERDEYSEHLKGERARWQQRMRKMSQEICTLKKEKQQDMRRVEKLERSLSKLKNQMAEPLPPEPPAVPSEVELQHLRKELERVAGELQAQVKNNQRISLLNQRQEERIREQEERLRKQEERIQEQHKSLQQLAKPQSVFKEPNNENKNALQLEQQVKELQEKLGEEHLEAASQQNQQLTAQLSLMALPGEGHGGEHLDSEGEEAPRPMPSVPEDPESREAMSSFMDHLEEKADLSELVKKKELCFIHHWRERCHQKTHHLLSEPGGRAKDAALGGGHHQAGAQGGDEGEAAGAAADGIAAYSNYNNGHRKFLAAAHNSADEPGPGAPAPQELGAADKHGHLCEVSLTSSAQGEAREDPLLDKPTAQPIVQDHQEHPGLGSNCCVPFLCWAWLPRRRR

SEQ ID NO: 36049 - protein, 632 aa, Homo sapiens; identical to SEQ ID NO: 36048
  Payload ID: 7131
  Gene Symbol: GOLGA8J
  Gene Name: golgin A8 family, member J
  Uniprot ID: A6NMD2
  ENSP ID: ENSP00000480494

SEQ ID NO: 36050 - protein, 630 aa, Homo sapiens
  Payload ID: 7132
  Gene Symbol: GOLGA8K
  Gene Name: golgin A8 family, member K
  Uniprot ID: D6RF30
  ENSP ID: ENSP00000426691
MAEETQHNKLAAAKKKLKEYWQKNSPRVPAGANRNRKTNGSIPEKATSGGCQPPRDSATGFHREGPTSSATLKDLESPCQERAVVLDSRSVEISQLKNTIKSLKQQKKQVEHQLEEEKKANNKKQKAKRVLEVQIQTLNIQKEELNTDLYHMKRSLRYFEEKSKDLAVRLQHSLQRKGELESVLSNVMATQKKKANQLSSRSKARTEWKLEQSMREEALLKVQLTQLKESFQQVQLERDEYSEHLKGERARWQQRMRKMSQEICTLKKEKQQDMRRVEKLERSLSKLKNQMAEPLPPEPPAVPSEVELQHLRKELERVAGELQAQVKKNQRISLLNQRQEERIQEQEERLRKQEERIQEQHKSLQQLAKPQSVFEEPNNENKNALQLEQQVKELQEKLGEEHLEAASQQNQQLTAQLSLMALPGEGHGEHLDSEGEEAPQPMPSVPEDLESREAMSSFMDHLKEKADLSELVKKELCFIHHWRDRRHQKTHHLLSEPGGCAKDAALGGGHHQAGAQGGDEGEAAGAAADGIAAYSNYNNGHRKFLAAAHNPADEPGPGAPAPQELGAADKHGDLREVSLTSSAQGEAREDPLLDKPTAQPIVQDHKEHPGLGSNCCVPLFCWAWLPRRRR

SEQ ID NO: 36051 - protein, 632 aa, Homo sapiens
  Payload ID: 7133
  Gene Symbol: GOLGA8M
  Gene Name: golgin A8 family, member M
  Uniprot ID: H3BSY2
  ENSP ID: ENSP00000456927
MAEETQHNKLAAAKKKLKEYWQKNSPRVPAGANRNRKTNGSIPQTATSGGCQPPGDSATGFHREGPTSSATLKDLESPCQERAVVLDSRSVEISQLKNTIKSLKQQKKQVEHQLEEEKKANNKKQKAKRVLEVQLQTLNIQKEELNTDLYHMKRSLRYFEEKSKDLAVRLQHSLQRKGELESVLSDVMATQKKKANQLSSPSKAGTEWKLEQSMREEALLKVQLTQLKESFQQVQLERDEYSEHLKGERARWQQRMRKMSQEICTLKKEKQQDMRRVEKLERSLSKLKNQMAEPLPPEPPAVPSEVELQHLRKELERVAGELQAQVKNNQRISLLNQRQEERIREQEERLRKQEERIQEQHKSLQQLAKPQSVFEEPNNENKSTLQLEQQVKELQEKLGEEHLEAASQQNQQLTAQLSLMALPGEGHGGEHLDSEGEEAPQPMPSVPEDPESREAMSSFMDHLEEKADLSELVKKQELRFIQYWQERCHQKIHHLLSEPGGRAKDAALGGGHHQAGAQGGDEGEAAGAAADGIAAYSNYNNGHRKFLAAAHNSADEPGPGAPAPQELGAADKHGDLCEVSLTSSAQGEAREDPLLDKPTAQPIVQDHQEHPGLGSNCCVPFFCWAWLPRRRR

SEQ ID NO: 36052 - protein, 632 aa, Homo sapiens
  Payload ID: 7134
  Gene Symbol: GOLGA8N
  Gene Name: golgin A8 family, member N
  Uniprot ID: F8WBI6
  ENSP ID: ENSP00000398454
MAEETQHNKLAAAKKKLKEYWQKNRPRVPAGVNRNRKTNGSIPETATSGGCQPPGDSATGFHREGPTSSATLKDLESPCQERAVVLDSTSVKISRLKNTIKSLKQQKKQVEHQLEEEKKANNERQKAERELEVQIQTLIIQKEELNTDLYHMERSLRYFEEESKDLAVRLQHSLQCKGELESALSAVIATEKKKANQLSSCSKAHTEWELEQSLQDQALLKAQLTQLKESFQQLQLERDECAEHIEGERARWHQRMSKMSQEICTLKKEKQQDMRRVEELERSLSKLKNQMAEPLPPEPPAVPSEVELQHLRKELERVAGELQSQVKNNQHISLLNRRQEERIREQEERLRKQEERLQEQHEKLRQLAKPQSVFEELNNENKSTLQLEQQVKELQEKLGEEHLEAASQQNQQLTAQLSLMALPGEGHGGEHLDSEGEEAPQPMPSVPEDLESREAMSSFMDHLKEKADLSELVKKQELRFIQYWQERCHQKIHHLLSEPGGRAKDAALGGGHHQAGAQGGDEGEAAGAAADGIAAYSNYNNGHRKFLAAAHNSADEPGPGAPAPQELGAADKHGDLREVTLTSSAQGEAREDPLLDKPTAQPIVQDHQEHPGLGSNCCVPLFCWAWLPRRRR

SEQ ID NO: 36053 - protein, 596 aa, Homo sapiens
  Payload ID: 7134
  Gene Symbol: GOLGA8N
  Gene Name: golgin A8 family, member N
  ENSP ID: ENSP00000454473
MAEETQHNKLAAAKKKLKEYWQKNRPRVPAGVNRNRKTNGSIPETATSGGCQPPGDSATGFHREGPTSSATLKDLESPCQERAVVLDSTSVKISRLKNTIKSLKQQKKQVEHQLEEEKKANNERQKAERELEVQIQTLIIQKEELNTDLYHMERSLRYFEEESKDLAVRLQHSLQCKGELESALSAVIATEKKKANQLSSCSKAHTEWELEQSLQDQALLKAQLTQICTLKKEKQQDMRRVEELERSLSKLKNQMAEPLPPEPPAVPSEVELQHLRKELERVAGELQSQVKNNQHISLLNRRQEERIREQEERLRKQEERLQEQHEKLRQLAKPQSVFEELNNENKSTLQLEQQVKELQEKLGEEHLEAASQQNQQLTAQLSLMALPGEGHGGEHLDSEGEEAPQPMPSVPEDLESREAMSSFMDHLKEKADLSELVKKQELRFIQYWQERCHQKIHHLLSEPGGRAKDAALGGGHHQAGAQGGDEGEAAGAAADGIAAYSNYNNGHRKFLAAAHNSADEPGPGAPAPQELGAADKHGDLREVTLTSSAQGEAREDPLLDKPTAQPIVQDHQEHPGLGSNCCVPLFCWAWLPRRRR

SEQ ID NO: 36054 - protein, 131 aa, Homo sapiens
  Payload ID: 7134
  Gene Symbol: GOLGA8N
  Gene Name: golgin A8 family, member N
  ENSP ID: ENSP00000482461
MLTLKEYWQKNRPRVPAGVNRNRKTNGSIPETATSGGCQPPGDSATGFHREGPTSSATLKDLESPCQERAVVLDSTSVKISRLKNTIKSLKQQKKQVEHQLEEEKKANNERQKAERELEVQIQTLIIQKEE

SEQ ID NO: 36055 - protein, 632 aa, Homo sapiens
  Payload ID: 7135
  Gene Symbol: GOLGA8O
  Gene Name: golgin A8 family, member O
  Uniprot ID: A6NCC3
  ENSP ID: ENSP00000423159
MAEETQHNKLAAAKKKLKEYWQKNRPRVPAGVNRNRKTNGSIPETATSGGCQPPGDSATGFHREGPTSSATLKDLESPCQERAVVLDSTSVKISRLKNTIKSLKQQKKQVEHQLEEEKKANNERQKAERELEVQIQTLIIQKEELNTDLYHMERSLRYFEEESKDLAVRLQHSLQCKGELESALSAVIATEKKKANQLSSCSKAHTEWELEQSLQDQALLKAQLTQLKESFQQLQLERDECAEHIEGERARWHQRMSKMSQEICTLKKEKQQDMRRVEELERSLSKLKNQMAEPLPPEPPAVPSEVELQHLRKELERVAGELQSQVKNNQHISLLNRRQEERIREQEERLRKQEERLQEQHEKLRQLAKPQSVFEELNNENKSTLQLEQQVKELQEKLGEEHLEAASQQNQQLTAQLSLMALPGEGHGGEHLDSEGEEAPRPMPSVPEDPESREAMSSFMDHLKEKADLSELVKKQELRFIQYWQERCHQKIHHLLSEPGGRAKDAALGGGHHQAGAQGGDEGEAAGAAADGIAAYSNYNNGHRKFLAAAHNSADEPGPGAPAPQELGAADKHGDLREVTLTSSAQGEAREDPLLDKPTAQPIVQDHQEHPGLGSNCCVPLFCWAWLPRRRR

SEQ ID NO: 36056 - protein, 131 aa, Homo sapiens; identical to SEQ ID NO: 36054
  Payload ID: 7135
  Gene Symbol: GOLGA8O
  Gene Name: golgin A8 family, member O
  ENSP ID: ENSP00000456713

SEQ ID NO: 36057 - protein, 632 aa, Homo sapiens
  Payload ID: 7136
  Gene Symbol: GOLGA8Q
  Gene Name: golgin A8 family, member Q
  ENSP ID: ENSP00000457904
MAEETQHNKLAAAKKKLKEYWQKNRPRVPAGVNRNRKTNGSIPETATSGGCQPPGDSATGFHREGPTSSATLKDLESPCQERAVVLDSTSVKISRLKNTIKSLKQQKKQVEHQLEEEKKANNERQKAERELEVQIQTLIIQKEELNTDLYHMERSLRYFEEESKDLAVRLQHSLQCKGELERALSAVIATEKKKANQLSSCSKAHTEWELEQSLQDQALLKAQLTQLKESFQQLQLERDECAEHIEGERARWHQRMSKMLQEICTLKKEKQQDMRRVEELERSLSKLKNQMAEPLPPEPPAVPSEVELQHLRKELERVAGELQSQVKNNQHISLLNRRQEERIREQEERLRKQEERLQEQHEKLRQLAKPQSVFEELNNENKSTLQLEQQVKELQEKLGEEHLEAASQQNQQLTAQLNLMALPGEGHGGEHLDSEGEEAPQPMPSVPEDLESREAMSSFMDHLKEKADLSELVKKQELRFIQYWQERCHQKIHHLLSEPGGRAKDAALGGGHHQAGAQGGDEGEAAGAAADGIAAYSNYNNGHRKFLAAAHNSADEPGPGAPAPQELGAADKHGDLREVTLTSSAQGEAREDPLLDKPTAQPIVQDHQEHPGLGSNCCVPLFCWAWLPRRRR

SEQ ID NO: 36058 - protein, 631 aa, Homo sapiens
  Payload ID: 7137
  Gene Symbol: GOLGA8R
  Gene Name: golgin A8 family, member R
  Uniprot ID: I6L899
  ENSP ID: ENSP00000323217
MAEETQHNKLAAAKKKLKEYWQKNRPRVPAGVNRNRKTNGSIPETATSGGCQPPGDSATGFHREGPTSSATLKDLESPCQERAVVLDSTSVKISRLKNTIKSLKQQKKQVEHQLEEEKKANNERQKAERVLEVQIQTLIIQKEELNTDLYHMERSLRYFEEESKDLAVRLQHSLQCKGELERALSAVIATEKKKANQLSSCSKAHTEWELEQSLQDQALLKAQLTQLKESFQQLQLERDECAEHIEGERARWHQRMSKMSQEICTLKKEKQDMRWVEQLEWSLSKLKNQTAEPLPPEPPAVPSEVELQHLRKELERVAGELQSQVKNNQHISLLNRRQEERIREQEERLRKQEERLQEQHEKLRQLAKPQSVFEELNNENKSTLQLEQQVKELQEKLGEEHLEVASQQNQQLTAQLSLMALPGEGHGGEHLDSEGEEAPQPMPSVPEDPESREAMSSFMDHLKEKADLSELLKKQELRFIQYWQERCHQKIHHLLSEPGGRAKDAALGGGHHQAGAQGGDEGEAAGAAADGIAAYSNYNNGHRKFLAAAHNSADEPGPGAPAPQELGAADKHGDLREVTLTSSAQGEAREDPLLDKPTAQPIVQDHQEHPGLGSNCCVPLFCWAWLPRRRR

SEQ ID NO: 36059 - protein, 625 aa, Homo sapiens
  Payload ID: 7138
  Gene Symbol: GOLGA8S
  Gene Name: golgin A8 family, member S
  ENSP ID: ENSP00000455298
MAEETRQSKLAAAKRKLKEYWQRNSPGVPAGAKRNRKTNGSIHETATSGGCHSPGDSATGIHGESPTSSATLKDLESPCQELAVVPDSRSVKVSQLKNTIKSLKQQKKQVVHQLEEEKKANNEKQKAERELEVQIQRLNIQKGKLNTDLYHTKRSLRYFEEESKDLAVRLQHSLQRKGELERALSAVTATQKKKAERFSSRSKARTEWKLEQSMREQALLKAQLTQLKESLKEVQLERDEYAEHLKGERARWQQRMRKMSQEVCSLKKEKKHDKYRVETLERSLSKLKNQMAEPLPPEPPAVPSEAELQHLRKELERVAGALQAQVEYNQRISLLNEGQKERLREQQERLPEQEERLQQLAEPQNSFKELNNENKSVLQLEQQVKELQEKLGKERLEAASQQKQQLTAQLSLMALPGEGDGGGHLDSEGEEAPRPIPSIPQDLESREAMSSFMDHLEEKADLSELVKKQELRFIQYWQERCHQKIHHLLSEPGGRAKDAALGGGHHQAGAQGGDEDEAAGAAADGIAAYSNYNNGHRKFLAAAHNPADEPGPGAPAPQELGAADKHGDLCEVSLTSSAQGEAREDPLLDKPTAQPIVQDHQEHPGLGNNCCVPFFCWAWLPRRRR

SEQ ID NO: 36060 - protein, 631 aa, Homo sapiens
  Payload ID: 7139
  Gene Symbol: GOLGA8T
  Gene Name: golgin A8 family, member T
  ENSP ID: ENSP00000455826
MAEETQHNKLAAAKKKLKEYWQKNSPRVPAGANRNRKTNGSIPEKATSGGCQPPRDSATGFHREGPTSSATLKDLESPCQERAVVLDSRSVEISQLKNTIKSLKQQKKQVEHQLEEEKKANNKKQKAKRVLEVQIQTLNIQKEELNTDLYHMKRSLRYFEEKSKDLAVRLQHSLQRKGELESVLSNVMATQKKKANQLSSRSKARTEWKLEQSMREETLLKVQLTQLKESFQQVQLERDEYSEHLKGERARWQQRMRKMSQEICTLKKEKQQDMRRVEELERSLSKLKNQMAEPLPPEPPAVPSEVELQHLRKELERVAGELQAQVKKNQRISLLNQRQEERIQEQEERLRKQEERIQEQHKSLQQLAKPQSVFEEPNNENKNALQLEQQVKELQEKLGEEHLEAASQQNQQLTAQLSLMALPGEGHGGEHLDSEGEEAPQPMPSVPEDLESREAMSSFMDHLKEKADLSELVKKELCFIHHWRDRRHQKTHHLLSEPGGCAKDAALGGGHHQAGAQGGDEGEAAGAAADGIAAYSNYNNGHRKFLAAAHNPADEPGPGAPAPQELGAADKHGDLREVSLTSSAQGEAREDPLLDKPTAQPIVQDHQEHPGLGSNCCVPFLCWAWLPRRRR

SEQ ID NO: 36061 - protein, 3259 aa, Homo sapiens
  Payload ID: 7140
  Gene Symbol: GOLGB1
  Gene Name: golgin B1
  Uniprot ID: Q14789
  ENSP ID: ENSP00000341848
MLSRLSGLANVVLHELSGDDDTDQNMRAPLDPELHQESDMEFNNTTQEDVQERLAYAEQLVVELKDIIRQKDVQLQQKDEALQEERKAADNKIKKLKLHAKAKLTSLNKYIEEMKAQGGTVLPTEPQSEEQLSKHDKSSTEEEMEIEKIKHKLQEKEELISTLQAQLTQAQAEQPAQSSTEMEEFVMMKQQLQEKEEFISTLQAQLSQTQAEQAAQQVVREKDARFETQVRLHEDELLQLVTQADVETEMQQKLRVLQRKLEEHEESLVGRAQVVDLLQQELTAAEQRNQILSQQLQQMEAEHNTLRNTVETEREESKILLEKMELEVAERKLSFHNLQEEMHHLLEQFEQAGQAQAELESRYSALEQKHKAEMEEKTSHILSLQKTGQELQSACDALKDQNSKLLQDKNEQAVQSAQTIQQLEDQLQQKSKEISQFLNRLPLQQHETASQTSFPDVYNEGTQAVTEENIASLQKRVVELENEKGALLLSSIELEELKAENEKLSSQITLLEAQNRTGEADREVSEISIVDIANKRSSSAEESGQDVLENTFSQKHKELSVLLLEMKEAQEEIAFLKLQLQGKRAEEADHEVLDQKEMKQMEGEGIAPIKMKVFLEDTGQDFPLMPNEESSLPAVEKEQASTEHQSRTSEEISLNDAGVELKSTKQDGDKSLSAVPDIGQCHQDELERLKSQILELELNFHKAQEIYEKNLDEKAKEISNLNQLIEEFKKNADNNSSAFTALSEERDQLLSQVKELSMVTELRAQVKQLEMNLAEAERQRRLDYESQTAHDNLLTEQIHSLSIEAKSKDVKIEVLQNELDDVQLQFSEQSTLIRSLQSQLQNKESEVLEGAERVRHISSKVEELSQALSQKELEITKMDQLLLEKKRDVETLQQTIEEKDQQVTEISFSMTEKMVQLNEEKFSLGVEIKTLKEQLNLLSRAEEAKKEQVEEDNEVSSGLKQNYDEMSPAGQISKEELQHEFDLLKKENEQRKRKLQAALINRKELLQRVSRLEEELANLKDESKKEIPLSETERGEVEEDKENKEYSEKCVTSKCQEIEIYLKQTISEKEVELQHIRKDLEEKLAAEEQFQALVKQMNQTLQDKTNQIDLLQAEISENQAIIQKLITSNTDASDGDSVALVKETVVISPPCTGSSEHWKPELEEKILALEKEKEQLQKKLQEALTSRKAILKKAQEKERHLREELKQQKDDYNRLQEQFDEQSKENENIGDQLRQLQIQVRESIDGKLPSTDQQESCSSTPGLEEPLFKATEQHHTQPVLESNLCPDWPSHSEDASALQGGTSVAQIKAQLKEIEAEKVELELKVSSTTSELTKKSEEVFQLQEQINKQGLEIESLKTVSHEAEVHAESLQQKLESSQLQIAGLEHLRELQPKLDELQKLISKKEEDVSYLSGQLSEKEAALTKIQTEIIEQEDLIKALHTQLEMQAKEHDERIKQLQVELCEMKQKPEEIGEESRAKQQIQRKLQAALISRKEALKENKSLQEELSLARGTIERLTKSLADVESQVSAQNKEKDTVLGRLALLQEERDKLITEMDRSLLENQSLSSSCESLKLALEGLTEDKEKLVKEIESLKSSKIAESTEWQEKHKELQKEYEILLQSYENVSNEAERIQHVVEAVRQEKQELYGKLRSTEANKKETEKQLQEAEQEMEEMKEKMRKFAKSKQQKILELEEENDRLRAEVHPAGDTAKECMETLLSSNASMKEELERVKMEYETLSKKFQSLMSEKDSLSEEVQDLKHQIEGNVSKQANLEATEKHDNQTNVTEEGTQSIPGETEEQDSLSMSTRPTCSESVPSAKSANPAVSKDFSSHDEINNYLQQIDQLKERIAGLEEEKQKNKEFSQTLENEKNTLLSQISTKDGELKMLQEEVTKMNLLNQQIQEELSRVTKLKETAEEEKDDLEERLMNQLAELNGSIGNYCQDVTDAQIKNELLESEMKNLKKCVSELEEEKQQLVKEKTKVESEIRKEYLEKIQGAQKEPGNKSHAKELQELLKEKQQEVKQLQKDCIRYQEKISALERTVKALEFVQTESQKDLEITKENLAQAVEHRKKAQAELASFKVLLDDTQSEAARVLADNLKLKKELQSNKESVKSQMKQKDEDLERRLEQAEEKHLKEKKNMQEKLDALRREKVHLEETIGEIQVTLNKKDKEVQQLQENLDSTVTQLAAFTKSMSSLQDDRDRVIDEAKKWERKFSDAIQSKEEEIRLKEDNCSVLKDQLRQMSIHMEELKINISRLEHDKQIWESKAQTEVQLQQKVCDTLQGENKELLSQLEETRHLYHSSQNELAKLESELKSLKDQLTDLSNSLEKCKEQKGNLEGIIRQQEADIQNSKFSYEQLETDLQASRELTSRLHEEINMKEQKIISLLSGKEEAIQVAIAELRQQHDKEIKELENLLSQEEEENIVLEEENKKAVDKTNQLMETLKTIKKENIQQKAQLDSFVKSMSSLQNDRDRIVGDYQQLEERHLSIILEKDQLIQEAAAENNKLKEEIRGLRSHMDDLNSENAKLDAELIQYREDLNQVITIKDSQQKQLLEVQLQQNKELENKYAKLEEKLKESEEANEDLRRSFNALQEEKQDLSKEIESLKVSISQLTRQVTALQEEGTLGLYHAQLKVKEEEVHRLSALFSSSQKRIAELEEELVCVQKEAAKKVGEIEDKLKKELKHLHHDAGIMRNETETAEERVAELARDLVEMEQKLLMVTKENKGLTAQIQSFGRSMSSLQNSRDHANEELDELKRKYDASLKELAQLKEQGLLNRERDALLSETAFSMNSTEENSLSHLEKLNQQLLSKDEQLLHLSSQLEDSYNQVQSFSKAMASLQNERDHLWNELEKFRKSEEGKQRSAAQPSTSPAEVQSLKKAMSSLQNDRDRLLKELKNLQQQYLQINQEITELHPLKAQLQEYQDKTKAFQIMQEELRQENLSWQHELHQLRMEKSSWEIHERRMKEQYLMAISDKDQQLSHLQNLIRELRSSSSQTQPLKVQYQRQASPETSASPDGSQNLVYETELLRTQLNDSLKEIHQKELRIQQLNSNFSQLLEEKNTLSIQLCDTSQSLRENQQHYGDLLNHCAVLEKQVQELQAGPLNIDVAPGAPQEKNGVHRKSDPEELREPQQSFSEAQQQLCNTRQEVNELRKLLEEERDQRVAAENALSVAEEQIRRLEHSEWDSSRTPIIGSCGTQEQALLIDLTSNSCRRTRSGVGWKRVLRSLCHSRTRVPLLAAIYFLMIHVLLILCFTGHL

SEQ ID NO: 36062 - protein, 3269 aa, Homo sapiens
  Payload ID: 7140
  Gene Symbol: GOLGB1
  Gene Name: golgin B1
  Uniprot ID: Q14789
  ENSP ID: ENSP00000377275
MLSRLSGLANVVLHELSGDDDTDQNMRAPLDPELHQESDMEFNNTTQEDVQERLAYAEQLVVELKDIIRQKDVQLQQKDEALQEERKAADNKIKKLKLHAKAKLTSLNKYIEEMKAQGGTVLPTEPQSEEQLSKHDKSSTEEEMEIEKIKHKLQEKEELISTLQAQLTQAQAEQPAQSSTEMEEFVMMKQQLQEKEEFISTLQAQLSQTQAEQAAQLSSMQQVVREKDARFETQVRLHEDELLQLVTQADVETEMQQKLRVLQRKLEEHEESLVGRAQVVDLLQQELTAAEQRNQILSQQLQQMEAEHNTLRNTVETEREESKILLEKMELEVAERKLSFHNLQEEMHHLLEQFEQAGQAQAELESRYSALEQKHKAEMEEKTSHILSLQKTGQELQSACDALKDQNSKLLQDKNEQAVQSAQTIQQLEDQLQQKSKEISQFLNRLPLQQHETASQTSFPDVYNEGTQAVTEENIASLQKRVVELENEKGALLLSSIELEELKAENEKLSSQITLLEAQNRTGEADREVSEISIVDIANKRSSSAEESGQDVLENTFSQKHKELSVLLLEMKEAQEEIAFLKLQLQGKRAEEADHEVLDQKEMKQMEGEGIAPIKMKVFLEDTGQDFPLMPNEESSLPAVEKEQASTEHQSRTSEEISLNDAGVELKSTKQDGDKSLSAVPDIGQCHQDELERLKSQILELELNFHKAQEIYEKNLDEKAKEISNLNQLIEEFKKNADNNSSAFTALSEERDQLLSQVKELSMVTELRAQVKQLEMNLAEAERQRRLDYESQTAHDNLLTEQIHSLSIEAKSKDVKIEVLQNELDDVQLQFSEQSTLIRSLQSQLQNKESEVLEGAERVRHISSKVEELSQALSQKELEITKMDQLLLEKKRDVETLQQTIEEKDQQVTEISFSMTEKMVQLNEEKFSLGVEIKTLKEQLNLLSRAEEAKKEQVEEDNEVSSGLKQNYDEMSPAGQISKEELQHEFDLLKKENEQRKRKLQAALINRKELLQRVSRLEEELANLKDESKKEIPLSETERGEVEEDKENKEYSEKCVTSKCQEIEIYLKQTISEKEVELQHIRKDLEEKLAAEEQFQALVKQMNQTLQDKTNQIDLLQAEISENQAIIQKLITSNTDASDGDSVALVKETVVISPPCTGSSEHWKPELEEKILALEKEKEQLQKKLQEALTSRKAILKKAQEKERHLREELKQQKDDYNRLQEQFDEQSKENENIGDQLRQLQIQVRESIDGKLPSTDQQESCSSTPGLEEPLFKATEQHHTQPVLESNLCPDWPSHSEDASALQGGTSVAQIKAQLKEIEAEKVELELKVSSTTSELTKKSEEVFQLQEQINKQGLEIESLKTVSHEAEVHAESLQQKLESSQLQIAGLEHLRELQPKLDELQKLISKKEEDVSYLSGQLSEKEAALTKIQTEIIEQEDLIKALHTQLEMQAKEHDERIKQLQVELCEMKQKPEEIGEESRAKQQIQRKLQAALISRKEALKENKSLQEELSLARGTIERLTKSLADVESQVSAQNKEKDTVLGRLALLQEERDKLITEMDRSLLENQSLSSSCESLKLALEGLTEDKEKLVKEIESLKSSKIAESTEWQEKHKELQKEYEILLQSYENVSNEAERIQHVVEAVRQEKQELYGKLRSTEANKKETEKQLQEAEQEMEEMKEKMRKFAKSKQQKILELEEENDRLRAEVHPAGDTAKECMETLLSSNASMKEELERVKMEYETLSKKFQSLMSEKDSLSEEVQDLKHQIEGNVSKQANLEATEKHDNQTNVTEEGTQSIPGETEEQDSLSMSTRPTCSESVPSAKSANPAVSKDFSSHDEINNYLQQIDQLKERIAGLEEEKQKNKEFSQTLENEKNTLLSQISTKDGELKMLQEEVTKMNLLNQQIQEELSRVTKLKETAEEEKDDLEERLMNQLAELNGSIGNYCQDVTDAQIKNELLESEMKNLKKCVSELEEEKQQLVKEKTKVESEIRKEYLEKIQGAQKEPGNKSHAKELQELLKEKQQEVKQLQKDCIRYQEKISALERTVKALEFVQTESQKDLEITKENLAQAVEHRKKAQAELASFKVLLDDTQSEAARVLADNLKLKKELQSNKESVKSQMKQKDEDLERRLEQAEEKHLKEKKNMQEKLDALRREKVHLEETIGEIQVTLNKKDKEVQQLQENLDSTVTQLAAFTKSMSSLQDDRDRVIDEAKKWERKFSDAIQSKEEEIRLKEDNCSVLKDQLRQMSIHMEELKINISRLEHDKQIWESKAQTEVQLQQKVCDTLQGENKELLSQLEETRHLYHSSQNELAKLESELKSLKDQLTDLSNSLEKCKEQKGNLEGIIRQQEADIQNSKFSYEQLETDLQASRELTSRLHEEINMKEQKIISLLSGKEEAIQVAIAELRQQHDKEIKELENLLSQEEEENIVLEEENKKAVDKTNQLMETLKTIKKENIQQKAQLDSFVKSMSSLQNDRDRIVGDYQQLEERHLSIILEKDQLIQEAAAENNKLKEEIRGLRSHMDDLNSENAKLDAELIQYREDLNQVITIKDSQQKQLLEVQLQQNKELENKYAKLEEKLKESEEANEDLRRSFNALQEEKQDLSKEIESLKVSISQLTRQVTALQEEGTLGLYHAQLKVKEEEVHRLSALFSSSQKRIAELEEELVCVQKEAAKKVGEIEDKLKKELKHLHHDAGIMRNETETAEERVAELARDLVEMEQKLLMVTKENKGLTAQIQSFGRSMSSLQNSRDHANEELDELKRKYDASLKELAQLKEQGLLNRERDALLSETAFSMNSTEENSLSHLEKLNQQLLSKDEQLLHLSSQLEDSYNQVQSFSKAMASLQNERDHLWNELEKFRKSEEGKQRSAAQPSTSPAEVQSLKKAMSSLQNDRDRLLKELKNLQQQYLQINQEITELHPLKAQLQEYQDKTKAFQIMQEELRQENLSWQHELHQLRMEKSSWEIHERRMKEQYLMAISDKDQQLSHLQNLIRELRSSSSQTQPLKVQYQRQASPETSASPDGSQNLVYETELLRTQLNDSLKEIHQKELRIQQLNSNFSQLLEEKNTLSIQLCDTSQSLRENQQHYGDLLNHCAVLEKQVQELQAVSKEKGPLNIDVAPGAPQEKNGVHRKSDPEELREPQQSFSEAQQQLCNTRQEVNELRKLLEEERDQRVAAENALSVAEEQIRRLEHSEWDSSRTPIIGSCGTQEQALLIDLTSNSCRRTRSGVGWKRVLRSLCHSRTRVPLLAAIYFLMIHVLLILCFTGHL

SEQ ID NO: 36063 - protein, 41 aa, Homo sapiens
  Payload ID: 7140
  Gene Symbol: GOLGB1
  Gene Name: golgin B1
  ENSP ID: ENSP00000417695
MLSRLSGLANVVLHELSGDDDTDQNMRAPLDPELHQESDME

SEQ ID NO: 36064 - protein, 1031 aa, Homo sapiens
  Payload ID: 7140
  Gene Symbol: GOLGB1
  Gene Name: golgin B1
  ENSP ID: ENSP00000417767
  MOD_RES (1)..(1): Any amino acid
XYAEQLVVELKDIIRQKDVQLQQKDEALQEERKAADNKIKKLKLHAKAKLTSLNKYIEEMKAQGGTVLPTEPQSEEQLSKHDKSSTEEEMEIEKIKHKLQEKEELISTLQAQLTQAQAEQPAQKLRVLQRKLEEHEESLVGRAQVVDLLQQELTAAEQRNQILSQQLQQMEAEHNTLRNTVETEREESKILLEKMELEVAERKLSFHNLQEEMHHLLEQFEQAGQAQAELESRYSALEQKHKAEMEEKTSHILSLQKTGQELQSACDALKDQNSKLLQDKNEQAVQSAQTIQQLEDQLQQKSKEISQFLNRLPLQQHETASQTSFPDVYNEGTQAVTEENIASLQKRVVELENEKGALLLSSIELEELKAENEKLSSQITLLEAQNRTGEADREVSEISIVDIANKRSSSAEESGQDVLENTFSQKHKELSVLLLEMKEAQEEIAFLKLQLQGKRAEEADHEVLDQKEMKQMEGEGIAPIKMKVFLEDTGQDFPLMPNEESSLPAVEKEQASTEHQSRTSEEISLNDAGVELKSTKQDGDKSLSAVPDIGQCHQDELERLKSQILELELNFHKAQEIYEKNLDEKAKEISNLNQLIEEFKKNADNNSSAFTALSEERDQLLSQVKELSMVTELRAQVKQLEMNLAEAERQRRLDYESQTAHDNLLTEQIHSLSIEAKSKDVKIEVLQNELDDVQLQFSEQSTLIRSLQSQLQNKESEVLEGAERVRHISSKVEELSQALSQKELEITKMDQLLLEKKRDVETLQQTIEEKDQQVTEISFSMTEKMVQLNEEKFSLGVEIKTLKEQLNLLSRAEEAKKEQVEEDNEVSSGLKQNYDEMSPAGQISKEELQHEFDLLKKENEQRKRKLQAALINRKELLQRVSRLEEELANLKDESKKEIPLSETERGEVEEDKENKEYSEKCVTSKCQEIEIYLKQTISEKEVELQHIRKDLEEKLAAEEQFQALVKQMNQTLQDKTNQIDLLQAEISENQAIIQKLITSNTDASDGDSVALVKETVVISPPCTGSSEHWKP

SEQ ID NO: 36065 - protein, 1640 aa, Homo sapiens
  Payload ID: 7140
  Gene Symbol: GOLGB1
  Gene Name: golgin B1
  ENSP ID: ENSP00000418231
MLSRLSGLANVVLHELSGDDDTDQNMRAPLDPELHQESDMEFNNTTQEDVQERLAYAEQLVVELKDIIRQKDVQLQQKDEALQEERKAADNKIKKLKLHAKAKLTSLNKYIEEMKAQGGTVLPTEPQSEEQLSKHDKSSTEEEMEIEKIKHKLQEKEELISTLQAQLTQAQAEQPAQSSTEMEEFVMMKQQLQEKEEFISTLQAQLSQTQAEQAAQKLRVLQRKLEEHEESLVGRAQVVDLLQQELTAAEQRNQILSQQLQQMEAEHNTLRNTVETEREESKILLEKMELEVAERKLSFHNLQEEMHHLLEQFEQAGQAQAELESRYSALEQKHKAEMEEKTSHILSLQKTGQELQSACDALKDQNSKLLQDKNEQAVQSAQTIQQLEDQLQQKSKEISQFLNRLPLQQHETASQTSFPDVYNEGTQAVTEENIASLQKRVVELENEKGALLLSSIELEELKAENEKLSSQITLLEAQNRTGEADREVSEISIVDIANKRSSSAEESGQDVLENTFSQKHKELSVLLLEMKEAQEEIAFLKLQLQGKRAEEADHEVLDQKEMKQMEGEGIAPIKMKVFLEDTGQDFPLMPNEESSLPAVEKEQASTEHQSRTSEEISLNDAGVELKSTKQDGDKSLSAVPDIGQCHQDELERLKSQILELELNFHKAQEIYEKNLDEKAKEISNLNQLIEEFKKNADNNSSAFTALSEERDQLLSQVKELSMVTELRAQVKQLEMNLAEAERQRRLDYESQTAHDNLLTEQIHSLSIEAKSKDVKIEVLQNELDDVQLQFSEQSTLIRSLQSQLQNKESEVLEGAERVRHISSKVEELSQALSQKELEITKMDQLLLEKKRDVETLQQTIEEKDQQVTEISFSMTEKMVQLNEEKFSLGVEIKTLKEQLNLLSRAEEAKKEQVEEDNEVSSGLKQNYDEMSPAGQISKEELQHEFDLLKKENEQRKRKLQAALINRKELLQRVSRLEEELANLKDESKKEIPLSETERGEVEEDKENKEYSEKCVTSKCQEIEIYLKQTISEKEVELQHIRKDLEEKLAAEEQFQALVKQMNQTLQDKTNQIDLLQAEISENQAIIQKLITSNTDASDGDSVALVKETVVISPPCTGSSEHWKPELEEKILALEKEKEQLQKKLQEALTSRKAILKKAQEKERHLREELKQQKDDYNRLQEQFDEQSKENENIGDQLRQLQIQVRESIDGKLPSTDQQESCSSTPGLEEPLFKATEQHHTQPVLESNLCPDWPSHSEDASALQGGTSVAQIKAQLKEIEAEKVELELKVSSTTSELTKKSEEVFQLQEQINKQGLEIESLKTVSHEAEVHAESLQQKLESSQLQIAGLEHLRELQPKLDELQKLISKKEEDVSYLSGQLSEKEAALTKIQTEIIEQEDLIKALHTQLEMQAKEHDERIKQLQVELCEMKQKPEEIGEESRAKQQIQRKLQAALISRKEALKENKSLQEELSLARGTIERLTKSLADVESQVSAQNKEKDTVLGRLALLQEERDKLITEMDRSLLENQSLSSSCESLKLALEGLTEDKEKLVKEIESLKSSKIAESTEWQEKHKELQKEYEILLQSYENVSNEAERIQHVVEAVRQEKQELYGKLRSTEANKKETEKQLQEAEQEMEEMKE

SEQ ID NO: 36066 - protein, 39 aa, Homo sapiens
  Payload ID: 7140
  Gene Symbol: GOLGB1
  Gene Name: golgin B1
  ENSP ID: ENSP00000419519
MLSRLSGLANVVLHELSGDDDTDQNMRAPLDPVSSSVLI

SEQ ID NO: 36067 - protein, 109 aa, Homo sapiens
  Payload ID: 7140
  Gene Symbol: GOLGB1
  Gene Name: golgin B1
  ENSP ID: ENSP00000420027
ASPETSASPDGSQNLVYETELLRTQLNDSLKEIHQKELRIQQLNSNFSQLLEEKNTLSIQLCDTSQSLRENQQHYGDLLNHCAVLEKQVQELQAWRQGFTILARLVLNS

SEQ ID NO: 36068 - protein, 3184 aa, Homo sapiens
  Payload ID: 7140
  Gene Symbol: GOLGB1
  Gene Name: golgin B1
  Uniprot ID: Q14789
  ENSP ID: ENSP00000484083
MEFNNTTQEDVQERLAYAEQLVVELKDIIRQKDVQLQQKDEALQEERKAADNKIKKLKLHAKAKLTSLNKYIEEMKAQGGTVLPTEPQSEEQLSKHDKSSTEEEMEIEKIKHKLQEKEELISTLQAQLTQAQAEQPAQSSTEMEEFVMMKQQLQEKEEFISTLQAQLSQTQAEQAAQKLRVLQRKLEEHEESLVGRAQVVDLLQQELTAAEQRNQILSQQLQQMEAEHNTLRNTVETEREESKILLEKMELEVAERKLSFHNLQEEMHHLLEQFEQAGQAQAELESRYSALEQKHKAEMEEKTSHILSLQKTGQELQSACDALKDQNSKLLQDKNEQAVQSAQTIQQLEDQLQQKSKEISQFLNRLPLQQHETASQTSFPDVYNEGTQAVTEENIASLQKRVVELENEKGALLLSSIELEELKAENEKLSSQITLLEAQNRTGEADREVSEISIVDIANKRSSSAEESGQDVLENTFSQKHKELSVLLLEMKEAQEEIAFLKLQLQGKRAEEADHEVLDQKEMKQMEGEGIAPIKMKVFLEDTGQDFPLMPNEESSLPAVEKEQASTEHQSRTSEEISLNDAGVELKSTKQDGDKSLSAVPDIGQCHQDELERLKSQILELELNFHKAQEIYEKNLDEKAKEISNLNQLIEEFKKNADNNSSAFTALSEERDQLLSQVKELSMVTELRAQVKQLEMNLAEAERQRRLDYESQTAHDNLLTEQIHSLSIEAKSKDVKIEVLQNELDDVQLQFSEQSTLIRSLQSQLQNKESEVLEGAERVRHISSKVEELSQALSQKELEITKMDQLLLEKKRDVETLQQTIEEKDQQVTEISFSMTEKMVQLNEEKFSLGVEIKTLKEQLNLLSRAEEAKKEQVEEDNEVSSGLKQNYDEMSPAGQISKEELQHEFDLLKKENEQRKRKLQAALINRKELLQRVSRLEEELANLKDESKKEIPLSETERGEVEEDKENKEYSEKCVTSKCQEIEIYLKQTISEKEVELQHIRKDLEEKLAAEEQFQALVKQMNQTLQDKTNQIDLLQAEISENQAIIQKLITSNTDASDGDSVALVKETVVISPPCTGSSEHWKPELEEKILALEKEKEQLQKKLQEALTSRKAILKKAQEKERHLREELKQQKDDYNRLQEQFDEQSKENENIGDQLRQLQIQVRESIDGKLPSTDQQESCSSTPGLEEPLFKATEQHHTQPVLESNLCPDWPSHSEDASALQGGTSVAQIKAQLKEIEAEKVELELKVSSTTSELTKKSEEVFQLQEQINKQGLEIESLKTVSHEAEVHAESLQQKLESSQLQIAGLEHLRELQPKLDELQKLISKKEEDVSYLSGQLSEKEAALTKIQTEIIEQEDLIKALHTQLEMQAKEHDERIKQLQVELCEMKQKPEEIGEESRAKQQIQRKLQAALISRKEALKENKSLQEELSLARGTIERLTKSLADVESQVSAQNKEKDTVLGRLALLQEERDKLITEMDRSLLENQSLSSSCESLKLALEGLTEDKEKLVKEIESLKSSKIAESTEWQEKHKELQKEYEILLQSYENVSNEAERIQHVVEAVRQEKQELYGKLRSTEANKKETEKQLQEAEQEMEEMKEKMRKFAKSKQQKILELEEENDRLRAEVHPAGDTAKECMETLLSSNASMKEELERVKMEYETLSKKFQSLMSEKDSLSEEVQDLKHQIEGNVSKQANLEATEKHDNQTNVTEEGTQSIPGETEEQDSLSMSTRPTCSESVPSAKSANPAVSKDFSSHDEINNYLQQIDQLKERIAGLEEEKQKNKEFSQTLENEKNTLLSQISTKDGELKMLQEEVTKMNLLNQQIQEELSRVTKLKETAEEEKDDLEERLMNQLAELNGSIGNYCQDVTDAQIKNELLESEMKNLKKCVSELEEEKQQLVKEKTKVESEIRKEYLEKIQGAQKEPGNKSHAKELQELLKEKQQEVKQLQKDCIRYQEKISALERTVKALEFVQTESQKDLEITKENLAQAVEHRKKAQAELASFKVLLDDTQSEAARVLADNLKLKKELQSNKESVKSQMKQKDEDLERRLEQAEEKHLKEKKNMQEKLDALRREKVHLEETIGEIQVTLNKKDKEVQQLQENLDSTVTQLAAFTKSMSSLQDDRDRVIDEAKKWERKFSDAIQSKEEEIRLKEDNCSVLKDQLRQMSIHMEELKINISRLEHDKQIWESKAQTEVQLQQKVCDTLQGENKELLSQLEETRHLYHSSQNELAKLESELKSLKDQLTDLSNSLEKCKEQKGNLEGIIRQQEADIQNSKFSYEQLETDLQASRELTSRLHEEINMKEQKIISLLSGKEEAIQVAIAELRQQHDKEIKELENLLSQEEEENIVLEEENKKAVDKTNQLMETLKTIKKENIQQKAQLDSFVKSMSSLQNDRDRIVGDYQQLEERHLSIILEKDQLIQEAAAENNKLKEEIRGLRSHMDDLNSENAKLDAELIQYREDLNQVITIKDSQQKQLLEVQLQQNKELENKYAKLEEKLKESEEANEDLRRSFNALQEEKQDLSKEIESLKVSISQLTRQVTALQEEGTLGLYHAQLKVKEEEVHRLSALFSSSQKRIAELEEELVCVQKEAAKKVGEIEDKLKKELKHLHHDAGIMRNETETAEERVAELARDLVEMEQKLLMVTKENKGLTAQIQSFGRSMSSLQNSRDHANEELDELKRKYDASLKELAQLKEQGLLNRERDALLSETAFSMNSTEENSLSHLEKLNQQLLSKDEQLLHLSSQLEDSYNQVQSFSKAMASLQNERDHLWNELEKFRKSEEGKQRSAAQPSTSPAEVQSLKKAMSSLQNDRDRLLKELKNLQQQYLQINQEITELHPLKAQLQEYQDKTKAFQIMQEELRQENLSWQHELHQLRMEKSSWEIHERRMKEQYLMAISDKDQQLSHLQNLIRELRSSSSQTQPLKVQYQRQASPETSASPDGSQNLVYETELLRTQLNDSLKEIHQKELRIQQLNSNFSQLLEEKNTLSIQLCDTSQSLRENQQHYGDLLNHCAVLEKQVQELQAGPLNIDVAPGAPQEKNGVHRKSDPEELREPQQSFSEAQQQLCNTRQEVNELRKLLEEERDQRVAAENALSVAEEQIRRLEHSEWDSSRTPIIGSCGTQEQALLIDLTSNSCRRTRSGVGWKRVLRSLCHSRTRVPLLAAIYFLMIHVLLILCFTGHL

SEQ ID NO: 36069 - protein, 246 aa, Homo sapiens
  Payload ID: 7141
  Gene Symbol: GORAB
  Gene Name: golgin, RAB6-interacting
  Uniprot ID: Q5T7V8
  ENSP ID: ENSP00000356736
MSWAAVLAVAAARFGHFWGCRWPGPMAQGWAGFSEEELRRLKQTKDPFEPQRRLPAKKSRQQLQREKALVEQSQKLGLQDGSTSLLPEQLLSAPKQRVNVQKPPFSSPTLPSHFTLTSPVGDGQPQGIESQPKELGLENSHDGHNNVEILPPKPDCKLEKKKVELQEKSRWEVLQQEQRLMEEKNKRKKALLAKAIAERSKRTQAETMKLKRIQKELQALDDMVSADIGILRNRIDQASLDYSYAR

SEQ ID NO: 36070 - protein, 394 aa, Homo sapiens
  Payload ID: 7141
  Gene Symbol: GORAB
  Gene Name: golgin, RAB6-interacting
  Uniprot ID: Q5T7V8
  ENSP ID: ENSP00000356737
MSWAAVLAVAAARFGHFWGCRWPGPMAQGWAGFSEEELRRLKQTKDPFEPQRRLPAKKSRQQLQREKALVEQSQKLGLQDGSTSLLPEQLLSAPKQRVNVQKPPFSSPTLPSHFTLTSPVGDGQPQGIESQPKELGLENSHDGHNNVEILPPKPDCKLEKKKVELQEKSRWEVLQQEQRLMEEKNKRKKALLAKAIAERSKRTQAETMKLKRIQKELQALDDMVSADIGILRNRIDQASLDYSYARKRFDRAEAEYIAAKLDIQRKTEIKEQLTEHLCTIIQQNELRKAKKLEELMQQLDVEADEETLELEVEVERLLHEQEVESRRPVVRLERPFQPAEESVTLEFAKENRKCQEQAVSPKVDDQCGNSSSIPFLSPNCPNQEGNDISAALAT

SEQ ID NO: 36071 - protein, 126 aa, Homo sapiens
  Payload ID: 7141
  Gene Symbol: GORAB
  Gene Name: golgin, RAB6-interacting
  ENSP ID: ENSP00000473336
  MOD_RES (1)..(1): Any amino acid
XSWAAVLAVAAARFGHFWGCRWPGPMAQGWAGFSEEELRRLKQTKGYKCPGLWSDSSRLMRRQTTKLCDSRYCKNLLQRQEEPHSAGDWMELGKISQSLCVSRGAFSRTKEKSTKDMNRYFLEKEI

SEQ ID NO: 36072 - protein, 2240 aa, Homo sapiens
  Payload ID: 7142
  Gene Symbol: GON4L
  Gene Name: gon-4-like (C. elegans)
  Uniprot ID: Q3T8J9
  ENSP ID: ENSP00000271883
MLPCKKRRTTVTESLQHKGNQEENNVDLESAVKPESDQVKDLSSVSLSWDPSHGRVAGFEVQSLQDAGNQLGMEDTSLSSGMLTQNTNVPILEGVDVAISQGITLPSLESFHPLNIHIGKGKLHATGSKRGKKMTLRPGPVTQEDRCDHLTLKEPFSGEPSEEVKEEGGKPQMNSEGEIPSLPSGSQSAKPVSQPRKSTQPDVCASPQEKPLRTLFHQPEEEIEDGGLFIPMEEQDNEESEKRRKKKKGTKRKRDGRGQEGTLAYDLKLDDMLDRTLEDGAKQHNLTAVNVRNILHEVITNEHVVAMMKAAISETEDMPMFEPKMTRSKLKEVVEKGVVIPTWNISPIKKANEIKPPQFVDIHLEEDDSSDEEYQPDDEEEDETAEESLLESDVESTASSPRGAKKSRLRQSSEMTETDEESGILSEAEKVTTPAIRHISAEVVPMGPPPPPKPKQTRDSTFMEKLHAVDEELASSPVCMDSFQPMDDSLIAFRTRSKMPLKDVPLGQLEAELQAPDITPDMYDPNTADDEDWKMWLGGLMNDDVGNEDEADDDDDPEYNFLEDLDEPDTEDFRTDRAVRITKKEVNELMEELFETFQDEMGFSNMEDDGPEEEECVAEPRPNFNTPQALRFEEPLANLLNEQHRTVKELFEQLKMKKSSAKQLQEVEKVKPQSEKVHQTLILDPAQRKRLQQQMQQHVQLLTQIHLLATCNPNLNPEATTTRIFLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKIVFTKAEDNLLALGLKHFEGTEFPNPLISKYLLTCKTAHQLTVRIKNLNMNRAPDNIIKFYKKTKQLPVLGKCCEEIQPHQWKPPIEREEHRLPFWLKASLPSIQEELRHMADGAREVGNMTGTTEINSDRSLEKDNLELGSESRYPLLLPKGVVLKLKPVATRFPRKAWRQKRSSVLKPLLIQPSPSLQPSFNPGKTPARSTHSEAPPSKMVLRIPHPIQPATVLQTVPGVPPLGVSGGESFESPAALPAVPPEARTSFPLSESQTLLSSAPVPKVMLPSLAPSKFRKPYVRRRPSKRRGVKASPCMKPAPVIHHPASVIFTVPATTVKIVSLGGGCNMIQPVNAAVAQSPQTIPITTLLVNPTSFPCPLNQSLVASSVSPLIVSGNSVNLPIPSTPEDKAHVNVDIACAVADGENAFQGLEPKLEPQELSPLSATVFPKVEHSPGPPLADAECQEGLSENSACRWTVVKTEEGRQALEPLPQGIQESLNNPTPGDLEEIVKMEPEEAREEISGSPERDICDDIKVEHAVELDTGAPSEELSSAGEVTKQTVLQKEEERSQPTKTPSSSQEPPDEGTSGTDVNKGSSKNALSSMDPEVRLSSPPGKPEDSSSVDGQSVGTPVGPETGGEKNGPEEEEEEDFDDLTQDEEDEMSSASEESVLSVPELQETMEKLTWLASERRMSQEGESEEENSQEENSEPEEEEEEEAEGMESLQKEDEMTDEAVGDSAEKPPTFASPETAPEVETSRTPPGESIKAAGKGRNNHRARNKRGSRARASKDTSKLLLLYDEDILERDPLREQKDLAFAQAYLTRVREALQHIPGKYEDFLQVIYEFESSTQRRTAVDLYKSLQILLQDWPQLLKDFAAFLLPEQALACGLFEEQQAFEKSRKFLRQLEICFAENPSHHQKIIKVLQGCADCLPQEITELKTQMWQLLKGHDHLQDEFSIFFDHLRPAASRMGDFEEINWTEEKEYEFDGFEEVALPDVEEEEEPPKIPTASKNKRKKEIGVQNHDKETEWPDGAKDCACSCHEGGPDSKLKKSKRRSCSHCSSKVCDSKSYKSKEPHELVGSSPHREASPMPGAKEAGQGKDMMEEEAPEERESTEATQSRTVRTTRKGEMPVSGLAVGSTLPSPREVTVTERLLLDGPPPHSPETPQFPPTTGAVLYTVKRNQVGPEVRSCPKASPRLQKEREGQKAVSESEALMLVWDASETEKLPGTVEPPASFLSPVSSKTRDAGRRHVSGKPDTQERWLPSSRARVKTRDRTCPVHESPSGIDTSETSPKAPRGGLAKDSGTQAKGPEGEQQPKAAEATVCANNSKVSSTGEKVVLWTREADRVILTMCQEQGAQPQTFNIISQQLGNKTPAEVSHRFRELMQLFHTACEASSEDEDDATSTSNADQLSDHGDLLSEEELDE

SEQ ID NO: 36073 - protein, 1529 aa, Homo sapiens
  Payload ID: 7142
  Gene Symbol: GON4L
  Gene Name: gon-4-like (C. elegans)
  Uniprot ID: Q3T8J9
  ENSP ID: ENSP00000354322
MLPCKKRRTTVTESLQHKGNQEENNVDLESAVKPESDQVKDLSSVSLSWDPSHGRVAGFEVQSLQDAGNQLGMEDTSLSSGMLTQNTNVPILEGVDVAISQGITLPSLESFHPLNIHIGKGKLHATGSKRGKKMTLRPGPVTQEDRCDHLTLKEPFSGEPSEEVKEEGGKPQMNSEGEIPSLPSGSQSAKPVSQPRKSTQPDVCASPQEKPLRTLFHQPEEEIEDGGLFIPMEEQDNEESEKRRKKKKGTKRKRDGRGQEGTLAYDLKLDDMLDRTLEDGAKQHNLTAVNVRNILHEVITNEHVVAMMKAAISETEDMPMFEPKMTRSKLKEVVEKGVVIPTWNISPIKKANEIKPPQFVDIHLEEDDSSDEEYQPDDEEEDETAEESLLESDVESTASSPRGAKKSRLRQSSEMTETDEESGILSEAEKVTTPAIRHISAEVVPMGPPPPPKPKQTRDSTFMEKLHAVDEELASSPVCMDSFQPMDDSLIAFRTRSKMPLKDVPLGQLEAELQAPDITPDMYDPNTADDEDWKMWLGGLMNDDVGNEDEADDDDDPEYNFLEDLDEPDTEDFRTDRAVRITKKEVNELMEELFETFQDEMGFSNMEDDGPEEEECVAEPRPNFNTPQALRFEEPLANLLNEQHRTVKELFEQLKMKKSSAKQLQEVEKVKPQSEKVHQTLILDPAQRKRLQQQMQQHVQLLTQIHLLATCNPNLNPEATTTRIFLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKIVFTKAEDNLLALGLKHFEGTEFPNPLISKYLLTCKTAHQLTVRIKNLNMNRAPDNIIKFYKKTKQLPVLGKCCEEIQPHQWKPPIEREEHRLPFWLKASLPSIQEELRHMADGAREVGNMTGTTEINSDRSLEKDNLELGSESRYPLLLPKGVVLKLKPVATRFPRKAWRQKRSSVLKPLLIQPSPSLQPSFNPGKTPARSTHSEAPPSKMVLRIPHPIQPATVLQTVPGVPPLGVSGGESFESPAALPAVPPEARTSFPLSESQTLLSSAPVPKVMLPSLAPSKFRKPYVRRRPSKRRGVKASPCMKPAPVIHHPASVIFTVPATTVKIVSLGGGCNMIQPVNAAVAQSPQTIPITTLLVNPTSFPCPLNQSLVASSVSPLIVSGNSVNLPIPSTPEDKAHVNVDIACAVADGENAFQGLEPKLEPQELSPLSATVFPKVEHSPGPPLADAECQEGLSENSACRWTVVKTEEGRQALEPLPQGIQESLNNPTPGDLEEIVKMEPEEAREEISGSPERDICDDIKVEHAVELDTGAPSEELSSAGEVTKQTVLQKEEERSQPTKTPSSSQEPPDEGTSGTDVNKGSSKNALSSMDPEVRLSSPPGKPEDSSSVDGQSVGTPVGPETGGEKNGPEEEEEEDFDDLTQDEEDEMSSASEESVLSVPELQVRAGEYSQVFRGLSNMYHLLICHLLACCTMDSPKIICI

SEQ ID NO: 36074 - protein, 2241 aa, Homo sapiens
  Payload ID: 7142
  Gene Symbol: GON4L
  Gene Name: gon-4-like (C. elegans)
  Uniprot ID: Q3T8J9
  ENSP ID: ENSP00000357315
MLPCKKRRTTVTESLQHKGNQEENNVDLESAVKPESDQVKDLSSVSLSWDPSHGRVAGFEVQSLQDAGNQLGMEDTSLSSGMLTQNTNVPILEGVDVAISQGITLPSLESFHPLNIHIGKGKLHATGSKRGKKMTLRPGPVTQEDRCDHLTLKEPFSGEPSEEVKEEGGKPQMNSEGEIPSLPSGSQSAKPVSQPRKSTQPDVCASPQEKPLRTLFHQPEEEIEDGGLFIPMEEQDNEESEKRRKKKKGTKRKRDGRGQEGTLAYDLKLDDMLDRTLEDGAKQHNLTAVNVRNILHEVITNEHVVAMMKAAISETEDMPMFEPKMTRSKLKEVVEKGVVIPTWNISPIKKANEIKPPQFVDIHLEEDDSSDEEYQPDDEEEDETAEESLLESDVESTASSPRGAKKSRLRQSSEMTETDEESGILSEAEKVTTPAIRHISAEVVPMGPPPPPKPKQTRDSTFMEKLHAVDEELASSPVCMDSFQPMDDSLIAFRTRSKMPLKDVPLGQLEAELQAPDITPDMYDPNTADDEDWKMWLGGLMNDDVGNEDEADDDDDPEYNFLEDLDEPDTEDFRTDRAVRITKKEVNELMEELFETFQDEMGFSNMEDDGPEEEECVAEPRPNFNTPQALRFEEPLANLLNEQHRTVKELFEQLKMKKSSAKQLQEVEKVKPQSEKVHQTLILDPAQRKRLQQQMQQHVQLLTQIHLLATCNPNLNPEATTTRIFLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKIVFTKAEDNLLALGLKHFEGTEFPNPLISKYLLTCKTAHQLTVRIKNLNMNRAPDNIIKFYKKTKQLPVLGKCCEEIQPHQWKPPIEREEHRLPFWLKASLPSIQEELRHMADGAREVGNMTGTTEINSDRSLEKDNLELGSESRYPLLLPKGVVLKLKPVATRFPRKAWRQKRSSVLKPLLIQPSPSLQPSFNPGKTPARSTHSEAPPSKMVLRIPHPIQPATVLQTVPGVPPLGVSGGESFESPAALPAVPPEARTSFPLSESQTLLSSAPVPKVMLPSLAPSKFRKPYVRRRPSKRRGVKASPCMKPAPVIHHPASVIFTVPATTVKIVSLGGGCNMIQPVNAAVAQSPQTIPITTLLVNPTSFPCPLNQSLVASSVSPLIVSGNSVNLPIPSTPEDKAHVNVDIACAVADGENAFQGLEPKLEPQELSPLSATVFPKVEHSPGPPLADAECQEGLSENSACRWTVVKTEEGRQALEPLPQGIQESLNNPTPGDLEEIVKMEPEEAREEISGSPERDICDDIKVEHAVELDTGAPSEELSSAGEVTKQTVLQKEEERSQPTKTPSSSQEPPDEGTSGTDVNKGSSKNALSSMDPEVRLSSPPGKPEDSSSVDGQSVGTPVGPETGGEKNGPEEEEEEDFDDLTQDEEDEMSSASEESVLSVPELQETMEKLTWLASERRMSQEGESEEENSQEENSEPEEEEEEEAEGMESLQKEDEMTDEAVGDSAEKPPTFASPETAPEVETSRTPPGESIKAAGKGRNNHRARNKRGSRARASKDTSKLLLLYDEDILERDPLREQKDLAFAQAYLTRVREALQHIPGKYEDFLQVIYEFESSTQRRTAVDLYKSLQILLQDWPQLLKDFAAFLLPEQALACGLFEEQQAFEKSRKFLRQLEICFAENPSHHQKIIKVLQGCADCLPQEITELKTQMWQLLKGHDHLQDEFSIFFDHLRPAASRMGDFEEINWTEEKEYEFDGFEEVALPDVEEEEEPPKIPTASKNKRKKEIGVQNHDKETEWPDGAKDCACSCHEGGPDSKLKKSKRRSCSHCSSKVCDSKSYKSKEPHELVGSSPHREASPMPGAKEAGQGKDMMEEEAPEERESTEATQSRTVRTTRKGEMPVSAGLAVGSTLPSPREVTVTERLLLDGPPPHSPETPQFPPTTGAVLYTVKRNQVGPEVRSCPKASPRLQKEREGQKAVSESEALMLVWDASETEKLPGTVEPPASFLSPVSSKTRDAGRRHVSGKPDTQERWLPSSRARVKTRDRTCPVHESPSGIDTSETSPKAPRGGLAKDSGTQAKGPEGEQQPKAAEATVCANNSKVSSTGEKVVLWTREADRVILTMCQEQGAQPQTFNIISQQLGNKTPAEVSHRFRELMQLFHTACEASSEDEDDATSTSNADQLSDHGDLLSEEELDE

SEQ ID NO: 36075 - protein, 2240 aa, Homo sapiens; identical to SEQ ID NO: 36072
  Payload ID: 7142
  Gene Symbol: GON4L
  Gene Name: gon-4-like (C. elegans)
  Uniprot ID: Q3T8J9
  ENSP ID: ENSP00000396117

SEQ ID NO: 36076 - protein, 1542 aa, Homo sapiens
  Payload ID: 7142
  Gene Symbol: GON4L
  Gene Name: gon-4-like (C. elegans)
  ENSP ID: ENSP00000478593
MLPCKKRRTTVTESLQHKGNQEENNVDLESAVKPESDQVKDLSSVSLSWDPSHGRVAGFEVQSLQDAGNQLGMEDTSLSSGMLTQNTNVPILEGVDVAISQGITLPSLESFHPLNIHIGKGKLHATGSKRGKKMTLRPGPVTQEDRCDHLTLKEPFSGEPSEEVKEEGGKPQMNSEGEIPSLPSGSQSAKPVSQPRKSTQPDVCASPQEKPLRTLFHQPEEEIEDGGLFIPMEEQDNEESEKRRKKKKGTKRKRDGRGQEGTLAYDLKLDDMLDRTLEDGAKQHNLTAVNVRNILHEVITNEHVVAMMKAAISETEDMPMFEPKMTRSKLKEVVEKGVVIPTWNISPIKKANEIKPPQFVDIHLEEDDSSDEEYQPDDEEEDETAEESLLESDVESTASSPRGAKKSRLRQSSEMTETDEESGILSEAEKVTTPAIRHISAEVVPMGPPPPPKPKQTRDSTFMEKLHAVDEELASSPVCMDSFQPMDDSLIAFRTRSKMPLKDVPLGQLEAELQAPDITPDMYDPNTADDEDWKMWLGGLMNDDVGNEDEADDDDDPEYNFLEDLDEPDTEDFRTDRAVRITKKEVNELMEELFETFQDEMGFSNMEDDGPEEEECVAEPRPNFNTPQALRFEEPLANLLNEQHRTVKELFEQLKMKKSSAKQLQEVEKVKPQSEKVHQTLILDPAQRKRLQQQMQQHVQLLTQIHLLATCNPNLNPEATTTRIFLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKIVFTKAEDNLLALGLKHFEGTEFPNPLISKYLLTCKTAHQLTVRIKNLNMNRAPDNIIKFYKKTKQLPVLGKCCEEIQPHQWKPPIEREEHRLPFWLKASLPSIQEELRHMADGAREVGNMTGTTEINSDRSLEKDNLELGSESRYPLLLPKGVVLKLKPVATRFPRKAWRQKRSSVLKPLLIQPSPSLQPSFNPGKTPARSTHSEAPPSKMVLRIPHPIQPATVLQTVPGVPPLGVSGGESFESPAALPAVPPEARTSFPLSESQTLLSSAPVPKVMLPSLAPSKFRKPYVRRRPSKRRGVKASPCMKPAPVIHHPASVIFTVPATTVKIVSLGGGCNMIQPVNAAVAQSPQTIPITTLLVNPTSFPCPLNQSLVASSVSPLIVSGNSVNLPIPSTPEDKAHVNVDIACAVADGENAFQGLEPKLEPQELSPLSATVFPKVEHSPGPPLADAECQEGLSENSACRWTVVKTEEGRQALEPLPQGIQESLNNPTPGDLEEIVKMEPEEAREEISGSPERDICDDIKVEHAVELDTGAPSEELSSAGEVTKQTVLQKEEERSQPTKTPSSSQEPPDEGTSGTDVNKGSSKNALSSMDPEVRLSSPPGKPEDSSSVDGQSVGTPVGPETGGEKNGPEEEEEEDFDDLTQDEEDEMSSASEESVLSVPELQVRAGEYSQVFRGLSNMYHLLICHLLACCTMDSPKIICIFVNALWDMIVELR

SEQ ID NO: 36077 - protein, 970 aa, Homo sapiens
  Payload ID: 7142
  Gene Symbol: GON4L
  Gene Name: gon-4-like (C. elegans)
  ENSP ID: ENSP00000481460
MLPCKKRRTTVTESLQHKGNQEENNVDLESAVKPESDQVKDLSSVSLSWDPSHGRVAGFEVQSLQDAGNQLGMEDTSLSSGMLTQNTNVPILEGVDVAISQGITLPSLESFHPLNIHIGKGKLHATGSKRGKKMTLRPGPVTQEDRCDHLTLKEPFSGEPSEEVKEEGGKPQMNSEGEIPSLPSGSQSAKPVSQPRKSTQPDVCASPQEKPLRTLFHQPEEEIEDGGLFIPMEEQDNEESEKRRKKKKGTKRKRDGRGQEGTLAYDLKLDDMLDRTLEDGAKQHNLTAVNVRNILHEVITNEHVVAMMKAAISETEDMPMFEPKMTRSKLKEVVEKGVVIPTWNISPIKKANEIKPPQFVDIHLEEDDSSDEEYQPDDEEEDETAEESLLESDVESTASSPRGAKKSRLRQSSEMTETDEESGILSEAEKVTTPAIRHISAEVVPMGPPPPPKPKQTRDSTFMEKLHAVDEELASSPVCMDSFQPMDDSLIAFRTRSKMPLKDVPLGQLEAELQAPDITPDMYDPNTADDEDWKMWLGGLMNDDVGNEDEADDDDDPEYNFLEDLDEPDTEDFRTDRAVRITKKEVNELMEELFETFQDEMGFSNMEDDGPEEEECVAEPRPNFNTPQALRFEEPLANLLNEQHRTVKELFEQLKMKKSSAKQLQEVEKVKPQSEKVHQTLILDPAQRKRLQQQMQQHVQLLTQIHLLATCNPNLNPEATTTRIFLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKIVFTKAEDNLLALGLKHFEGTEFPNPLISKYLLTCKTAHQLTVRIKNLNMNRAPDNIIKFYKKTKQLPVLGKCCEEIQPHQWKPPIEREEHRLPFWLKASLPSIQEELRHMADGARQSYRRKRRGVSQLKPLHLLKSPLMKEPQGQM

SEQ ID NO: 36078 - protein, 2241 aa, Homo sapiens; identical to SEQ ID NO: 36074
  Payload ID: 7142
  Gene Symbol: GON4L
  Gene Name: gon-4-like (C. elegans)
  Uniprot ID: Q3T8J9
  ENSP ID: ENSP00000483100

SEQ ID NO: 36079 - protein, 92 aa, Homo sapiens
  Payload ID: 7143
  Gene Symbol: GNRH1
  Gene Name: gonadotropin-releasing hormone 1 (luteinizing-releasing hormone)
  Uniprot ID: P01148
  ENSP ID: ENSP00000276414
MKPIQKLLAGLILLTWCVEGCSSQHWSYGLRPGGKRDAENLIDSFQEIVKEVGQLAETQRFECTTHQPRSPLRDLKGALESLIEEETGQKKI

SEQ ID NO: 36080 - protein, 92 aa, Homo sapiens; identical to SEQ ID NO: 36079
  Payload ID: 7143
  Gene Symbol: GNRH1
  Gene Name: gonadotropin-releasing hormone 1 (luteinizing-releasing hormone)
  Uniprot ID: P01148
  ENSP ID: ENSP00000391280

SEQ ID NO: 36081 - protein, 120 aa, Homo sapiens
  Payload ID: 7144
  Gene Symbol: GNRH2
  Gene Name: gonadotropin-releasing hormone 2
  Uniprot ID: O43555
  ENSP ID: ENSP00000245983
MASSRRGLLLLLLLTAHLGPSEAQHWSHGWYPGGKRALSSAQDPQNALRPPGRALDTAAGSPVQTAHGLPSDALAPLDDSMPWEGRTTAQWSLHRKRHLARTLLTAAREPRPAPPSSNKV

SEQ ID NO: 36082 - protein, 113 aa, Homo sapiens
  Payload ID: 7144
  Gene Symbol: GNRH2
  Gene Name: gonadotropin-releasing hormone 2
  Uniprot ID: O43555
  ENSP ID: ENSP00000352003
MASSRRGLLLLLLLTAHLGPSEAQHWSHGWYPGGKRALSSAQDPQNALRPPAGSPVQTAHGLPSDALAPLDDSMPWEGRTTAQWSLHRKRHLARTLLTAAREPRPAPPSSNKV

SEQ ID NO: 36083 - protein, 112 aa, Homo sapiens
  Payload ID: 7144
  Gene Symbol: GNRH2
  Gene Name: gonadotropin-releasing hormone 2
  Uniprot ID: O43555
  ENSP ID: ENSP00000369704
MASSRRGLLLLLLLTAHLGPSEAQHWSHGWYPGGKRALSSAQDPQNALRPPGSPVQTAHGLPSDALAPLDDSMPWEGRTTAQWSLHRKRHLARTLLTAAREPRPAPPSSNKV

SEQ ID NO: 36084 - protein, 113 aa, Homo sapiens; identical to SEQ ID NO: 36082
  Payload ID: 7144
  Gene Symbol: GNRH2
  Gene Name: gonadotropin-releasing hormone 2
  Uniprot ID: O43555
  ENSP ID: ENSP00000369705

SEQ ID NO: 36085 - protein, 328 aa, Homo sapiens
  Payload ID: 7145
  Gene Symbol: GNRHR
  Gene Name: gonadotropin-releasing hormone receptor
  Uniprot ID: P30968
  ENSP ID: ENSP00000226413
MANSASPEQNQNHCSAINNSIPLMQGNLPTLTLSGKIRVTVTFFLFLLSATFNASFLLKLQKWTQKKEKGKKLSRMKLLLKHLTLANLLETLIVMPLDGMWNITVQWYAGELLCKVLSYLKLFSMYAPAFMMVVISLDRSLAITRPLALKSNSKVGQSMVGLAWILSSVFAGPQLYIFRMIHLADSSGQTKVFSQCVTHCSFSQWWHQAFYNFFTFSCLFIIPLFIMLICNAKIIFTLTRVLHQDPHELQLNQSKNNIPRARLKTLKMTVAFATSFTVCWTPYYVLGIWYWFDPEMLNRLSDPVNHFFFLFAFLNPCFDPLIYGYFSL

SEQ ID NO: 36086 - protein, 249 aa, Homo sapiens
  Payload ID: 7145
  Gene Symbol: GNRHR
  Gene Name: gonadotropin-releasing hormone receptor
  Uniprot ID: P30968
  ENSP ID: ENSP00000397561
MANSASPEQNQNHCSAINNSIPLMQGNLPTLTLSGKIRVTVTFFLFLLSATFNASFLLKLQKWTQKKEKGKKLSRMKLLLKHLTLANLLETLIVMPLDGMWNITVQWYAGELLCKVLSYLKLFSMYAPAFMMVVISLDRSLAITRPLALKSNSKVGQSMVGLAWILSSVFAGPQLPLHHPSFHHADLQCKNHLHPDTGPSSGPPRTTTESVQEQYTKSTAEDSKNDGCICHFIYCLLDSLLCPRNLVLV

SEQ ID NO: 36087 - protein, 257 aa, Homo sapiens
  Payload ID: 7146
  Gene Symbol: GSC
  Gene Name: goosecoid homeobox
  Uniprot ID: P56915
  ENSP ID: ENSP00000238558
MPASMFSIDNILAARPRCKDSVLPVAHSAAAPVVFPALHGDSLYGASGGASSDYGAFYPRPVAPGGAGLPAAVSGSRLGYNNYFYGQLHVQAAPVGPACCGAVPPLGAQQCSCVPTPPGYEGPGSVLVSPVPHQMLPYMNVGTLSRTELQLLNQLHCRRKRRHRTIFTDEQLEALENLFQETKYPDVGTREQLARKVHLREEKVEVWFKNRRAKWRRQKRSSSEESENAEKWNKTSSSKASPEKREEEGKSDLDSDS

SEQ ID NO: 36088 - protein, 205 aa, Homo sapiens
  Payload ID: 7147
  Gene Symbol: GSC2
  Gene Name: goosecoid homeobox 2
  Uniprot ID: O15499
  ENSP ID: ENSP00000086933
MAAAAGGAASRRGAGRPCPFSIEHILSSLPERSLPARAACPPQPAGRQSPAKPEEPGAPEAAPCACCCCCGPRAAPCGPPEAAAGLGARLAWPLRLGPAVPLSLGAPAGGSGALPGAVGPGSQRRTRRHRTIFSEEQLQALEALFVQNQYPDVSTRERLAGRIRLREERVEVWFKNRRAKWRHQKRASASARLLPGVKKSPKGSC

SEQ ID NO: 36089 - protein, 170 aa, Homo sapiens
  Payload ID: 7148
  Gene Symbol: GPALPP1
  Gene Name: GPALPP motifs containing 1
  Uniprot ID: Q8IXQ4
  ENSP ID: ENSP00000350145
MKEKLTKGDDDSSKPIVRESWMTELPPEMKDFGLGPRTFKRRADDTSGDRSIWTDTPADRERKAKETQEARKSSSKKDEEHILSGRDKRLAEQVSSYNESKRSESLMDIHHKKLKSKAAEDKNKPQERIPFDRDKDLKVNRFDEAQKKALIKKSRELNTRFSHGKGNMFL

SEQ ID NO: 36090 - protein, 338 aa, Homo sapiens
  Payload ID: 7148
  Gene Symbol: GPALPP1
  Gene Name: GPALPP motifs containing 1
  ENSP ID: ENSP00000355211
MARDLIGPALPPGFKARGTAEDEERDPSPGPALPPNYKSSSSDSSDSDEDSSSLYEEGNQESEEDDSGPTARKQRKNQDDDDDDDDGFFGPALPPGFKKQDDSPPRPIIGPALPPGFIKSTQKSDKGRDDPGQQETDSSEDEDIIGPMPAKGPVNYNVTTEFEKRAQRMKEKLTKGDDDSSKPIVRESWMTELPPEMKDFGLGPRTFKRRADDTSGDRSIWTDTPADRERKAKETQEARKSSSKKDEEHILSGRDKRLAEQVSSYNESKRSESLMDIHHKKLKSKAAEDKNKPQERIPFDRDKDLKVNRFDEAQKKALIKKSRELNTRFSHGKGNMFL

SEQ ID NO: 36091 - protein, 340 aa, Homo sapiens
  Payload ID: 7148
  Gene Symbol: GPALPP1
  Gene Name: GPALPP motifs containing 1
  Uniprot ID: Q8IXQ4
  ENSP ID: ENSP00000368447
MARDLIGPALPPGFKARGTAEDEERDPSPVAGPALPPNYKSSSSDSSDSDEDSSSLYEEGNQESEEDDSGPTARKQRKNQDDDDDDDDGFFGPALPPGFKKQDDSPPRPIIGPALPPGFIKSTQKSDKGRDDPGQQETDSSEDEDIIGPMPAKGPVNYNVTTEFEKRAQRMKEKLTKGDDDSSKPIVRESWMTELPPEMKDFGLGPRTFKRRADDTSGDRSIWTDTPADRERKAKETQEARKSSSKKDEEHILSGRDKRLAEQVSSYNESKRSESLMDIHHKKLKSKAAEDKNKPQERIPFDRDKDLKVNRFDEAQKKALIKKSRELNTRFSHGKGNMFL

SEQ ID NO: 36092 - protein, 340 aa, Homo sapiens; identical to SEQ ID NO: 36091
  Payload ID: 7148
  Gene Symbol: GPALPP1
  Gene Name: GPALPP motifs containing 1
  Uniprot ID: Q8IXQ4
  ENSP ID: ENSP00000432500

SEQ ID NO: 36093 - protein, 100 aa, Homo sapiens
  Payload ID: 7148
  Gene Symbol: GPALPP1
  Gene Name: GPALPP motifs containing 1
  ENSP ID: ENSP00000480028
MARDLIGPALPPGFKARGTAEDEERDPSPGKRRRLRCPPGPSTHSLAGPCSLKKVGGLGGRRSGEWARPDPRELFSSQTVAGGRRLGDPPRNELWRGLAS

SEQ ID NO: 36094 - protein, 388 aa, Homo sapiens
  Payload ID: 7149
  Gene Symbol: GPN1
  Gene Name: GPN-loop GTPase 1
  Uniprot ID: Q9HCN4
  ENSP ID: ENSP00000264718
MRCLYGRVGGARRKMAASAAAAELQASGGPRHPVCLLVLGMAGSGKTTFVQRLTGHLHAQGTPPYVINLDPAVHEVPFPANIDIRDTVKYKEVMKQYGLGPNGGIVTSLNLFATRFDQVMKFIEKAQNMSKYVLIDTPGQIEVFTWSASGTIITEALASSFPTVVIYVMDTSRSTNPVTFMSNMLYACSILYKTKLPFIVVMNKTDIIDHSFAVEWMQDFEAFQDALNQETTYVSNLTRSMSLVLDEFYSSLRVVGVSAVLGTGLDELFVQVTSAAEEYEREYRPEYERLKKSLANAESQQQREQLERLRKDMGSVALDAGTAKDSLSPVLHPSDLILTRGTLDEEDEEADSDTDDIDHRVTEESHEEPAFQNFMQESMAQYWKRNNK

SEQ ID NO: 36095 - protein, 362 aa, Homo sapiens
  Payload ID: 7149
  Gene Symbol: GPN1
  Gene Name: GPN-loop GTPase 1
  Uniprot ID: Q9HCN4
  ENSP ID: ENSP00000384255
MTGHTRSSLPRCTGIVLLIKLRFSERLTGHLHAQGTPPYVINLDPAVHEVPFPANIDIRDTVKYKEVMKQYGLGPNGGIVTSLNLFATRFDQVMKFIEKAQNMSKYVLIDTPGQIEVFTWSASGTIITEALASSFPTVVIYVMDTSRSTNPVTFMSNMLYACSILYKTKLPFIVVMNKTDIIDHSFAVEWMQDFEAFQDALNQETTYVSNLTRSMSLVLDEFYSSLRVVGVSAVLGTGLDELFVQVTSAAEEYEREYRPEYERLKKSLANAESQQQREQLERLRKDMGSVALDAGTAKDSLSPVLHPSDLILTRGTLDEEDEEADSDTDDIDHRVTEESHEEPAFQNFMQESMAQYWKRNNK

SEQ ID NO: 36096 - protein, 73 aa, Homo sapiens
  Payload ID: 7149
  Gene Symbol: GPN1
  Gene Name: GPN-loop GTPase 1
  ENSP ID: ENSP00000395981
MAASAAAAELQASGGPRHPVCLLVLGMAGSGKTTFVQRLTGHLHAQGTPPYVINLDPAVHEVPFPANIGDEIY

SEQ ID NO: 36097 - protein, 295 aa, Homo sapiens
  Payload ID: 7149
  Gene Symbol: GPN1
  Gene Name: GPN-loop GTPase 1
  Uniprot ID: Q9HCN4
  ENSP ID: ENSP00000398115
MKQYGLGPNGGIVTSLNLFATRFDQVMKFIEKAQNMSKYVLIDTPGQIEVFTWSASGTIITEALASSFPTVVIYVMDTSRSTNPVTFMSNMLYACSILYKTKLPFIVVMNKTDIIDHSFAVEWMQDFEAFQDALNQETTYVSNLTRSMSLVLDEFYSSLRVVGVSAVLGTGLDELFVQVTSAAEEYEREYRPEYERLKKSLANAESQQQREQLERLRKDMGSVALDAGTAKDSLSPVLHPSDLILTRGTLDEEDEEADSDTDDIDHRVTEESHEEPAFQNFMQESMAQYWKRNNK

SEQ ID NO: 36098 - protein, 279 aa, Homo sapiens
  Payload ID: 7149
  Gene Symbol: GPN1
  Gene Name: GPN-loop GTPase 1
  Uniprot ID: Q9HCN4
  ENSP ID: ENSP00000412170
MKFPFLPILVMKFIEKAQNMSKYVLIDTPGQIEVFTWSASGTIITEALASSFPTVVIYVMDTSRSTNPVTFMSNMLYACSILYKTKLPFIVVMNKTDIIDHSFAVEWMQDFEAFQDALNQETTYVSNLTRSMSLVLDEFYSSLRVVGVSAVLGTGLDELFVQVTSAAEEYEREYRPEYERLKKSLANAESQQQREQLERLRKDMGSVALDAGTAKDSLSPVLHPSDLILTRGTLDEEDEEADSDTDDIDHRVTEESHEEPAFQNFMQESMAQYWKRNNK

SEQ ID NO: 36099 - protein, 295 aa, Homo sapiens; identical to SEQ ID NO: 36097
  Payload ID: 7149
  Gene Symbol: GPN1
  Gene Name: GPN-loop GTPase 1
  Uniprot ID: Q9HCN4
  ENSP ID: ENSP00000424678

SEQ ID NO: 36100 - protein, 279 aa, Homo sapiens; identical to SEQ ID NO: 36098
  Payload ID: 7149
  Gene Symbol: GPN1
  Gene Name: GPN-loop GTPase 1
  Uniprot ID: Q9HCN4
  ENSP ID: ENSP00000427269

SEQ ID NO: 36101 - protein, 374 aa, Homo sapiens
  Payload ID: 7149
  Gene Symbol: GPN1
  Gene Name: GPN-loop GTPase 1
  Uniprot ID: Q9HCN4
  ENSP ID: ENSP00000476446
MAASAAAAELQASGGPRHPVCLLVLGMAGSGKTTFVQRLTGHLHAQGTPPYVINLDPAVHEVPFPANIDIRDTVKYKEVMKQYGLGPNGGIVTSLNLFATRFDQVMKFIEKAQNMSKYVLIDTPGQIEVFTWSASGTIITEALASSFPTVVIYVMDTSRSTNPVTFMSNMLYACSILYKTKLPFIVVMNKTDIIDHSFAVEWMQDFEAFQDALNQETTYVSNLTRSMSLVLDEFYSSLRVVGVSAVLGTGLDELFVQVTSAAEEYEREYRPEYERLKKSLANAESQQQREQLERLRKDMGSVALDAGTAKDSLSPVLHPSDLILTRGTLDEEDEEADSDTDDIDHRVTEESHEEPAFQNFMQESMAQYWKRNNK

SEQ ID NO: 36102 - protein, 388 aa, Homo sapiens; identical to SEQ ID NO: 36094
  Payload ID: 7149
  Gene Symbol: GPN1
  Gene Name: GPN-loop GTPase 1
  Uniprot ID: Q9HCN4
  ENSP ID: ENSP00000484680

SEQ ID NO: 36103 - protein, 131 aa, Homo sapiens
  Payload ID: 7150
  Gene Symbol: GPN2
  Gene Name: GPN-loop GTPase 2
  ENSP ID: ENSP00000363248
MLAGLELLTSAFNLDYYTEVLDLSYLLDHLASDPFFRHYRQLNEKLVQLIEDYSLVSFIPLNIQDKESIQRVLQAVDKANGYCFRAQEQRSLEAMMSAAMGADFHFSSTLGIQEKYLAPSNQSVEQEAMQL

SEQ ID NO: 36104 - protein, 310 aa, Homo sapiens
  Payload ID: 7150
  Gene Symbol: GPN2
  Gene Name: GPN-loop GTPase 2
  Uniprot ID: Q9H9Y4
  ENSP ID: ENSP00000363250
MAGAAPTTAFGQAVIGPPGSGKTTYCLGMSEFLRALGRRVAVVNLDPANEGLPYECAVDVGELVGLGDVMDALRLGPNGGLLYCMEYLEANLDWLRAKLDPLRGHYFLFDCPGQVELCTHHGALRSIFSQMAQWDLRLTAVHLVDSHYCTDPAKFISVLCTSLATMLHVELPHINLLSKMDLIEHYGKLAFNLDYYTEVLDLSYLLDHLASDPFFRHYRQLNEKLVQLIEDYSLVSFIPLNIQDKESIQRVLQAVDKANGYCFRAQEQRSLEAMMSAAMGADFHFSSTLGIQEKYLAPSNQSVEQEAMQL

SEQ ID NO: 36105 - protein, 112 aa, Homo sapiens
  Payload ID: 7150
  Gene Symbol: GPN2
  Gene Name: GPN-loop GTPase 2
  ENSP ID: ENSP00000408257
MAGAAPTTAFGQAVIGPPGSGKTTYCLGMSEFLRALGRRVAVVNLDPANEGRLAQHLLPNGAVGPQADCRPPRGFSLLHRPCQVHFSTVYLPGHHAARGTAPHQPPFQDGPH

SEQ ID NO: 36106 - protein, 284 aa, Homo sapiens
  Payload ID: 7151
  Gene Symbol: GPN3
  Gene Name: GPN-loop GTPase 3
  Uniprot ID: Q9UHW5
  ENSP ID: ENSP00000228827
MPRYAQLVMGPAGSGKSTYCATMVQHCEALNRSVQVVNLDPAAEHFNYSVMADIRELIEVDDVMEDDSLRFGPNGGLVFCMEYFANNFDWLENCLGHVEDDYILFDCPGQIELYTHLPVMKQLVQQLEQWEFRVCGVFLVDSQFMVESFKFISGILAALSAMISLEIPQVNIMTKMDLLSKKAKKEIEKFLDPDMYSLLEDSTSDLRSKKFKKLTKAICGLIDDYSMVRFLPYDQSDEESMNIVLQHIDFAIQYGEDLEFKEPKEREDESSSMFDEYFQECQDE

SEQ ID NO: 36107 - protein, 323 aa, Homo sapiens
  Payload ID: 7151
  Gene Symbol: GPN3
  Gene Name: GPN-loop GTPase 3
  Uniprot ID: Q9UHW5
  ENSP ID: ENSP00000442770
MLPKTRGAFHFSIPDPQHICKSRGSPYRSNVCTQTTDRSTWRKDAELYLLSVITQSTYCATMVQHCEALNRSVQVVNLDPAAEHFNYSVMADIRELIEVDDVMEDDSLRFGPNGGLVFCMEYFANNFDWLENCLGHVEDDYILFDCPGQIELYTHLPVMKQLVQQLEQWEFRVCGVFLVDSQFMVESFKFISGILAALSAMISLEIPQVNIMTKMDLLSKKAKKEIEKFLDPDMYSLLEDSTSDLRSKKFKKLTKAICGLIDDYSMVRFLPYDQSDEESMNIVLQHIDFAIQYGEDLEFKEPKEREDESSSMFDEYFQECQDE

SEQ ID NO: 36108 - protein, 294 aa, Homo sapiens
  Payload ID: 7151
  Gene Symbol: GPN3
  Gene Name: GPN-loop GTPase 3
  Uniprot ID: Q9UHW5
  ENSP ID: ENSP00000443068
MPRYAQLVMGPAGSGKVRICGDKERKSTYCATMVQHCEALNRSVQVVNLDPAAEHFNYSVMADIRELIEVDDVMEDDSLRFGPNGGLVFCMEYFANNFDWLENCLGHVEDDYILFDCPGQIELYTHLPVMKQLVQQLEQWEFRVCGVFLVDSQFMVESFKFISGILAALSAMISLEIPQVNIMTKMDLLSKKAKKEIEKFLDPDMYSLLEDSTSDLRSKKFKKLTKAICGLIDDYSMVRFLPYDQSDEESMNIVLQHIDFAIQYGEDLEFKEPKEREDESSSMFDEYFQECQDE

SEQ ID NO: 36109 - protein, 159 aa, Homo sapiens
  Payload ID: 7151
  Gene Symbol: GPN3
  Gene Name: GPN-loop GTPase 3
  ENSP ID: ENSP00000447480
MVQHCEALNRSVQVVNLDPAAEHFNYSVMADIRELIEVDDVMEDDSLRFGPNGGLVFCMEYFANNFDWLENCLGHVEDDYILFDCPGQIELYTHLPVMKQLVQQLEQWEFRVCGVFLVDSQFMVESFKFISGILAALSAMISLEIPQVNIMTKMDLLSK

SEQ ID NO: 36110 - protein, 120 aa, Homo sapiens
  Payload ID: 7151
  Gene Symbol: GPN3
  Gene Name: GPN-loop GTPase 3
  ENSP ID: ENSP00000448159
FISGILAALSAMISLEIPQVNIMTKMDLLSKKAKKEIEKFLDPDMYSLLEDSTSDLRSKKFKKLTKAICGLSDEESMNIVLQHIDFAIQYGEDLEFKEPKEREDESSSMFDEYFQECQDE

SEQ ID NO: 36111 - protein, 118 aa, Homo sapiens
  Payload ID: 7151
  Gene Symbol: GPN3
  Gene Name: GPN-loop GTPase 3
  ENSP ID: ENSP00000448335
  MOD_RES (1)..(1): Any amino acid
XIRELIEVDDVMEDDSLRFGPNGGLVFCMEYFANNFDWLENCLGHVEDDYILFDCPGQIELYTHLPVMKQLVQQLEQWEFRVCGVFLVDSQFMVESFKIDDYSMVRFLPYDQSDEESM

SEQ ID NO: 36112 - protein, 25 aa, Homo sapiens
  Payload ID: 7151
  Gene Symbol: GPN3
  Gene Name: GPN-loop GTPase 3
  ENSP ID: ENSP00000474521
MPRYAQLVMGPAGSGKSTYCATMVQ

SEQ ID NO: 36113 - protein, 556 aa, Homo sapiens
  Payload ID: 7152
  Gene Symbol: GPR75-ASB3
  Gene Name: GPR75-ASB3 readthrough
  ENSP ID: ENSP00000385085
MAMMPLVLHHPERQAELGSGLRDGGGAALRPPGRLVKQMDFTEAYADTCSTVGLAAREGNVKVLRKLLKKGRSVDVADNRGWMPIHEAAYHNSVECLQMLINADSSENYIKMKTFEGFCALHLAASQGHWKIVQILLEAGADPNATTLEETTPLFLAVENGQIDVLRLLLQHGANVNGSHSMCGWNSLHQASFQENAEIIKLLLRKGANKECQDDFGITPLFVAAQYGKLESLSILISSGANVNCQALDKATPLFIAAQEGHTKCVELLLSSGADPDLYCNEDSWQLPIHAAAQMGHTKILDLLIPLTNRACDTGLNKVSPVYSAVFGGHEDCLEILLRNGYSPDAQACLVFGFSSPVCMAFQKDCEFFGIVNILLKYGAQINELHLAYCLKYEKFSIFRYFLRKGCSLGPWNHIYEFVNHAIKAQAKYKEWLPHLLVAGFDPLILLCNSWIDSVSIDTLIFTLEFTNWKTLAPAVERMLSARASNAWILQQHIATVPSLTHLCRLEIRSSLKSERLRSDSYISQLPLPRSLHNYLLYEDVLRMYEVPELAAIQDG

SEQ ID NO: 36114 - protein, 776 aa, Homo sapiens
  Payload ID: 7153
  Gene Symbol: GPRIN3
  Gene Name: GPRIN family member 3
  Uniprot ID: Q6ZVF9
  ENSP ID: ENSP00000328672
MGTVPDPLRSAKTSLIAASGKEDDLGEPQAASPRHRPALLCKNANGFSGAPAEPDLSPRAAAEALMQVCEHETTQPDMSSPGVFNEVQKAPATFNSPGNPQLPGSSQPAASAPSSAAGRDLIHTPLTMPANQHTCQSIPGDQPNAITSSMPEDSLMRSQRTSNREQPEKPSCPVGGVLSSSKDQVSCEFPSPETIQGTVQTPVTAARVVSHSSSPVGGPEGERQGAICDSEMRSCKPLTRESGCSENKQPSVTASGPQGTTSVTPQPTPLTSEPSACPPGPEKVPLPAQRQMSRFKEASTMTNQAESEIKEVPSRAWQDAEVQAVASVESRSVSTSPSILTAFLKESRAPEHFEQEQLRVICHSSGSHTLELSDSTLAPQESSQCPGIMPQVHIQAAAAESTAFQRENKLASLPGGVLKTSSINLVSSNAQHTCKEDGRLAGMTPVREESTAKKLAGTNSSSLKATAIDQISISACSQAETSYGLGKFETRPSEFAEKTTNGHKTDPDCKLSDSCGSISKADHSGSLDPTNKGDAREKKPASPQVVKEKESTGTDTSDAKTLLLNPKSQESGGTESAANPTPSPIRKNQESTLEENRQTKTATSLSLPSDPMGDSSPGSGKKTPSRSVKASPRRPSRVSEFLKEQKLNVTAAAAQVGLTPGDKKKQLGADSKLQLKQSKRVRDVVWDEQGMTWEVYGASLDAESLGIAIQNHLQRQIREHEKLIKTQNSQTRRSISSDTSSNKKLRGRQHSVFQSMLQNFRRPNCCVRPAPSSVLD

SEQ ID NO: 36115 - protein, 776 aa, Homo sapiens; identical to SEQ ID NO: 36114
  Payload ID: 7153
  Gene Symbol: GPRIN3
  Gene Name: GPRIN family member 3
  Uniprot ID: Q6ZVF9
  ENSP ID: ENSP00000476603

SEQ ID NO: 36116 - protein, 166 aa, Homo sapiens
  Payload ID: 7154
  Gene Symbol: GPSM1
  Gene Name: G-protein signaling modulator 1
  Uniprot ID: Q86YR5
  ENSP ID: ENSP00000291775
MDDQRCPLDDGQAGAAEATAAPTLEDRIAQPSMTASPQTEEFFDLIASSQSRRLDDQRASVGSLPGLRITHSNAGHLRGHGEPQEPGDDFFNMLIKYQSSRIDDQRCPPPDVLPRGPTMPDEDFFSLIQRVQAKRMDEQRVDLAGGPEQGAGGPPEPQQQCQPGAS

SEQ ID NO: 36117 - protein, 653 aa, Homo sapiens
  Payload ID: 7154
  Gene Symbol: GPSM1
  Gene Name: G-protein signaling modulator 1
  ENSP ID: ENSP00000346797
  MOD_RES (1)..(1): Any amino acid
XMEASCLELALEGERLCKAGDFKTGVAFFEAAVQVGTEDLKTLSAIYSQLGNAYFYLKEHGRALEYHKHDLLLARTIGDRMGEAKASGNLGNTLKVLGRFDEAAVCCQRHLSIAQEQGDKVGEARALYNIGNVYHAKGKQLSWNAANATQDPGHLPPDVRETLCKASEFYERNLSLVKELGDRAAQGRAYGNLGNTHYLLGNFTEATTFHKERLAIAKEFGDKAAERRAYSNLGNAHVFLGRFDVAAEYYKKTLQLSRQLRDQAVEAQACYSLGNTYTLLQDYERAAEYHLRHLLIAQELADRVGEGRACWSLGNAYVSMGRPAQALTFAKKHLQISQEIGDRHGELTARMNVAQLQLVLGRLTSPAASEKPDLAGYEAQGARPKRTQRLSAETWDLLRLPLEREQNGDSHHSGDWRGPSRDSLPLPVRSRKYQEGPDAERRPREGSHSPLDSADVRVHVPRTSIPRAPSSDEECFFDLLTKFQSSRMDDQRCPLDDGQAGAAEATAAPTLEDRIAQPSMTASPQTEEFFDLIASSQSRRLDDQRASVGSLPGLRITHSNAGHLRGHGEPQEPGDDFFNMLIKYQSSRIDDQRCPPPDVLPRGPTMPDEDFFSLIQRVQAKRMDEQRVDLAGGPEQGAGGPPEPQQQCQPGAS

SEQ ID NO: 36118 - protein, 166 aa, Homo sapiens; identical to SEQ ID NO: 36116
  Payload ID: 7154
  Gene Symbol: GPSM1
  Gene Name: G-protein signaling modulator 1
  Uniprot ID: Q86YR5
  ENSP ID: ENSP00000376673

SEQ ID NO: 36119 - protein, 166 aa, Homo sapiens; identical to SEQ ID NO: 36116
  Payload ID: 7154
  Gene Symbol: GPSM1
  Gene Name: G-protein signaling modulator 1
  Uniprot ID: Q86YR5
  ENSP ID: ENSP00000390705

SEQ ID NO: 36120 - protein, 675 aa, Homo sapiens
  Payload ID: 7154
  Gene Symbol: GPSM1
  Gene Name: G-protein signaling modulator 1
  ENSP ID: ENSP00000392828
MAGPAPPAADELPGPAARRLYSRMEASCLELALEGERLCKAGDFKTGVAFFEAAVQVGTEDLKTLSAIYSQLGNAYFYLKEHGRALEYHKHDLLLARTIGDRMGEAKASGNLGNTLKVLGRFDEAAVCCQRHLSIAQEQGDKVGEARALYNIGNVYHAKGKQLSWNAANATQDPGHLPPDVRETLCKASEFYERNLSLVKELGDRAAQGRAYGNLGNTHYLLGNFTEATTFHKERLAIAKEFGDKAAERRAYSNLGNAHVFLGRFDVAAEYYKKTLQLSRQLRDQAVEAQACYSLGNTYTLLQDYERAAEYHLRHLLIAQELADRVGEGRACWSLGNAYVSMGRPAQALTFAKKHLQISQEIGDRHGELTARMNVAQLQLVLGRLTSPAASEKPDLAGYEAQGARPKRTQRLSAETWDLLRLPLEREQNGDSHHSGDWRGPSRDSLPLPVRSRKYQEGPDAERRPREGSHSPLDSADVRVHVPRTSIPRAPSSDEECFFDLLTKFQSSRMDDQRCPLDDGQAGAAEATAAPTLEDRIAQPSMTASPQTEEFFDLIASSQSRRLDDQRASVGSLPGLRITHSNAGHLRGHGEPQEPGDDFFNMLIKYQSSRIDDQRCPPPDVLPRGPTMPDEDFFSLIQRVQAKRMDEQRVDLAGGPEQGAGGPPEPQQQCQPGAS

SEQ ID NO: 36121 - protein, 457 aa, Homo sapiens
  Payload ID: 7154
  Gene Symbol: GPSM1
  Gene Name: G-protein signaling modulator 1
  ENSP ID: ENSP00000479405
MAGPAPPAADELPGPAARRLYSRMEASCLELALEGERLCKAGDFKTGVAFFEAAVQVGTEDLKTLSAIYSQLGNAYFYLKEHGRALEYHKHDLLLARTIGDRMGEAKASGNLGNTLKVLGRFDEAAVCCQRHLSIAQEQGDKVGEARALYNIGNVYHAKGKQLSWNAANATQDPGHLPPDVRETLCKASEFYERNLSLVKELGDRAAQGRAYGNLGNTHYLLGNFTEATTFHKERLAIAKEFGDKAAERRAYSNLGNAHVFLGRFDVAAEYYKKTLQLSRQLRDQAVEAQACYSLGNTYTLLQDYERAAEYHLRHLLIAQELADRVGEGRACWSLGNAYVSMGRPAQALTFAKKHLQISQEIGDRHGELTARMNVAQLQLVLGRLTSPAASEKPDLAGYEAQGEFQGCGGVLLPTGTDRIRSCGGVGSRPGQHGGGGSRQKMAPTSQFFLASGTAQA

SEQ ID NO: 36122 - protein, 684 aa, Homo sapiens
  Payload ID: 7155
  Gene Symbol: GPSM2
  Gene Name: G-protein signaling modulator 2
  Uniprot ID: P81274
  ENSP ID: ENSP00000264126
MEENLISMREDHSFHVRYRMEASCLELALEGERLCKSGDCRAGVSFFEAAVQVGTEDLKTLSAIYSQLGNAYFYLHDYAKALEYHHHDLTLARTIGDQLGEAKASGNLGNTLKVLGNFDEAIVCCQRHLDISRELNDKVGEARALYNLGNVYHAKGKSFGCPGPQDVGEFPEEVRDALQAAVDFYEENLSLVTALGDRAAQGRAFGNLGNTHYLLGNFRDAVIAHEQRLLIAKEFGDKAAERRAYSNLGNAYIFLGEFETASEYYKKTLLLARQLKDRAVEAQSCYSLGNTYTLLQDYEKAIDYHLKHLAIAQELNDRIGEGRACWSLGNAYTALGNHDQAMHFAEKHLEISREVGDKSGELTARLNLSDLQMVLGLSYSTNNSIMSENTEIDSSLNGVRPKLGRRHSMENMELMKLTPEKVQNWNSEILAKQKPLIAKPSAKLLFVNRLKGKKYKTNSSTKVLQDASNSIDHRIPNSQRKISADTIGDEGFFDLLSRFQSNRMDDQRCCLQEKNCHTASTTTSSTPPKMMLKTSSVPVVSPNTDEFLDLLASSQSRRLDDQRASFSNLPGLRLTQNSQSVLSHLMTNDNKEADEDFFDILVKCQGSRLDDQRCAPPPATTKGPTVPDEDFFSLILRSQGKRMDEQRVLLQRDQNRDTDFGLKDFLQNNALLEFKNSGKKSADH

SEQ ID NO: 36123 - protein, 684 aa, Homo sapiens; identical to SEQ ID NO: 36122
  Payload ID: 7155
  Gene Symbol: GPSM2
  Gene Name: G-protein signaling modulator 2
  Uniprot ID: P81274
  ENSP ID: ENSP00000385510

SEQ ID NO: 36124 - protein, 217 aa, Homo sapiens
  Payload ID: 7155
  Gene Symbol: GPSM2
  Gene Name: G-protein signaling modulator 2
  ENSP ID: ENSP00000390629
  MOD_RES (1)..(1): Any amino acid
XMELMKLTPEKVQNWNSEILAKQKPLIAKPSAKLLFVNRLKGKKYKTNSSTKVLQDASNSIDHRIPNSQRKISADTIGDEGFFDLLSRFQSNRMDDQRCCLQEKNCHTASTTTSSTPPKMMLKTSSVPVVSPNTDEFLDLLASSQSRRLDDQRASFSNLPGLRLTQNSQSVLSHLMTNDNKEADEDFFDILVKCQVCLYIFFVLHTAQIPLKTLVVL

SEQ ID NO: 36125 - protein, 52 aa, Homo sapiens
  Payload ID: 7155
  Gene Symbol: GPSM2
  Gene Name: G-protein signaling modulator 2
  ENSP ID: ENSP00000392138
MEENLISMREDHSFHVRYRMEASCLELALEGERLCKSGDCRAGVSFFEAAVQ

SEQ ID NO: 36126 - protein, 75 aa, Homo sapiens
  Payload ID: 7155
  Gene Symbol: GPSM2
  Gene Name: G-protein signaling modulator 2
  ENSP ID: ENSP00000401948
MEENLISMREDHSFHVRYRMEASCLELALEGERLCKSGDCRAGVSFFEAAVQVGTEDLKTLSAIYSQLGNAYFYL

SEQ ID NO: 36127 - protein, 213 aa, Homo sapiens
  Payload ID: 7155
  Gene Symbol: GPSM2
  Gene Name: G-protein signaling modulator 2
  ENSP ID: ENSP00000408664
MEENLISMREDHSFHVRYRMEASCLELALEGERLCKSGDCRAGVSFFEAAVQVGTEDLKTLSAIYSQLGNAYFYLHDYAKALEYHHHDLTLARTIGDQLGEAKASGNLGNTLKVLGNFDEAIVCCQRHLDISRELNDKVGEARALYNLGNVYHAKGKSFGCPGPQDVGEFPEEVRDALQAAVDFYEENLSLVTALGDRAAQGRAFGNLGNTHY

SEQ ID NO: 36128 - protein, 160 aa, Homo sapiens
  Payload ID: 7156
  Gene Symbol: GPSM3
  Gene Name: G-protein signaling modulator 3
  Uniprot ID: Q9Y4H4
  ENSP ID: ENSP00000364180
MEAERPQEEEDGEQGPPQDEEGWPPPNSTTRPWRSAPPSPPPPGTRHTALGPRSASLLSLQTELLLDLVAEAQSRRLEEQRATFYTPQNPSSLAPAPLRPLEDREQLYSTILSHQCQRMEAQRSEPPLPPGGQELLELLLRVQGGGRMEEQRSRPPTHTC

SEQ ID NO: 36129 - protein, 160 aa, Homo sapiens; identical to SEQ ID NO: 36128
  Payload ID: 7156
  Gene Symbol: GPSM3
  Gene Name: G-protein signaling modulator 3
  Uniprot ID: Q9Y4H4
  ENSP ID: ENSP00000364183

SEQ ID NO: 36130 - protein, 160 aa, Homo sapiens; identical to SEQ ID NO: 36128
  Payload ID: 7156
  Gene Symbol: GPSM3
  Gene Name: G-protein signaling modulator 3
  Uniprot ID: Q9Y4H4
  ENSP ID: ENSP00000372752

SEQ ID NO: 36131 - protein, 160 aa, Homo sapiens; identical to SEQ ID NO: 36128
  Payload ID: 7156
  Gene Symbol: GPSM3
  Gene Name: G-protein signaling modulator 3
  Uniprot ID: Q9Y4H4
  ENSP ID: ENSP00000372756

SEQ ID NO: 36132 - protein, 160 aa, Homo sapiens; identical to SEQ ID NO: 36128
  Payload ID: 7156
  Gene Symbol: GPSM3
  Gene Name: G-protein signaling modulator 3
  Uniprot ID: Q9Y4H4
  ENSP ID: ENSP00000392487

SEQ ID NO: 36133 - protein, 160 aa, Homo sapiens; identical to SEQ ID NO: 36128
  Payload ID: 7156
  Gene Symbol: GPSM3
  Gene Name: G-protein signaling modulator 3
  Uniprot ID: Q9Y4H4
  ENSP ID: ENSP00000396786

SEQ ID NO: 36134 - protein, 160 aa, Homo sapiens; identical to SEQ ID NO: 36128
  Payload ID: 7156
  Gene Symbol: GPSM3
  Gene Name: G-protein signaling modulator 3
  Uniprot ID: Q9Y4H4
  ENSP ID: ENSP00000403132

SEQ ID NO: 36135 - protein, 160 aa, Homo sapiens; identical to SEQ ID NO: 36128
  Payload ID: 7156
  Gene Symbol: GPSM3
  Gene Name: G-protein signaling modulator 3
  Uniprot ID: Q9Y4H4
  ENSP ID: ENSP00000405026

SEQ ID NO: 36136 - protein, 160 aa, Homo sapiens; identical to SEQ ID NO: 36128
  Payload ID: 7156
  Gene Symbol: GPSM3
  Gene Name: G-protein signaling modulator 3
  Uniprot ID: Q9Y4H4
  ENSP ID: ENSP00000407538

SEQ ID NO: 36137 - protein, 160 aa, Homo sapiens; identical to SEQ ID NO: 36128
  Payload ID: 7156
  Gene Symbol: GPSM3
  Gene Name: G-protein signaling modulator 3
  Uniprot ID: Q9Y4H4
  ENSP ID: ENSP00000410087

SEQ ID NO: 36138 - protein, 160 aa, Homo sapiens; identical to SEQ ID NO: 36128
  Payload ID: 7156
  Gene Symbol: GPSM3
  Gene Name: G-protein signaling modulator 3
  Uniprot ID: Q9Y4H4
  ENSP ID: ENSP00000413430

SEQ ID NO: 36139 - protein, 160 aa, Homo sapiens; identical to SEQ ID NO: 36128
  Payload ID: 7156
  Gene Symbol: GPSM3
  Gene Name: G-protein signaling modulator 3
  Uniprot ID: Q9Y4H4
  ENSP ID: ENSP00000413975

SEQ ID NO: 36140 - protein, 160 aa, Homo sapiens; identical to SEQ ID NO: 36128
  Payload ID: 7156
  Gene Symbol: GPSM3
  Gene Name: G-protein signaling modulator 3
  Uniprot ID: Q9Y4H4
  ENSP ID: ENSP00000414024

SEQ ID NO: 36141 - protein, 160 aa, Homo sapiens; identical to SEQ ID NO: 36128
  Payload ID: 7156
  Gene Symbol: GPSM3
  Gene Name: G-protein signaling modulator 3
  Uniprot ID: Q9Y4H4
  ENSP ID: ENSP00000414939

SEQ ID NO: 36142 - protein, 157 aa, Homo sapiens
  Payload ID: 7156
  Gene Symbol: GPSM3
  Gene Name: G-protein signaling modulator 3
  ENSP ID: ENSP00000431348
MVSRMDIFWHQGPPQDEEGWPPPNSTTRPWRSAPPSPPPPGTRHTALGPRSASLLSLQTELLLDLVAEAQSRRLEEQRATFYTPQNPSSLAPAPLRPLEDREQLYSTILSHQCQRMEAQRSEPPLPPGGQELLELLLRVQGGGRMEEQRSRPPTHTC

SEQ ID NO: 36143 - protein, 49 aa, Homo sapiens
  Payload ID: 7156
  Gene Symbol: GPSM3
  Gene Name: G-protein signaling modulator 3
  ENSP ID: ENSP00000432037
MEAERPQEEEDGEQGPPQDEEGWPPPNSTTRPWRSAPPSPPPPGTRHTD

SEQ ID NO: 36144 - protein, 49 aa, Homo sapiens; identical to SEQ ID NO: 36143
  Payload ID: 7156
  Gene Symbol: GPSM3
  Gene Name: G-protein signaling modulator 3
  ENSP ID: ENSP00000432714

SEQ ID NO: 36145 - protein, 157 aa, Homo sapiens; identical to SEQ ID NO: 36142
  Payload ID: 7156
  Gene Symbol: GPSM3
  Gene Name: G-protein signaling modulator 3
  ENSP ID: ENSP00000433153

SEQ ID NO: 36146 - protein, 49 aa, Homo sapiens; identical to SEQ ID NO: 36143
  Payload ID: 7156
  Gene Symbol: GPSM3
  Gene Name: G-protein signaling modulator 3
  ENSP ID: ENSP00000433356

SEQ ID NO: 36147 - protein, 49 aa, Homo sapiens; identical to SEQ ID NO: 36143
  Payload ID: 7156
  Gene Symbol: GPSM3
  Gene Name: G-protein signaling modulator 3
  ENSP ID: ENSP00000434464

SEQ ID NO: 36148 - protein, 157 aa, Homo sapiens; identical to SEQ ID NO: 36142
  Payload ID: 7156
  Gene Symbol: GPSM3
  Gene Name: G-protein signaling modulator 3
  ENSP ID: ENSP00000434769

SEQ ID NO: 36149 - protein, 49 aa, Homo sapiens; identical to SEQ ID NO: 36143
  Payload ID: 7156
  Gene Symbol: GPSM3
  Gene Name: G-protein signaling modulator 3
  ENSP ID: ENSP00000434899

SEQ ID NO: 36150 - protein, 157 aa, Homo sapiens; identical to SEQ ID NO: 36142
  Payload ID: 7156
  Gene Symbol: GPSM3
  Gene Name: G-protein signaling modulator 3
  ENSP ID: ENSP00000435410

SEQ ID NO: 36151 - protein, 157 aa, Homo sapiens; identical to SEQ ID NO: 36142
  Payload ID: 7156
  Gene Symbol: GPSM3
  Gene Name: G-protein signaling modulator 3
  ENSP ID: ENSP00000435723

SEQ ID NO: 36152 - protein, 49 aa, Homo sapiens; identical to SEQ ID NO: 36143
  Payload ID: 7156
  Gene Symbol: GPSM3
  Gene Name: G-protein signaling modulator 3
  ENSP ID: ENSP00000436125

SEQ ID NO: 36153 - protein, 157 aa, Homo sapiens; identical to SEQ ID NO: 36142
  Payload ID: 7156
  Gene Symbol: GPSM3
  Gene Name: G-protein signaling modulator 3
  ENSP ID: ENSP00000436358

SEQ ID NO: 36154 - protein, 49 aa, Homo sapiens; identical to SEQ ID NO: 36143
  Payload ID: 7156
  Gene Symbol: GPSM3
  Gene Name: G-protein signaling modulator 3
  ENSP ID: ENSP00000437307

SEQ ID NO: 36155 - protein, 124 aa, Homo sapiens
  Payload ID: 7156
  Gene Symbol: GPSM3
  Gene Name: G-protein signaling modulator 3
  ENSP ID: ENSP00000478357
MYIFESSTSLDLNPPLPTGTMPLPVPFLPSRGWRLRDPRKKRMVSRAPLRMRKAGPLQTPPLGLGDLLLHPLLLQGPATQPWDPARPPCSPCRLNSFWTWWLKPSPAAWRSRGPPSTPPKTPQA

SEQ ID NO: 36156 - protein, 124 aa, Homo sapiens; identical to SEQ ID NO: 36155
  Payload ID: 7156
  Gene Symbol: GPSM3
  Gene Name: G-protein signaling modulator 3
  ENSP ID: ENSP00000479164

SEQ ID NO: 36157 - protein, 124 aa, Homo sapiens; identical to SEQ ID NO: 36155
  Payload ID: 7156
  Gene Symbol: GPSM3
  Gene Name: G-protein signaling modulator 3
  ENSP ID: ENSP00000479690

SEQ ID NO: 36158 - protein, 124 aa, Homo sapiens; identical to SEQ ID NO: 36155
  Payload ID: 7156
  Gene Symbol: GPSM3
  Gene Name: G-protein signaling modulator 3
  ENSP ID: ENSP00000480670

SEQ ID NO: 36159 - protein, 124 aa, Homo sapiens; identical to SEQ ID NO: 36155
  Payload ID: 7156
  Gene Symbol: GPSM3
  Gene Name: G-protein signaling modulator 3
  ENSP ID: ENSP00000480790

SEQ ID NO: 36160 - protein, 124 aa, Homo sapiens; identical to SEQ ID NO: 36155
  Payload ID: 7156
  Gene Symbol: GPSM3
  Gene Name: G-protein signaling modulator 3
  ENSP ID: ENSP00000485009

SEQ ID NO: 36161 - protein, 618 aa, Homo sapiens
  Payload ID: 7157
  Gene Symbol: GRHL1
  Gene Name: grainyhead-like transcription factor 1
  Uniprot ID: Q9NZI5
  ENSP ID: ENSP00000324693
MTQEYDNKRPVLVLQNEALYPQRRSYTSEDEAWKSFLENPLTAATKAMMSINGDEDSAAALGLLYDYYKVPRERRSSTAKPEVEHPEPDHSKRNSIPIVTEQPLISAGENRVQVLKNVPFNIVLPHGNQLGIDKRGHLTAPDTTVTVSIATMPTHSIKTETQPHGFAVGIPPAVYHPEPTERVVVFDRNLNTDQFSSGAQAPNAQRRTPDSTFSETFKEGVQEVFFPSDLSLRMPGMNSEDYVFDSVSGNNFEYTLEASKSLRQKPGDSTMTYLNKGQFYPITLKEVSSSEGIHHPISKVRSVIMVVFAEDKSREDQLRHWKYWHSRQHTAKQRCIDIADYKESFNTISNIEEIAYNAISFTWDINDEAKVFISVNCLSTDFSSQKGVKGLPLNIQVDTYSYNNRSNKPVHRAYCQIKVFCDKGAERKIRDEERKQSKRKVSDVKVPLLPSHKRMDITVFKPFIDLDTQPVLFIPDVHFANLQRGTHVLPIASEELEGEGSVLKRGPYGTEDDFAVPPSTKLARIEEPKRVLLYVRKESEEVFDALMLKTPSLKGLMEAISDKYDVPHDKIGKIFKKCKKGILVNMDDNIVKHYSNEDTFQLQIEEAGGSYKLTLTEI

SEQ ID NO: 36162 - protein, 429 aa, Homo sapiens
  Payload ID: 7157
  Gene Symbol: GRHL1
  Gene Name: grainyhead-like transcription factor 1
  Uniprot ID: Q9NZI5
  ENSP ID: ENSP00000384209
MASLWESPQQCIILSPLSGWWFSIGISILTSSALVLKPQMLKGELQTRPSQRPSRKAFRRNNFEYTLEASKSLRQKPGDSTMTYLNKGQFYPITLKEVSSSEGIHHPISKVRSVIMVVFAEDKSREDQLRHWKYWHSRQHTAKQRCIDIADYKESFNTISNIEEIAYNAISFTWDINDEAKVFISVNCLSTDFSSQKGVKGLPLNIQVDTYSYNNRSNKPVHRAYCQIKVFCDKGAERKIRDEERKQSKRKVSDVKVPLLPSHKRMDITVFKPFIDLDTQPVLFIPDVHFANLQRGTHVLPIASEELEGEGSVLKRGPYGTEDDFAVPPSTKLARIEEPKRVLLYVRKESEEVFDALMLKTPSLKGLMEAISDKYDVPHDKIGKIFKKCKKGILVNMDDNIVKHYSNEDTFQLQIEEAGGSYKLTLTEI

SEQ ID NO: 36163 - protein, 93 aa, Homo sapiens
  Payload ID: 7157
  Gene Symbol: GRHL1
  Gene Name: grainyhead-like transcription factor 1
  ENSP ID: ENSP00000387521
MTQEYDNKRPVLVLQNEALYPQRRSYTSEDEAWKSFLENPLTAATKAMMSINGDEDSAAALGLLYDYYKVPRERRSSTAKPEVEHPEPDHSKR

SEQ ID NO: 36164 - protein, 511 aa, Homo sapiens
  Payload ID: 7157
  Gene Symbol: GRHL1
  Gene Name: grainyhead-like transcription factor 1
  Uniprot ID: Q9NZI5
  ENSP ID: ENSP00000418275
MTQEYDNKRPVLVLQNEALYPQRRSYTSEDEAWKSFLENPLTAATKAMMSINGDEDSAAALGLLYDYYKVPRERRSSTAKPEVEHPEPDHSKRNSIPIVTEQPLISAGENRVQVLKNVPFNIVLPHGNQLGIDKRGHLTAPDTTVTVSIATMPTHSIKTETQPHGFAVGIPPAVYHPEPTERVVVFDRNLNTDQFSSGAQAPNAQRRTPDSTFSETFKEGVQEVFFPSDLSLRMPGMNSEDYVFDSVSGNNFEYTLEASKSLRQKPGDSTMTYLNKGQFYPITLKEVSSSEGIHHPISKVRSVIMVVFAEDKSREDQLRHWKYWHSRQHTAKQRCIDIADYKESFNTISNIEEIAYNAISFTWDINDEAKVFISVNCLSTDFSSQKGVKGLPLNIQVDTYSYNNRSNKPVHRAYCQIKVFCDKGAERKIRDEERKQSKRKGKCPDPSSQFLMLKCHCFPLTSEWISQFSNPSLISILSLSSSFLTCTLPTCSGALMSFPLPLKNWRVKALS

SEQ ID NO: 36165 - protein, 72 aa, Homo sapiens
  Payload ID: 7157
  Gene Symbol: GRHL1
  Gene Name: grainyhead-like transcription factor 1
  ENSP ID: ENSP00000419831
MLKTPSLKGLMEAISDKYDVPHDKIGKIFKKCKKGILVNMDDNIVKHYSNEDTFQLQIEEAGGSYKLTLTEI

SEQ ID NO: 36166 - protein, 229 aa, Homo sapiens
  Payload ID: 7157
  Gene Symbol: GRHL1
  Gene Name: grainyhead-like transcription factor 1
  ENSP ID: ENSP00000420654
MRKWTKKGNCKRPVLVLQNEALYPQRRSYTSEDEAWKSFLENPLTAATKAMMSINGDEDSAAALGLLYDYYKVPRERRSSTAKPEVEHPEPDHSKRNSIPIVTEQPLISAGENRVQVLKNVPFNIVLPHGNQLGIDKRGHLTAPDTTVTVSIATMPTHSIKTETQPHGFAVGIPPAVYHPEPTERVVVFDRNLNTDQFSSGAQAPNAQRRTPDSTFSETFKEGVQEEQL

SEQ ID NO: 36167 - protein, 625 aa, Homo sapiens
  Payload ID: 7158
  Gene Symbol: GRHL2
  Gene Name: grainyhead-like transcription factor 2
  Uniprot ID: Q6ISB3
  ENSP ID: ENSP00000251808
MSQESDNNKRLVALVPMPSDPPFNTRRAYTSEDEAWKSYLENPLTAATKAMMSINGDEDSAAALGLLYDYYKVPRDKRLLSVSKASDSQEDQEKRNCLGTSEAQSNLSGGENRVQVLKTVPVNLSLNQDHLENSKREQYSISFPESSAIIPVSGITVVKAEDFTPVFMAPPVHYPRGDGEEQRVVIFEQTQYDVPSLATHSAYLKDDQRSTPDSTYSESFKDAATEKFRSASVGAEEYMYDQTSSGTFQYTLEATKSLRQKQGEGPMTYLNKGQFYAITLSETGDNKCFRHPISKVRSVVMVVFSEDKNRDEQLKYWKYWHSRQHTAKQRVLDIADYKESFNTIGNIEEIAYNAVSFTWDVNEEAKIFITVNCLSTDFSSQKGVKGLPLMIQIDTYSYNNRSNKPIHRAYCQIKVFCDKGAERKIRDEERKQNRKKGKGQASQTQCNSSSDGKLAAIPLQKKSDITYFKTMPDLHSQPVLFIPDVHFANLQRTGQVYYNTDDEREGGSVLVKRMFRPMEEEFGPVPSKQMKEEGTKRVLLYVRKETDDVFDALMLKSPTVKGLMEAISEKYGLPVEKIAKLYKKSKKGILVNMDDNIIEHYSNEDTFILNMESMVEGFKVTLMEI

SEQ ID NO: 36168 - protein, 609 aa, Homo sapiens
  Payload ID: 7158
  Gene Symbol: GRHL2
  Gene Name: grainyhead-like transcription factor 2
  Uniprot ID: Q6ISB3
  ENSP ID: ENSP00000379260
MPSDPPFNTRRAYTSEDEAWKSYLENPLTAATKAMMSINGDEDSAAALGLLYDYYKVPRDKRLLSVSKASDSQEDQEKRNCLGTSEAQSNLSGGENRVQVLKTVPVNLSLNQDHLENSKREQYSISFPESSAIIPVSGITVVKAEDFTPVFMAPPVHYPRGDGEEQRVVIFEQTQYDVPSLATHSAYLKDDQRSTPDSTYSESFKDAATEKFRSASVGAEEYMYDQTSSGTFQYTLEATKSLRQKQGEGPMTYLNKGQFYAITLSETGDNKCFRHPISKVRSVVMVVFSEDKNRDEQLKYWKYWHSRQHTAKQRVLDIADYKESFNTIGNIEEIAYNAVSFTWDVNEEAKIFITVNCLSTDFSSQKGVKGLPLMIQIDTYSYNNRSNKPIHRAYCQIKVFCDKGAERKIRDEERKQNRKKGKGQASQTQCNSSSDGKLAAIPLQKKSDITYFKTMPDLHSQPVLFIPDVHFANLQRTGQVYYNTDDEREGGSVLVKRMFRPMEEEFGPVPSKQMKEEGTKRVLLYVRKETDDVFDALMLKSPTVKGLMEAISEKYGLPVEKIAKLYKKSKKGILVNMDDNIIEHYSNEDTFILNMESMVEGFKVTLMEI

SEQ ID NO: 36169 - protein, 6 aa, Homo sapiens
  Payload ID: 7158
  Gene Symbol: GRHL2
  Gene Name: grainyhead-like transcription factor 2
  ENSP ID: ENSP00000430473
MSQESD

SEQ ID NO: 36170 - protein, 607 aa, Homo sapiens
  Payload ID: 7159
  Gene Symbol: GRHL3
  Gene Name: grainyhead-like transcription factor 3
  Uniprot ID: Q8TE85
  ENSP ID: ENSP00000236255
MWMNSILPIFLFRSVRLLKNDPVNLQKFSYTSEDEAWKTYLENPLTAATKAMMRVNGDDDSVAALSFLYDYYMGPKEKRILSSSTGGRNDQGKRYYHGMEYETDLTPLESPTHLMKFLTENVSGTPEYPDLLKKNNLMSLEGALPTPGKAAPLPAGPSKLEAGSVDSYLLPTTDMYDNGSLNSLFESIHGVPPTQRWQPDSTFKDDPQESMLFPDILKTSPEPPCPEDYPSLKSDFEYTLGSPKAIHIKSGESPMAYLNKGQFYPVTLRTPAGGKGLALSSNKVKSVVMVVFDNEKVPVEQLRFWKHWHSRQPTAKQRVIDVADCKENFNTVEHIEEVAYNALSFVWNVNEEAKVFIGVNCLSTDFSSQKGVKGVPLNLQIDTYDCGLGTERLVHRAVCQIKIFCDKGAERKMRDDERKQFRRKVKCPDSSNSGVKGCLLSGFRGNETTYLRPETDLETPPVLFIPNVHFSSLQRSGGAAPSAGPSSSNRLPLKRTCSPFTEEFEPLPSKQAKEGDLQRVLLYVRRETEEVFDALMLKTPDLKGLRNAISEKYGFPEENIYKVYKKCKRGILVNMDNNIIQHYSNHVAFLLDMGELDGKIQIILKEL

SEQ ID NO: 36171 - protein, 626 aa, Homo sapiens
  Payload ID: 7159
  Gene Symbol: GRHL3
  Gene Name: grainyhead-like transcription factor 3
  Uniprot ID: Q8TE85
  ENSP ID: ENSP00000288955
MSNELDFRSVRLLKNDPVNLQKFSYTSEDEAWKTYLENPLTAATKAMMRVNGDDDSVAALSFLYDYYMGPKEKRILSSSTGGRNDQGKRYYHGMEYETDLTPLESPTHLMKFLTENVSGTPEYPDLLKKNNLMSLEGALPTPGKAAPLPAGPSKLEAGSVDSYLLPTTDMYDNGSLNSLFESIHGVPPTQRWQPDSTFKDDPQESMLFPDILKTSPEPPCPEDYPSLKSDFEYTLGSPKAIHIKSGESPMAYLNKGQFYPVTLRTPAGGKGLALSSNKVKSVVMVVFDNEKVPVEQLRFWKHWHSRQPTAKQRVIDVADCKENFNTVEHIEEVAYNALSFVWNVNEEAKVFIGVNCLSTDFSSQKGVKGVPLNLQIDTYDCGLGTERLVHRAVCQIKIFCDKGAERKMRDDERKQFRRKVKCPDSSNSGVKGCLLSGFRGNETTYLRPETDLETPPVLFIPNVHFSSLQRSGGAAPSAGPSSSNRLPLKRTCSPFTEEFEPLPSKQAKEGDLQRVLLYVRRETEEVFDALMLKTPDLKGLRNAISEKYGFPEENIYKVYKKCKRGETSLLHPRLSRHPPPDCLECSHPVTQVRNMGFGDGFWRQRDLDSNPSPTTVNSLHFTVNSE

SEQ ID NO: 36172 - protein, 556 aa, Homo sapiens
  Payload ID: 7159
  Gene Symbol: GRHL3
  Gene Name: grainyhead-like transcription factor 3
  Uniprot ID: Q8TE85
  ENSP ID: ENSP00000348333
MMRVNGDDDSVAALSFLYDYYMGPKEKRILSSSTGGRNDQGKRYYHGMEYETDLTPLESPTHLMKFLTENVSGTPEYPDLLKKNNLMSLEGALPTPGKAAPLPAGPSKLEAGSVDSYLLPTTDMYDNGSLNSLFESIHGVPPTQRWQPDSTFKDDPQESMLFPDILKTSPEPPCPEDYPSLKSDFEYTLGSPKAIHIKSGESPMAYLNKGQFYPVTLRTPAGGKGLALSSNKVKSVVMVVFDNEKVPVEQLRFWKHWHSRQPTAKQRVIDVADCKENFNTVEHIEEVAYNALSFVWNVNEEAKVFIGVNCLSTDFSSQKGVKGVPLNLQIDTYDCGLGTERLVHRAVCQIKIFCDKGAERKMRDDERKQFRRKVKCPDSSNSGVKGCLLSGFRGNETTYLRPETDLETPPVLFIPNVHFSSLQRSGGAAPSAGPSSSNRLPLKRTCSPFTEEFEPLPSKQAKEGDLQRVLLYVRRETEEVFDALMLKTPDLKGLRNAISEKYGFPEENIYKVYKKCKRGILVNMDNNIIQHYSNHVAFLLDMGELDGKIQIILKEL

SEQ ID NO: 36173 - protein, 602 aa, Homo sapiens
  Payload ID: 7159
  Gene Symbol: GRHL3
  Gene Name: grainyhead-like transcription factor 3
  Uniprot ID: Q8TE85
  ENSP ID: ENSP00000354943
MSNELDFRSVRLLKNDPVNLQKFSYTSEDEAWKTYLENPLTAATKAMMRVNGDDDSVAALSFLYDYYMGPKEKRILSSSTGGRNDQGKRYYHGMEYETDLTPLESPTHLMKFLTENVSGTPEYPDLLKKNNLMSLEGALPTPGKAAPLPAGPSKLEAGSVDSYLLPTTDMYDNGSLNSLFESIHGVPPTQRWQPDSTFKDDPQESMLFPDILKTSPEPPCPEDYPSLKSDFEYTLGSPKAIHIKSGESPMAYLNKGQFYPVTLRTPAGGKGLALSSNKVKSVVMVVFDNEKVPVEQLRFWKHWHSRQPTAKQRVIDVADCKENFNTVEHIEEVAYNALSFVWNVNEEAKVFIGVNCLSTDFSSQKGVKGVPLNLQIDTYDCGLGTERLVHRAVCQIKIFCDKGAERKMRDDERKQFRRKVKCPDSSNSGVKGCLLSGFRGNETTYLRPETDLETPPVLFIPNVHFSSLQRSGGAAPSAGPSSSNRLPLKRTCSPFTEEFEPLPSKQAKEGDLQRVLLYVRRETEEVFDALMLKTPDLKGLRNAISEKYGFPEENIYKVYKKCKRGILVNMDNNIIQHYSNHVAFLLDMGELDGKIQIILKEL

SEQ ID NO: 36174 - protein, 81 aa, Homo sapiens
  Payload ID: 7159
  Gene Symbol: GRHL3
  Gene Name: grainyhead-like transcription factor 3
  ENSP ID: ENSP00000431290
MMRVNGDDDSVAALSFLYDYYMGPKEKRILSSSTGGRNDQGKRYYHGMEYETDLTPLESPTHLMKFLTENVSGTPEYPDLL

SEQ ID NO: 36175 - protein, 52 aa, Homo sapiens
  Payload ID: 7159
  Gene Symbol: GRHL3
  Gene Name: grainyhead-like transcription factor 3
  ENSP ID: ENSP00000435130
MWMNSILPIFLVPRRSGYCPPALGAGMTKERGTTMAWNMRRTSLPLKAPHTS

SEQ ID NO: 36176 - protein, 713 aa, Homo sapiens
  Payload ID: 7160
  Gene Symbol: GRAMD1A
  Gene Name: GRAM domain containing 1A
  Uniprot ID: Q96CP6
  ENSP ID: ENSP00000439267
MFDTTPHSGRSTPSSSPSLRKRLQLLPPSRPPPEPEPGTMVEKGSDSSSEKGGVPGTPSTQSLGSRNFIRNSKMLSPTYKQRNEDFRKLFSKLPEAERLIVDYSCALQREILLQGRLYLSENWICFYSNIFRWETTISIQLKEVTCLKKEKTAKLIPNAIQICTESEKHFFTSFGARDRCFLLIFRLWQNALLEKTLSPRELWHLVHQCYGSELGLTSEDEDYVSPLQLNGLGTPKEVGDVIALSDITSSGAADRSQEPSPVGSRRGHVTPNLSRASSDADHGAEEDKEEQVDSQPDASSSQTVTPVAEPPSTEPTQPDGPTTLGPLDLLPSEELLTDTSNSSSSTGEEADLAALLPDLSGRLLINSVFHVGAERLQQMLFSDSPFLQGFLQQCKFTDVTLSPWSGDSKCHQRRVLTYTIPISNPLGPKSASVVETQTLFRRGPQAGGCVVDSEVLTQGIPYQDYFYTAHRYCILGLARNKARLRVSSEIRYRKQPWSLVKSLIEKNSWSGIEDYFHHLERELAKAEKLSLEEGGKDARGLLSGLRRRKRPLSWRAHGDGPQHPDPDPCARAGIHTSGSLSSRFSEPSVDQGPGAGIPSALVLISIVLIILIALNVLLFYRLWSLERTAHTFESWHSLALAKGKFPQTATEWAEILALQKQFHSVEVHKWRQILRASVELLDEMKFSLEKLHQGITVSDPPFDTQPRPDDSFS

SEQ ID NO: 36177 - protein, 724 aa, Homo sapiens
  Payload ID: 7160
  Gene Symbol: GRAMD1A
  Gene Name: GRAM domain containing 1A
  Uniprot ID: Q96CP6
  ENSP ID: ENSP00000441032
MFDTTPHSGRSTPSSSPSLRKRLQLLPPSRPPPEPEPGTMVEKGSDSSSEKGGVPGTPSTQSLGSRNFIRNSKKMQSWYSMLSPTYKQRNEDFRKLFSKLPEAERLIVDYSCALQREILLQGRLYLSENWICFYSNIFRWETTISIQLKEVTCLKKEKTAKLIPNAIQICTESEKHFFTSFGARDRCFLLIFRLWQNALLEKTLSPRELWHLVHQCYGSELGLTSEDEDYVSPLQLNGLGTPKEVGDVIALSDITSSGAADRSQEPSPVGSRRGHVTPNLSRASSDADHGAEEDKEEQVDSQPDASSSQTVTPVAEPPSTEPTQPDGPTTLGPLDLLPSEELLTDTSNSSSSTGEEADLAALLPDLSGRLLINSVFHVGAERLQQMLFSDSPFLQGFLQQCKFTDVTLSPWSGDSKCHQRRVLTYTIPISNPLGPKSASVVETQTLFRRGPQAGGCVVDSEVLTQGIPYQDYFYTAHRYCILGLARNKARLRVSSEIRYRKQPWSLVKSLIEKNSWSGIEDYFHHLERELAKAEKLSLEEGGKDARGLLSGLRRRKRPLSWRAHGDGPQHPDPDPCARAGIHTSGSLSSRFSEPSVDQGPGAGIPSALVLISIVICVSLIILIALNVLLFYRLWSLERTAHTFESWHSLALAKGKFPQTATEWAEILALQKQFHSVEVHKWRQILRASVELLDEMKFSLEKLHQGITVSDPPFDTQPRPDDSFS

SEQ ID NO: 36178 - protein, 807 aa, Homo sapiens
  Payload ID: 7160
  Gene Symbol: GRAMD1A
  Gene Name: GRAM domain containing 1A
  ENSP ID: ENSP00000470220
MDDVLPLMPWETLLAQGSPQGSPDLPAGQRKQQPQGDRAQGLASESWKLLEVPIIHITPSSDGESPACTPTPRRRQQQRMPDPQSLSQDSTTPHSGRSTPSSSPSLRKRLQLLPPSRPPPEPEPGTMVEKGSDSSSEKGGVPGTPSTQSLGSRNFIRNSKKMQSWYSMLSPTYKQRNEDFRKLFSKLPEAERLIVDYSCALQREILLQGRLYLSENWICFYSNIFRWETTISIQLKEVTCLKKEKTAKLIPNAIQICTESEKHFFTSFGARDRCFLLIFRLWQNALLEKTLSPRELWHLVHQCYGSELGLTSEDEDYVSPLQLNGLGTPKEVGDVIALSDITSSGAADRSQEPSPVGSRRGHVTPNLSRASSDADHGAEEDKEEQVDSQPDASSSQTVTPVAEPPSTEPTQPDGPTTLGPLDLLPSEELLTDTSNSSSSTGEEADLAALLPDLSGRLLINSVFHVGAERLQQMLFSDSPFLQGFLQQCKFTDVTLSPWSGDSKCHQRRVLTYTIPISNPLGPKSASVVETQTLFRRGPQAGGCVVDSEVLTQGIPYQDYFYTAHRYCILGLARNKARLRVSSEIRYRKQPWSLVKSLIEKNSWSGIEDYFHHLERELAKAEKLSLEEGGKDARGLLSGLRRRKRPLSWRAHGDGPQHPDPDPCARAGIHTSGSLSSRFSEPSVDQGPGAGIPSALVLISIVLIILIALNVLLFYRLWSLERTAHTFESWHSLALAKGKFPQTATEWAEILALQKQFHSVEVHKWRQILRASVELLDEMKFSLEKLHQGITVSDPPFDTQPRPDDSFS

SEQ ID NO: 36179 - protein, 222 aa, Homo sapiens
  Payload ID: 7160
  Gene Symbol: GRAMD1A
  Gene Name: GRAM domain containing 1A
  ENSP ID: ENSP00000471290
MFDTTPHSGRSTPSSSPSLRKRLQLLPPSRPPPEPEPGTMVEKGSDSSSEKGGVPGTPSTQSLGSRNFIRNSKKMQSWYSMLSPTYKQRNEDFRKLFSKLPEAERLIVDYSCALQREILLQGRLYLSENWICFYSNIFRWETTISIQLKEVTCLKKEKTAKLIPNAIQICTESEKHFFTSFGARDRCFLLIFRLWQNALLEKDPQGSGRCDRPERHHLLGGS

SEQ ID NO: 36180 - protein, 205 aa, Homo sapiens
  Payload ID: 7160
  Gene Symbol: GRAMD1A
  Gene Name: GRAM domain containing 1A
  ENSP ID: ENSP00000474401
MFDTTPHSGRSTPSSSPSLRKRLQLLPPSRPPPEPEPGTMVEKGSDSSSEKGGVPGTPSTQSLGSRNFIRNSKKMQSWYSMLSPTYKQRNEDFRKLFSKLPEAERLIVDYSCALQREILLQGRLYLSENWICFYSNIFRWETTISIQLKEVTCLKKEKTAKLIPNAIQICTESEKVTEDPVTGPRGPPLSRPPPPNMQSPICSAP

SEQ ID NO: 36181 - protein, 738 aa, Homo sapiens [sequence omitted]

SEQ ID NO: 36182 - protein, 425 aa, Homo sapiens
  Payload ID: 7161
  Gene Symbol: GRAMD1B
  Gene Name: GRAM domain containing 1B
  Uniprot ID: Q3KR37
  ENSP ID: ENSP00000388458
MPTSSAVLLRVLSIPLLTVLILARDLSALGGCPWGPLPLRCHCLLPDPLFCAGEVQAFYEDLSGRQYVNEVFNFSVDKLYDLLFTNSPFQRDFMEQRRFSDIIFHPWKKEENGNQSRVILYTITLTNPLAPKTATVRETQTMYKASQESECYVIDAEVLTHDVPYHDYFYTINRYTLTRVARNKSRLRVSTELRYRKQPWGLVKTFIEKNFWSGLEDYFRHLESELAKTESTYLAEMHRQSPKEKASKTTTVRRRKRPHAHLRVPHLEEVMSPVTTPTDEDVGHRIKHVAGSTQTRHIPEDTPNGFHLQSVSKLLLVISCVLVLLVILNMMLFYKLWMLEYTTQTLTAWQGLRLQERLPQSQTEWAQLLESQQKYHDTELQKWREIIKSSVMLLDQMKDSLINLQNGIRSRDYTSESEEKRNRYH

SEQ ID NO: 36183 - protein, 745 aa, Homo sapiens
  Payload ID: 7161
  Gene Symbol: GRAMD1B
  Gene Name: GRAM domain containing 1B
  Uniprot ID: Q3KR37
  ENSP ID: ENSP00000402457
MKGFKLSCTASNSNRSTPACSPILRKRSRSPTPQNQDGDTMVEKGSDHSSDKSPSTPEQGVQRSCSSQSGRSGGKNSKSHKRLSKKSQSWYNVLSPTYKQRNEDFRKLFKQLPDTERLIVDYSCALQRDILLQGRLYLSENWICFYSNIFRWETLLTVRLKDICSMTKEKTARLIPNAIQVCTDSEKHFFTSFGARDRTYMMMFRLWQNALLEKPLCPKELWHFVHQCYGNELGLTSDDEDYVPPDDDFNTMGYCEEIPVEENEVNDSSSKSSIETKPDASPQLPKKSITNSTLTSTGSSEAPVSFDGLPLEEEALEGDGSLEKELAIDNIMGEKIEMIAPVNSPSLDFNDNEDIPTELSDSSDTHDEGEVQAFYEDLSGRQYVNEVFNFSVDKLYDLLFTNSPFQRDFMEQRRFSDIIFHPWKKEENGNQSRVILYTITLTNPLAPKTATVRETQTMYKASQESECYVIDAEVLTHDVPYHDYFYTINRYTLTRVARNKSRLRVSTELRYRKQPWGLVKTFIEKNFWSGLEDYFRHLESELAKTESTYLAEMHRQSPKEKASKTTTVRRRKRPHAHLRVPHLEEVMSPVTTPTDEDVGHRIKHVAGSTQTRHIPEDTPNGFHLQSVSKLLLVISCVICFSLVLLVILNMMLFYKLWMLEYTTQTLTAWQGLRLQERLPQSQTEWAQLLESQQKYHDTELQKWREIIKSSVMLLDQMKDSLINLQNGIRSRDYTSESEEKRNRYH

SEQ ID NO: 36184 - protein, 698 aa, Homo sapiens
  Payload ID: 7161
  Gene Symbol: GRAMD1B
  Gene Name: GRAM domain containing 1B
  Uniprot ID: Q3KR37
  ENSP ID: ENSP00000432987
MVEKGSDHSSDKSPSTPEQGVQRSCSSQSGRSGGKNSKKSQSWYNVLSPTYKQRNEDFRKLFKQLPDTERLIVDYSCALQRDILLQGRLYLSENWICFYSNIFRWETLLTVRLKDICSMTKEKTARLIPNAIQVCTDSEKHFFTSFGARDRTYMMMFRLWQNALLEKPLCPKELWHFVHQCYGNELGLTSDDEDYVPPDDDFNTMGYCEEIPVEENEVNDSSSKSSIETKPDASPQLPKKSITNSTLTSTGSSEAPVSFDGLPLEEEALEGDGSLEKELAIDNIMGEKIEMIAPVNSPSLDFNDNEDIPTELSDSSDTHDEGEVQAFYEDLSGRQYVNEVFNFSVDKLYDLLFTNSPFQRDFMEQRRFSDIIFHPWKKEENGNQSRVILYTITLTNPLAPKTATVRETQTMYKASQESECYVIDAEVLTHDVPYHDYFYTINRYTLTRVARNKSRLRVSTELRYRKQPWGLVKTFIEKNFWSGLEDYFRHLESELAKTESTYLAEMHRQSPKEKASKTTTVRRRKRPHAHLRVPHLEEVMSPVTTPTDEDVGHRIKHVAGSTQTRHIPEDTPNGFHLQSVSKLLLVISCVICFSLVLLVILNMMLFYKLWMLEYTTQTLTAWQGLRLQERLPQSQTEWAQLLESQQKYHDTELQKWREIIKSSVMLLDQMKDSLINLQNGIRSRDYTSESEEKRNRYH

SEQ ID NO: 36185 - protein, 441 aa, Homo sapiens
  Payload ID: 7161
  Gene Symbol: GRAMD1B
  Gene Name: GRAM domain containing 1B
  ENSP ID: ENSP00000434214
MASSTASNSNRSTPACSPILRKRSRSPTPQNQDGDTMVEKGSDHSSDKSPSTPEQGVQRSCSSQSGRSGGKNSKKSQSWYNVLSPTYKQRNEDFRKLFKQLPDTERLIVDYSCALQRDILLQGRLYLSENWICFYSNIFRWETLLTVRLKDICSMTKEKTARLIPNAIQVCTDSEKHFFTSFGARDRTYMMMFRLWQNALLEKPLCPKELWHFVHQCYGNELGLTSDDEDYVPPDDDFNTMGYCEEIPVEENEVNDSSSKSSIETKPDASPQLPKKSITNSTLTSTGSSEAPVSFDGLPLEEEALEGDGSLEKELAIDNIMGEKIEMIAPVNSPSLDFNDNEDIPTELSDSSDTHDEGEVQAFYEDLSGRQYVNEVFNFSVDKLYDLLFTNSPFQRDFMEQRRFSDIIFHPWKKEENGNQSRVILYTITLTNPLAPKTATV

SEQ ID NO: 36186 - protein, 738 aa, Homo sapiens
  Payload ID: 7161
  Gene Symbol: GRAMD1B
  Gene Name: GRAM domain containing 1B
  Uniprot ID: Q3KR37
  ENSP ID: ENSP00000436500
MKGFKLSCTASNSNRSTPACSPILRKRSRSPTPQNQDGDTMVEKGSDHSSDKSPSTPEQGVQRSCSSQSGRSGGKNSKKSQSWYNVLSPTYKQRNEDFRKLFKQLPDTERLIVDYSCALQRDILLQGRLYLSENWICFYSNIFRWETLLTVRLKDICSMTKEKTARLIPNAIQVCTDSEKHFFTSFGARDRTYMMMFRLWQNALLEKPLCPKELWHFVHQCYGNELGLTSDDEDYVPPDDDFNTMGYCEEIPVEENEVNDSSSKSSIETKPDASPQLPKKSITNSTLTSTGSSEAPVSFDGLPLEEEALEGDGSLEKELAIDNIMGEKIEMIAPVNSPSLDFNDNEDIPTELSDSSDTHDEGEVQAFYEDLSGRQYVNEVFNFSVDKLYDLLFTNSPFQRDFMEQRRFSDIIFHPWKKEENGNQSRVILYTITLTNPLAPKTATVRETQTMYKASQESECYVIDAEVLTHDVPYHDYFYTINRYTLTRVARNKSRLRVSTELRYRKQPWGLVKTFIEKNFWSGLEDYFRHLESELAKTESTYLAEMHRQSPKEKASKTTTVRRRKRPHAHLRVPHLEEVMSPVTTPTDEDVGHRIKHVAGSTQTRHIPEDTPNGFHLQSVSKLLLVISCVICFSLVLLVILNMMLFYKLWMLEYTTQTLTAWQGLRLQERLPQSQTEWAQLLESQQKYHDTELQKWREIIKSSVMLLDQMKDSLINLQNGIRSRDYTSESEEKRNRYH

SEQ ID NO: 36187 - protein, 166 aa, Homo sapiens
  Payload ID: 7161
  Gene Symbol: GRAMD1B
  Gene Name: GRAM domain containing 1B
  ENSP ID: ENSP00000488382
MVEKGSDHSSDKSPSTPEQGVQRSCSSQSGRSGGKNSKKSQSWYNVLSPTYKQRNEDFRKLFKQLPDTERLIVDYSCALQRDILLQGRLYLSENWICFYSNIFRWETLLTVRLKDICSMTKEKTARLIPNAIQVCTDSEKHFFTSFGARDRTYMMMFRLWQNALLE

SEQ ID NO: 36188 - protein, 171 aa, Homo sapiens
  Payload ID: 7161
  Gene Symbol: GRAMD1B
  Gene Name: GRAM domain containing 1B
  ENSP ID: ENSP00000488613
MSFLSSQQSSQQSSHDDDSSRFLSPRAREESTASNSNRSTPACSPILRKRSRSPTPQNQDGDTMVEKGSDHSSDKSPSTPEQGVQRSCSSQSGRSGGKNSKKSQSWYNVLSPTYKQRNEDFRKLFKQLPDTERLIVDYSCALQRDILLQGRLYLSENWICFYSNIFRWETL

SEQ ID NO: 36189 - protein, 108 aa, Homo sapiens
  Payload ID: 7161
  Gene Symbol: GRAMD1B
  Gene Name: GRAM domain containing 1B
  ENSP ID: ENSP00000488714
MVEKGSDHSSDKSPSTPEQGVQRSCSSQSGRSGGKNSKKSQSWYNVLSPTYKQRNEDFRKLFKQLPDTERLIVDYSCALQRDILLQGRLYLSENWICFYSNIFRWETL

SEQ ID NO: 36190 - protein, 662 aa, Homo sapiens
  Payload ID: 7162
  Gene Symbol: GRAMD1C
  Gene Name: GRAM domain containing 1C
  Uniprot ID: Q8IYS0
  ENSP ID: ENSP00000350881
MEGAPTVRQVMNEGDSSLATDLQEDVEENPSPTVEENNVVVKKQGPNLHNWSGDWSFWISSSTYKDRNEEYRRQFTHLPDTERLIADYACALQRDILLQGRLYLSENWLCFYSNIFRWETTISIALKNITFMTKEKTARLIPNAIQIVTESEKFFFTSFGARDRSYLSIFRLWQNVLLDKSLTRQEFWQLLQQNYGTELGLNAEEMENLSLSIEDVQPRSPGRSSLDDSGERDEKLSKSISFTSESISRVSETESFDGNSSKGGLGKEESQNEKQTKKSLLPTLEKKLTRVPSKSLDLNKNEYLSLDKSSTSDSVDEENVPEKDLHGRLFINRIFHISADRMFELLFTSSRFMQKFASSRNIIDVVSTPWTAELGGDQLRTMTYTIVLNSPLTGKCTAATEKQTLYKESREARFYLVDSEVLTHDVPYHDYFYTVNRYCIIRSSKQKCRLRVSTDLKYRKQPWGLVKSLIEKNSWSSLEDYFKQLESDLLIEESVLNQAIEDPGKLTGLRRRRRTFNRTAETVPKLSSQHSSGDVGLGAKGDITGKKKEMENYNVTLIVVMSIFVLLLVLLNVTLFLKLSKIEHAAQSFYRLRLQEEKSLNLASDMVSRAETIQKNKDQAHRLKGVLRDSIVMLEQLKSSLIMLQKTFDLLNKNKTGMAVES

SEQ ID NO: 36191 - protein, 457 aa, Homo sapiens
  Payload ID: 7162
  Gene Symbol: GRAMD1C
  Gene Name: GRAM domain containing 1C
  Uniprot ID: Q8IYS0
  ENSP ID: ENSP00000408135
MENLSLSIEDVQPRSPGRSSLDDSGERDEKLSKSISFTSESISRVSETESFDGNSSKGGLGKEESQNEKQTKKSLLPTLEKKLTRVPSKSLDLNKNEYLSLDKSSTSDSVDEENVPEKDLHGRLFINRIFHISADRMFELLFTSSRFMQKFASSRNIIDVVSTPWTAELGGDQLRTMTYTIVLNSPLTGKCTAATEKQTLYKESREARFYLVDSEVLTHDVPYHDYFYTVNRYCIIRSSKQKCRLRVSTDLKYRKQPWGLVKSLIEKNSWSSLEDYFKQLESDLLIEESVLNQAIEDPGKLTGLRRRRRTFNRTAETVPKLSSQHSSGDVGLGAKGDITGKKKEMENYNVTLIVVMSIFVLLLVLLNVTLFLKLSKIEHAAQSFYRLRLQEEKSLNLASDMVSRAETIQKNKDQAHRLKGVLRDSIVMLEQLKSSLIMLQKTFDLLNKNKTGMAVES

SEQ ID NO: 36192 - protein, 206 aa, Homo sapiens
  Payload ID: 7162
  Gene Symbol: GRAMD1C
  Gene Name: GRAM domain containing 1C
  ENSP ID: ENSP00000417936
MEGAPTVRQVMNEGDSSLATDLQEDVEENPSPTVEENNVVVKKQGPNLHNWSGDWSFWISSSTYKDRNEEYRRQFTHLPDTERLIADYACALQRDILLQGRLYLSENWLCFYSNIFRWETTFFFTSFGARDRSYLSIFRLWQNVLLDKSLTRQEFWQLLQQNYGTELGLNAEEMENLSLSIEDVQPRSPKMRNRPKRVSYQLWKRS

SEQ ID NO: 36193 - protein, 380 aa, Homo sapiens
  Payload ID: 7162
  Gene Symbol: GRAMD1C
  Gene Name: GRAM domain containing 1C
  ENSP ID: ENSP00000418302
MENLSLSIEDVQPRSPGRSSLDDSGERDEKLSKSISFTSESISRVSETESFDGNSSKGGLGKEESQNEKQTKKSLLPTLEKKLTRVPSKSLDLNKNEYLSLDKSSTSDSVDEENVPEKDLHGRLFINRIFHISADRMFELLFTSSRFMQKFASSRNIIDVVSTPWTAELGGDQLRTMTYTIVLNSPLTGKCTAATEKQTLYKESREARFYLVDSEVLTHDVPYHDYFYTVNRYCIIRSSKQKCRLRVSTDLKYRKQPWGLVKSLIEKNSWSSLEDYFKQLESDLLIEESVLNQAIEDPGKLTGLRRRRRTFNRTAETVPKLSSQHSSGDVGLGAKGDITGKKKEMENYNVTLIVVMSIFVLLLVLLNVTLFLKLSKIEHA

SEQ ID NO: 36194 - protein, 89 aa, Homo sapiens
  Payload ID: 7162
  Gene Symbol: GRAMD1C
  Gene Name: GRAM domain containing 1C
  ENSP ID: ENSP00000418501
MEGAPTVRQVMNEGDSSLATDLQEDVEENPSPTVEENNVVVKKQGPNLHNWSGDWSFWISSSTYKDRNEEYRRQFTHLPDTERLIAEPD

SEQ ID NO: 36195 - protein, 495 aa, Homo sapiens
  Payload ID: 7162
  Gene Symbol: GRAMD1C
  Gene Name: GRAM domain containing 1C
  ENSP ID: ENSP00000419132
MSFQCHICAYHTHSLTRQEFWQLLQQNYGTELGLNAEEMENLSLSIEDVQPRSPGRSSLDDSGERDEKLSKSISFTSESISRVSETESFDGNSSKGGLGKEESQNEKQTKKSLLPTLEKKLTRVPSKSLDLNKNEYLSLDKSSTSDSVDEENVPEKDLHGRLFINRIFHISADRMFELLFTSSRFMQKFASSRNIIDVVSTPWTAELGGDQLRTMTYTIVLNSPLTGKCTAATEKQTLYKESREARFYLVDSEVLTHDVPYHDYFYTVNRYCIIRSSKQKCRLRVSTDLKYRKQPWGLVKSLIEKNSWSSLEDYFKQLESDLLIEESVLNQAIEDPGKLTGLRRRRRTFNRTAETVPKLSSQHSSGDVGLGAKGDITGKKKEMENYNVTLIVVMSIFVLLLVLLNVTLFLKLSKIEHAAQSFYRLRLQEEKSLNLASDMVSRAETIQKNKDQAHRLKGVLRDSIVMLEQLKSSLIMLQKTFDLLNKNKTGMAVES

SEQ ID NO: 36196 - protein, 44 aa, Homo sapiens
  Payload ID: 7162
  Gene Symbol: GRAMD1C
  Gene Name: GRAM domain containing 1C
  ENSP ID: ENSP00000419571
MNIFLWTKAALQILLMKKMFLRKIFMEDFLSTVFFISVLTECLN

SEQ ID NO: 36197 - protein, 354 aa, Homo sapiens
  Payload ID: 7163
  Gene Symbol: GRAMD2
  Gene Name: GRAM domain containing 2
  Uniprot ID: Q8IUY3
  ENSP ID: ENSP00000311657
MTALSRSEATEEGGNQQMHRKTASLNSPVSCKEKPDRVEEPPDYSLHWPEGLKGEEIKKCGREGITLNKYNQQYHKLFKDVPLEEVVLKVCSCALQRDFLLQGRLYISPNWLCFHASLFGKDIKVVIPVVSVQMIKKHKMARLLPNGLAITTNTSQKYIFVSLLSRDSVYDLLRRVCTHLQPSSKKSLSVREFSGEPESLEVLIPEMKWRKVCPSSRSLSLPDNIPCIPPSSVDSTDSFFPSRKPPMSEKSRAQVASENGGRWAWPMPGWGPACPKKMPNCSPTAKNAVYEEDELEEEPRSTGELRLWDYRLLKVFFVLICFLVMSSSYLAFRISRLEQQLCSLSWDDPVPGHR

SEQ ID NO: 36198 - protein, 145 aa, Homo sapiens
  Payload ID: 7163
  Gene Symbol: GRAMD2
  Gene Name: GRAM domain containing 2
  ENSP ID: ENSP00000457088
MSNQQMHRKTASLNSPVSCKEKPDRVEEPPDYSLHWPEGLKGEEIKKCGREGITLNKYNQQYHKLFKDVPLEEVVLKVCSCALQRDFLLQGRLYISPNWLCFHASLFGKDIKVVIPVVSVQMIKKHKMARLLPNGLAITTNTSQK

SEQ ID NO: 36199 - protein, 47 aa, Homo sapiens
  Payload ID: 7163
  Gene Symbol: GRAMD2
  Gene Name: GRAM domain containing 2
  ENSP ID: ENSP00000457155
MSNQQMHRKTASLNSPVSCKEKPDRVEEPPDYSAIPLSQCGSLSQVR

SEQ ID NO: 36200 - protein, 169 aa, Homo sapiens
  Payload ID: 7163
  Gene Symbol: GRAMD2
  Gene Name: GRAM domain containing 2
  ENSP ID: ENSP00000457383
MGLFFPSNQQMHRKTASLNSPVSCKEKPDRVEEPPDYSLHWPEGLKGEEIKKCGREGITLNKYNQQYHKLFKDVPLEEVVLKVCSCALQRDFLLQGRLYISPNWLCFHASLFGKDIKVVIPVVSVQMIKKHKMARLLPNGLAITTNTSQKYIFVSLLSRDSVYDLLRRV

SEQ ID NO: 36201 - protein, 211 aa, Homo sapiens
  Payload ID: 7163
  Gene Symbol: GRAMD2
  Gene Name: GRAM domain containing 2
  ENSP ID: ENSP00000457660
MLRGNQQMHRKTASLNSPVSCKEKPDRVEEPPDYSLHWPEGLKGEEIKKCGREGITLNKYNQQYHKLFKDVPLEEVVLKVCSCALQRDFLLQGRLYISPNWLCFHASLFGKDIKVVIPVVSVQMIKKHKMARLLPNGLAITTNTSQKYIFVSLLSRDSVYDLLRRVCTHLQPSSKKSLSVREFSGEPESLEVLIPEMKWRKVCPSSRSLSL

SEQ ID NO: 36202 - protein, 432 aa, Homo sapiens
  Payload ID: 7164
  Gene Symbol: GRAMD3
  Gene Name: GRAM domain containing 3
  Uniprot ID: Q96HH9
  ENSP ID: ENSP00000285689
MTELQQDVEDTKPAKVLGKRESKLGSAHSEAENGVEEKKKACRSPTAQSPTPSVEADSPDQKKIISLWSKSSFDGASLASDKNDCKTESKNDPKTERKKSSSSSQYKANMHFHKLFLSVPTEEPLKQSFTCALQKEILYQGKLFVSENWICFHSKVFGKDTKISIPAFSVTLIKKTKTALLVPNALIIATVTDRYIFVSLLSRDSTYKLLKSVCGHLENTSVGNSPNPSSAENSFRADRPSSLPLDFNDEFSDLDGVVQQRRQDMEGYSSSGSQTPESENSRDFHATESQTVLNVSKGEAKPTRADAHVNRVPEGKAKSLPVQGLSETVGILHKVKSQKCPMLHHILIFYAIVVCALIISTFYMRYRINTLEEQLGLLTSIVDTHNTEQAAPSGLRSQVQFNVEVLCQELTANIVKLEKIQNNLQKLLENGD

SEQ ID NO: 36203 - protein, 87 aa, Homo sapiens
  Payload ID: 7164
  Gene Symbol: GRAMD3
  Gene Name: GRAM domain containing 3
  ENSP ID: ENSP00000421494
MTELQQDVEDTKPAKVLGKRESKLGSAHSEAENGVEEKKKACRSPTAQSPTPSVEADSPDQKKIISLCPYLLSKSMLHSGPRVKIQF

SEQ ID NO: 36204 - protein, 87 aa, Homo sapiens
  Payload ID: 7164
  Gene Symbol: GRAMD3
  Gene Name: GRAM domain containing 3
  ENSP ID: ENSP00000423236
MTELQQDVEDTKPAKVLGKRESKLGSAHSEAENGVEEKKKACRSPTAQSPTPSVEADSPDQKKIISLCTRPICTFTSCFLVSQRRNH

SEQ ID NO: 36205 - protein, 288 aa, Homo sapiens
  Payload ID: 7164
  Gene Symbol: GRAMD3
  Gene Name: GRAM domain containing 3
  ENSP ID: ENSP00000424985
MVKKRLPSSDTVFRFETPGSPRKANVEASRSSTDSPSSVFLSSEAENGVEEKKKACRSPTAQSPTPSVEADSPDQKKIISLWSKSSFDGASLASDKNDCKTESKNDPKTERKKSSSSSQYKANMHFHKLFLSVPTEEPLKQSFTCALQKEILYQGKLFVSENWICFHSKVFGKDTKISIPAFSVTLIKKTKTALLVPNALIIATVTDRYIFVSLLSRDSTYKLLKSVCGHLENTSVGNSPNPSSAENSFRADRPSSLPLDFNDEFSDLDGVVQQRRQDMEGYSSSGSQ

SEQ ID NO: 36206 - protein, 416 aa, Homo sapiens
  Payload ID: 7164
  Gene Symbol: GRAMD3
  Gene Name: GRAM domain containing 3
  Uniprot ID: Q96HH9
  ENSP ID: ENSP00000426088
MSKVKRFPFFFSSEAENGVEEKKKACRSPTAQSPTPSVEADSPDQKKIISLWSKSSFDGASLASDKNDCKTESKNDPKTERKKSSSSSQYKANMHFHKLFLSVPTEEPLKQSFTCALQKEILYQGKLFVSENWICFHSKVFGKDTKISIPAFSVTLIKKTKTALLVPNALIIATVTDRYIFVSLLSRDSTYKLLKSVCGHLENTSVGNSPNPSSAENSFRADRPSSLPLDFNDEFSDLDGVVQQRRQDMEGYSSSGSQTPESENSRDFHATESQTVLNVSKGEAKPTRADAHVNRVPEGKAKSLPVQGLSETVGILHKVKSQKCPMLHHILIFYAIVVCALIISTFYMRYRINTLEEQLGLLTSIVDTHNTEQAAPSGLRSQVQFNVEVLCQELTANIVKLEKIQNNLQKLLENGD

SEQ ID NO: 36207 - protein, 447 aa, Homo sapiens
  Payload ID: 7164
  Gene Symbol: GRAMD3
  Gene Name: GRAM domain containing 3
  Uniprot ID: Q96HH9
  ENSP ID: ENSP00000426120
MTRRQQVLQAKRSIQQTFQAQLMPWKSMFHGREVKPVGPDLELSEAENGVEEKKKACRSPTAQSPTPSVEADSPDQKKIISLWSKSSFDGASLASDKNDCKTESKNDPKTERKKSSSSSQYKANMHFHKLFLSVPTEEPLKQSFTCALQKEILYQGKLFVSENWICFHSKVFGKDTKISIPAFSVTLIKKTKTALLVPNALIIATVTDRYIFVSLLSRDSTYKLLKSVCGHLENTSVGNSPNPSSAENSFRADRPSSLPLDFNDEFSDLDGVVQQRRQDMEGYSSSGSQTPESENSRDFHATESQTVLNVSKGEAKPTRADAHVNRVPEGKAKSLPVQGLSETVGILHKVKSQKCPMLHHILIFYAIVVCALIISTFYMRYRINTLEEQLGLLTSIVDTHNTEQAAPSGLRSQVQFNVEVLCQELTANIVKLEKIQNNLQKLLENGD

SEQ ID NO: 36208 - protein, 410 aa, Homo sapiens
  Payload ID: 7164
  Gene Symbol: GRAMD3
  Gene Name: GRAM domain containing 3
  ENSP ID: ENSP00000426143
MTELQQDVEDTKPAKVLGKRESKLGSAHSEAENGVEEKKKACRSPTAQSPTPSVEADSPDQKKIISLCPYLLSKSMLHSGPRYKANMHFHKLFLSVPTEEPLKQSFTCALQKEILYQGKLFVSENWICFHSKVFGKDTKISIPAFSVTLIKKTKTALLVPNALIIATVTDRYIFVSLLSRDSTYKLLKSVCGHLENTSVGNSPNPSSAENSFRADRPSSLPLDFNDEFSDLDGVVQQRRQDMEGYSSSGSQTPESENSRVDFHATESQTVLNVSKGEAKPTRADAHVNRVPEGKAKSLPVQGLSETVGILHKVKSQKCPMLHHILIFYAIVVCALIISTFYMRYRINTLEEQLGLLTSIVDTHNTEQAAPSGLRSQVQFNVEVLCQELTANIVKLEKIQNNLQKLLENGD

SEQ ID NO: 36209 - protein, 323 aa, Homo sapiens
  Payload ID: 7164
  Gene Symbol: GRAMD3
  Gene Name: GRAM domain containing 3
  ENSP ID: ENSP00000427596
MHFHKLFLSVPTEEPLKQSFTCALQKEILYQGKLFVSENWICFHSKVFGKDTKISIPAFSVTLIKKTKTALLVPNALIIATVTDRYIFVSLLSRDSTYKLLKSVCGHLENTSVGNSPNPSSAENSFRADRPSSLPLDFNDEFSDLDGVVQQRRQDMEGYSSSGSQTPESENSRDFHATESQTVLNVSKGEAKPTRADAHVNRVPEGKAKSLPVQGLSETVGILHKVKSQKCPMLHHILIFYAIVVCALIISTFYMRYRINTLEEQLGLLTSIVDTHNTEQAAPSGLRSQVQFNVEVLCQELTANIVKLEKIQNNLQKLLENGD

SEQ ID NO: 36210 - protein, 440 aa, Homo sapiens
  Payload ID: 7164
  Gene Symbol: GRAMD3
  Gene Name: GRAM domain containing 3
  Uniprot ID: Q96HH9
  ENSP ID: ENSP00000441876
MWKTQSLRKCSGRGRANLAQPTQRLRMVWRRKRKPAGRQQPNPLPHLWRRTPQTRRKSLAYAHIFSPNLCFIQDQESKSSFDGASLASDKNDCKTESKNDPKTERKKSSSSSQYKANMHFHKLFLSVPTEEPLKQSFTCALQKEILYQGKLFVSENWICFHSKVFGKDTKISIPAFSVTLIKKTKTALLVPNALIIATVTDRYIFVSLLSRDSTYKLLKSVCGHLENTSVGNSPNPSSAENSFRADRPSSLPLDFNDEFSDLDGVVQQRRQDMEGYSSSGSQTPESENSRDFHATESQTVLNVSKGEAKPTRADAHVNRVPEGKAKSLPVQGLSETVGILHKVKSQKCPMLHHILIFYAIVVCALIISTFYMRYRINTLEEQLGLLTSIVDTHNTEQAAPSGLRSQVQFNVEVLCQELTANIVKLEKIQNNLQKLLENGD

SEQ ID NO: 36211 - protein, 328 aa, Homo sapiens
  Payload ID: 7164
  Gene Symbol: GRAMD3
  Gene Name: GRAM domain containing 3
  Uniprot ID: Q96HH9
  ENSP ID: ENSP00000444049
MYKANMHFHKLFLSVPTEEPLKQSFTCALQKEILYQGKLFVSENWICFHSKVFGKDTKISIPAFSVTLIKKTKTALLVPNALIIATVTDRYIFVSLLSRDSTYKLLKSVCGHLENTSVGNSPNPSSAENSFRADRPSSLPLDFNDEFSDLDGVVQQRRQDMEGYSSSGSQTPESENSRDFHATESQTVLNVSKGEAKPTRADAHVNRVPEGKAKSLPVQGLSETVGILHKVKSQKCPMLHHILIFYAIVVCALIISTFYMRYRINTLEEQLGLLTSIVDTHNTEQAAPSGLRSQVQFNVEVLCQELTANIVKLEKIQNNLQKLLENGD

SEQ ID NO: 36212 - protein, 578 aa, Homo sapiens
  Payload ID: 7165
  Gene Symbol: GRAMD4
  Gene Name: GRAM domain containing 4
  Uniprot ID: Q6IC98
  ENSP ID: ENSP00000354313
MLRRLDKIRFRGHKRDDFLDLAESPNASDTECSDEIPLKVPRTSPRDSEELRDPAGPGTLIMATGVQDFNRTEFDRLNEIKGHLEIALLEKHFLQEELRKLREETNAEMLRQELDRERQRRMELEQKVQEVLKARTEEQMAQQPPKGQAQASNGAERRSQGLSSRLQKWFYERFGEYVEDFRFQPEENTVETEEPLSARRLTENMRRLKRGAKPVTNFVKNLSALSDWYSVYTSAIAFTVYMNAVWHGWAIPLFLFLAILRLSLNYLIARGWRIQWSIVPEVSEPVEPPKEDLTVSEKFQLVLDVAQKAQNLFGKMADILEKIKNLFMWVQPEITQKLYVALWAAFLASCFFPYRLVGLAVGLYAGIKFFLIDFIFKRCPRLRAKYDTPYIIWRSLPTDPQLKERSSAAVSRRLQTTSSRSYVPSAPAGLGKEEDAGRFHSTKKGNFHEIFNLTENERPLAVCENGWRCCLINRDRKMPTDYIRNGVLYVTENYLCFESSKSGSSKRNKVIKLVDITDIQKYKVLSVLPGSGMGIAVSTPSTQKPLVFGAMVHRDEAFETILSQYIKITSAAASGGDS

SEQ ID NO: 36213 - protein, 578 aa, Homo sapiens; identical to SEQ ID NO: 36212
  Payload ID: 7165
  Gene Symbol: GRAMD4
  Gene Name: GRAM domain containing 4
  Uniprot ID: Q6IC98
  ENSP ID: ENSP00000385689

SEQ ID NO: 36214 - protein, 101 aa, Homo sapiens
  Payload ID: 7165
  Gene Symbol: GRAMD4
  Gene Name: GRAM domain containing 4
  Uniprot ID: Q6IC98
  ENSP ID: ENSP00000385851
MPTDYIRNGVLYVTENYLCFESSKSGSSKRNKVIKLVDITDIQKYKVLSVLPGSGMGIAVSTPSTQKPLVFGAMVHRDEAFETILSQYIKITSAAASGGDS

SEQ ID NO: 36215 - protein, 223 aa, Homo sapiens
  Payload ID: 7165
  Gene Symbol: GRAMD4
  Gene Name: GRAM domain containing 4
  ENSP ID: ENSP00000397501
  MOD_RES (1)..(1): Any amino acid
XEDFRFQPEENTVETEEPLSARRLTENMRRLKRGAKPVTNFVKNLSALSDWYSVYTSAIAFTVYMNAVWHGWAIPLFLFLAILRLSLNYLIARGWRIQWSIVPEVSEPVEPPKEDLTVSEKFQLVLDVAQKAQNLFGKMADILEKIKNLFMWVQPEITQKLYVALWAAFLASCFFPYRLVGLAVVLTRDLSLEGQRLPAPSKDGPSWDLGSLELSCPSWVGHH

SEQ ID NO: 36216 - protein, 33 aa, Homo sapiens
  Payload ID: 7165
  Gene Symbol: GRAMD4
  Gene Name: GRAM domain containing 4
  ENSP ID: ENSP00000408042
MLRRLDKIRFRGHKRDDFLDLAESPNASDTECS

SEQ ID NO: 36217 - protein, 86 aa, Homo sapiens
  Payload ID: 7165
  Gene Symbol: GRAMD4
  Gene Name: GRAM domain containing 4
  ENSP ID: ENSP00000409784
MLRRLDKIRFRGHKRDDFLDLAESPNASDTECSDEIPLKVPRTSPRDSEELRDPAGPGTLIMATGVQDFNRTEFDRLNEIKGHLEI

SEQ ID NO: 36218 - protein, 198 aa, Homo sapiens
  Payload ID: 7166
  Gene Symbol: GCA
  Gene Name: grancalcin, EF-hand calcium binding protein
  ENSP ID: ENSP00000233612
MQMGQPVPETGPAILLDGYSGPAYSDTYSSAGDSVYTYFSAVAGQDGEVDAEELQRCLTQSGINGTYSPFSLETCRIMIAMLDRDHTGKMGFNAFKELWAALNAWKENFMTVDQDGSGTVEHHELRQAIGLMGYRLSPQTLTTIVKRYSKNGRIFFDDYVACCVKLRALTDFFRKRDHLQQGSANFIYDDFLQGTMAI

SEQ ID NO: 36219 - protein, 146 aa, Homo sapiens
  Payload ID: 7166
  Gene Symbol: GCA
  Gene Name: grancalcin, EF-hand calcium binding protein
  ENSP ID: ENSP00000393218
MWRRQEEVLPKINLTSCGFPNTNLFPWEFGGGFEKFGNFSIQVPGMQMGQPVPETGPAILLDGYSGPAYSDTYSSAGDSVYTYFSAVAGQDGEVDAEELQRCLTQSGINGTYSPFSLETCRIMIAMLDRDHTGKMGFNAFKELWAA

SEQ ID NO: 36220 - protein, 217 aa, Homo sapiens
  Payload ID: 7166
  Gene Symbol: GCA
  Gene Name: grancalcin, EF-hand calcium binding protein
  Uniprot ID: P28676
  ENSP ID: ENSP00000394842
MAYPGYGGGFGNFSIQVPGMQMGQPVPETGPAILLDGYSGPAYSDTYSSAGDSVYTYFSAVAGQDGEVDAEELQRCLTQSGINGTYSPFSLETCRIMIAMLDRDHTGKMGFNAFKELWAALNAWKENFMTVDQDGSGTVEHHELRQAIGLMGYRLSPQTLTTIVKRYSKNGRIFFDDYVACCVKLRALTDFFRKRDHLQQGSANFIYDDFLQGTMAI

SEQ ID NO: 36221 - protein, 132 aa, Homo sapiens
  Payload ID: 7166
  Gene Symbol: GCA
  Gene Name: grancalcin, EF-hand calcium binding protein
  ENSP ID: ENSP00000403805
MQMGQPVPETGPAILLDGYSGPAYSDTYSSAGDSVYTYFSAVAGQDGEVDAEELQRCLTQSGINGTYSPFSLETCRIMIAMLDRDHTGKMGFNAFKELWAALNAWKENFMTVDQDGSGTVEHHELRQAIGLM

SEQ ID NO: 36222 - protein, 146 aa, Homo sapiens
  Payload ID: 7166
  Gene Symbol: GCA
  Gene Name: grancalcin, EF-hand calcium binding protein
  ENSP ID: ENSP00000408620
  MOD_RES (1)..(1): Any amino acid
XFSLETCRIMIAMLDRDHTGKMGFNAFKELWAALNAWKENFMTVDQDGSGTVEHHELRQAIGLMGYRLSPQTLTTIVKRYSKNGRIFFDDYVACCVKLRALTDFFRKRDHLQQGSANFIYDDCGGMNVINFEHLDTERPESVCKSD

SEQ ID NO: 36223 - protein, 87 aa, Homo sapiens
  Payload ID: 7166
  Gene Symbol: GCA
  Gene Name: grancalcin, EF-hand calcium binding protein
  ENSP ID: ENSP00000412899
MQMGQPVPETGPAILLDGYSGPAYSDTYSSAGDSVYTYFSAVAGQDGEVDAEELQRCLTQSGINGTYSPFSLETCRIMIAMLDRKET

SEQ ID NO: 36224 - protein, 593 aa, Homo sapiens
  Payload ID: 7167
  Gene Symbol: GRN
  Gene Name: granulin
  Uniprot ID: P28799
  ENSP ID: ENSP00000053867
MWTLVSWVALTAGLVAGTRCPDGQFCPVACCLDPGGASYSCCRPLLDKWPTTLSRHLGGPCQVDAHCSAGHSCIFTVSGTSSCCPFPEAVACGDGHHCCPRGFHCSADGRSCFQRSGNNSVGAIQCPDSQFECPDFSTCCVMVDGSWGCCPMPQASCCEDRVHCCPHGAFCDLVHTRCITPTGTHPLAKKLPAQRTNRAVALSSSVMCPDARSRCPDGSTCCELPSGKYGCCPMPNATCCSDHLHCCPQDTVCDLIQSKCLSKENATTDLLTKLPAHTVGDVKCDMEVSCPDGYTCCRLQSGAWGCCPFTQAVCCEDHIHCCPAGFTCDTQKGTCEQGPHQVPWMEKAPAHLSLPDPQALKRDVPCDNVSSCPSSDTCCQLTSGEWGCCPIPEAVCCSDHQHCCPQGYTCVAEGQCQRGSEIVAGLEKMPARRASLSHPRDIGCDQHTSCPVGQTCCPSLGGSWACCQLPHAVCCEDRQHCCPAGYTCNVKARSCEKEVVSAQPATFLARSPHVGVKDVECGEGHFCHDNQTCCRDNRQGWACCPYRQGVCCADRRHCCPAGFRCAARGTKCLRREAPRWDAPLRDPALRQLL

SEQ ID NO: 36225 - protein, 163 aa, Homo sapiens
  Payload ID: 7167
  Gene Symbol: GRN
  Gene Name: granulin
  ENSP ID: ENSP00000465375
MWTLVSWVALTAGLVAGTRCPDGQFCPVACCLDPGGASYSCCRPLLDKWPTTLSRHLGGPCQVDAHCSAGHSCIFTVSGTSSCCPFPEAVACGDGHHCCPRGFHCSADGRSCFQRSGNNSVGAIQCPDSQFECPDFSTCCVMVDGSWGCCPMPQASCCEDRVH

SEQ ID NO: 36226 - protein, 136 aa, Homo sapiens
  Payload ID: 7167
  Gene Symbol: GRN
  Gene Name: granulin
  ENSP ID: ENSP00000465518
MWTLVSWVALTAGLVAGTRCPDGQFCPVACCLDPGGASYSCCRPLLDKWPTTLSRHLGGPCQVDAHCSAGHSCIFTVSGTSSCCPFPEAVACGDGHHCCPRGFHCSADGRSCFQRSGNNSVGAIQCPDSQFECPDF

SEQ ID NO: 36227 - protein, 388 aa, Homo sapiens
  Payload ID: 7167
  Gene Symbol: GRN
  Gene Name: granulin
  ENSP ID: ENSP00000465673
  MOD_RES (1)..(1): Any amino acid
XAKKLPAQRTNRAVALSSSVMCPDARSRCPDGSTCCELPSGKYGCCPMPNATCCSDHLHCCPQDTVCDLIQSKCLSKENATTDLLTKLPAHTVGDVKCDMEVSCPDGYTCCRLQSGAWGCCPFTQAVCCEDHIHCCPAGFTCDTQKGTCEQGPHQVPWMEKAPAHLSLPDPQALKRDVPCDNVSSCPSSDTCCQLTSGEWGCCPIPEAVCCSDHQHCCPQGYTCVAEGQCQRGSEIVAGLEKMPARRASLSHPRDIGCDQHTSCPVGQTCCPSLGGSWACCQLPHAVCCEDRQHCCPAGYTCNVKARSCEKEVVSAQPATFLARSPHVGVKDVECGEGHFCHDNQTCCRDNRQGWACCPYRQVSANPHPGAGYGQGPGPTSSNPLAPL

SEQ ID NO: 36228 - protein, 62 aa, Homo sapiens
  Payload ID: 7167
  Gene Symbol: GRN
  Gene Name: granulin
  ENSP ID: ENSP00000466271
MWTLVSWVALTAGLVAGTRCPDGQFCPVACCLDPGGASYSCCRPLLDKWPTTLSRHLGGPCQ

SEQ ID NO: 36229 - protein, 149 aa, Homo sapiens
  Payload ID: 7167
  Gene Symbol: GRN
  Gene Name: granulin
  ENSP ID: ENSP00000466405
MWTLVSWVALTAGLVAGTRCPDGQFCPVACCLDPGGASYSCCRPLLDKWPTTLSRHLGGPCQVDAHCSAGHSCIFTVSGTSSCCPFPEAVACGDGHHCCPRGFHCSADGRSCFQRSGNNSVGAIQCPDSQFECPDFSTCCVMVDGSWGC

SEQ ID NO: 36230 - protein, 172 aa, Homo sapiens
  Payload ID: 7167
  Gene Symbol: GRN
  Gene Name: granulin
  ENSP ID: ENSP00000466611
MWTLVSWVALTAGLVAGTRCPDGQFCPVACCLDPGGASYSCCRPLLDKWPTTLSRHLGGPCQVDAHCSAGHSCIFTVSGTSSCCPFPEASCCEDRVHCCPHGAFCDLVHTRCITPTGTHPLAKKLPAQRTNRAVALSSSVMCPDARSRCPDGSTCCELPSGKYGCCPMPNAT

SEQ ID NO: 36231 - protein, 111 aa, Homo sapiens
  Payload ID: 7167
  Gene Symbol: GRN
  Gene Name: granulin
  ENSP ID: ENSP00000466956
MWTLVSWVALTAGLVAGTRCPDGQFCPVACCLDPGGASYSCCRPLLDKWPTTLSRHLGGPCQVDAHCSAGHSCIFTVSGTSSCCPFPEAVACGDGHHCCPRGFHCSADGRS

SEQ ID NO: 36232 - protein, 135 aa, Homo sapiens
  Payload ID: 7167
  Gene Symbol: GRN
  Gene Name: granulin
  ENSP ID: ENSP00000467022
MWTLVSWVALTAGLVAGTRCPDGQFCPVACCLDPGGASYSCCRPLLDKWPTTLSRHLGGPCQVDAHCSAGHSCIFTVSGTSSCCPFPEAVACGDGHHCCPRGFHCSADGRSCFQRSGNNSVGAIQCPDSQFECPD

SEQ ID NO: 36233 - protein, 191 aa, Homo sapiens
  Payload ID: 7167
  Gene Symbol: GRN
  Gene Name: granulin
  ENSP ID: ENSP00000467431
MWTLVSWVALTAGLVAGTRCPDGQFCPVACCLDPGGASYSCCRPLLDKWPTTLSRHLGGPCQVDAHCSAGHSCIFTVSGTSSCCPFPEIKGPCQCRFLCVPQAVACGDGHHCCPRGFHCSADGRSCFQRSGNNSVGAIQCPDSQFECPDFSTCCVMVDGSWGCCPMPQASCCEDRVHCCPHGAFCDLVHTR

SEQ ID NO: 36234 - protein, 436 aa, Homo sapiens
  Payload ID: 7167
  Gene Symbol: GRN
  Gene Name: granulin
  ENSP ID: ENSP00000467616
MWTLVSWVALTAGLVAGTRCPDGQFCPVACCLDPGGASYSCCRPLLDKWPTTLSRHLGGPCQVDAHCSAGHSCIFTVSGTSSCCPFPEAVACGDGHHCCPRGFHCSADGRSCFQRSGNNSVGAIQCPDSQFECPDFSTCCVMVDGSWGCCPMPQAVCCEDHIHCCPAGFTCDTQKGTCEQGPHQVPWMEKAPAHLSLPDPQALKRDVPCDNVSSCPSSDTCCQLTSGEWGCCPIPEAVCCSDHQHCCPQGYTCVAEGQCQRGSEIVAGLEKMPARRASLSHPRDIGCDQHTSCPVGQTCCPSLGGSWACCQLPHAVCCEDRQHCCPAGYTCNVKARSCEKEVVSAQPATFLARSPHVGVKDVECGEGHFCHDNQTCCRDNRQGWACCPYRQGVCCADRRHCCPAGFRCAARGTKCLRREAPRWDAPLRDPALRQLL

SEQ ID NO: 36235 - protein, 37 aa, Homo sapiens
  Payload ID: 7167
  Gene Symbol: GRN
  Gene Name: granulin
  ENSP ID: ENSP00000467745
MWTLVSWVALTAGLVAGTRCPDGQFCPVACCLDPGGA

SEQ ID NO: 36236 - protein, 110 aa, Homo sapiens
  Payload ID: 7167
  Gene Symbol: GRN
  Gene Name: granulin
  ENSP ID: ENSP00000467837
  MOD_RES (1)..(1): Any amino acid
XCPSLGGSWACCQLPHAVCCEDRQHCCPAGYTCNVKARSCEKEVVSAQPATFLARSPHVGVKDVECGEGHFCHDNQTCCRDNRQGWACCPYRQPGVPSVCAGRPRAGTPL

SEQ ID NO: 36237 - protein, 142 aa, Homo sapiens
  Payload ID: 7167
  Gene Symbol: GRN
  Gene Name: granulin
  ENSP ID: ENSP00000467870
MWTLVSWVALTAGLVAGTRCPDGQFCPVACCLDPGGASYSCCRPLLDKWPTTLSRHLGGPCQVDAHCSAGHSCIFTVSGTSSCCPFPEAVACGDGHHCCPRGFHCSADGRSCFQRSGNNSVGAIQCPDSQFECPDFSTCCVM

SEQ ID NO: 36238 - protein, 189 aa, Homo sapiens
  Payload ID: 7167
  Gene Symbol: GRN
  Gene Name: granulin
  ENSP ID: ENSP00000468318
MWTLVSWVALTAGLVAGTRCPDGQFCPVACCLDPGGASYSCCRPLLDKWPTTLSRHLGGPCQVDAHCSAGHSCIFTVSGTSSCCPFPEAVACGDGHHCCPRGFHCSADGRSCFQRSGNNSVGAIQCPDSQFECPDFSTCCVMVDGSWGCCPMPQGALLSARCLLRPGSHPLHHTHGHPPPGKEAPCPED

SEQ ID NO: 36239 - protein, 145 aa, Homo sapiens
  Payload ID: 7168
  Gene Symbol: GNLY
  Gene Name: granulysin
  Uniprot ID: P22749
  ENSP ID: ENSP00000263863
MATWALLLLAAMLLGNPGLVFSRLSPEYYDLARAHLRDEEKSCPCLAQEGPQGDLLTKTQELGRDYRTCLTIVQKLKKMVDKPTQRSVSNAATRVCRTGRSRWRDVCRNFMRRYQSRVTQGLVAGETAQQICEDLRLCIPSTGPL

SEQ ID NO: 36240 - protein, 130 aa, Homo sapiens
  Payload ID: 7168
  Gene Symbol: GNLY
  Gene Name: granulysin
  Uniprot ID: P22749
  ENSP ID: ENSP00000387116
MEGLVFSRLSPEYYDLARAHLRDEEKSCPCLAQEGPQGDLLTKTQELGRDYRTCLTIVQKLKKMVDKPTQRSVSNAATRVCRTGRSRWRDVCRNFMRRYQSRVTQGLVAGETAQQICEDLRLCIPSTGPL

SEQ ID NO: 36241 - protein, 187 aa, Homo sapiens
  Payload ID: 7168
  Gene Symbol: GNLY
  Gene Name: granulysin
  ENSP ID: ENSP00000434467
  MOD_RES (1)..(1): Any amino acid
XHLRDEEKSCPCLAQEGPQGDLLTKTQELGRDYRTCLTIVQKLKKMVDKPTQRSVSNAATRVCRTGRSRWRDVCRNFMRRYQSRVTQGLVAGETAQQICEDLRLCIPSTGPTTCSGCRLASRMCLWVPSEPSHLVLWKKHRLLSSDPGNLSNLCRLLASSIQNPLSSLPPLTPSAVLPSHENKVSSK

SEQ ID NO: 36242 - protein, 172 aa, Homo sapiens
  Payload ID: 7168
  Gene Symbol: GNLY
  Gene Name: granulysin
  ENSP ID: ENSP00000436423
MATWALLLLAAMLLGNPGLEVSVSPKGKNTSGRESGFGWAIWMEGLVFSRLSPEYYDLARAHLRDEEKSCPCLAQEGPQGDLLTKTQELGRDYRTCLTIVQKLKKMVDKPTQRSVSNAATRVCRTGRSRWRDVCRNFMRRYQSRVTQGLVAGETAQQICEDLRLCIPSTGPL

SEQ ID NO: 36243 - protein, 262 aa, Homo sapiens
  Payload ID: 7169
  Gene Symbol: GZMA
  Gene Name: granzyme A (granzyme 1, cytotoxic T-lymphocyte-associated serine esterase 3)
  Uniprot ID: P12544
  ENSP ID: ENSP00000274306
MRNSYRFLASSLSVVVSLLLIPEDVCEKIIGGNEVTPHSRPYMVLLSLDRKTICAGALIAKDWVLTAAHCNLNKRSQVILGAHSITREEPTKQIMLVKKEFPYPCYDPATREGDLKLLQLMEKAKINKYVTILHLPKKGDDVKPGTMCQVAGWGRTHNSASWSDTLREVNITIIDRKVCNDRNHYNFNPVIGMNMVCAGSLRGGRDSCNGDSGSPLLCEGVFRGVTSFGLENKCGDPRGPGVYILLSKKHLNWIIMTIKGAV

SEQ ID NO: 36244 - protein, 247 aa, Homo sapiens
  Payload ID: 7170
  Gene Symbol: GZMB
  Gene Name: granzyme B (granzyme 2, cytotoxic T-lymphocyte-associated serine esterase 1)
  Uniprot ID: P10144
  ENSP ID: ENSP00000216341
MQPILLLLAFLLLPRADAGEIIGGHEAKPHSRPYMAYLMIWDQKSLKRCGGFLIRDDFVLTAAHCWGSSINVTLGAHNIKEQEPTQQFIPVKRPIPHPAYNPKNFSNDIMLLQLERKAKRTRAVQPLRLPSNKAQVKPGQTCSVAGWGQTAPLGKHSHTLQEVKMTVQEDRKCESDLRHYYDSTIELCVGDPEIKKTSFKGDSGGPLVCNKVAQGIVSYGRNNGMPPRACTKVSSFVHWIKKTMKRY

SEQ ID NO: 36245 - protein, 202 aa, Homo sapiens
  Payload ID: 7170
  Gene Symbol: GZMB
  Gene Name: granzyme B (granzyme 2, cytotoxic T-lymphocyte-associated serine esterase 1)
  ENSP ID: ENSP00000371980
MQPILLLLAFLLLPRADAGEIIGGHEAKPHSRPYMAYLMIWDQKSLKRCGGFLIRDDFVLTAAHCWGRLERKAKRTRAVQPLRLPSNKAQVKPGQTCSVAGWGQTAPLGKHSHTLQEVKMTVQEDRKCESDLRHYYDSTIELCVGDPEIKKTSFKGDSGGPLVCNKVAQGIVSYGRNNGMPPRACTKVSSFVHWIKKTMKRY

SEQ ID NO: 36246 - protein, 202 aa, Homo sapiens; identical to SEQ ID NO: 36245
  Payload ID: 7170
  Gene Symbol: GZMB
  Gene Name: granzyme B (granzyme 2, cytotoxic T-lymphocyte-associated serine esterase 1)
  ENSP ID: ENSP00000371982

SEQ ID NO: 36247 - protein, 235 aa, Homo sapiens
  Payload ID: 7170
  Gene Symbol: GZMB
  Gene Name: granzyme B (granzyme 2, cytotoxic T-lymphocyte-associated serine esterase 1)
  ENSP ID: ENSP00000387385
MQTFPSGEIIGGHEAKPHSRPYMAYLMIWDQKSLKRCGGFLIRDDFVLTAAHCWGSSINVTLGAHNIKEQEPTQQFIPVKRPIPHPAYNPKNFSNDIMLLQLERKAKRTRAVQPLRLPSNKAQVKPGQTCSVAGWGQTAPLGKHSHTLQEVKMTVQEDRKCESDLRHYYDSTIELCVGDPEIKKTSFKGDSGGPLVCNKVAQGIVSYGRNNGMPPRACTKVSSFVHWIKKTMKRY

SEQ ID NO: 36248 - protein, 35 aa, Homo sapiens
  Payload ID: 7170
  Gene Symbol: GZMB
  Gene Name: granzyme B (granzyme 2, cytotoxic T-lymphocyte-associated serine esterase 1)
  ENSP ID: ENSP00000432074
MQPILLLLAFLLLPRADAAGEKGQADQSCAAPQAT

SEQ ID NO: 36249 - protein, 90 aa, Homo sapiens
  Payload ID: 7170
  Gene Symbol: GZMB
  Gene Name: granzyme B (granzyme 2, cytotoxic T-lymphocyte-associated serine esterase 1)
  ENSP ID: ENSP00000434213
MQPILLLLAFLLLPRADAGEIIGGHEAKPHSRPYMAYLMIWDQKSLKRCGGFLIRDDFVLTAAHCWGSWRERPSGPELCSPSGYLATRPR

SEQ ID NO: 36250 - protein, 44 aa, Homo sapiens
  Payload ID: 7170
  Gene Symbol: GZMB
  Gene Name: granzyme B (granzyme 2, cytotoxic T-lymphocyte-associated serine esterase 1)
  ENSP ID: ENSP00000435084
MQECSELQLPFYQDPPSVMLDKLSAGMAEQQAILKKSQGDHRGT

SEQ ID NO: 36251 - protein, 90 aa, Homo sapiens; identical to SEQ ID NO: 36249
  Payload ID: 7170
  Gene Symbol: GZMB
  Gene Name: granzyme B (granzyme 2, cytotoxic T-lymphocyte-associated serine esterase 1)
  ENSP ID: ENSP00000450535

SEQ ID NO: 36252 - protein, 152 aa, Homo sapiens
  Payload ID: 7170
  Gene Symbol: GZMB
  Gene Name: granzyme B (granzyme 2, cytotoxic T-lymphocyte-associated serine esterase 1)
  ENSP ID: ENSP00000479643
MQPILLLLAFLLLPRADQLERKAKRTRAVQPLRLPSNKAQVKPGQTCSVAGWGQTAPLGKHSHTLQEVKMTVQEDRKCESDLRHYYDSTIELCVGDPEIKKTSFKGDSGGPLVCNKVAQGIVSYGRNNGMPPRACTKVSSFVHWIKKTMKRY

SEQ ID NO: 36253 - protein, 246 aa, Homo sapiens
  Payload ID: 7171
  Gene Symbol: GZMH
  Gene Name: granzyme H (cathepsin G-like 2, protein h-CCPX)
  Uniprot ID: P20718
  ENSP ID: ENSP00000216338
MQPFLLLLAFLLTPGAGTEEIIGGHEAKPHSRPYMAFVQFLQEKSRKRCGGILVRKDFVLTAAHCQGSSINVTLGAHNIKEQERTQQFIPVKRPIPHPAYNPKNFSNDIMLLQLERKAKWTTAVRPLRLPSSKAQVKPGQLCSVAGWGYVSMSTLATTLQEVLLTVQKDCQCERLFHGNYSRATEICVGDPKKTQTGFKGDSGGPLVCKDVAQGILSYGNKKGTPPGVYIKVSHFLPWIKRTMKRL

SEQ ID NO: 36254 - protein, 160 aa, Homo sapiens
  Payload ID: 7171
  Gene Symbol: GZMH
  Gene Name: granzyme H (cathepsin G-like 2, protein h-CCPX)
  Uniprot ID: P20718
  ENSP ID: ENSP00000371988
MQPFLLLLAFLLTPGAGTEEIIGGHEAKPHSRPYMAFVQFLQEKSRKRCGGILVRKDFVLTAAHCQGSSINVTLGAHNIKEQERTQQFIPVKRPIPHPAYNPKNFSNDIMLLQGDSGGPLVCKDVAQGILSYGNKKGTPPGVYIKVSHFLPWIKRTMKRL

SEQ ID NO: 36255 - protein, 115 aa, Homo sapiens
  Payload ID: 7171
  Gene Symbol: GZMH
  Gene Name: granzyme H (cathepsin G-like 2, protein h-CCPX)
  ENSP ID: ENSP00000450576
MQPFLLLLAFLLTPGAGTEEIIGGHEAKPHSRPYMAFVQFLQEKSRKRCGGILVRKDFVLTAAHCQGRGDSGGPLVCKDVAQGILSYGNKKGTPPGVYIKVSHFLPWIKRTMKRL

SEQ ID NO: 36256 - protein, 264 aa, Homo sapiens
  Payload ID: 7172
  Gene Symbol: GZMK
  Gene Name: granzyme K (granzyme 3
  tryptase II)
  Uniprot ID: P49863
  ENSP ID: ENSP00000231009
MTKFSSFSLFFLIVGAYMTHVCFNMEIIGGKEVSPHSRPFMASIQYGGHHVCGGVLIDPQWVLTAAHCQYRFTKGQSPTVVLGAHSLSKNEASKQTLEIKKFIPFSRVTSDPQSNDIMLVKLQTAAKLNKHVKMLHIRSKTSLRSGTKCKVTGWGATDPDSLRPSDTLREVTVTVLSRKLCNSQSYYNGDPFITKDMVCAGDAKGQKDSCKGDSGGPLICKGVFHAIVSGGHECGVATKPGIYTLLTKKYQTWIKSNLVPPHTN

SEQ ID NO: 36257 - protein, 257 aa, Homo sapiens
  Payload ID: 7173
  Gene Symbol: GZMM
  Gene Name: granzyme M (lymphocyte met-ase 1)
  Uniprot ID: P51124
  ENSP ID: ENSP00000264553
MEACVSSLLVLALGALSVGSSFGTQIIGGREVIPHSRPYMASLQRNGSHLCGGVLVHPKWVLTAAHCLAQRMAQLRLVLGLHTLDSPGLTFHIKAAIQHPRYKPVPALENDLALLQLDGKVKPSRTIRPLALPSKRQVVAAGTRCSMAGWGLTHQGGRLSRVLRELDLQVLDTRMCNNSRFWNGSLSPSMVCLAADSKDQAPCKGDSGGPLVCGKGRVLARVLSFSSRVCTDIFKPPVATAVAPYVSWIRKVTGRSA

SEQ ID NO: 36258 - protein, 218 aa, Homo sapiens
  Payload ID: 7173
  Gene Symbol: GZMM
  Gene Name: granzyme M (lymphocyte met-ase 1)
  ENSP ID: ENSP00000476255
MASLQRNGSHLCGGVLVHPKWVLTAAHCLAQRMAQLRLVLGLHTLDSPGLTFHIKAAIQHPRYKPVPALENDLALLQLDGKVKPSRTIRPLALPSKRQVVAAGTRCSMAGWGLTHQGGRLSRVLRELDLQVLDTRMCNNSRFWNGSLSPSMVCLAADSKDQAPCKGDSGGPLVCGKGRVLARVLSFSSRVCTDIFKPPVATAVAPYVSWIRKVTGRSA

SEQ ID NO: 36259 - protein, 1035 aa, Homo sapiens
  Payload ID: 7174
  Gene Symbol: GIGYF1
  Gene Name: GRB10 interacting GYF protein 1
  Uniprot ID: O75420
  ENSP ID: ENSP00000275732
MAAETLNFGPEWLRALSGGGSVASPPPSPAMPKYKLADYRYGREEMLALYVKENKVPEELQDKEFAAVLQDEPLQPLALEPLTEEEQRNFSLSVNSVAVLRLMGKGAGPPLAGTSRGRGSTRSRGRGRGDSCFYQRSIEEGDGAFGRSPREIQRSQSWDDRGERRFEKSARRDGARCGFEEGGAGPRKEHARSDSENWRSLREEQEEEEEGSWRLGAGPRRDGDRWRSASPDGGPRSAGWREHGERRRKFEFDLRGDRGGCGEEEGRGGGGSSHLRRCRAPEGFEEDKDGLPEWCLDDEDEEMGTFDASGAFLPLKKGPKEPIPEEQELDFQGLEEEEEPSEGLEEEGPEAGGKELTPLPPQEEKSSSPSPLPTLGPLWGTNGDGDETAEKEPPAAEDDIRGIQLSPGVGSSAGPPGDLEDDEGLKHLQQEAEKLVASLQDSSLEEEQFTAAMQTQGLRHSAAATALPLSHGAARKWFYKDPQGEIQGPFTTQEMAEWFQAGYFSMSLLVKRGCDEGFQPLGEVIKMWGRVPFAPGPSPPPLLGNMDQERLKKQQELAAAALYQQLQHQQFLQLVSSRQLPQCALREKAALGDLTPPPPPPPQQQQQQLTAFLQQLQALKPPRGGDQNLLPTMSRSLSVPDSGRLWDVHTSASSQSGGEASLWDIPINSSTQGPILEQLQLQHKFQERREVELRAKREEEERKRREEKRRQQQQEEQKRRQEEEELFRRKHVRQQELLLKLLQQQQAVPVPPAPSSPPPLWAGLAKQGLSMKTLLELQLEGERQLHKQPPPREPARAQAPNHRVQLGGLGTAPLNQWVSEAGPLWGGPDKSGGGSSGLGLWEDTPKSGGSLVRGLGLKNSRSSPSLSDSYSHLSGRPIRKKTEEEEKLLKLLQGIPRPQDGFTQWCEQMLHTLSATGSLDVPMAVAILKEVESPYDVHDYIRSCLGDTLEAKEFAKQFLERRAKQKASQQRQQQQEAWLSSASLQTAFQANHSTKLGPGEGSKAKRRALMLHSDPSILGYSLHGSSGEIESVDDY

SEQ ID NO: 36260 - protein, 1299 aa, Homo sapiens
  Payload ID: 7175
  Gene Symbol: GIGYF2
  Gene Name: GRB10 interacting GYF protein 2
  Uniprot ID: Q6Y7W6
  ENSP ID: ENSP00000362664
MAAETQTLNFGPEWLRALSSGGSITSPPLSPALPKYKLADYRYGREEMLALFLKDNKIPSDLLDKEFLPILQEEPLPPLALVPFTEEEQRNFSMSVNSAAVLRLTGRGGGGTVVGAPRGRSSSRGRGRGRGECGFYQRSFDEVEGVFGRGGGREMHRSQSWEERGDRRFEKPGRKDVGRPNFEEGGPTSVGRKHEFIRSESENWRIFREEQNGEDEDGGWRLAGSRRDGERWRPHSPDGPRSAGWREHMERRRRFEFDFRDRDDERGYRRVRSGSGSIDDDRDSLPEWCLEDAEEEMGTFDSSGAFLSLKKVQKEPIPEEQEMDFRPVDEGEECSDSEGSHNEEAKEPDKTNKKEGEKTDRVGVEASEETPQTSSSSARPGTPSDHQSQEASQFERKDEPKTEQTEKAEEETRMENSLPAKVPSRGDEMVADVQQPLSQIPSDTASPLLILPPPVPNPSPTLRPVETPVVGAPGMGSVSTEPDDEEGLKHLEQQAEKMVAYLQDSALDDERLASKLQEHRAKGVSIPLMHEAMQKWYYKDPQGEIQGPFNNQEMAEWFQAGYFTMSLLVKRACDESFQPLGDIMKMWGRVPFSPGPAPPPHMGELDQERLTRQQELTALYQMQHLQYQQFLIQQQYAQVLAQQQKAALSSQQQQQLALLLQQFQTLKMRISDQNIIPSVTRSVSVPDTGSIWELQPTASQPTVWEGGSVWDLPLDTTTPGPALEQLQQLEKAKAAKLEQERREAEMRAKREEEERKRQEELRRQQEEILRRQQEEERKRREEEELARRKQEEALRRQREQEIALRRQREEEERQQQEEALRRLEERRREEEERRKQEELLRKQEEEAAKWAREEEEAQRRLEENRLRMEEEAARLRHEEEERKRKELEVQRQKELMRQRQQQQEALRRLQQQQQQQQLAQMKLPSSSTWGQQSNTTACQSQATLSLAEIQKLEEERERQLREEQRRQQRELMKALQQQQQQQQQKLSGWGNVSKPSGTTKSLLEIQQEEARQMQKQQQQQQQHQQPNRARNNTHSNLHTSIGNSVWGSINTGPPNQWASDLVSSIWSNADTKNSNMGFWDDAVKEVGPRNSTNKNKNNASLSKSVGVSNRQNKKVEEEEKLLKLFQGVNKAQDGFTQWCEQMLHALNTANNLDVPTFVSFLKEVESPYEVHDYIRAYLGDTSEAKEFAKQFLERRAKQKANQQRQQQQLPQQQQQQPPQQPPQQPQQQDSVWGMNHSTLHSVFQTNQSNNQQSNFEAVQSGKKKKKQKMVRADPSLLGFSVNASSERLNMGEIETLDDY

SEQ ID NO: 36261 - protein, 1299 aa, Homo sapiens; identical to SEQ ID NO: 36260
  Payload ID: 7175
  Gene Symbol: GIGYF2
  Gene Name: GRB10 interacting GYF protein 2
  Uniprot ID: Q6Y7W6
  ENSP ID: ENSP00000386537

SEQ ID NO: 36262 - protein, 1321 aa, Homo sapiens
  Payload ID: 7175
  Gene Symbol: GIGYF2
  Gene Name: GRB10 interacting GYF protein 2
  ENSP ID: ENSP00000386765
MAAETQTLNFGPEWLRALSSGGSITSPPLSPALPKYKLADYRYGREEMLALFLKDNKIPSDLLDKEFLPILQEEPLPPLALVPFTEEEQRNFSMSVNSAAVLRLTGRGGGGTVVGAPRGRSSSRGRGRGRGECGFYQRSFDEVEGVFGRGGGREMHRSQSWEERGDRRFEKPGRKDVGKKNGYYCMYSPVLLLGQPLCQGRPNFEEGGPTSVGRKHEFIRSESENWRIFREEQNGEDEDGGWRLAGSRRDGERWRPHSPDGPRSAGWREHMERRRRFEFDFRDRDDERGYRRVRSGSGSIDDDRDSLPEWCLEDAEEEMGTFDSSGAFLSLKKVQKEPIPEEQEMDFRPVDEGEECSDSEGSHNEEAKEPDKTNKKEGEKTDRVGVEASEETPQTSSSSARPGTPSDHQSQEASQFERKDEPKTEQTEKAEEETRMENSLPAKVPSRGDEMVADVQQPLSQIPSDTASPLLILPPPVPNPSPTLRPVETPVVGAPGMGSVSTEPDDEEGLKHLEQQAEKMVAYLQDSALDDERLASKLQEHRAKGVSIPLMHEAMQKWYYKDPQGEIQGPFNNQEMAEWFQAGYFTMSLLVKRACDESFQPLGDIMKMWGRVPFSPGPAPPPHMGELDQERLTRQQELTALYQMQHLQYQQFLIQQQYAQVLAQQQKAALSSQQQQQLALLLQQFQTLKMRISDQNIIPSVTRSVSVPDTGSIWELQPTASQPTVWEGGSVWDLPLDTTTPGPALEQLQQLEKAKAAKLEQERREAEMRAKREEEERKRQEELRRQQEEILRRQQEEERKRREEEELARRKQEEALRRQREQEIALRRQREEEERQQQEEALRRLEERRREEEERRKQEELLRKQEEEAAKWAREEEEAQRRLEENRLRMEEEAARLRHEEEERKRKELEVQRQKELMRQRQQQQEALRRLQQQQQQQQLAQMKLPSSSTWGQQSNTTACQSQATLSLAEIQKLEEERERQLREEQRRQQRELMKALQQQQQQQQQKLSGWGNVSKPSGTTKSLLEIQQEEARQMQKQQQQQQQHQQPNRARNNTHSNLHTSIGNSVWGSINTGPPNQWASDLVSSIWSNADTKNSNMGFWDDAVKEVGPRNSTNKNKNNASLSKSVGVSNRQNKKVEEEEKLLKLFQGVNKAQDGFTQWCEQMLHALNTANNLDVPTFVSFLKEVESPYEVHDYIRAYLGDTSEAKEFAKQFLERRAKQKANQQRQQQQLPQQQQQQPPQQPPQQPQQQDSVWGMNHSTLHSVFQTNQSNNQQSNFEAVQSGKKKKKQKMVRADPSLLGFSVNASSERLNMGEIETLDDY

SEQ ID NO: 36263 - protein, 1293 aa, Homo sapiens
  Payload ID: 7175
  Gene Symbol: GIGYF2
  Gene Name: GRB10 interacting GYF protein 2
  Uniprot ID: Q6Y7W6
  ENSP ID: ENSP00000387070
MAAETQTLNFGPEWLRALSSGGSITSPPLSPALPKYKLADYRYGREEMLALFLKDNKIPSDLLDKEFLPILQEEPLPPLALVPFTEEEQRNFSMSVNSAAVLRLTGRGGGGTVVGAPRGRSSSRGRGRGRGECGFYQRSFDEVEGVFGRGGGREMHRSQSWEERGDRRFEKPGRKDVGRPNFEEGGPTSVGRKHEFIRSESENWRIFREEQNGEDEDGGWRLAGSRRDGERWRPHSPGWREHMERRRRFEFDFRDRDDERGYRRVRSGSGSIDDDRDSLPEWCLEDAEEEMGTFDSSGAFLSLKKVQKEPIPEEQEMDFRPVDEGEECSDSEGSHNEEAKEPDKTNKKEGEKTDRVGVEASEETPQTSSSSARPGTPSDHQSQEASQFERKDEPKTEQTEKAEEETRMENSLPAKVPSRGDEMVADVQQPLSQIPSDTASPLLILPPPVPNPSPTLRPVETPVVGAPGMGSVSTEPDDEEGLKHLEQQAEKMVAYLQDSALDDERLASKLQEHRAKGVSIPLMHEAMQKWYYKDPQGEIQGPFNNQEMAEWFQAGYFTMSLLVKRACDESFQPLGDIMKMWGRVPFSPGPAPPPHMGELDQERLTRQQELTALYQMQHLQYQQFLIQQQYAQVLAQQQKAALSSQQQQQLALLLQQFQTLKMRISDQNIIPSVTRSVSVPDTGSIWELQPTASQPTVWEGGSVWDLPLDTTTPGPALEQLQQLEKAKAAKLEQERREAEMRAKREEEERKRQEELRRQQEEILRRQQEEERKRREEEELARRKQEEALRRQREQEIALRRQREEEERQQQEEALRRLEERRREEEERRKQEELLRKQEEEAAKWAREEEEAQRRLEENRLRMEEEAARLRHEEEERKRKELEVQRQKELMRQRQQQQEALRRLQQQQQQQQLAQMKLPSSSTWGQQSNTTACQSQATLSLAEIQKLEEERERQLREEQRRQQRELMKALQQQQQQQQQKLSGWGNVSKPSGTTKSLLEIQQEEARQMQKQQQQQQQHQQPNRARNNTHSNLHTSIGNSVWGSINTGPPNQWASDLVSSIWSNADTKNSNMGFWDDAVKEVGPRNSTNKNKNNASLSKSVGVSNRQNKKVEEEEKLLKLFQGVNKAQDGFTQWCEQMLHALNTANNLDVPTFVSFLKEVESPYEVHDYIRAYLGDTSEAKEFAKQFLERRAKQKANQQRQQQQLPQQQQQQPPQQPPQQPQQQDSVWGMNHSTLHSVFQTNQSNNQQSNFEAVQSGKKKKKQKMVRADPSLLGFSVNASSERLNMGEIETLDDY

SEQ ID NO: 36264 - protein, 1320 aa, Homo sapiens
  Payload ID: 7175
  Gene Symbol: GIGYF2
  Gene Name: GRB10 interacting GYF protein 2
  Uniprot ID: Q6Y7W6
  ENSP ID: ENSP00000387170
MAAETQTLNFGPEWLRALSSGGSITSPPLSPALPKYKLADYRYGREEMLALFLKDNKIPSDLLDKEFLPILQEEPLPPLALVPFTEEEQRNFSMSVNSAAVLRLTGRGGGGTVVGAPRGRSSSRGRGRGRGECGFYQRSFDEVEGVFGRGGGREMHRSQSWEERGDRRFEKPGRKDVGKKNGYYCMYSPVLLLGQPLCQGRPNFEEGGPTSVGRKHEFIRSESENWRIFREEQNGEDEDGGWRLAGSRRDGERWRPHSPDGPRSAGWREHMERRRRFEFDFRDRDDERGYRRVRSGSGSIDDDRDSLPEWCLEDAEEEMGTFDSSGAFLSLKKVQKEPIPEEQEMDFRPVDEGEECSDSEGSHNEEAKEPDKTNKKEGEKTDRVGVASEETPQTSSSSARPGTPSDHQSQEASQFERKDEPKTEQTEKAEEETRMENSLPAKVPSRGDEMVADVQQPLSQIPSDTASPLLILPPPVPNPSPTLRPVETPVVGAPGMGSVSTEPDDEEGLKHLEQQAEKMVAYLQDSALDDERLASKLQEHRAKGVSIPLMHEAMQKWYYKDPQGEIQGPFNNQEMAEWFQAGYFTMSLLVKRACDESFQPLGDIMKMWGRVPFSPGPAPPPHMGELDQERLTRQQELTALYQMQHLQYQQFLIQQQYAQVLAQQQKAALSSQQQQQLALLLQQFQTLKMRISDQNIIPSVTRSVSVPDTGSIWELQPTASQPTVWEGGSVWDLPLDTTTPGPALEQLQQLEKAKAAKLEQERREAEMRAKREEEERKRQEELRRQQEEILRRQQEEERKRREEEELARRKQEEALRRQREQEIALRRQREEEERQQQEEALRRLEERRREEEERRKQEELLRKQEEEAAKWAREEEEAQRRLEENRLRMEEEAARLRHEEEERKRKELEVQRQKELMRQRQQQQEALRRLQQQQQQQQLAQMKLPSSSTWGQQSNTTACQSQATLSLAEIQKLEEERERQLREEQRRQQRELMKALQQQQQQQQQKLSGWGNVSKPSGTTKSLLEIQQEEARQMQKQQQQQQQHQQPNRARNNTHSNLHTSIGNSVWGSINTGPPNQWASDLVSSIWSNADTKNSNMGFWDDAVKEVGPRNSTNKNKNNASLSKSVGVSNRQNKKVEEEEKLLKLFQGVNKAQDGFTQWCEQMLHALNTANNLDVPTFVSFLKEVESPYEVHDYIRAYLGDTSEAKEFAKQFLERRAKQKANQQRQQQQLPQQQQQQPPQQPPQQPQQQDSVWGMNHSTLHSVFQTNQSNNQQSNFEAVQSGKKKKKQKMVRADPSLLGFSVNASSERLNMGEIETLDDY

SEQ ID NO: 36265 - protein, 176 aa, Homo sapiens
  Payload ID: 7175
  Gene Symbol: GIGYF2
  Gene Name: GRB10 interacting GYF protein 2
  ENSP ID: ENSP00000387276
MDRIWAEREKKFQLVKNKQDGPRSAGWREHMERRRRFEFDFRDRDDERGYRRVRSGSGSIDDDRDSLPEWCLEDAEEEMGTFDSSGAFLSLKKVQKEPIPEEQEMDFRPVDEGEECSDSEGSHNEEAKEPDKTNKKEGEKTDRVGVEASEETPQTSSSSARPGTPSDHQSQEASQF

SEQ ID NO: 36266 - protein, 59 aa, Homo sapiens
  Payload ID: 7175
  Gene Symbol: GIGYF2
  Gene Name: GRB10 interacting GYF protein 2
  ENSP ID: ENSP00000389322
MDRIWAEREKKFQLVKNKQDGPRSAGWREHMERRRSTERAYSRRAGDGLPACGRRGGVL

SEQ ID NO: 36267 - protein, 90 aa, Homo sapiens
  Payload ID: 7175
  Gene Symbol: GIGYF2
  Gene Name: GRB10 interacting GYF protein 2
  ENSP ID: ENSP00000390325
MISDGRPNFEEGGPTSVGRKHEFIRSESENWRIFREEQNGEDEDGGWRLAGSRRDGERWRPHSPDGPRSAGWREHMERRRRFEFDFRDRD

SEQ ID NO: 36268 - protein, 119 aa, Homo sapiens
  Payload ID: 7175
  Gene Symbol: GIGYF2
  Gene Name: GRB10 interacting GYF protein 2
  ENSP ID: ENSP00000392218
MTKLPDDPGRPNFEEGGPTSVGRKHEFIRSESENWRIFREEQNGEDEDGGWRLAGSRRDGERWRPHSPDGPRSAGWREHMERRRRFEFDFRDRDDERGYRRVRSGSGSIDDDRDSLPEW

SEQ ID NO: 36269 - protein, 106 aa, Homo sapiens
  Payload ID: 7175
  Gene Symbol: GIGYF2
  Gene Name: GRB10 interacting GYF protein 2
  ENSP ID: ENSP00000392991
MAAETQTLNFGPEWLRALSSGGSITSPPLSPALPKYKLADYRYGREEMLALFLKDNKIPSDLLDKEFLPILQEEPLPPLALVPFTEEEQRNFSMSVNSAAVLRLTG

SEQ ID NO: 36270 - protein, 62 aa, Homo sapiens
  Payload ID: 7175
  Gene Symbol: GIGYF2
  Gene Name: GRB10 interacting GYF protein 2
  ENSP ID: ENSP00000395299
MERRRRFEFDFRDRDDERGYRRVRSGSGSIDDDRDSLPEWCLEDAEEEMGTFDSSGAFLSLK

SEQ ID NO: 36271 - protein, 13 aa, Homo sapiens
  Payload ID: 7175
  Gene Symbol: GIGYF2
  Gene Name: GRB10 interacting GYF protein 2
  ENSP ID: ENSP00000396590
MAAETQTLNFGPE

SEQ ID NO: 36272 - protein, 112 aa, Homo sapiens
  Payload ID: 7175
  Gene Symbol: GIGYF2
  Gene Name: GRB10 interacting GYF protein 2
  ENSP ID: ENSP00000396958
MAAETQTLNFGPEWLRALSSGGSITSPPLSPALPKYKLADYRYGREEMLALFLKDNKIPSDLLDKEFLPILQEEPLPPLALVPFTEEEQRNFSMSVNSAAVLRLTGRGGGGT

SEQ ID NO: 36273 - protein, 143 aa, Homo sapiens
  Payload ID: 7175
  Gene Symbol: GIGYF2
  Gene Name: GRB10 interacting GYF protein 2
  ENSP ID: ENSP00000398055
MERRRRFEFDFRDRDDERGYRRVRSGSGSIDDDRDSLPEWCLEDAEEEMGTFDSSGAFLSLKKVQKEPIPEEQEMDFRPVDEGEECSDSEGSHNEEAKEPDKTNKKEGEKTDRVGVEASEETPQTSSSSARPGTPSDHQSQEA

SEQ ID NO: 36274 - protein, 92 aa, Homo sapiens
  Payload ID: 7175
  Gene Symbol: GIGYF2
  Gene Name: GRB10 interacting GYF protein 2
  ENSP ID: ENSP00000399064
MAAETQTLNFGPEWLRALSSGGSITSPPLSPALPKYKLADYRYGREEMLALFLKDNKIPSDLLDKEFLPILQEEPLPPLALVPFTEEEQRQR

SEQ ID NO: 36275 - protein, 62 aa, Homo sapiens; identical to SEQ ID NO: 36270
  Payload ID: 7175
  Gene Symbol: GIGYF2
  Gene Name: GRB10 interacting GYF protein 2
  ENSP ID: ENSP00000400076

SEQ ID NO: 36276 - protein, 71 aa, Homo sapiens
  Payload ID: 7175
  Gene Symbol: GIGYF2
  Gene Name: GRB10 interacting GYF protein 2
  ENSP ID: ENSP00000401261
MERRRRFEFDFRDRDDERGYRRVRSGSGSIDDDRDSLPEWCLEDAEEEMGTFDSSGAFLSLKKVQKEPIPE

SEQ ID NO: 36277 - protein, 93 aa, Homo sapiens
  Payload ID: 7175
  Gene Symbol: GIGYF2
  Gene Name: GRB10 interacting GYF protein 2
  ENSP ID: ENSP00000402053
MAAETQTLNFGPEWLRALSSGGSITSPPLSPALPKYKLADYRYGREEMLALFLKDNKIPSDLLDKEFLPILQEEPLPPLALVPFTEEEQRNFS

SEQ ID NO: 36278 - protein, 115 aa, Homo sapiens
  Payload ID: 7175
  Gene Symbol: GIGYF2
  Gene Name: GRB10 interacting GYF protein 2
  ENSP ID: ENSP00000402712
MAAETQTLNFGPEWLRALSSGGSITSPPLSPALPKYKLADYRYGREEMLALFLKDNKIPSDLLDKEFLPILQEEPLPPLALVPFTEEEQRNFSMSVNSAAVLRLTGRGGGGTVVG

SEQ ID NO: 36279 - protein, 720 aa, Homo sapiens
  Payload ID: 7175
  Gene Symbol: GIGYF2
  Gene Name: GRB10 interacting GYF protein 2
  ENSP ID: ENSP00000404195
MAAETQTLNFGPEWLRALSSGGSITSPPLSPALPKYKLADYRYGREEMLALFLKDNKIPSDLLDKEFLPILQEEPLPPLALVPFTEEEQRNFSMSVNSAAVLRLTGRGGGGTVVGAPRGRSSSRGRGRPNFEEGGPTSVGRKHEFIRSESENWRIFREEQNGEDEDGGWRLAGSRRDGERWRPHSPGWREHMERRRRFEFDFRDRDDERGYRRVRSGSGSIDDDRDSLPEWCLEDAEEEMGTFDSSGAFLSLKKVQKEPIPEEQEMDFRPVDEGEECSDSEGSHNEEAKEPDKTNKKEGEKTDRVGVEASEETPQTSSSSARPGTPSDHQSQEASQFERKDEPKTEQTEKAEEETRMENSLPAKVPSRGDEMVADVQQPLSQIPSDTASPLLILPPPVPNPSPTLRPVETPVVGAPGMGSVSTEPDDEEGLKHLEQQAEKMVAYLQDSALDDERLASKLQEHRAKGVSIPLMHEAMQKWYYKDPQGEIQGPFNNQEMAEWFQAGYFTMSLLVKRACDESFQPLGDIMKMWGRVPFSPGPAPPPHMGELDQERLTRQQELTALYQMQHLQYQQFLIQQQYAQVLAQQQKAALSSQQQQQLALLLQQFQTLKMRISDQNIIPSVTRSVSVPDTGSIWELQPTASQPTVWEGGSVWDLPLDTTTPGPALEQLQQLEKAKAAKLEQERREAEMRAKREEEERKRQEELRRQQEEILRRQQEEER

SEQ ID NO: 36280 - protein, 99 aa, Homo sapiens
  Payload ID: 7175
  Gene Symbol: GIGYF2
  Gene Name: GRB10 interacting GYF protein 2
  ENSP ID: ENSP00000407161
MAAETQTLNFGPEWLRALSSGGSITSPPLSPALPKYKLADYRYGREEMLALFLKDNKIPSDLLDKEFLPILQEEPLPPLALVPFTEEEQRNFSMSVNSA

SEQ ID NO: 36281 - protein, 836 aa, Homo sapiens
  Payload ID: 7175
  Gene Symbol: GIGYF2
  Gene Name: GRB10 interacting GYF protein 2
  ENSP ID: ENSP00000410297
MAAETQTLNFGPEWLRALSSGGSITSPPLSPALPKYKLADYRYGREEMLALFLKDNKIPSDLLDKEFLPILQEEPLPPLALVPFTEEEQRNFSMSVNSAAVLRLTGRGGGGTVVGAPRGRSSSRGRGRGRGECGFYQRSFDEVEGVFGRGGGREMHRSQSWEERGDRRFEKPGRKDVGRPNFEEGGPTSVGRKHEFIRSESENWRIFREEQNGEDEDGGWRLAGSRRDGERWRPHSPGWREHMERRRRFEFDFRDRDDERGYRRVRSGSGSIDDDRDSLPEWCLEDAEEEMGTFDSSGAFLSLKKVQKEPIPEEQEMDFRPVDEGEECSDSEGSHNEEAKEPDKTNKKEGEKTDRVGVEASEETPQTSSSSARPGTPSDHQSQEASQFERKDEPKTEQTEKAEEETRMENSLPAKVPSRGDEMVADVQQPLSQIPSDTASPLLILPPPVPNPSPTLRPVETPVVGAPGMGSVSTEPDDEEGLKHLEQQAEKMVAYLQDSALDDERLASKLQEHRAKGVSIPLMHEAMQKWYYKDPQGEIQGPFNNQEMAEWFQAGYFTMSLLVKRACDESFQPLGDIMKMWGRVPFSPGPAPPPHMGELDQERLTRQQELTALYQMQHLQYQQFLIQQQYAQVLAQQQKAALSSQQQQQLALLLQQFQTLKMRISDQNIIPSVTRSVSVPDTGSIWELQPTASQPTVWEGGSVWDLPLDTTTPGPALEQLQQLEKAKAAKLEQERREAEMRAKREEEERKRQEELRRQQEEILRRQQEEERKRREEEELARRKQEEALRRQREQEIALRRQREEEERQQQEEALRRLEERRREEEERRKQEELLRK

SEQ ID NO: 36282 - protein, 68 aa, Homo sapiens
  Payload ID: 7175
  Gene Symbol: GIGYF2
  Gene Name: GRB10 interacting GYF protein 2
  ENSP ID: ENSP00000413612
MAAETQTLNFGPEWLRALSSGGSITSPPLSPALPKYKLADYRYGRGECGFYQRSFDEVEGVFGRGGGR

SEQ ID NO: 36283 - protein, 149 aa, Homo sapiens
  Payload ID: 7175
  Gene Symbol: GIGYF2
  Gene Name: GRB10 interacting GYF protein 2
  ENSP ID: ENSP00000415037
MKALQQQQQQQQQKLSGWGNVSKPSGTTKSLLEIQQEEARQMQKQQQQQQQHQQPNRARNNTHSNLHTSIGNSVWGSINTGPPNQWASDLVSSIWSNADTKNSNMGFWDDAVKEVGPRNSTNKNKNNASLSKSVGVSNRQNKKVEEEEK

SEQ ID NO: 36284 - protein, 1321 aa, Homo sapiens; identical to SEQ ID NO: 36262
  Payload ID: 7175
  Gene Symbol: GIGYF2
  Gene Name: GRB10 interacting GYF protein 2
  ENSP ID: ENSP00000487548

SEQ ID NO: 36285 - protein, 876 aa, Homo sapiens
  Payload ID: 7176
  Gene Symbol: GAREM
  Gene Name: GRB2 associated, regulator of MAPK1
  Uniprot ID: Q9H706
  ENSP ID: ENSP00000269209
MDPAPSLGCSLKDVKWSSVAVPLDLLVSTYRLPQIARLDNGECVEGLRENDYLLIHSCRQWTTITAHSLEEGHYVIGPKIEIPVHYAGQFKLLEQDRDIKEPVQYFNSVEEVAKAFPERVYVMEDITFNVKVASGECNEDTEVYNITLCTGDELTLMGQAEILYAKTFKEKSRLNTIFKKIGKLNSISKLGKGKMPCLICMNHRTNESISLPFQCKGRFSTRSPLELQMQEGEHTIRNIVEKTRLPVNVTVPSPPPRNPYDLHFIREGHRYKFVNIQTKTVVVCCVLRNNKILPMHFPLHLTVPKFSLPEHLVKGESWPETLVHHWLGICQEQFDIDEYSRAVRDVKTDWNEECKSPKKGRCSGHNHVPNSLSYARDELTQSFHRLSVCVYGNNLHGNSEVNLHGCRDLGGDWAPFPHDILPYQDSGDSGSDYLFPEASEESAGIPGKSELPYEELWLEEGKPSHQPLTRSLSEKNRCDQFRGSVRSKCATSPLPIPGTLGAAVKSSDTALPPPPVPPKSEAVREECRLLNAPPVPPRSAKPLSTSPSIPPRTVKPARQQTRSPSPTLSYYSSGLHNISVTKTDTNPSESTPVSCYPCNRVKTDSVDLKSPFGSPSAEAVSSRLSWPNHYSGASESQTRSDFLLDPSRSYSYPRQKTPGTPKRNCPAPFDFDGCELLASPTSPVTAEFSSSVSGCPKSASYSLESTDVKSLAAGVTKQSTSCPALPPRAPKLVEEKVASETSPLPLKIDGAEEDPKSGSPDLSEDQYFVKKGMQDIFSASYPFSSPLHLQLAPRSCGDGSPWQPPADLSGLSIEEVSKSLRFIGLSEDVISFFVTEKIDGNLLVQLTEEILSEDFKLSKLQVKKIMQFINGWRPKI

SEQ ID NO: 36286 - protein, 875 aa, Homo sapiens
  Payload ID: 7176
  Gene Symbol: GAREM
  Gene Name: GRB2 associated, regulator of MAPK1
  Uniprot ID: Q9H706
  ENSP ID: ENSP00000382165
MDPAPSLGCSLKDVKWSSVAVPLDLLVSTYRLPQIARLDNGECVEGLRENDYLLIHSCRQWTTITAHSLEEGHYVIGPKIEIPVHYAGQFKLLEQDRDIKEPVQYFNSVEEVAKAFPERVYVMEDITFNVKVASGECNEDTEVYNITLCTGDELTLMGQAEILYAKTFKEKSRLNTIFKKIGKLNSISKLGKGKMPCLICMNHRTNESISLPFQCKGRFSTRSPLELQMQEGEHTIRNIVEKTRLPVNVTVPSPPPRNPYDLHFIREGHRYKFVNIQTKTVVVCCVLRNNKILPMHFPLHLTVPKFSLPEHLVKGESWPETLVHHWLGICQEQFDIDEYSRAVRDVKTDWNEECKSPKKGRCSGHNHVPNSLSYARDELTQSFHRLSVCVYGNNLHGNSEVNLHGCRDLGGDWAPFPHDILPYQDSGDSGSDYLFPEASEESAGIPGKSELPYEELWLEEGKPSHQPLTRSLSEKNRCDQFRGSVRSKCATSPLPIPGTLGAAVKSSDTALPPPPVPPKSEAVREECRLLNAPPVPPRSAKPLSTSPSIPPRTVKPARQQTRSPSPTLSYYSSGLHNIVTKTDTNPSESTPVSCYPCNRVKTDSVDLKSPFGSPSAEAVSSRLSWPNHYSGASESQTRSDFLLDPSRSYSYPRQKTPGTPKRNCPAPFDFDGCELLASPTSPVTAEFSSSVSGCPKSASYSLESTDVKSLAAGVTKQSTSCPALPPRAPKLVEEKVASETSPLPLKIDGAEEDPKSGSPDLSEDQYFVKKGMQDIFSASYPFSSPLHLQLAPRSCGDGSPWQPPADLSGLSIEEVSKSLRFIGLSEDVISFFVTEKIDGNLLVQLTEEILSEDFKLSKLQVKKIMQFINGWRPKI

SEQ ID NO: 36287 - protein, 36 aa, Homo sapiens
  Payload ID: 7176
  Gene Symbol: GAREM
  Gene Name: GRB2 associated, regulator of MAPK1
  ENSP ID: ENSP00000464185
  MOD_RES (1)..(1): Any amino acid
XAAVKSSDTALPPPPVPPKSEARQGFITLPRLVSKS

SEQ ID NO: 36288 - protein, 664 aa, Homo sapiens
  Payload ID: 7177
  Gene Symbol: GAREML
  Gene Name: GRB2 associated, regulator of MAPK1-like
  Uniprot ID: Q75VX8
  ENSP ID: ENSP00000384581
MHRMPDPGKFKLLEQARDVREPVRYFSSVEEVASVFPDRIFVMEAITFSVKVVSGEFSEDSEVYNFTLHAGDELTLMGQAEILCAKTTKERSRFTTLLRKLGRAGALAGVGGGGPASAGAAGGTGGGGARPVKGKMPCLICMNHRTNESLSLPFQCQGRFSTRSPLELQMQEGEHTVRAIIERVRLPVNVLVPSRPPRNPYDLHPVREGHCYKLVSIISKTVVLGLALRREGPAPLHFLLLTDTPRFALPQGLLAGDPRVERLVRDSASYCRERFDPDEYSTAVREAPAELAEDCASPRRARLCLPAPRAPGLARAPGPLAPAPAGEGDQEYVSPDWAAAPEPAAPPAEIPYEELWAHQGPEGLVRPPPGLDLISFGAAGPPRREPEAPPPPVPPKSEAVKEECRLLNAPPVPPRGGNGSGRLSSSPPVPPRFPKLQPVHSPSSSLSYYSSGLQDGAGSRSGSGSPSPDTYSLYCYPCTWGDCKEPVLEPFDPFELGQGSSPEPELLRSQEPRAVGTPGPGPRLSPLGPSKAFEPEGLVLHQVPTPLSPAALQGPEAGGALFLTQGRLEGPPASPRDGATGFGVRDASSWQPPADLSALSLEEVSRSLRFIGLSEDVVSFFARERIDGSIFVQLSEDILADDFHLTKLQVKKIMQFIKGWRPKI

SEQ ID NO: 36289 - protein, 874 aa, Homo sapiens
  Payload ID: 7177
  Gene Symbol: GAREML
  Gene Name: GRB2 associated, regulator of MAPK1-like
  Uniprot ID: Q75VX8
  ENSP ID: ENSP00000384593
MEKLAAGLAGLRWSMGAFPLDLIVSRCRLPTLACLGPGEYAEGVSERDILLIHSCRQWTTVTAHTLEEGHYVIGPKIDIPLQYPGKFKLLEQARDVREPVRYFSSVEEVASVFPDRIFVMEAITFSVKVVSGEFSEDSEVYNFTLHAGDELTLMGQAEILCAKTTKERSRFTTLLRKLGRAGALAGVGGGGPASAGAAGGTGGGGARPVKGKMPCLICMNHRTNESLSLPFQCQGRFSTRSPLELQMQEGEHTVRAIIERVRLPVNVLVPSRPPRNPYDLHPVREGHCYKLVSIISKTVVLGLALRREGPAPLHFLLLTDTPRFALPQGLLAGDPRVERLVRDSASYCRERFDPDEYSTAVREAPAELAEDCASPRRARLCLPAPRAPGLARAPGPLAPAPAGEGDQEYVSPDWAAAPEPAAPPAEIPYEELWAHQGPEGLVRPPPGLDLISFGAAGPPRREPEAPPPPVPPKSEAVKEECRLLNAPPVPPRGGNGSGRLSSSPPVPPRFPKLQPVHSPSSSLSYYSSGLQDGAGSRSGSGSPSPDTYSLYCYPCTWGDCKVGESSSRPAPGPLPSTTQPSQASRALTEPLSGRAASLLGADTPVKTYHSCPPLFKPSHPQKRFAPFGALNPFSGPAYPSGPSAALSSGPRTTSGPVATSGPAYSPGPASPGQAYSAAPPSSCAPSSSSSSEWQEPVLEPFDPFELGQGSSPEPELLRSQEPRAVGTPGPGPRLSPLGPSKAFEPEGLVLHQVPTPLSPAALQGPEAGGALFLTQGRLEGPPASPRDGATGFGVRDASSWQPPADLSALSLEEVSRSLRFIGLSEDVVSFFARERIDGSIFVQLSEDILADDFHLTKLQVKKIMQFIKGWRPKI

SEQ ID NO: 36290 - protein, 694 aa, Homo sapiens
  Payload ID: 7178
  Gene Symbol: GAB1
  Gene Name: GRB2-associated binding protein 1
  Uniprot ID: Q13480
  ENSP ID: ENSP00000262994
MSGGEVVCSGWLRKSPPEKKLKRYAWKRRWFVLRSGRLTGDPDVLEYYKNDHAKKPIRIIDLNLCQQVDAGLTFNKKEFENSYIFDINTIDRIFYLVADSEEEMNKWVRCICDICGFNPTEEDPVKPPGSSLQAPADLPLAINTAPPSTQADSSSATLPPPYQLINVPPHLETLGIQEDPQDYLLLINCQSKKPEPTRTHADSAKSTSSETDCNDNVPSHKNPASSQSKHGMNGFFQQQMIYDSPPSRAPSASVDSSLYNLPRSYSHDVLPKVSPSSTEADGELYVFNTPSGTSSVETQMRHVSISYDIPPTPGNTYQIPRTFPEGTLGQTSKLDTIPDIPPPRPPKPHPAHDRSPVETCSIPRTASDTDSSYCIPTAGMSPSRSNTISTVDLNKLRKDASSQDCYDIPRAFPSDRSSSLEGFHNHFKVKNVLTVGSVSSEELDENYVPMNPNSPPRQHSSSFTEPIQEANYVPMTPGTFDFSSFGMQVPPPAHMGFRSSPKTPPRRPVPVADCEPPPVDRNLKPDRKVKPAPLEIKPLPEWEELQAPVRSPITRSFARDSSRFPMSPRPDSVHSTTSSSDSHDSEENYVPMNPNLSSEDPNLFGSNSLDGGSSPMIKPKGDKQVEYLDLDLDSGKSTPPRKQKSSGSGSSVADERVDYVVVDQQKTLALKSTREAWTDGRQSTESETPAKSVK

SEQ ID NO: 36291 - protein, 724 aa, Homo sapiens
  Payload ID: 7178
  Gene Symbol: GAB1
  Gene Name: GRB2-associated binding protein 1
  Uniprot ID: Q13480
  ENSP ID: ENSP00000262995
MSGGEVVCSGWLRKSPPEKKLKRYAWKRRWFVLRSGRLTGDPDVLEYYKNDHAKKPIRIIDLNLCQQVDAGLTFNKKEFENSYIFDINTIDRIFYLVADSEEEMNKWVRCICDICGFNPTEEDPVKPPGSSLQAPADLPLAINTAPPSTQADSSSATLPPPYQLINVPPHLETLGIQEDPQDYLLLINCQSKKPEPTRTHADSAKSTSSETDCNDNVPSHKNPASSQSKHGMNGFFQQQMIYDSPPSRAPSASVDSSLYNLPRSYSHDVLPKVSPSSTEADGELYVFNTPSGTSSVETQMRHVSISYDIPPTPGNTYQIPRTFPEGTLGQTSKLDTIPDIPPPRPPKPHPAHDRSPVETCSIPRTASDTDSSYCIPTAGMSPSRSNTISTVDLNKLRKDASSQDCYDIPRAFPSDRSSSLEGFHNHFKVKNVLTVGSVSSEELDENYVPMNPNSPPRQHSSSFTEPIQEANYVPMTPGTFDFSSFGMQVPPPAHMGFRSSPKTPPRRPVPVADCEPPPVDRNLKPDRKGQSPKILRLKPHGLERTDSQTIGDFATRRKVKPAPLEIKPLPEWEELQAPVRSPITRSFARDSSRFPMSPRPDSVHSTTSSSDSHDSEENYVPMNPNLSSEDPNLFGSNSLDGGSSPMIKPKGDKQVEYLDLDLDSGKSTPPRKQKSSGSGSSVADERVDYVVVDQQKTLALKSTREAWTDGRQSTESETPAKSVK

SEQ ID NO: 36292 - protein, 94 aa, Homo sapiens
  Payload ID: 7178
  Gene Symbol: GAB1
  Gene Name: GRB2-associated binding protein 1
  ENSP ID: ENSP00000420867
  MOD_RES (1)..(1): Any amino acid
XGRLTGDPDVLEYYKNDHAKKPIRIIDLNLCQQVDAGLTFNKKEFENSYIFDINTIDRIFYLVADSEEEMNKWVRCICDICGFNPTEEGSHFVV

SEQ ID NO: 36293 - protein, 591 aa, Homo sapiens
  Payload ID: 7178
  Gene Symbol: GAB1
  Gene Name: GRB2-associated binding protein 1
  ENSP ID: ENSP00000424554
MNKWVRCICDICGFNPTEEDPVKPPGSSLQAPADLPLAINTAPPSTQADSSSATLPPPYQLINVPPHLETLGIQEDPQDYLLLINCQSKKPEPTRTHADSAKSTSSETDCNDNVPSHKNPASSQSKHGMNGFFQQQMIYDSPPSRAPSASVDSSLYNLPRSYSHDVLPKVSPSSTEADGELYVFNTPSGTSSVETQMRHVSISYDIPPTPGNTYQIPRTFPEGTLGQTSKLDTIPDIPPPRPPKPHPAHDRSPVETCSIPRTASDTDSSYCIPTAGMSPSRSNTISTVDLNKLRKDASSQDCYDIPRAFPSDRSSSLEGFHNHFKVKNVLTVGSVSSEELDENYVPMNPNSPPRQHSSSFTEPIQEANYVPMTPGTFDFSSFGMQVPPPAHMGFRSSPKTPPRRPVPVADCEPPPVDRNLKPDRKVKPAPLEIKPLPEWEELQAPVRSPITRSFARDSSRFPMSPRPDSVHSTTSSSDSHDSEENYVPMNPNLSSEDPNLFGSNSLDGGSSPMIKPKGDKQVEYLDLDLDSGKSTPPRKQKSSGSGSSVADERVDYVVVDQQKTLALKSTREAWTDGRQSTESETPAKSVK

SEQ ID NO: 36294 - protein, 176 aa, Homo sapiens
  Payload ID: 7178
  Gene Symbol: GAB1
  Gene Name: GRB2-associated binding protein 1
  ENSP ID: ENSP00000425921
MDEAWKRRWFVLRSGRLTGDPDVLEYYKNDHAKKPIRIIDLNLCQQVDAGLTFNKKEFENSYIFDINTIDRIFYLVADSEEEMNKWVRCICDICGFNPTEEDPVKPPGSSLQAPADLPLAINTAPPSTQADSSSATLPPPYQLINVPPHLETLGIQEDPQDYLLLINCQSKKPEPT

SEQ ID NO: 36295 - protein, 91 aa, Homo sapiens
  Payload ID: 7178
  Gene Symbol: GAB1
  Gene Name: GRB2-associated binding protein 1
  ENSP ID: ENSP00000426297
  MOD_RES (1)..(1): Any amino acid
XPVKPPGSSLQAPADLPLAINTAPPSTQADSSSATLPPPYQLINVPPHLETLGIQEDPQDYLLLINCQSKKPEPTRNASEECEMKILPCHF

SEQ ID NO: 36296 - protein, 48 aa, Homo sapiens
  Payload ID: 7178
  Gene Symbol: GAB1
  Gene Name: GRB2-associated binding protein 1
  ENSP ID: ENSP00000426668
MNKWVRCICDICGFNPTEEDPVKPPGSSLQAPADLPLAINTAPPSTQA

SEQ ID NO: 36297 - protein, 239 aa, Homo sapiens
  Payload ID: 7178
  Gene Symbol: GAB1
  Gene Name: GRB2-associated binding protein 1
  ENSP ID: ENSP00000427435
MSGGEVVCSGWLRKSPPEKKLKRYAWKRRWFVLRSGRLTGDPDVLEYYKNDHAKKPIRIIDLNLCQQVDAGLTFNKKEFENSYIFDINTIDRIFYLVADSEEEMNKWVRCICDICGFNPTEEDPVKPPGSSLQAPADLPLAINTAPPSTQADSSSATLPPPYQLINVPPHLETLGIQEDPQDYLLLINCQSKKPEPTSQGSSFVSEEGEEYLLLEDFESKTIPLQTHADSAKSTSSETD

SEQ ID NO: 36298 - protein, 638 aa, Homo sapiens
  Payload ID: 7179
  Gene Symbol: GAB2
  Gene Name: GRB2-associated binding protein 2
  Uniprot ID: Q9UQC2
  ENSP ID: ENSP00000343959
MSGDPDVLEYYKNDHSKKPLRIINLNFCEQVDAGLTFNKKELQDSFVFDIKTSERTFYLVAETEEDMNKWVQSICQICGFNQAEESTDSLRNVSSAGHGPRSSPAELSSSSQHLLRERKSSAPSHSSQPTLFTFEPPVSNHMQPTLSTSAPQEYLYLHQCISRRAENARSASFSQGTRASFLMRSDTAVQKLAQGNGHCVNGISGQVHGFYSLPKPSRHNTEFRDSTYDLPRSLASHGHTKGSLTGSETDNEDVYTFKTPSNTLCREFGDLLVDNMDVPATPLSAYQIPRTFTLDKNHNAMTVATPGDSAIAPPPRPPKPSQAETPRWGSPQQRPPISENSRSVAATIPRRNTLPAMDNSRLHRASSCETYEYPQRGGESAGRSAESMSDGVGSFLPGKMIVGRSDSTNSEDNYVPMNPGSSTLLAMERAGDNSQSVYIPMSPGAHHFDSLGYPSTTLPVHRGPSRGSEIQPPPVNRNLKPDRKAKPTPLDLRNNTVIDELPFKSPITKSWSRANHTFNSSSSQYCRPISTQSITSTDSGDSEENYVPMQNPVSASPVPSGTNSPAPKKSTGSVDYLALDFQPSSPSPHRKPSTSSVTSDEKVDYVQVDKEKTQALQNTMQEWTDVRQSSEPSKGAKL

SEQ ID NO: 36299 - protein, 676 aa, Homo sapiens
  Payload ID: 7179
  Gene Symbol: GAB2
  Gene Name: GRB2-associated binding protein 2
  Uniprot ID: Q9UQC2
  ENSP ID: ENSP00000354952
MSGGGDVVCTGWLRKSPPEKKLRRYAWKKRWFILRSGRMSGDPDVLEYYKNDHSKKPLRIINLNFCEQVDAGLTFNKKELQDSFVFDIKTSERTFYLVAETEEDMNKWVQSICQICGFNQAEESTDSLRNVSSAGHGPRSSPAELSSSSQHLLRERKSSAPSHSSQPTLFTFEPPVSNHMQPTLSTSAPQEYLYLHQCISRRAENARSASFSQGTRASFLMRSDTAVQKLAQGNGHCVNGISGQVHGFYSLPKPSRHNTEFRDSTYDLPRSLASHGHTKGSLTGSETDNEDVYTFKTPSNTLCREFGDLLVDNMDVPATPLSAYQIPRTFTLDKNHNAMTVATPGDSAIAPPPRPPKPSQAETPRWGSPQQRPPISENSRSVAATIPRRNTLPAMDNSRLHRASSCETYEYPQRGGESAGRSAESMSDGVGSFLPGKMIVGRSDSTNSEDNYVPMNPGSSTLLAMERAGDNSQSVYIPMSPGAHHFDSLGYPSTTLPVHRGPSRGSEIQPPPVNRNLKPDRKAKPTPLDLRNNTVIDELPFKSPITKSWSRANHTFNSSSSQYCRPISTQSITSTDSGDSEENYVPMQNPVSASPVPSGTNSPAPKKSTGSVDYLALDFQPSSPSPHRKPSTSSVTSDEKVDYVQVDKEKTQALQNTMQEWTDVRQSSEPSKGAKL

SEQ ID NO: 36300 - protein, 102 aa, Homo sapiens
  Payload ID: 7179
  Gene Symbol: GAB2
  Gene Name: GRB2-associated binding protein 2
  ENSP ID: ENSP00000431868
MSGDPDVLEYYKNDHSKKPLRIINLNFCEQVDAGLTFNKKELQDSFVFDIKTSERTFYLVAETEEDMNKWVQSICQICGFNQAEESTDSLRNVSSAGHGPRS

SEQ ID NO: 36301 - protein, 130 aa, Homo sapiens
  Payload ID: 7179
  Gene Symbol: GAB2
  Gene Name: GRB2-associated binding protein 2
  ENSP ID: ENSP00000433762
MSGDPDVLEYYKNDHSKKPLRIINLNFCEQVDAGLTFNKKELQDSFVFDIKTSERTFYLVAETEEDMNKWVQSICQICGFNQAEESTDSLRNVSSAGHGPRSSPAELSSSSQHLLRERKSSAPSHSSQPT

SEQ ID NO: 36302 - protein, 548 aa, Homo sapiens
  Payload ID: 7180
  Gene Symbol: GAB3
  Gene Name: GRB2-associated binding protein 3
  Uniprot ID: Q8WWW8
  ENSP ID: ENSP00000358581
MSAGDAVCTGWLVKSPPERKLQRYAWRKRWFVLRRGRMSGNPDVLEYYRNKHSSKPIRVIDLSECAVWKHVGPSFVRKEFQNNFVFIVKTTSRTFYLVAKTEQEMQVWVHSISQVCNLGHLEDGAADSMESLSYTPSSLQPSSASSLLTAHAASSSLPRDDPNTNAVATEETRSESELLFLPDYLVLSNCETGRLHHTSLPTRCDSWSNSDRSLEQASFDDVFVDCLQPLPSSHLVHPSCHGSGAQEVPSSRPQAALIWSREINGPPRDHLSSSPLLESSLSSTIQVDKNQGSLPCGAKELDIMSNTPPPRPPKPSHLSERRQEEWSTHSGSKKPECTLVPRRISLSGLDNMRTWKADVEGQSLRHRDKRLSLNLPCRFSPMYPTASASIEDSYVPMSPQAGASGLGPHCSPDDYIPMNSGSISSPLPELPANLEPPPVNRDLKPQRKSRPPPLDLRNLSIIREHASLTRTRTVPCSRTSFLSPERNGINSARFFANPVSREDEESYIEMKLLLSEEQRVDYVQVDEQKTQALQSTKQEWTDERQSKV

SEQ ID NO: 36303 - protein, 586 aa, Homo sapiens
  Payload ID: 7180
  Gene Symbol: GAB3
  Gene Name: GRB2-associated binding protein 3
  Uniprot ID: Q8WWW8
  ENSP ID: ENSP00000358588
MSAGDAVCTGWLVKSPPERKLQRYAWRKRWFVLRRGRMSGNPDVLEYYRNKHSSKPIRVIDLSECAVWKHVGPSFVRKEFQNNFVFIVKTTSRTFYLVAKTEQEMQVWVHSISQVCNLGHLEDGADSMESLSYTPSSLQPSSASSLLTAHAASSSLPRDDPNTNAVATEETRSESELLFLPDYLVLSNCETGRLHHTSLPTRCDSWSNSDRSLEQASFDDVFVDCLQPLPSSHLVHPSCHGSGAQEVPSSRPQAALIWSREINGPPRDHLSSSPLLESSLSSTIQVDKNQGSLPCGAKELDIMSNTPPPRPPKPSHLSERRQEEWSTHSGSKKPECTLVPRRISLSGLDNMRTWKADVEGQSLRHRDKRLSLNLPCRFSPMYPTASASIEDSYVPMSPQAGASGLGPHCSPDDYIPMNSGSISSPLPELPANLEPPPVNRDLKPQRKSRPPPLDLRNLSIIREHASLTRTRTVPCSRTSFLSPERNGINSARFFANPVSREDEESYIEMEEHRTASSLSSGALTWTKKFSLDYLALDFNSASPAPMQQKLLLSEEQRVDYVQVDEQKTQALQSTKQEWTDERQSKV

SEQ ID NO: 36304 - protein, 587 aa, Homo sapiens
  Payload ID: 7180
  Gene Symbol: GAB3
  Gene Name: GRB2-associated binding protein 3
  Uniprot ID: Q8WWW8
  ENSP ID: ENSP00000399588
MSAGDAVCTGWLVKSPPERKLQRYAWRKRWFVLRRGRMSGNPDVLEYYRNKHSSKPIRVIDLSECAVWKHVGPSFVRKEFQNNFVFIVKTTSRTFYLVAKTEQEMQVWVHSISQVCNLGHLEDGAADSMESLSYTPSSLQPSSASSLLTAHAASSSLPRDDPNTNAVATEETRSESELLFLPDYLVLSNCETGRLHHTSLPTRCDSWSNSDRSLEQASFDDVFVDCLQPLPSSHLVHPSCHGSGAQEVPSSRPQAALIWSREINGPPRDHLSSSPLLESSLSSTIQVDKNQGSLPCGAKELDIMSNTPPPRPPKPSHLSERRQEEWSTHSGSKKPECTLVPRRISLSGLDNMRTWKADVEGQSLRHRDKRLSLNLPCRFSPMYPTASASIEDSYVPMSPQAGASGLGPHCSPDDYIPMNSGSISSPLPELPANLEPPPVNRDLKPQRKSRPPPLDLRNLSIIREHASLTRTRTVPCSRTSFLSPERNGINSARFFANPVSREDEESYIEMEEHRTASSLSSGALTWTKKFSLDYLALDFNSASPAPMQQKLLLSEEQRVDYVQVDEQKTQALQSTKQEWTDERQSKV

SEQ ID NO: 36305 - protein, 150 aa, Homo sapiens
  Payload ID: 7180
  Gene Symbol: GAB3
  Gene Name: GRB2-associated binding protein 3
  ENSP ID: ENSP00000412258
  MOD_RES (1)..(1): Any amino acid
XSGALTWTKKFSLDYLALDFNSASPAPMQQARAFVFQVISSPGPRQEKQPPSEVCWPPGRGKREIAESQNTSFSLGLEHVTSFLLLLFCFLESRSHSVTQAGVQWHGHSSLQPRSPGLKLSSHLSLPSSWYYSCTSSPTAVFYFLIKNDL

SEQ ID NO: 36306 - protein, 574 aa, Homo sapiens
  Payload ID: 7181
  Gene Symbol: GAB4
  Gene Name: GRB2-associated binding protein family, member 4
  Uniprot ID: Q2WGN9
  ENSP ID: ENSP00000383431
MSLPSPSPSRELCPPDPAFAPLSSWPGSGPAGGSTRSGHVLYSGWLRKSPPEKKLRLFAWRKRWFILRRGQTSSDPDVLEYYKNDGSKKPLRTINLNLCEQLDVDVTLNFNKKEIQKGYMFDIKTSERTFYLVAETREDMNEWVQSICQICGFRQEESTGFLGNISSASHGLCSSPAEPSCSHQHLPQEQEPTSEPPVSHCVPPTWPIPAPPGCLRSHQHASQRAEHARSASFSQGSEAPFIMRRNTAMQNLAQHSGYSVDGVSGHIHGFHSLSKPSQHNAEFRGSTHRIPWSLASHGHTRGSLTGSEADNEASSGKYTQHGGGNASRPAESMHEGVCSFLPGRTLVGLSDSIASEGSCVPMNPGSPTLPAVKQAGDDSQGVCIPVGSCLVRFDLLGSPLTELSMHQDLSQGHEVQLPPVNRSLKPNQKANPTPPNLRNNRVINELSFKPPVTEPWSGTSHTFDSSSSQHPISTQSITNTDSEDSGERYLFPNPASAFPVSGGTSSSAPPRSTGNIHYAALDFQPSKPSIGSVTSGKKVDYVQVDLEKTQALQKTMHEQMCLRQSSEPPRGAKL

SEQ ID NO: 36307 - protein, 191 aa, Homo sapiens
  Payload ID: 7181
  Gene Symbol: GAB4
  Gene Name: GRB2-associated binding protein family, member 4
  ENSP ID: ENSP00000428584
  MOD_RES (1)..(1): Any amino acid
XVLYSGWLRKSPPEKKLRLFAWRKRWFILRRGQTSSDPDVLEYYKNDGSKKPLRTINLNLCEQLDVDVTLNFNKKEIQKGYMFDIKTSERTFYLVAETREDMNEWVQSICQICGFRQEESTAEPSCSHQHLPQEQEPTSEPPVSHCVPPTWPIPAPPGCLRSHQHASQRAEHASFLRQVHPAWWRECQPAC

SEQ ID NO: 36308 - protein, 157 aa, Homo sapiens
  Payload ID: 7182
  Gene Symbol: GAPT
  Gene Name: GRB2-binding adaptor protein, transmembrane
  Uniprot ID: Q8N292
  ENSP ID: ENSP00000323075
MSKSCGNNLAAISVGISLLLLLVVCGIGCVWHWKHRVATRFTLPRFLQRRSSRRKVCTKTFLGPRIIGLRHEISVETQDHKSAVRGNNTHDNYENVEAGPPKAKGKTDKELYENTGQSNFEEHIYGNETSSDYYNFQKPRPSEVPQDEDIYILPDSY

SEQ ID NO: 36309 - protein, 157 aa, Homo sapiens; identical to SEQ ID NO: 36308
  Payload ID: 7182
  Gene Symbol: GAPT
  Gene Name: GRB2-binding adaptor protein, transmembrane
  Uniprot ID: Q8N292
  ENSP ID: ENSP00000379997

SEQ ID NO: 36310 - protein, 69 aa, Homo sapiens
  Payload ID: 7182
  Gene Symbol: GAPT
  Gene Name: GRB2-binding adaptor protein, transmembrane
  ENSP ID: ENSP00000422645
MSKSCGNNLAAISVGISLLLLLVVCGIGCVWHWKHRVATRFTLPRFLQRRSSRRKVCTKTFLGPRIIGL

SEQ ID NO: 36311 - protein, 68 aa, Homo sapiens
  Payload ID: 7182
  Gene Symbol: GAPT
  Gene Name: GRB2-binding adaptor protein, transmembrane
  ENSP ID: ENSP00000423113
MSKSCGNNLAAISVGISLLLLLVVCGIGCVWHWKHRVATRFTLPRFLQRRSSRRKVCTKTFLGPRIIG

SEQ ID NO: 36312 - protein, 217 aa, Homo sapiens
  Payload ID: 7183
  Gene Symbol: GRAP
  Gene Name: GRB2-related adaptor protein
  Uniprot ID: Q13588
  ENSP ID: ENSP00000284154
MESVALYSFQATESDELAFNKGDTLKILNMEDDQNWYKAELRGVEGFIPKNYIRVKPHPWYSGRISRQLAEEILMKRNHLGAFLIRESESSPGEFSVSVNYGDQVQHFKVLREASGKYFLWEEKFNSLNELVDFYRTTTIAKKRQIFLRDEEPLLKSPGACFAQAQFDFSAQDPSQLSFRRGDIIEVLERPDPHWWRGRSCGRVGFFPRSYVQPVHL

SEQ ID NO: 36313 - protein, 188 aa, Homo sapiens
  Payload ID: 7183
  Gene Symbol: GRAP
  Gene Name: GRB2-related adaptor protein
  ENSP ID: ENSP00000378997
MEDDQNWYKAELRGVEGFIPKNYIRVKPHPWYSGRISRQLAEEILMKRNHLGAFLIRESESSPGEFSVSVNYGDQVQHFKVLREASGKYFLWEEKFNSLNELVDFYRTTTIAKKRQIFLRDEEPLLKSPGACFAQAQFDFSAQDPSQLSFRRGDIIEVLERPDPHWWRGRSCGRVGFFPRSYVQPVHL

SEQ ID NO: 36314 - protein, 205 aa, Homo sapiens
  Payload ID: 7183
  Gene Symbol: GRAP
  Gene Name: GRB2-related adaptor protein
  ENSP ID: ENSP00000459833
MESVALYSFQATESDELAFNKGDTLKILNMEDDQNWYKAELRGVEGFIPKNYIRVKPHPWYSGRISRQLAEEILMKRNHLGAFLIRESESSPGEFSVSVNHLGPALPRPSLTSQPRTPRSSASAVATSLRSWSAQTPTGGGAGPAGALASSHGVTCSPCTCEQPGGRSGQRAFLQELRSREDMDTPSSVRVTRGSVDGLGLNVGS

SEQ ID NO: 36315 - protein, 103 aa, Homo sapiens
  Payload ID: 7183
  Gene Symbol: GRAP
  Gene Name: GRB2-related adaptor protein
  ENSP ID: ENSP00000464328
MESVALYSFQATESDELAFNKGDTLKILNMEDDQNWYKAELRGVEGFIPKNYIRVKPHPWYSGRISRQLAEEILMKRNHLGAFLIRESESSPGEFSVSVKWAN

SEQ ID NO: 36316 - protein, 330 aa, Homo sapiens
  Payload ID: 7184
  Gene Symbol: GRAP2
  Gene Name: GRB2-related adaptor protein 2
  Uniprot ID: O75791
  ENSP ID: ENSP00000339186
MEAVAKFDFTASGEDELSFHTGDVLKILSNQEEWFKAELGSQEGYVPKNFIDIQFPKWFHEGLSRHQAENLLMGKEVGFFIIRASQSSPGDFSISVRHEDDVQHFKVMRDNKGNYFLWTEKFPSLNKLVDYYRTNSISRQKQIFLRDRTREDQGHRGNSLDRRSQGGPHLSGAVGEEIRPSMNRKLSDHPPTLPLQQHQHQPQPPQYAPAPQQLQQPPQQRYLQHHHFHQERRGGSLDINDGHCGTGLGSEMNAALMHRRHTDPVQLQAAGRVRWARALYDFEALEDDELGFHSGEVVEVLDSSNPSWWTGRLHNKLGLFPANYVAPMTR

SEQ ID NO: 36317 - protein, 330 aa, Homo sapiens; identical to SEQ ID NO: 36316
  Payload ID: 7184
  Gene Symbol: GRAP2
  Gene Name: GRB2-related adaptor protein 2
  Uniprot ID: O75791
  ENSP ID: ENSP00000385607

SEQ ID NO: 36318 - protein, 97 aa, Homo sapiens
  Payload ID: 7184
  Gene Symbol: GRAP2
  Gene Name: GRB2-related adaptor protein 2
  ENSP ID: ENSP00000396355
MEAVAKFDFTASGEDELSFHTGDVLKILSNQEEWFKAELGSQEGYVPKNFIDIQFPKWFHEGLSRHQAENLLMGKEVGFFIIRASQSSPGDFSISVR

SEQ ID NO: 36319 - protein, 118 aa, Homo sapiens
  Payload ID: 7185
  Gene Symbol: GRAPL
  Gene Name: GRB2-related adaptor protein-like
  Uniprot ID: Q8TC17
  ENSP ID: ENSP00000437409
MESVALYSFQATESDELAFNKGDTLKILNMEDDQNWYKAELRGVEGFIPKNYIRVKPHPWYSGRISRQLAEEILMKRNHLGAFLIRESESSPGEFSVSVNNRAQRGPCLGPKSHSRLG

SEQ ID NO: 36320 - protein, 65 aa, Homo sapiens
  Payload ID: 7185
  Gene Symbol: GRAPL
  Gene Name: GRB2-related adaptor protein-like
  ENSP ID: ENSP00000459618
  MOD_RES (1)..(1): Any amino acid
XIRVKPHPWYSGRISRQLAEEILMKRNHLGAFLIRESESSPGEFSVSVKAQRGPCLGPKSHSRLG

SEQ ID NO: 36321 - protein, 17 aa, Homo sapiens
  Payload ID: 7185
  Gene Symbol: GRAPL
  Gene Name: GRB2-related adaptor protein-like
  ENSP ID: ENSP00000464934
  MOD_RES (1)..(1): Any amino acid
XSESSPGEFSVSVKWAN

SEQ ID NO: 36322 - protein, 70 aa, Homo sapiens
  Payload ID: 7185
  Gene Symbol: GRAPL
  Gene Name: GRB2-related adaptor protein-like
  ENSP ID: ENSP00000465788
MEDDQNWYKAELRGVEGFIPKNYIRVKPHPWYSGRISRQLAEEILMKRNHLGAFLIRESESSPGEFSVSV

SEQ ID NO: 36323 - protein, 100 aa, Homo sapiens
  Payload ID: 7185
  Gene Symbol: GRAPL
  Gene Name: GRB2-related adaptor protein-like
  ENSP ID: ENSP00000466091
MESVALYSFQATESDELAFNKGDTLKILNMEDDQNWYKAELRGVEGFIPKNYIRVKPHPWYSGRISRQLAEEILMKRNHLGAFLIRESESSPGEFSVSVK

SEQ ID NO: 36324 - protein, 184 aa, Homo sapiens
  Payload ID: 7186
  Gene Symbol: GREM1
  Gene Name: gremlin 1, DAN family BMP antagonist
  Uniprot ID: O60565
  ENSP ID: ENSP00000300177
MSRTAYTVGALLLLLGTLLPAAEGKKKGSQGAIPPPDKAQHNDSEQTQSPQQPGSRNRGRGQGRGTAMPGEEVLESSQEALHVTERKYLKRDWCKTQPLKQTIHEEGCNSRTIINRFCYGQCNSFYIPRHIRKEEGSFQSCSFCKPKKFTTMMVTLNCPELQPPTKKKRVTRVKQCRCISIDLD

SEQ ID NO: 36325 - protein, 143 aa, Homo sapiens
  Payload ID: 7186
  Gene Symbol: GREM1
  Gene Name: gremlin 1, DAN family BMP antagonist
  Uniprot ID: O60565
  ENSP ID: ENSP00000323101
MSRTAYTVGALLLLLGTLLPAAEGKKKGSQGAIPPPDKALHVTERKYLKRDWCKTQPLKQTIHEEGCNSRTIINRFCYGQCNSFYIPRHIRKEEGSFQSCSFCKPKKFTTMMVTLNCPELQPPTKKKRVTRVKQCRCISIDLD

SEQ ID NO: 36326 - protein, 143 aa, Homo sapiens; identical to SEQ ID NO: 36325
  Payload ID: 7186
  Gene Symbol: GREM1
  Gene Name: gremlin 1, DAN family BMP antagonist
  Uniprot ID: O60565
  ENSP ID: ENSP00000453141

SEQ ID NO: 36327 - protein, 42 aa, Homo sapiens
  Payload ID: 7186
  Gene Symbol: GREM1
  Gene Name: gremlin 1, DAN family BMP antagonist
  ENSP ID: ENSP00000453387
MSRTAYTVGALLLLLGTLLPAAEGKKKGSQGAIPPPAKRPCM

SEQ ID NO: 36328 - protein, 184 aa, Homo sapiens; identical to SEQ ID NO: 36324
  Payload ID: 7186
  Gene Symbol: GREM1
  Gene Name: gremlin 1, DAN family BMP antagonist
  Uniprot ID: O60565
  ENSP ID: ENSP00000478319

SEQ ID NO: 36329 - protein, 143 aa, Homo sapiens; identical to SEQ ID NO: 36325
  Payload ID: 7186
  Gene Symbol: GREM1
  Gene Name: Gremlin 1, DAN family BMP antagonist
  ENSP ID: ENSP00000488158

SEQ ID NO: 36330 - protein, 42 aa, Homo sapiens; identical to SEQ ID NO: 36327
  Payload ID: 7186
  Gene Symbol: GREM1
  Gene Name: Gremlin 1, DAN family BMP antagonist
  ENSP ID: ENSP00000488217

SEQ ID NO: 36331 - protein, 184 aa, Homo sapiens; identical to SEQ ID NO: 36324
  Payload ID: 7186
  Gene Symbol: GREM1
  Gene Name: Gremlin 1, DAN family BMP antagonist
  ENSP ID: ENSP00000488588

SEQ ID NO: 36332 - protein, 168 aa, Homo sapiens
  Payload ID: 7187
  Gene Symbol: GREM2
  Gene Name: gremlin 2, DAN family BMP antagonist
  Uniprot ID: Q9H772
  ENSP ID: ENSP00000318650
MFWKLSLSLFLVAVLVKVAEARKNRPAGAIPSPYKDGSSNNSERWQHQIKEVLASSQEALVVTERKYLKSDWCKTQPLRQTVSEEGCRSRTILNRFCYGQCNSFYIPRHVKKEEESFQSCAFCKPQRVTSVLVELECPGLDPPFRLKKIQKVKQCRCMSVNLSDSDKQ

SEQ ID NO: 36333 - protein, 480 aa, Homo sapiens
  Payload ID: 7188
  Gene Symbol: GRSF1
  Gene Name: G-rich RNA sequence binding factor 1
  Uniprot ID: Q12849
  ENSP ID: ENSP00000254799
MAGTRWVLGALLRGCGCNCSSCRRTGAACLPFYSAAGSIPSGVSGRRRLLLLLGAAAAAASQTRGLQTGPVPPGRLAGPPAVATSAAAAAAASYSALRASLLPQSLAAAAAVPTRSYSQESKTTYLEDLPPPPEYELAPSKLEEEVDDVFLIRAQGLPWSCTMEDVLNFFSDCRIRNGENGIHFLLNRDGKRRGDALIEMESEQDVQKALEKHRMYMGQRYVEVYEINNEDVDALMKSLQVKSSPVVNDGVVRLRGLPYSCNEKDIVDFFAGLNIVDITFVMDYRGRRKTGEAYVQFEEPEMANQALLKHREEIGNRYIEIFPSRRNEVRTHVGSYKGKKIASFPTAKYITEPEMVFEEHEVNEDIQPMTAFESEKEIELPKEVPEKLPEAADFGTTSSLHFVHMRGLPFQANAQDIINFFAPLKPVRITMEYSSSGKATGEADVHFETHEDAVAAMLKDRSHVHHRYIELFLNSCPKGK

SEQ ID NO: 36334 - protein, 417 aa, Homo sapiens
  Payload ID: 7188
  Gene Symbol: GRSF1
  Gene Name: G-rich RNA sequence binding factor 1
  ENSP ID: ENSP00000421789
  MOD_RES (1)..(1): Any amino acid
XPPPSTLCSYWALEQGKLSQASGLLLVLFSPRVSGRLGSVSVAGVNVEALFPAWPMESKTTYLEDLPPPPEYELAPSKLEEEVDDVFLIRAQGLPWSCTMEDVLNFFSDCRIRNGENGIHFLLNRDGKRRGDALIEMESEQDVQKALEKHRMYMGQRYVEVYEINNEDVDALMKSLQVKSSPVVNDGVVRLRGLPYSCNEKDIVDFFAGLNIVDITFVMDYRGRRKTGEAYVQFEEPEMANQALLKHREEIGNRYIEIFPSRRNEVRTHVGSYKGKKIASFPTAKYITEPEMVFEEHEVNEDIQPMTAFESEKEIELPKEVPEKLPEAADFGTTSSLHFVHMRGLPFQANAQDIINFFAPLKPVRITMEYSSSGKATGEADVHFETHEDAVAAMLKDRSHVHHRYIELFLNSCPKGK

SEQ ID NO: 36335 - protein, 318 aa, Homo sapiens
  Payload ID: 7188
  Gene Symbol: GRSF1
  Gene Name: G-rich RNA sequence binding factor 1
  Uniprot ID: Q12849
  ENSP ID: ENSP00000425430
MEDVLNFFSDCRIRNGENGIHFLLNRDGKRRGDALIEMESEQDVQKALEKHRMYMGQRYVEVYEINNEDVDALMKSLQVKSSPVVNDGVVRLRGLPYSCNEKDIVDFFAGLNIVDITFVMDYRGRRKTGEAYVQFEEPEMANQALLKHREEIGNRYIEIFPSRRNEVRTHVGSYKGKKIASFPTAKYITEPEMVFEEHEVNEDIQPMTAFESEKEIELPKEVPEKLPEAADFGTTSSLHFVHMRGLPFQANAQDIINFFAPLKPVRITMEYSSSGKATGEADVHFETHEDAVAAMLKDRSHVHHRYIELFLNSCPKGK

SEQ ID NO: 36336 - protein, 453 aa, Homo sapiens
  Payload ID: 7188
  Gene Symbol: GRSF1
  Gene Name: G-rich RNA sequence binding factor 1
  ENSP ID: ENSP00000427354
AAAVPTRSYSQVRGRREGPGARSLPGRVHAPPRPSVPPCAPRGHARGSATLAAHPPPSTLCSYWALEQGKLSQASGLLLVLFSPRVSGRLGSESKTTYLEDLPPPPEYELAPSKLEEEVDDVFLIRAQGLPWSCTMEDVLNFFSDCRIRNGENGIHFLLNRDGKRRGDALIEMESEQDVQKALEKHRMYMGQRYVEVYEINNEDVDALMKSLQVKSSPVVNDGVVRLRGLPYSCNEKDIVDFFAGLNIVDITFVMDYRGRRKTGEAYVQFEEPEMANQALLKHREEIGNRYIEIFPSRRNEVRTHVGSYKGKKIASFPTAKYITEPEMVFEEHEVNEDIQPMTAFESEKEIELPKEVPEKLPEAADFGTTSSLHFVHMRGLPFQANAQDIINFFAPLKPVRITMEYSSSGKATGEADVHFETHEDAVAAMLKDRSHVHHRYIELFLNSCPKGK

SEQ ID NO: 36337 - protein, 114 aa, Homo sapiens
  Payload ID: 7188
  Gene Symbol: GRSF1
  Gene Name: G-rich RNA sequence binding factor 1
  ENSP ID: ENSP00000427644
KRRGDALIEMESEQDVQKALEKHRMYMGQRYVEVYEINNEDVDALMKSLQVKSSPVVNDGVVRLRGLPYSCNEKDIVDFFADTSRYFQAEGMKFEHMSVLIRERKSHLFLLLSI

SEQ ID NO: 36338 - protein, 424 aa, Homo sapiens
  Payload ID: 7188
  Gene Symbol: GRSF1
  Gene Name: G-rich RNA sequence binding factor 1
  ENSP ID: ENSP00000443380
MAGTRWVLGALLRGCGCNCSSCRRTGAACLPFYSAASYSALRASLLPQSLAAAAAVPTRSYSQESKTTYLEDLPPPPEYELAPSKLEEEVDDVFLIRAQGLPWSCTMEDVLNFFSDCRIRNGENGIHFLLNRDGKRRGDALIEMESEQDVQKALEKHRMYMGQRYVEVYEINNEDVDALMKSLQVKSSPVVNDGVVRLRGLPYSCNEKDIVDFFAGLNIVDITFVMDYRGRRKTGEAYVQFEEPEMANQALLKHREEIGNRYIEIFPSRRNEVRTHVGSYKGKKIASFPTAKYITEPEMVFEEHEVNEDIQPMTAFESEKEIELPKEVPEKLPEAADFGTTSSLHFVHMRGLPFQANAQDIINFFAPLKPVRITMEYSSSGKATGEADVHFETHEDAVAAMLKDRSHVHHRYIELFLNSCPKGK

SEQ ID NO: 36339 - protein, 445 aa, Homo sapiens
  Payload ID: 7189
  Gene Symbol: GCOM1
  Gene Name: GRINL1A complex locus 1
  ENSP ID: ENSP00000369942
MLRSTSTVTLLSGGAARTPGAPSRRANVCRLRLTVPPESPVPEQCEKKIERKEQLLDLSNGEPTRKLPQGVVYGVVRRSDQNQQKEMVVYGWSTSQLKEEMNYIKDVRATLEKVRKRMYGDYDEMRQKIRQLTQELSVSHAQQEYLENHIQTQSSALDRFNAMNSALASDSIGLQKTLVDVTLENSNIKDQIRNLQQTYEASMDKLREKQRQLEVAQVENQLLKMKVESSQEANAEVMREMTKKLYSQYEEKLQEEQRKHSAEKEALLEETNSFLKAIEEANKKMQAAEISLEEKDQRIGELDRLIERMEKERHQLQLQLLEHETEMSGELTDSDKERYQQLEEASASLRERIRHLDDMVHCQQKKVKQMVEEIESLKKKLQQKQLLILQLLEKISFLEGENNELQSRLDYLTETQAKTEVETREIGVGCDLLPRRCKQSSQRKN

SEQ ID NO: 36340 - protein, 550 aa, Homo sapiens
  Payload ID: 7189
  Gene Symbol: GCOM1
  Gene Name: GRINL1A complex locus 1
  ENSP ID: ENSP00000369943
MLRSTSTVTLLSGGAARTPGAPSRRANVCRLRLTVPPESPVPEQCEKKIERKEQLLDLSNGEPTRKLPQGVVYGVVRRSDQNQQKEMVVYGWSTSQLKEEMNYIKDVRATLEKVRKRMYGDYDEMRQKIRQLTQELSVSHAQQEYLENHIQTQSSALDRFNAMNSALASDSIGLQKTLVDVTLENSNIKDQIRNLQQTYEASMDKLREKQRQLEVAQVENQLLKMKVESSQEANAEVMREMTKKLYSQYEEKLQEEQRKHSAEKEALLEETNSFLKAIEEANKKMQAAEISLEEKDQRIGELDRLIERMEKERHQLQLQLLEHETEMSGELTDSDKERYQQLEEASASLRERIRHLDDMVHCQQKKVKQMVEEIESLKKKLQQKQLLILQLLEKISFLEGENNELQSRLDYLTETQAKTEVETREIGVGCDLLPRLPFRQNDSSSHCQKSGSPISSEERRRRDKQHLDDITAARLLPLHHMPTQLLSIEESLALQKQQKQNYEEMQAKLAAQKLAERLNIKMRSYNPEGESSGRYREVRDEDDDWSSDEF

SEQ ID NO: 36341 - protein, 466 aa, Homo sapiens
  Payload ID: 7189
  Gene Symbol: GCOM1
  Gene Name: GRINL1A complex locus 1
  ENSP ID: ENSP00000432066
MLRSTSTVTLLSGGAARTPGAPSRRANVCRLRLTVPPESPVPEQCEKKIERKEQLLDLSNGEPTRKLPQGVVYGVVRRSDQNQQKEMVVYGWSTSQLKEEMNYIKDVRATLEKVRKRMYGDYDEMRQKIRQLTQELSVSHAQQEYLENHIQTQSSALDRFNAMNSALASDSIGLQKTLVDVTLENSNIKDQIRNLQQTYEASMDKLREKQRQLEVAQVENQLLKMKVESSQEANAEVMREMTKKLYSQYEEKLQEEQRKHSAEKEALLEETNSFLKAIEEANKKMQAAEISLEEKDQRIGELDRLIERMEKERHQLQLQLLEHETEMSGELTDSDKERYQQLEEASASLRERIRHLDDMVHCQQKKVKQMVEEIESLKKKLQQKQLLILQLLEKISFLEGENNELQSRLDYLTETQAKTEVETREIGVGCDLLPSQTGRTREIVMPSRNYTPYTRVLELTMKKTLT

SEQ ID NO: 36342 - protein, 397 aa, Homo sapiens
  Payload ID: 7189
  Gene Symbol: GCOM1
  Gene Name: GRINL1A complex locus 1
  ENSP ID: ENSP00000432563
MLRSTSTVTLLSGGAARTPGAPSRRANVCRLRLTVPPESPVPEQCEKKIERKEQLLDLSNGEPTRKLPQGVVYGVVRRSDQNQQKEMVVYGWSTSQLKEEMNYIKDKTLVDVTLENSNIKDQIRNLQQTYEASMDKLREKQRQLEVAQVENQLLKMKVESSQEANAEVMREMTKKLYSQYEEKLQEEQRKHSAEKEALLEETNSFLKAIEEANKKMQAAEISLEEKDQRIGELDRLIERMEKERHQLQLQLLEHETEMSGELTDSDKERYQQLEEASASLRERIRHLDDMVHCQQKKVKQMVEEIESLKKKLQQKQLLILQLLEKISFLEGENNELQSRLDYLTETQAKTEVETREIGVGCDLLPSQTGRTREIVMPSRNYTPYTRVLELTMKKTLT

SEQ ID NO: 36343 - protein, 435 aa, Homo sapiens
  Payload ID: 7189
  Gene Symbol: GCOM1
  Gene Name: GRINL1A complex locus 1
  ENSP ID: ENSP00000433702
MLRSTSTVTLLSGGAARTPGAPSRRANVCRLRLTVPPESPVPEQCEKKIERKEQLLDLSNGEPTRKLPQGVVYGVVRRSDQNQQKEMVVYGWSTSQLKEEMNYIKDVSHAQQEYLENHIQTQSSALDRFNAMNSALASDSIGLQKTLVDVTLENSNIKDQIRNLQQTYEASMDKLREKQRQLEVAQVENQLLKMKVESSQEANAEVMREMTKKLYSQYEEKLQEEQRKHSAEKEALLEETNSFLKAIEEANKKMQAAEISLEEKDQRIGELDRLIERMEKERHQLQLQLLEHETEMSGELTDSDKERYQQLEEASASLRERIRHLDDMVHCQQKKVKQMVEEIESLKKKLQQKQLLILQLLEKISFLEGENNELQSRLDYLTETQAKTEVETREIGVGCDLLPSQTGRTREIVMPSRNYTPYTRVLELTMKKTLT

SEQ ID NO: 36344 - protein, 379 aa, Homo sapiens
  Payload ID: 7189
  Gene Symbol: GCOM1
  Gene Name: GRINL1A complex locus 1
  ENSP ID: ENSP00000434505
MLRSTSTVTLLSGGAARTPGAPSRRANVCRLRLTVPPESPVPEQCEKKIERKEQLLDLSNGEPTRKLPQGVVYGVVRRSDQNQQKEMVVYGWSTSQLKEEMNYIKDVRATLEKVRKRMYGDYDEMRQKIRQLTQELSVSHAQQEYLENHIQTQSSALDRFNAMNSALASDSIGLQKTLVDVTLENSNIKDQIRNLQQTYEASMDKLREKQRQLEVAQVENQLLKMKVESSQEANAEVMREMTKKLYSQYEEKLQEEQRKHSAEKEALLEETNSFLKAIEEANKKMQAAEISLEEKDQRIGELDRLIERMEKERHQLQLQLLEHETEMSGELTDSDKERYQQLEEASASLRERIRHLDDMVHCQQKKVKQMVEEVTFSTK

SEQ ID NO: 36345 - protein, 415 aa, Homo sapiens
  Payload ID: 7189
  Gene Symbol: GCOM1
  Gene Name: GRINL1A complex locus 1
  ENSP ID: ENSP00000434588
MLRSTSTVTLLSGGAARTPGAPSRRANVCRLRLTVPPESPVPEQCEKKIERKEQLLDLSNGEPTRKLPQGVVYGVVRRSDQNQQKEMVVYGWSTSQLKEEMNYIKDVSHAQQEYLENHIQTQSSALDRFNAMNSALASDSIGLQKTLVDVTLENSNIKDQIRNLQQTYEASMDKLREKQRQLEVAQVENQLLKMKVESSQEANAEVMREMTKKLYSQYEEKLQEEQRKHSAEKEALLEETNSFLKAIEEANKKMQAAEISLEEKDQRIGELDRLIERMEKERHQLQLQLLEHETEMSGELTDSDKERYQQLEEASASLRERIRHLDDMVHCQQKKVKQMVEENNELQSRLDYLTETQAKTEVETREIGVGCDLLPRQSRKFEKVLNEFVQLLPLPHHLLWAFGNVCWRRHFGLLQ

SEQ ID NO: 36346 - protein, 414 aa, Homo sapiens
  Payload ID: 7189
  Gene Symbol: GCOM1
  Gene Name: GRINL1A complex locus 1
  ENSP ID: ENSP00000435028
MLRSTSTVTLLSGGAARTPGAPSRRANVCRLRLTVPPESPVPEQCEKKIERKEQLLDLSNGEPTRKLPQGVVYGVVRRSDQNQQKEMVVYGWSTSQLKEEMNYIKDVRATLEKVRKRMYGDYDEMRQKIRQLTQELSVSHAQQEYLENHIQTQSSALDRFNAMNSALASDSIGLQKTLVDVTLENSNIKDQIRNLQQTYEASMDKLREKQRQLEVAQVENQLLKMKVESSQEANAEVMREMTKKLYSQYEEKLQEEQRKHSAEKEALLEETNSFLKAIEEANKKMQAAEISLEEKDQRIGELDRLIERMEKERHQLQLQLLEHETEMSGELTDSDKERYQQLEEASASLRERIRHLDDMVHCQQKKVKQMVEEIESLKKKLQQKQLLILQLLEKISFLEGEGRKGLKGRLKMSC

SEQ ID NO: 36347 - protein, 438 aa, Homo sapiens
  Payload ID: 7189
  Gene Symbol: GCOM1
  Gene Name: GRINL1A complex locus 1
  ENSP ID: ENSP00000435774
MLRSTSTVTLLSGGAARTPGAPSRRANVCRLRLTVPPESPVPEQCEKKIERKEQLLDLSNGEPTRKLPQGVVYGVVRRSDQNQQKEMVVYGWSTSQLKEEMNYIKDVRATLEKVRKRMYGDYDEMRQKIRQLTQELSVSHAQQEYLENHIQTQSSALDRFNAMNSALASDSIGLQKTLVDVTLENSNIKDQIRNLQQTYEASMDKLREKQRQLEVAQVENQLLKMKVESSQEANAEVMREMTKKLYSQYEEKLQEEQRKHSAEKEALLEETNSFLKAIEEANKKMQAAEISLEEKDQRIGELDRLIERMEKERHQLQLQLLEHETEMSGELTDSDKERYQQLEEASASLRERIRHLDDMVHCQQKKVKQMVEENNELQSRLDYLTETQAKTEVETREIGVGCDLLPSQTGRTREIVMPSRNYTPYTRVLELTMKKTLT

SEQ ID NO: 36348 - protein, 390 aa, Homo sapiens
  Payload ID: 7189
  Gene Symbol: GCOM1
  Gene Name: GRINL1A complex locus 1
  ENSP ID: ENSP00000436614
MLRSTSTVTLLSGGAARTPGAPSRRANVCRLRLTVPPESPVPEQCEKKIERKEQLLDLSNGEPTRKLPQGVVYGVVRRSDQNQQKEMVVYGWSTSQLKEEMNYIKDVRATLEKVRKRMYGDYDEMRQKIRQLTQELSVSHAQQEYLENHIQTQSSALDRFNAMNSALASDSIGLQKTLVDVTLENSNIKDQIRNLQQTYEASMDKLREKQRQLEVAQVENQLLKMKVESSQEANAEVMREMTKKLYSQYEEKLQEEQRKHSAEKEALLEETNSFLKAIEEANKKMQAAEISLEEKDQRIGELDRLIERMEKERHQLQLQLLEHETEMSGELTDSDKERYQQLEEASASLRERIRHLDDMVHCQQKKVKQMVEEIMSHELFSRFSLRLFGR

SEQ ID NO: 36349 - protein, 407 aa, Homo sapiens
  Payload ID: 7189
  Gene Symbol: GCOM1
  Gene Name: GRINL1A complex locus 1
  ENSP ID: ENSP00000436922
MLRSTSTVTLLSGGAARTPGAPSRRANVCRLRLTVPPESPVPEQCEKKIERKEQLLDLSNGEPTRKLPQGVVYGVVRRSDQNQQKEMVVYGWSTSQLKEEMNYIKDVRATLEKVRKRMYGDYDEMRQKIRQLTQELSVSHAQQEYLENHIQTQSSALDRFNAMNSALASDSIGLQKTLVDVTLENSNIKDQIRNLQQTYEASMDKLREKQRQLEVAQVENQLLKMKVESSQEANAEVMREMTKKLYSQYEEKLQEEQRKHSAEKEALLEETNSFLKAIEEANKKMQAAEISLEEKDQRIGELDRLIERMEKERHQLQLQLLEHETEMSGELTDSDKERYQQLEEASASLRERIRHLDDMVHCQQKKVKQMVEEIESLKKKLQQKQLLILQLLEKISFLEGEVTFSTK

SEQ ID NO: 36350 - protein, 765 aa, Homo sapiens
  Payload ID: 7189
  Gene Symbol: GCOM1
  Gene Name: GRINL1A complex locus 1
  ENSP ID: ENSP00000465231
MLRSTSTVTLLSGGAARTPGAPSRRANVCRLRLTVPPESPVPEQCEKKIERKEQLLDLSNGEPTRKLPQGVVYGVVRRSDQNQQKEMVVYGWSTSQLKEEMNYIKDVRATLEKVRKRMYGDYDEMRQKIRQLTQELSVSHAQQEYLENHIQTQSSALDRFNAMNSALASDSIGLQKTLVDVTLENSNIKDQIRNLQQTYEASMDKLREKQRQLEVAQVENQLLKMKVESSQEANAEVMREMTKKLYSQYEEKLQEEQRKHSAEKEALLEETNSFLKAIEEANKKMQAAEISLEEKDQRIGELDRLIERMEKERHQLQLQLLEHETEMSGELTDSDKERYQQLEEASASLRERIRHLDDMVHCQQKKVKQMVEEIESLKKKLQQKQLLILQLLEKISFLEGENNELQSRLDYLTETQAKTEVETREIGVGCDLLPRKFICKLPDKGKKIFDSFAKLKAAIAECEEVRRKSELFNPVSLDCKLRQKAIAEVDVGTDKAQNSDPILDTSSLVPGCSSVDNIKSSQTSQNQGLGRPTLEGDEETSEVEYTVNKGPASSNRDRVPPSSEASEHHPRHRVSSQAEDTSSSFDNLFIDRLQRITIADQGEQQSEENASTKNLTGLSSGTEKKPHYMEVLEMRAKNPVPQLRKFKTNVLPFRQNDSSSHCQKSGSPISSEERRRRDKQHLDDITAARLLPLHHMPTQLLSIEESLALQKQQKQNYEEMQAKLAAQKLAERLNIKMRSYNPEGESSGRYREVRDEDDDWSSDEF

SEQ ID NO: 36351 - protein, 775 aa, Homo sapiens
  Payload ID: 7190
  Gene Symbol: GCC1
  Gene Name: GRIP and coiled-coil domain containing 1
  Uniprot ID: Q96CN9
  ENSP ID: ENSP00000318821
MEKFGMNFGGGPSKKDLLETIETQKKQLLQYQARLKDVVRAYKSLLKEKEALEASIKVLSVSHEADVGLAGVQLPGLTFPDSVDDRCSTHSEDSTGTATSLDTAASLTSTKGEFGVEDDRPARGPPPPKSEEASWSESGVSSSSGDGPFAGGEVDKRLHQLKTQLATLTSSLATVTQEKSRMEASYLADKKKMKQDLEDASNKAEEERARLEGELKGLQEQIAETKARLITQQHDRAQEQSDHALMLRELQKLLQEERTQRQDLELRLEETREALAGRAYAAEQMEGFELQTKQLTREVEELKSELQAIRDEKNQPDPRLQELQEEAARLKSHFQAQLQQEMRKTALAEDQLRQQSQVEEQRVAALENQISEVSELLGTYEKAKQKDQLAIQKLKERILQLDLENKTLALAASSRSPLDSHGEESSLDVNVLKDKMEKLKRLLQVAARKSQVTLDVEKLCDLEIMPSSEAADGEKATALYYQQELKQLKEEFERYKMRAQVVLKSKNTKDGNLGKELEAAQEQLAELKEKYISLRLSCEELEHQHQQEADDWKQELARLQQLHRQELERCQLDFRDRTLKLEEELHKQRDRALAVLTEKDLELEQLRSVALASGLPGRRSPVGGGGPGDPADTSSSDSLTQALQLAAANEPTFFLYAEQLARKEVEITSLRKQKHRLEVEVHQLQDRLLEEGERHREEVAALQSHIEKNIRDQSREGANLEYLKNIIYRFLTLPDSLGRQQTLTAILTILHFSPEEKQVIMRLPTSASWWPSGKR

SEQ ID NO: 36352 - protein, 1684 aa, Homo sapiens
  Payload ID: 7191
  Gene Symbol: GCC2
  Gene Name: GRIP and coiled-coil domain containing 2
  Uniprot ID: Q8IWJ2
  ENSP ID: ENSP00000307939
MEDLVQDGVASPATPGTGKSKLETLPKEDLIKFAKKQMMLIQKAKSRCTELEKEIEELRSKPVTEGTGDIIKALTERLDALLLEKAETEQQCLSLKKENIKMKQEVEDSVTKMGDAHKELEQSHINYVKEIENLKNELMAVRSKYSEDKANLQKQLEEAMNTQLELSEQLKFQNNSEDNVKKLQEEIEKIRPGFEEQILYLQKQLDATTDEKKETVTQLQNIIEANSQHYQKNINSLQEELLQLKAIHQEEVKELMCQIEASAKEHEAEINKLNELKENLVKQCEASEKNIQKKYECELENLRKATSNANQDNQICSILLQENTFVEQVVNEKVKHLEDTLKELESQHSILKDEVTYMNNLKLKLEMDAQHIKDEFFHEREDLEFKINELLLAKEEQGCVIEKLKSELAGLNKQFCYTVEQHNREVQSLKEQHQKEISELNETFLSDSEKEKLTLMFEIQGLKEQCENLQQEKQEAILNYESLREIMEILQTELGESAGKISQEFESMKQQQASDVHELQQKLRTAFTEKDALLETVNRLQGENEKLLSQQELVPELENTIKNLQEKNGVYLLSLSQRDTMLKELEGKINSLTEEKDDFINKLKNSHEEMDNFHKKCEREERLILELGKKVEQTIQYNSELEQKVNELTGGLEETLKEKDQNDQKLEKLMVQMKVLSEDKEVLSAEVKSLYEENNKLSSEKKQLSRDLEVFLSQKEDVILKEHITQLEKKLQLMVEEQDNLNKLLENEQVQKLFVKTQLYGFLKEMGSEVSEDSEEKDVVNVLQAVGESLAKINEEKCNLAFQRDEKVLELEKEIKCLQEESVVQCEELKSLLRDYEQEKVLLRKELEEIQSEKEALQSDLLEMKNANEKTRLENQNLLIQVEEVSQTCSKSEIHNEKEKCFIKEHENLKPLLEQKELRDRRAELILLKDSLAKSPSVKNDPLSSVKELEEKIENLEKECKEKEEKINKIKLVAVKAKKELDSSRKETQTVKEELESLRSEKDQLSASMRDLIQGAESYKNLLLEYEKQSEQLDVEKERANNFEHRIEDLTRQLRNSTLQCETINSDNEDLLARIETLQSNAKLLEVQILEVQRAKAMVDKELEAEKLQKEQKIKEHATTVNELEELQVQLQKQKKQLQKTMQELELVKKDAQQTTLMNMEIADYERLMKELNQKLTNKNNKIEDLEQEIKIQKQKQETLQEEITSLQSSVQQYEEKNTKIKQLLVKTKKELADSKQAETDHLILQASLKGELEASQQQVEVYKIQLAEITSEKHKIHEHLKTSAEQHQRTLSAYQQRVTALQEECRAAKAEQATVTSEFESYKVRVHNVLKQQKNKSMSQAETEGAKQEREHLEMLIDQLKIKLQDSQNNLQINVSELQTLQSEHDTLLERHNKMLQETVSKEAELREKLCSIQSENMMMKSEHTQTVSQLTSQNEVLRNSFRDQVRHLQEEHRKTVETLQQQLSKMEAQLFQLKNEPTTRSPVSSQQSLKNLRERRNTDLPLLDMHTVTREEGEGMETTDTESVSSASTYTQSLEQLLNSPETKLEPPLWHAEFTKEELVQKLSSTTKSADHLNGLLRETEATNAILMEQIKLLKSEIRRLERNQEREKSAANLEYLKNVLLQFIFLKPGSERERLLPVINTMLQLSPEEKGKLAAVAQGEEENASRSSGWASYLHSWSGLR

SEQ ID NO: 36353 - protein, 247 aa, Homo sapiens
  Payload ID: 7191
  Gene Symbol: GCC2
  Gene Name: GRIP and coiled-coil domain containing 2
  ENSP ID: ENSP00000376996
NLLLEYEKQSEQLDVEKERANNFEHRIEDLTRQLRNSTLQCETINSDNEDLLARIETLQSNAKLLEVQILEVQRAKAMVDKELEAEKLQKEQKIKEHATTVNELEELQVQLQKQKKQLQKTMQELELVKKDAQQTTLMNMEIADYERLMKELNQKLTNKNNKIEDLEQEIKIQKQKQETLQEEITSLQSSVQQYEEKNTKIKQLLVKTKKELADSKQAETDHLILQASLKGELEASQQQVEVYKFVF

SEQ ID NO: 36354 - protein, 916 aa, Homo sapiens
  Payload ID: 7191
  Gene Symbol: GCC2
  Gene Name: GRIP and coiled-coil domain containing 2
  ENSP ID: ENSP00000386997
MMLIQKAKSRCTELEKEIEELRSKPVTEGTGDIIKALTERLDALLLEKAETEQQCLSLKKENIKMKQEVEDSVTKMGDAHKELEQSHINYVKEIENLKNELMAVRSKYSEDKANLQKQLEEAMNTQLELSEQLKFQNNSEDNVKKLQEEIEKIRPGFEEQILYLQKQLDATTDEKKETVTQLQNIIEANSQHYQKNINSLQEELLQLKAIHQEEVKELMCQIEASAKEHEAEINKLNELKENLVKQCEASEKNIQKKYECELENLRKATSNANQDNQICSILLQENTFVEQVVNEKVKHLEDTLKELESQHSILKDEVTYMNNLKLKLEMDAQHIKDEFFHEREDLEFKINELLLAKEEQGCVIEKLKSELAGLNKQFCYTVEQHNREVQSLKEQHQKEISELNETFLSDSEKEKLTLMFEIQGLKEQCENLQQEKQEAILNYESLREIMEILQTELGESAGKISQEFESMKQQQASDVHELQQKLRTAFTEKDALLETVNRLQGENEKLLSQQELVPELENTIKNLQEKNGVYLLSLSQRDTMLKELEGKINSLTEEKDDFINKLKNSHEEMDNFHKKCEREERLILELGKKVEQTIQYNSELEQKVNELTGGLEETLKEKDQNDQKLEKLMVQMKVLSEDKEVLSAEVKSLYEENNKLSSEKKQLSRDLEVFLSQKEDVILKEHITQLEKKLQLMVEEQDNLNKLLENEQVQKLFVKTQLYGFLKEMGSEVSEDSEEKDVVNVLQAVGESLAKINEEKCNLAFQRDEKVLELEKEIKCLQEESVVQCEELKSLLRDYEQEKVLLRKELEEIQSEKEALQSDLLEMKNANEKTRLENQNLLIQVEEVSQTCSKSEIHNEKEKCFIKEHENLKPLLEQKELRDRRAELILLKDSLAKSPSVKNDPLSSVKELEEKI

SEQ ID NO: 36355 - protein, 247 aa, Homo sapiens
  Payload ID: 7191
  Gene Symbol: GCC2
  Gene Name: GRIP and coiled-coil domain containing 2
  ENSP ID: ENSP00000387350
MEVTQDLVQDGVASPATPGTGKSKLETLPKEDLIKFAKKQMMLIQKAKSRCTELEKEIEELRSKPVTEGTGDIIKALTERLDALLLEKAETEQQCLSLKKENIKMKQEVEDSVTKMGDAHKELEQSHINYVKEIENLKNELMAVRSKYSEDKANLQKQLEEAMNTQLELSEQLKFQNNSEDNVKKLQEEIEKIRPGFEEQILYLQKQLDATTDEKKETVTQLQNIIEANSQHYQKNINSLQEELLQL

SEQ ID NO: 36356 - protein, 87 aa, Homo sapiens
  Payload ID: 7191
  Gene Symbol: GCC2
  Gene Name: GRIP and coiled-coil domain containing 2
  ENSP ID: ENSP00000392470
  MOD_RES (1)..(1): Any amino acid
XEEKINKIKLVAVKAKKELDSSRKETQTVKEELESLRSEKDQLSASMRDLIQGAESYKNMKSSQSNWMWKKNVLIILSIVLKTLQDN

SEQ ID NO: 36357 - protein, 45 aa, Homo sapiens
  Payload ID: 7191
  Gene Symbol: GCC2
  Gene Name: GRIP and coiled-coil domain containing 2
  Uniprot ID: Q8IWJ2
  ENSP ID: ENSP00000419969
MEDLVQDGVASPATPGTGKSKNWRKKLKNSDQNLLLKELVILLRH

SEQ ID NO: 36358 - protein, 146 aa, Homo sapiens
  Payload ID: 7191
  Gene Symbol: GCC2
  Gene Name: GRIP and coiled-coil domain containing 2
  ENSP ID: ENSP00000475234
LKSLLRDYEQEKVLLRKELEEIQSEKEALQSDLLEMKNANEKTRLENQNLLIQVEEVSQTCSKSEIHNEKEKCFIKEHENLKPLLEQKELRDRRAELILLKDSLAKSPSVKNDPLSSVKELEEKIGKNRLERGKLLLQKKEGELLL

SEQ ID NO: 36359 - protein, 127 aa, Homo sapiens
  Payload ID: 7191
  Gene Symbol: GCC2
  Gene Name: GRIP and coiled-coil domain containing 2
  ENSP ID: ENSP00000475798
  MOD_RES (1)..(1): Any amino acid
XKVLLRKELEEIQSEKEALQSDLLEMKNANEKTRLENQNLLIQVEEVSQTCSKSEIHNEKEKCFIKEHENLKPLLEQKELRDRRAELILLKDSLAKSPSVKNDPLSSVKELEEKIGNYGFADVVTIN

SEQ ID NO: 36360 - protein, 683 aa, Homo sapiens
  Payload ID: 7191
  Gene Symbol: GCC2
  Gene Name: GRIP and coiled-coil domain containing 2
  ENSP ID: ENSP00000482844
MCQIEASAKEHEAEINKLNELKENLVKQCEASEKNIQKKYECELENLRKATSNANQDNQICSILLQENTFVEQVVNEKVKHLEDTLKELESQHSILKDEVTYMNNLKLKLEMDAQHIKDEFFHEREDLEFKINELLLAKEEQGCVIEKLKSELAGLNKQFCYTVEQHNREVQSLKEQHQKEISELNETFLSDSEKEKLTLMFEIQGLKEQCENLQQEKQEAILNYESLREIMEILQTELGESAGKISQEFESMKQQQASDVHELQQKLRTAFTEKDALLETVNRLQGENEKLLSQQELVPELENTIKNLQEKNGVYLLSLSQRDTMLKELEGKINSLTEEKDDFINKLKNSHEEMDNFHKKCEREERLILELGKKVEQTIQYNSELEQKVNELTGGLEETLKEKDQNDQKLEKLMVQMKVLSEDKEVLSAEVKSLYEETINSVQKKQLSRDLEVFLSQKEDVILKEHITQLEKKLQLMVEEQDNLNKLLENEQVQKLFVKTQLYGFLKEMGSEVSEDSEEKDVVNVLQAVGESLAKINEEKCNLAFQRDEKVLELEKEIKCLQEESVVQCEELKSLLRDYEQEKVLLRKELEEIQSEKEALQSDLLEMKNANEKTRLENQNLLIQVEEVSQTCSKSEIHNEKEKCFIKEHENLKPLLEQKELRDRRAELILLKDSLAKSPSKK

SEQ ID NO: 36361 - protein, 841 aa, Homo sapiens
  Payload ID: 7192
  Gene Symbol: GRIPAP1
  Gene Name: GRIP1 associated protein 1
  Uniprot ID: Q4V328
  ENSP ID: ENSP00000365606
MAQALSEEEFQRMQAQLLELRTNNYQLSDELRKNGVELTSLRQKVAYLDKEFSKAQKALSKSKKAQEVEVLLSENEMLQAKLHSQEEDFRLQNSTLMAEFSKLCSQMEQLEQENQQLKEGAAGAGVAQAGPLVDGELLRLQAENTALQKNVAALQERYGKEAGKFSAVSEGQGDPPGGLAPTVLAPMPLAEVELKWEMEKEEKRLLWEQLQGLESSKQAETSRLQEELAKLSEKLKKKQESFCRLQTEKETLFNDSRNKIEELQQRKEADHKAQLARTQKLQQELEAANQSLAELRDQRQGERLEHAAALRALQDQVSIQSADAQEQVEGLLAENNALRTSLAALEQIQTAKTQELNMLREQTTGLAAELQQQQAEYEDLMGQKDDLNSQLQESLRANSRLLEQLQEIGQEKEQLTQELQEARKSAEKRKAMLDELAMETLQEKSQHKEELGAVRLRHEKEVLGVRARYERELRELHEDKKRQEEELRGQIREEKARTRELETLQQTVEELQAQVHSMDGAKGWFERRLKEAEESLQQQQQEQEEALKQCREQHAAELKGKEEELQDVRDQLEQAQEERDCHLKTISSLKQEVKDTVDGQRILEKKGSAALKDLKRQLHLERKRADKLQERLQDILTNSKSRSGLEELVLSEMNSPSRTQTGDSSSISSFSYREILREKESSAVPARSLSSSPQAQPPRPAELSDEEVAELFQRLAETQQEKWMLEEKVKHLEVSSASMAEDLCRKSAIIETYVMDSRIDVSVAAGHTDRSGLGSVLRDLVKPGDENLREMNKKLQNMLEEQLTKNMHLHKDMEVLSQEIVRLSKECVGPPDPDLEPGETS

SEQ ID NO: 36362 - protein, 810 aa, Homo sapiens
  Payload ID: 7192
  Gene Symbol: GRIPAP1
  Gene Name: GRIP1 associated protein 1
  ENSP ID: ENSP00000469842
MAQALSEEEFQRMQAQLLELRTNNYQLSDELRKNGVELTSLRQKVAYLDKEFSKAQKALSKSKKAQEVEVLLSENEMLQAKLHSQEEDFRLQNSTLMAEFSKLCSQMEQLEQENQQLKEGAAGAGVAQAGPLVDGELLRLQAENTALQKNVAALQERYGKEAGKFSAVSEGQGDPPGGLAPTVLAPMPLAEVELKWEMEKEEKRLLWEQLQGLESSKQAETSRLQEELAKLSEKLKKKQESFCRLQTEKETLFNDSRNKIEELQQRKEADHKAQLARTQKLQQELEAANQSLAELRDQRQGERLEHAAALRALQDQIQTAKTQELNMLREQTTGLAAELQQQQAEYEDLMGQKDDLNSQLQESLRANSRLLEQLQEIGQEKEQLTQELQEARKSAEKRKAMLDELAMETLQEKSQHKEELGAVRLRHEKEVLGVRARYERELRELHEDKKRQEEELRGQIREEKARTRELETLQQTVEELQAQVHSMDGAKGWFERRLKEAEESLQQQQQEQEEALKQCREQHAAELKGKEEELQDVRDQLEQAQEERDCHLKTISSLKQEVKDTVDGQRILEKKGSAALKDLKRQLHLERKRADKLQERLQDILTNSKSRSGLEELVLSEMNSPSRTQTGDSSSISSFSYREILREKESSAVPARSLSSSPQAQPPRPAELSDEEVAELFQRLAETQQEKWMLEEKVKHLEVSSASMAEDLCRKSAIIETYVMDSRIDVSVAAGHTDRSGLGSVLRDLVKPGDENLREMNKKLQNMLEEQLTKNMHLHKDMEVLSQEIVRLSKECVGPPDPDLEPGETS

SEQ ID NO: 36363 - protein, 796 aa, Homo sapiens
  Payload ID: 7192
  Gene Symbol: GRIPAP1
  Gene Name: GRIP1 associated protein 1
  ENSP ID: ENSP00000477574
MAQALSEEEFQRMQAQLLELRTNNYQLSDELRKNGVELTSLRQKVAYLDKEFSKAQKLCSQMEQLEQENQQLKEGAAGAGVAQAGPLVDGELLRLQAENTALQKNVAALQERYGKEAGKFSAVSEGQGDPPGGLAPTVLAPMPLAEVELKWEMEKEEKRLLWEQLQGLESSKQAETSRLQEELAKLSEKLKKKQESFCRLQTEKETLFNDSRNKIEELQQRKEADHKAQLARTQKLQQELEAANQSLAELRDQRQGERLEHAAALRALQDQVSIQSADAQEQVEGLLAENNALRTSLAALEQIQTAKTQELNMLREQTTGLAAELQQQQAEYEDLMGQKDDLNSQLQESLRANSRLLEQLQEIGQEKEQLTQELQEARKSAEKRKAMLDELAMETLQEKSQHKEELGAVRLRHEKEVLGVRARYERELRELHEDKKRQEEELRGQIREEKARTRELETLQQTVEELQAQVHSMDGAKGWFERRLKEAEESLQQQQQEQEEALKQCREQHAAELKGKEEELQDVRDQLEQAQEERDCHLKTISSLKQEVKDTVDGQRILEKKGSAALKDLKRQLHLERKRADKLQERLQDILTNSKSRSGLEELVLSEMNSPSRTQTGDSSSISSFSYREILREKESSAVPARSLSSSPQAQPPRPAELSDEEVAELFQRLAETQQEKWMLEEKVKHLEVSSASMAEDLCRKSAIIETYVMDSRIDVSVAAGHTDRSGLGSVLRDLVKPGDENLREMNKKLQNMLEEQLTKNMHLHKDMEVLSQEIVRLSKECVGPPDPDLEPGETS

SEQ ID NO: 36364 - protein, 23 aa, Homo sapiens
  Payload ID: 7192
  Gene Symbol: GRIPAP1
  Gene Name: GRIP1 associated protein 1
  ENSP ID: ENSP00000479263
MLQAKLHSQEEDFRLQNSTLMAE

SEQ ID NO: 36365 - protein, 69 aa, Homo sapiens
  Payload ID: 7192
  Gene Symbol: GRIPAP1
  Gene Name: GRIP1 associated protein 1
  ENSP ID: ENSP00000480042
MLQAKLHSQEEDFRLQNSTLMAEFSKLCSQMEQLEQENQQLKEGAAGAGVAQAGPLVDGELLRLQAENT

SEQ ID NO: 36366 - protein, 61 aa, Homo sapiens
  Payload ID: 7192
  Gene Symbol: GRIPAP1
  Gene Name: GRIP1 associated protein 1
  ENSP ID: ENSP00000480180
  MOD_RES (1)..(1): Any amino acid
XSQEEDFRLQNSTLMAEFSKPCRNAMGKKPGSSQLSVRARGIPQGAWPPPSWPPCRWQRWS

SEQ ID NO: 36367 - protein, 302 aa, Homo sapiens
  Payload ID: 7192
  Gene Symbol: GRIPAP1
  Gene Name: GRIP1 associated protein 1
  ENSP ID: ENSP00000480856
  MOD_RES (1)..(1): Any amino acid
XANSRLLEQLQEIGQEKEQLTQELQEARKSAEKRKAMLDELAMETLQEKSQHKEELGAVRLRHEKEVLGVRARYERELRELHEDKKRQEEELRGQIREEKARTRELETLQQTVEELQAQVHSMDGAKGWFERRLKEAEGKEEELQDVRDQLEQAQEERDCHLKTISSLKQEVKDTVDGQRILEKKGSAALKDLKRQLHLERKRADKLQERLQDILTNSKSRSGLEELVLSEMNSPSRTQTGDSSSISSFSYREILREKESSAVPARSLSSSPQAQPPRPAELSDEEVAELFQRLAETQQEKW

SEQ ID NO: 36368 - protein, 121 aa, Homo sapiens
  Payload ID: 7192
  Gene Symbol: GRIPAP1
  Gene Name: GRIP1 associated protein 1
  ENSP ID: ENSP00000482629
MQAQLLELRTNNYQLSDELRKNGVELTSLRQKVAYLDKEFSKAQKALSKSKKAQEVEVLLSENEMLQAKLHSQEEDFRLQNSTLMAEFSKERYGKEAGKFSAVSEGQGDPPGGLAPTVLAP

SEQ ID NO: 36369 - protein, 474 aa, Homo sapiens
  Payload ID: 7193
  Gene Symbol: GC
  Gene Name: group-specific component (vitamin D binding protein)
  Uniprot ID: P02774
  ENSP ID: ENSP00000273951
MKRVLVLLLAVAFGHALERGRDYEKNKVCKEFSHLGKEDFTSLSLVLYSRKFPSGTFEQVSQLVKEVVSLTEACCAEGADPDCYDTRTSALSAKSCESNSPFPVHPGTAECCTKEGLERKLCMAALKHQPQEFPTYVEPTNDEICEAFRKDPKEYANQFMWEYSTNYGQAPLSLLVSYTKSYLSMVGSCCTSASPTVCFLKERLQLKHLSLLTTLSNRVCSQYAAYGEKKSRLSNLIKLAQKVPTADLEDVLPLAEDITNILSKCCESASEDCMAKELPEHTVKLCDNLSTKNSKFEDCCQEKTAMDVFVCTYFMPAAQLPELPDVELPTNKDVCDPGNTKVMDKYTFELSRRTHLPEVFLSKVLEPTLKSLGECCDVEDSTTCFNAKGPLLKKELSSFIDKGQELCADYSENTFTEYKKKLAERLKAKLPDATPTELAKLVNKHSDFASNCCSINSPPLYCDSEIDAELKNIL

SEQ ID NO: 36370 - protein, 493 aa, Homo sapiens
  Payload ID: 7193
  Gene Symbol: GC
  Gene Name: group-specific component (vitamin D binding protein)
  Uniprot ID: P02774
  ENSP ID: ENSP00000421725
MLWSWSEERGGAARLSGRKMKRVLVLLLAVAFGHALERGRDYEKNKVCKEFSHLGKEDFTSLSLVLYSRKFPSGTFEQVSQLVKEVVSLTEACCAEGADPDCYDTRTSALSAKSCESNSPFPVHPGTAECCTKEGLERKLCMAALKHQPQEFPTYVEPTNDEICEAFRKDPKEYANQFMWEYSTNYGQAPLSLLVSYTKSYLSMVGSCCTSASPTVCFLKERLQLKHLSLLTTLSNRVCSQYAAYGEKKSRLSNLIKLAQKVPTADLEDVLPLAEDITNILSKCCESASEDCMAKELPEHTVKLCDNLSTKNSKFEDCCQEKTAMDVFVCTYFMPAAQLPELPDVELPTNKDVCDPGNTKVMDKYTFELSRRTHLPEVFLSKVLEPTLKSLGECCDVEDSTTCFNAKGPLLKKELSSFIDKGQELCADYSENTFTEYKKKLAERLKAKLPDATPTELAKLVNKHSDFASNCCSINSPPLYCDSEIDAELKNIL

SEQ ID NO: 36371 - protein, 348 aa, Homo sapiens
  Payload ID: 7193
  Gene Symbol: GC
  Gene Name: group-specific component (vitamin D binding protein)
  ENSP ID: ENSP00000422664
MKRVLVLLLAVAFGHALERGRDYEKNKVCKEFSHLGKEDFTSLSLVLYSRKFPSGTFEQVSQLVKEVVSLTEACCAEGADPDCYDTRTSALSAKSCESNSPFPVHPGTAECCTKEGLERKLCMAALKHQPQEFPTYVEPTNDEICEAFRKDPKEYANQFMWEYSTNYGQAPLSLLVSYTKSYLSMVGSCCTSASPTVCFLKERLQLKHLSLLTTLSNRVCSQYAAYGEKKSRLSNLIKLAQKVPTADLEDVLPLAEDITNILSKCCESASEDCMAKELPEHTVKLCDNLSTKNSKFEDCCQEKTAMDVFVCTYFMPAAQLPELPDVELPTNKDVCDPGNTKVMDKALY

SEQ ID NO: 36372 - protein, 476 aa, Homo sapiens
  Payload ID: 7193
  Gene Symbol: GC
  Gene Name: group-specific component (vitamin D binding protein)
  ENSP ID: ENSP00000426683
MKRVLVLLLAVAFGHALERGRDYEKNKVCKEFSHLGKEDFTSLSLVLYSRKFPSGTFEQVSQLVKEVVSLTEACCAEGADPDCYDTRTSALSAKSCESNSPFPVHPGTAECCTKEGLERKLCMAALKHQPQEFPTYVEPTNDEICEAFRKDPKEYANQFMWEYSTNYGQAPLSLLVSYTKSYLSMVGSCCTSASPTVCFLKERLQLKHLSLLTTLSNRVCSQYAAYGEKKSRLSNLIKLAQKVPTADLEDVLPLAEDITNILSKCCESASEDCMAKELPEHTVKLCDNLSTKNSKFEDCCQEKTAMDVFVCTYFMPAAQLPELPDVELPTNKDVCDPGNTKVMDKYTFELSRRTHLPEVFLSKVLEPTLKSLGECCDVEDSTTCFNAKGPLLKKELSSFIDKGQELCADYSENTFTEYKKKLAERLKAKLPDATPTELAKLVNKHSDFASNCCSINSPPLYCDSETRVGATQGNDL

SEQ ID NO: 36373 - protein, 145 aa, Homo sapiens
  Payload ID: 7193
  Gene Symbol: GC
  Gene Name: group-specific component (vitamin D binding protein)
  ENSP ID: ENSP00000426718
MKRVLVLLLAVAFGHALERGRDYEKNKVCKEFSHLGKEDFTSLSLVLYSRKFPSGTFEQVSQLVKEVVSLTEACCAEGADPDCYDTRTSALSAKSCESNSPFPVHPGTAECCTKEGLERKLCMAALKHQPQEFPTYVEPTNDEIC

SEQ ID NO: 36374 - protein, 131 aa, Homo sapiens
  Payload ID: 7194
  Gene Symbol: GADD45A
  Gene Name: growth arrest and DNA-damage-inducible, alpha
  Uniprot ID: P24522
  ENSP ID: ENSP00000360024
MTLEEFSAGEQKTESDPDNVVLCLLAADEDDDRDVALQIHFTLIQAFCCENDINILRVSNPGRLAELLLLETDAGPAASEGAEQPPDLHCVLVTNPHSSQWKDPALSQLICFCRESRYMDQWVPVINLPER

SEQ ID NO: 36375 - protein, 165 aa, Homo sapiens
  Payload ID: 7194
  Gene Symbol: GADD45A
  Gene Name: growth arrest and DNA-damage-inducible, alpha
  Uniprot ID: P24522
  ENSP ID: ENSP00000360025
MTLEEFSAGEQKTERMDKVGDALEEVLSKALSQRTITVGVYEAAKLLNVDPDNVVLCLLAADEDDDRDVALQIHFTLIQAFCCENDINILRVSNPGRLAELLLLETDAGPAASEGAEQPPDLHCVLVTNPHSSQWKDPALSQLICFCRESRYMDQWVPVINLPER

SEQ ID NO: 36376 - protein, 60 aa, Homo sapiens
  Payload ID: 7194
  Gene Symbol: GADD45A
  Gene Name: growth arrest and DNA-damage-inducible, alpha
  ENSP ID: ENSP00000482814
MTLEEFSAGEQKTERMDKVGDALEEVLSKALSQRTITVGVYEAAKLLNVIHIHLNGRILP

SEQ ID NO: 36377 - protein, 160 aa, Homo sapiens
  Payload ID: 7195
  Gene Symbol: GADD45B
  Gene Name: growth arrest and DNA-damage-inducible, beta
  Uniprot ID: O75293
  ENSP ID: ENSP00000215631
MTLEELVACDNAAQKMQTVTAAVEELLVAAQRQDRLTVGVYESAKLMNVDPDSVVLCLLAIDEEEEDDIALQIHFTLIQSFCCDNDINIVRVSGMQRLAQLLGEPAETQGTTEARDLHCLLVTNPHTDAWKSHGLVEVASYCEESRGNNQWVPYISLQER

SEQ ID NO: 36378 - protein, 60 aa, Homo sapiens
  Payload ID: 7195
  Gene Symbol: GADD45B
  Gene Name: growth arrest and DNA-damage-inducible, beta
  ENSP ID: ENSP00000466414
MTLEELVACDNAAQKMQTVTAAVEELLVAAQRQDRLTVGVYESAKLMNGPRQRGPLPLGH

SEQ ID NO: 36379 - protein, 176 aa, Homo sapiens
  Payload ID: 7195
  Gene Symbol: GADD45B
  Gene Name: growth arrest and DNA-damage-inducible, beta
  ENSP ID: ENSP00000467490
MTLEELVACDNAAQKMQTVTAAVEELLVAAQRQDRLTVGVYESAKLMNVDPDSVVLCLLAIDEEEEDDIALQIHFTLIQSFCCDNDINIVRVSGMQRLAQLLGEPAETQGTTEARDLHCLLVTVSRASALPRHARAPGPVFVNKVGLTGPAQLSAQPRLACPVGSRAGASSPRKLF

SEQ ID NO: 36380 - protein, 66 aa, Homo sapiens
  Payload ID: 7195
  Gene Symbol: GADD45B
  Gene Name: growth arrest and DNA-damage-inducible, beta
  ENSP ID: ENSP00000468374
MQTVTAAVEELLVAAQRQDRLTVGVYESAKLMNVDPDSVVLCLLAIDEEEEDDIALQIHFTLIQSF

SEQ ID NO: 36381 - protein, 66 aa, Homo sapiens; identical to SEQ ID NO: 36380
  Payload ID: 7195
  Gene Symbol: GADD45B
  Gene Name: growth arrest and DNA-damage-inducible, beta
  ENSP ID: ENSP00000468620

SEQ ID NO: 36382 - protein, 159 aa, Homo sapiens
  Payload ID: 7196
  Gene Symbol: GADD45G
  Gene Name: growth arrest and DNA-damage-inducible, gamma
  Uniprot ID: O95257
  ENSP ID: ENSP00000252506
MTLEEVRGQDTVPESTARMQGAGKALHELLLSAQRQGCLTAGVYESAKVLNVDPDNVTFCVLAAGEEDEGDIALQIHFTLIQAFCCENDIDIVRVGDVQRLAAIVGAGEEAGAPGDLHCILISNPNEDAWKDPALEKLSLFCEESRSVNDWVPSITLPE

SEQ ID NO: 36383 - protein, 141 aa, Homo sapiens
  Payload ID: 7196
  Gene Symbol: GADD45G
  Gene Name: growth arrest and DNA-damage-inducible, gamma
  ENSP ID: ENSP00000364924
MQGAGKALHELLLSAQRQGCLTAGVYESAKVLNVDPDNVTFCVLAAGEEDEGDIALQIHFTLIQAFCCENDIDIVRVGDVQRLAAIVGAGEEAGAPGDLHCILISNPNEDAWKDPALEKLSLFCEESRSVNDWVPSITLPE

SEQ ID NO: 36384 - protein, 222 aa, Homo sapiens
  Payload ID: 7197
  Gene Symbol: GADD45GIP1
  Gene Name: growth arrest and DNA-damage-inducible, gamma interacting protein 1
  Uniprot ID: Q8TAE8
  ENSP ID: ENSP00000323065
MAASVRQARSLLGVAATLAPGSRGYRARPPPRRRPGPRWPDPEDLLTPRWQLGPRYAAKQFARYGAASGVVPGSLWPSPEQLRELEAEEREWYPSLATMQESLRVKQLAEEQKRREREQHIAECMAKMPQMIVNWQQQQRENWEKAQADKERRARLQAEAQELLGYQVDPRSARFQELLQDLEKKERKRLKEEKQKRKKEARAAALAAAVAQDPAASGAPSS

SEQ ID NO: 36385 - protein, 345 aa, Homo sapiens
  Payload ID: 7198
  Gene Symbol: GAS1
  Gene Name: growth arrest-specific 1
  Uniprot ID: P54826
  ENSP ID: ENSP00000298743
MVAALLGGGGEARGGTVPGAWLCLMALLQLLGSAPRGSGLAHGRRLICWQALLQCQGEPECSYAYNQYAEACAPVLAQHGGGDAPGAAAAAFPASAASFSSRWRCPSHCISALIQLNHTRRGPALEDCDCAQDENCKSTKRAIEPCLPRTSGGGAGGPGAGGVMGCTEARRRCDRDSRCNLALSRYLTYCGKVFNGLRCTDECRTVIEDMLAMPKAALLNDCVCDGLERPICESVKENMARLCFGAELGNGPGSSGSDGGLDDYYDEDYDDEQRTGGAGGEQPLDDDDGVPHPPRPGSGAAASGGRGDLPYGPGRRSSGGGGRLAPRGAWTPLASILLLLLGPLF

SEQ ID NO: 36386 - protein, 313 aa, Homo sapiens
  Payload ID: 7199
  Gene Symbol: GAS2
  Gene Name: growth arrest-specific 2
  Uniprot ID: O43903
  ENSP ID: ENSP00000278187
MCTALSPKVRSGPGLSDMHQYSQWLASRHEANLLPMKEDLALWLTNLLGKEITAETFMEKLDNGALLCQLAETMQEKFKESMDANKPTKNLPLKKIPCKTSAPSGSFFARDNTANFLSWCRDLGVDETCLFESEGLVLHKQPREVCLCLLELGRIAARYGVEPPGLIKLEKEIEQEETLSAPSPSPSPSSKSSGKKSTGNLLDDAVKRISEDPPCKCPNKFCVERLSQGRYRVGEKILFIRMLHNKHVMVRVGGGWETFAGYLLKHDPCRMLQISRVDGKTSPIQSKSPTLKDMNPDNYLVVSASYKAKKEIK

SEQ ID NO: 36387 - protein, 313 aa, Homo sapiens; identical to SEQ ID NO: 36386
  Payload ID: 7199
  Gene Symbol: GAS2
  Gene Name: growth arrest-specific 2
  Uniprot ID: O43903
  ENSP ID: ENSP00000401145

SEQ ID NO: 36388 - protein, 141 aa, Homo sapiens
  Payload ID: 7199
  Gene Symbol: GAS2
  Gene Name: growth arrest-specific 2
  Uniprot ID: O43903
  ENSP ID: ENSP00000432026
MCTALSPKVRSGPGLSDMHQYSQWLASRHEANLLPMKEDLALWLTNLLGKEITAETFMEKLDNGALLCQLAETMQEKFKESMDANKPTKNLPLKKIPCKTSAPSGSFFARDNTANFLSWCRDLGVDETCLFESEGLGFGGQ

SEQ ID NO: 36389 - protein, 181 aa, Homo sapiens
  Payload ID: 7199
  Gene Symbol: GAS2
  Gene Name: growth arrest-specific 2
  ENSP ID: ENSP00000432584
MCTALSPKVRSGPGLSDMHQYSQWLASRHEANLLPMKEDLALWLTNLLGKEITAETFMEKLDNGALLCQLAETMQEKFKESMDANKPTKNLPLKKIPCKTSAPSGSFFARDNTANFLSWCRDLGVDETCLFESEGLVLHKQPREVCLCLLELGRIAARYGVEPPGLIKLEKEIEQEETLSA

SEQ ID NO: 36390 - protein, 155 aa, Homo sapiens
  Payload ID: 7199
  Gene Symbol: GAS2
  Gene Name: growth arrest-specific 2
  ENSP ID: ENSP00000433182
MCTALSPKVRSGPGLSDMHQYSQWLASRHEANLLPMKEDLALWLTNLLGKEITAETFMEKLDNGALLCQLAETMQEKFKESMDANKPTKNLPLKKIPCKTSAPSGSFFARDNTANFLSWCRDLGVDETCLFESEGLVLHKQPREVCLCLLELGRI

SEQ ID NO: 36391 - protein, 136 aa, Homo sapiens
  Payload ID: 7199
  Gene Symbol: GAS2
  Gene Name: growth arrest-specific 2
  ENSP ID: ENSP00000434478
MCTALSPKVRSGPGLSDMHQYSQWLASRHEANLLPMKEDLALWLTNLLGKEITAETFMEKLDNGALLCQLAETMQEKFKESMDANKPTKNLPLKKIPCKTSAPSGSFFARDNTANFLSWCRDLGVDETCLFESEGL

SEQ ID NO: 36392 - protein, 205 aa, Homo sapiens
  Payload ID: 7199
  Gene Symbol: GAS2
  Gene Name: growth arrest-specific 2
  ENSP ID: ENSP00000435946
MCTALSPKVRSGPGLSDMHQYSQWLASRHEANLLPMKEDLALWLTNLLGKEITAETFMEKLDNGALLCQLAETMQEKFKESMDANKPTKNLPLKKIPCKTSAPSGSFFARDNTANFLSWCRDLGVDETCLFESEGLVLHKQPREVCLCLLELGRIAARYGVEPPGLIKLEKEIEQEETLSAPSPSPSPSSKSSGKKSTGNLLDDA

SEQ ID NO: 36393 - protein, 141 aa, Homo sapiens; identical to SEQ ID NO: 36388
  Payload ID: 7199
  Gene Symbol: GAS2
  Gene Name: growth arrest-specific 2
  Uniprot ID: O43903
  ENSP ID: ENSP00000485708

SEQ ID NO: 36394 - protein, 454 aa, Homo sapiens
  Payload ID: 7200
  Gene Symbol: GAS2L1
  Gene Name: growth arrest-specific 2 like 1
  Uniprot ID: Q99501
  ENSP ID: ENSP00000383995
MADPVAGIAGSAAKSVRPFRSSEAYVEAMKEDLAEWLNALYGLGLPGGGDGFLTGLATGTTLCQHANAVTEAARALAAARPARGVAFQAHSVVPGSFMARDNVATFIGWCRVELGVPEVLMFETEDLVLRKNEKSVVLCLLEVARRGARLGLLAPRLVQFEQEIERELRAAPPAPNAPAAGEDTTETAPAPGTPARGPRMTPSDLRNLDELVREILGRCTCPDQFPMIKVSEGKYRVGDSSLLIFVRVLRSHVMVRVGGGWDTLEHYLDKHDPCRCSSTAHRPPQPRVCTFSPQRVSPTTSPRPASPVPGSERRGSRPEMTPVSLRSTKEGPETPPSSSSSSLSVLGGKCGQPGDSGRTANGLPGPRSQALSSSSDEGSPCPGMGGPLDAPGSPLACTEPSRTWARGRMDTQPDRKPSRIPTPRGPRRPSGPAELGTWHALHSVTPRAEPDSWM

SEQ ID NO: 36395 - protein, 143 aa, Homo sapiens
  Payload ID: 7200
  Gene Symbol: GAS2L1
  Gene Name: growth arrest-specific 2 like 1
  ENSP ID: ENSP00000388645
MADPVAGIAGSAAKSVRPFRSSEAYVEAMKEDLAEWLNALYGLGLPGGGDGFLTGLATGTTLCQHANAVTEAARALAAARPARGVAFQAHSVVPGSFMARDNVATFIGWCRVELGVPEVLMFETEDLVLRKNEKSVVLCLLEV

SEQ ID NO: 36396 - protein, 138 aa, Homo sapiens
  Payload ID: 7200
  Gene Symbol: GAS2L1
  Gene Name: growth arrest-specific 2 like 1
  ENSP ID: ENSP00000395988
MADPVAGIAGSAAKSVRPFRSSEAYVEAMKEDLAEWLNALYGLGLPGGGDGFLTGLATGTTLCQHANAVTEAARALAAARPARGVAFQAHSVVPGSFMARDNVATFIGWCRVELGVPEVLMFETEDLVLRKNEKSVVL

SEQ ID NO: 36397 - protein, 681 aa, Homo sapiens
  Payload ID: 7200
  Gene Symbol: GAS2L1
  Gene Name: growth arrest-specific 2 like 1
  ENSP ID: ENSP00000478343
MADPVAGIAGSAAKSVRPFRSSEAYVEAMKEDLAEWLNALYGLGLPGGGDGFLTGLATGTTLCQHANAVTEAARALAAARPARGVAFQAHSVVPGSFMARDNVATFIGWCRVELGVPEVLMFETEDLVLRKNEKSVVLCLLEVARRGARLGLLAPRLVQFEQEIERELRAAPPAPNAPAAGEDTTETAPAPGTPARGPRMTPSDLRNLDELVREILGRCTCPDQFPMIKVSEGKYRVGDSSLLIFVRVLRSHVMVRVGGGWDTLEHYLDKHDPCRCSSTAHRPPQPRVCTFSPQRVSPTTSPRPASPVPGSERRGSRPEMTPVSLRSTKEGPETPPRPRDQLPPHPRSRRYSGDSDSSASSAQSGPLGTRSDDTGTGPRRERPSRRLTTGTPASPRRPPALRSQSRDRLDRGRPRGAPGGRGAQLSVPSPARRARSQSREEQAVLLVRRDRDGQHSWVPRGRGSGGSGRSTPQTPRARSPAAPRLSRVSSPSPELGTTPASIFRTPLQLDPQQEQQLFRRLEEEFLANARALEAVASVTPTGPAPDPARAPDPPAPDSAYCSSSSSSSSLSVLGGKCGQPGDSGRTANGLPGPRSQALSSSSDEGSPCPGMGGPLDAPGSPLACTEPSRTWARGRMDTQPDRKPSRIPTPRGPRRPSGPAELGTWHALHSVTPRAEPDSWM

SEQ ID NO: 36398 - protein, 681 aa, Homo sapiens; identical to SEQ ID NO: 36397
  Payload ID: 7200
  Gene Symbol: GAS2L1
  Gene Name: growth arrest-specific 2 like 1
  ENSP ID: ENSP00000478908

SEQ ID NO: 36399 - protein, 681 aa, Homo sapiens; identical to SEQ ID NO: 36397
  Payload ID: 7200
  Gene Symbol: GAS2L1
  Gene Name: growth arrest-specific 2 like 1
  ENSP ID: ENSP00000479551

SEQ ID NO: 36400 - protein, 681 aa, Homo sapiens; identical to SEQ ID NO: 36397
  Payload ID: 7200
  Gene Symbol: GAS2L1
  Gene Name: growth arrest-specific 2 like 1
  ENSP ID: ENSP00000481012

SEQ ID NO: 36401 - protein, 337 aa, Homo sapiens
  Payload ID: 7200
  Gene Symbol: GAS2L1
  Gene Name: growth arrest-specific 2 like 1
  Uniprot ID: Q99501
  ENSP ID: ENSP00000484130
MADPVAGIAGSAAKSVRPFRSSEAYVEAMKEDLAEWLNALYGLGLPGGGDGFLTGLATGTTLCQHANAVTEAARALAAARPARGVAFQAHSVVPGSFMARDNVATFIGWCRVELGVPEVLMFETEDLVLRKNEKSVVLCLLEVARRGARLGLLAPRLVQFEQEIERELRAAPPAPNAPAAGEDTTETAPAPGTPARGPRMTPSDLRNLDELVREILGRCTCPDQFPMIKVSEGKYRVGDSSLLIFVRVLRSHVMVRVGGGWDTLEHYLDKHDPCRCSSTAHRPPQPRVCTFSPQRVSPTTSPRPASPVPGSERRGSRPEMTPVSLRSTKEGPETPPR

SEQ ID NO: 36402 - protein, 864 aa, Homo sapiens
  Payload ID: 7201
  Gene Symbol: GAS2L2
  Gene Name: growth arrest-specific 2 like 2
  ENSP ID: ENSP00000474009
MSQPAGGRRKPRTLGPPVCSIRPFKSSEQYLEAMKEDLAEWLRDLYGLDIDAANFLQVLETGLVLCQHANVVTDAALAFLAEAPAQAQKIPMPRVGVSCNGAAQPGTFQARDNVSNFIQWCRKEMGIQEVLMFETEDLVLRKNVKNVVLCLLELGRRAWRFGVAAPTLVQLEEEIEEEVRRELPCHFRNLDQMVQSLVSHCTCPVQFSMVKVSEGKYRVGDSNTLIFIRILRNHVMVRVGGGWDTLGHYLDKHDPCRCTSLSHKPGSFLKPPAPPVQHEVRVQDGPSQTQPTMTISRSQSPPPPVDWKTYTSSDRRLRPPTPSSPRPRRERGAGTGASREMAPFLRCQERSLIPSWRQPTAGDSPPSPQSSSTQKGRDPQCTSSGKREERYPPELPRGRIPTSWVHEETDSWGTDAGNPTPQRLRAIEATTKGISARGPSPLPRSFGPAECLGLRLPLRDEAKGAFFQFREPESVRSPTPVQGLTKIPIRLPPARPPTPGRSFPGATSGSPRTELGRDPIPLRAVTVDLAGSTHGDCSVEVRQEDQQLDIQVMAEARESWDLGLQEQEGRYTPLPLGGNKEQAIYCSLEEEILGNMKLLEVRSACPQGTRSGVIPRSGVYIPRLAGQWPEPGGPYDKAIQELAQGSPSLLKVDLEAWKAAPTGSPKPAVTPGPGSLKGKLGARQSGPRTKASLSAKGTHMRKVPPQGGQDCSASTVSASPEAPTPSPLDPNSDKAKACLSKGRRTLRKPKRVPSIYKLKLRPRIRPRRDHRPEKQPSRIPRPLAYVFLGPARQPPKDRLLRAVLGSKGGEASRVDGASVGEEEEEGKEEKEPAAPLESSPQPPEGLQPHWLNQAPLPPEEESWV

SEQ ID NO: 36403 - protein, 880 aa, Homo sapiens
  Payload ID: 7201
  Gene Symbol: GAS2L2
  Gene Name: growth arrest-specific 2 like 2
  Uniprot ID: Q8NHY3
  ENSP ID: ENSP00000474529
MSQPAGGRRKPRTLGPPVCSIRPFKSSEQYLEAMKEDLAEWLRDLYGLDIDAANFLQVLETGLVLCQHANVVTDAALAFLAEAPAQAQKIPMPRVGVSCNGAAQPGTFQARDNVSNFIQWCRKEMGIQEVLMFETEDLVLRKNVKNVVLCLLELGRRAWRFGVAAPTLVQLEEEIEEEVRRELALPPPDPSPPAPPRRQPCHFRNLDQMVQSLVSHCTCPVQFSMVKVSEGKYRVGDSNTLIFIRILRNHVMVRVGGGWDTLGHYLDKHDPCRCTSLSHKPGSFLKPPAPPVQHEVRVQDGPSQTQPTMTISRSQSPPPPVDWKTYTSSDRRLRPPTPSSPRPRRERGAGTGASREMAPFLRCQERSLIPSWRQPTAGDSPPSPQSSSTQKGRDPQCTSSGKREERYPPELPRGRIPTSWVHEETDSWGTDAGNPTPQRLRAIEATTKGISARGPSPLPRSFGPAECLGLRLPLRDEAKGAFFQFREPESVRSPTPVQGLTKIPIRLPPARPPTPGRSFPGATSGSPRTELGRDPIPLRAVTVDLAGSTHGDCSVEVRQEDQQLDIQVMAEARESWDLGLQEQEGRYTPLPLGGNKEQAIYCSLEEEILGNMKLLEVRSACPQGTRSGVIPRSGVYIPRLAGQWPEPGGPYDKAIQELAQGSPSLLKVDLEAWKAAPTGSPKPAVTPGPGSLKGKLGARQSGPRTKASLSAKGTHMRKVPPQGGQDCSASTVSASPEAPTPSPLDPNSDKAKACLSKGRRTLRKPKRVPSIYKLKLRPRIRPRRDHRPEKQPSRIPRPLAYVFLGPARQPPKDRLLRAVLGSKGGEASRVDGASVGEEEEEGKEEKEPAAPLESSPQPPEGLQPHWLNQAPLPPEEESWV

SEQ ID NO: 36404 - protein, 213 aa, Homo sapiens
  Payload ID: 7201
  Gene Symbol: GAS2L2
  Gene Name: growth arrest-specific 2 like 2
  ENSP ID: ENSP00000480457
MSQPAGGRRKPRTLGPPVCSIRPFKSSEQYLEAMKEDLAEWLRDLYGLDIDAANFLQVLETGLVLCQHANVVTDAALAFLAEAPAQAQKIPMPRVGVSCNGAAQPGTFQARDNVSNFIQWCRKEMGIQEVLMFETEDLVLRKNVKNVVLCLLELGRRAWRFGVAAPTLVQLEEEIEEEVRRELALPLPQPGPDGAEPCEPLHVPSAVLHGQSV

SEQ ID NO: 36405 - protein, 694 aa, Homo sapiens
  Payload ID: 7202
  Gene Symbol: GAS2L3
  Gene Name: growth arrest-specific 2 like 3
  Uniprot ID: Q86XJ1
  ENSP ID: ENSP00000266754
MQPAIQVWFGEDLPLSPRSPLTPRHGPGLANVCQYDEWIAVRHEATLLPMQEDLSIWLSGLLGIKVKAEKLLEELDNGVLLCQLIDVLQNMVKTCNSEESGNFPMRKVPCKKDAASGSFFARDNTANFLHWCRDIGVDETYLFESEGLVLHKDPRQVYLCLLEIGRIVSRYGVEPPVLVKLEKEIELEETLLNTSGPEDSISIPKSCCRHEELHEAVKHIAEDPPCSCSHRFSIEYLSEGRYRLGDKILFIRMLHGKHVMVRVGGGWDTLQGFLLKYDPCRILQFATLEQKILAFQKGVSNESVPDSPARTPQPPEMNPLSAVNMFQKQNSKPSVPVSIPKSKEKQGRPPGALVPASSLKGGNLGSMSVRSKLPNSPAASSHPKLKSSKGITKKPQAPSNNASSSLASLNPVGKNTSSPALPRTAPCISESPRKCISSPNTPKAKVIPAQNSADLPESTLLPNKCSGKTQPKYLKHNHISSRDNAVSHLAAHSNSSSKCPKLPKANIPVRPKPSFQSSAKMTKTSSKTIATGLGTQSQPSDGAPQAKPVPAQKLKSALNLNQPVSVSSVSPVKATQKSKDKNIVSATKKQPQNKSAFQKTGPSSLKSPGRTPLSIVSLPQSSTKTQTAPKSAQTVAKSQHSTKGPPRSGKTPASIRKPPSSVKDADSGDKKPTAKKKEDDDHYFVMTGSKKPRK

SEQ ID NO: 36406 - protein, 694 aa, Homo sapiens; identical to SEQ ID NO: 36405
  Payload ID: 7202
  Gene Symbol: GAS2L3
  Gene Name: growth arrest-specific 2 like 3
  Uniprot ID: Q86XJ1
  ENSP ID: ENSP00000439672

SEQ ID NO: 36407 - protein, 590 aa, Homo sapiens
  Payload ID: 7202
  Gene Symbol: GAS2L3
  Gene Name: growth arrest-specific 2 like 3
  ENSP ID: ENSP00000442406
MRKVPCKKDAASGSFFARDNTANFLHWCRDIGVDETYLFESEGLVLHKDPRQVYLCLLEIGRIVSRYGVEPPVLVKLEKEIELEETLLNTSGPEDSISIPKSCCRHEELHEAVKHIAEDPPCSCSHRFSIEYLSEGRYRLGDKILFIRMLHGKHVMVRVGGGWDTLQGFLLKYDPCRILQFATLEQKILAFQKGVSNESVPDSPARTPQPPEMNPLSAVNMFQKQNSKPSVPVSIPKSKEKQGRPPGALVPASSLKGGNLGSMSVRSKLPNSPAASSHPKLKSSKGITKKPQAPSNNASSSLASLNPVGKNTSSPALPRTAPCISESPRKCISSPNTPKAKVIPAQNSADLPESTLLPNKCSGKTQPKYLKHNHISSRDNAVSHLAAHSNSSSKCPKLPKANIPVRPKPSFQSSAKMTKTSSKTIATGLGTQSQPSDGAPQAKPVPAQKLKSALNLNQPVSVSSVSPVKATQKSKDKNIVSATKKQPQNKSAFQKTGPSSLKSPGRTPLSIVSLPQSSTKTQTAPKSAQTVAKSQHSTKGPPRSGKTPASIRKPPSSVKDADSGDKKPTAKKKEDDDHYFVMTGSKKPRK

SEQ ID NO: 36408 - protein, 49 aa, Homo sapiens
  Payload ID: 7202
  Gene Symbol: GAS2L3
  Gene Name: growth arrest-specific 2 like 3
  ENSP ID: ENSP00000448184
MQPAIQVWFGEDLPLSPRSPLTPRHGPGLANVCQYDEWIAVRHEATLLP

SEQ ID NO: 36409 - protein, 694 aa, Homo sapiens; identical to SEQ ID NO: 36405
  Payload ID: 7202
  Gene Symbol: GAS2L3
  Gene Name: growth arrest-specific 2 like 3
  Uniprot ID: Q86XJ1
  ENSP ID: ENSP00000448955

SEQ ID NO: 36410 - protein, 391 aa, Homo sapiens
  Payload ID: 7202
  Gene Symbol: GAS2L3
  Gene Name: growth arrest-specific 2 like 3
  ENSP ID: ENSP00000450107
VPDSPARTPQPPEMNPLSAVNMFQKQNSKPSVPVSIPKSKEKQGRPPGALVPASSLKGGNLGSMSVRSKLPNSPAASSHPKLKSSKGITKKPQAPSNNASSSLASLNPVGKNTSSPALPRTAPCISESPRKCISSPNTPKAKVIPAQNSADLPESTLLPNKCSGKTQPKYLKHNHISSRDNAVSHLAAHSNSSSKCPKLPKANIPVRPKPSFQSSAKMTKTSSKTIATGLGTQSQPSDGAPQAKPVPAQKLKSALNLNQPVSVSSVSPVKATQKSKDKNIVSATKKQPQNKSAFQKTGPSSLKSPGRTPLSIVSLPQSSTKTQTAPKSAQTVAKSQHSTKGPPRSGKTPASIRKPPSSVKDADSGDKKPTAKKKEDDDHYFVMTGSKKPRK

SEQ ID NO: 36411 - protein, 678 aa, Homo sapiens
  Payload ID: 7203
  Gene Symbol: GAS6
  Gene Name: growth arrest-specific 6
  Uniprot ID: Q14393
  ENSP ID: ENSP00000331831
MAPSLSPGPAALRRAPQLLLLLLAAECALAALLPAREATQFLRPRQRRAFQVFEEAKQGHLERECVEELCSREEAREVFENDPETDYFYPRYLDCINKYGSPYTKNSGFATCVQNLPDQCTPNPCDRKGTQACQDLMGNFFCLCKAGWGGRLCDKDVNECSQENGGCLQICHNKPGSFHCSCHSGFELSSDGRTCQDIDECADSEACGEARCKNLPGSYSCLCDEGFAYSSQEKACRDVDECLQGRCEQVCVNSPGSYTCHCDGRGGLKLSQDMDTCEDILPCVPFSVAKSVKSLYLGRMFSGTPVIRLRFKRLQPTRLVAEFDFRTFDPEGILLFAGGHQDSTWIVLALRAGRLELQLRYNGVGRVTSSGPVINHGMWQTISVEELARNLVIKVNRDAVMKIAVAGDLFQPERGLYHLNLTVGGIPFHEKDLVQPINPRLDGCMRSWNWLNGEDTTIQETVKVNTRMQCFSVTERGSFYPGSGFAFYSLDYMRTPLDVGTESTWEVEVVAHIRPAADTGVLFALWAPDLRAVPLSVALVDYHSTKKLKKQLVVLAVEHTALALMEIKVCDGQEHVVTVSLRDGEATLEVDGTRGQSEVSAAQLQERLAVLERHLRSPVLTFAGGLPDVPVTSAPVTAFYRGCMTLEVNRRLLDLDEAAYKHSDITAHSCPPVEPAAA

SEQ ID NO: 36412 - protein, 416 aa, Homo sapiens
  Payload ID: 7204
  Gene Symbol: GAS7
  Gene Name: growth arrest-specific 7
  Uniprot ID: O60861
  ENSP ID: ENSP00000322608
MKPGMVPPPPGEESQTVILPPGWQSYLSPQGRRYYVNTTTNETTWERPSSSPGIPASPGSHRSSLPPTVNGYHASGTPAHPPETAHMSVRKSTGDSQNLGSSSPSKKQSKENTITINCVTFPHPDTMPEQQLLKPTEWSYCDYFWADKKDPQGNGTVAGFELLLQKQLKGKQMQKEMSEFIRERIKIEEDYAKNLAKLSQNSLASQEEGSLGEAWAQVKKSLADEAEVHLKFSAKLHSEVEKPLMNFRENFKKDMKKCDHHIADLRKQLASRYASVEKARKALTERQRDLEMKTQQLEIKLSNKTEEDIKKARRKSTQAGDDLMRCVDLYNQAQSKWFEEMVTTTLELERLEVERVEMIRQHLCQYTQLRHETDMFNQSTVEPVDQLLRKVDPAKDRELWVREHKTGNIRPVDMEI

SEQ ID NO: 36413 - protein, 181 aa, Homo sapiens
  Payload ID: 7204
  Gene Symbol: GAS7
  Gene Name: growth arrest-specific 7
  ENSP ID: ENSP00000379421
MVPPPPGEESQTVILPPGWQSYLSPQGRRYYVNTTTNETTWERPSSSPGIPASPGSHRSSLPPTVNGYHASGTPAHPPETAHMSVRKSTGDSQNLGSSSPSKKQSKENTITELERLEVERVEMIRQHLCQYTQLRHETDMFNQSTVEPVDQLLRKVDPAKDRELWVREHKTGNIRPVDMEI

SEQ ID NO: 36414 - protein, 476 aa, Homo sapiens
  Payload ID: 7204
  Gene Symbol: GAS7
  Gene Name: growth arrest-specific 7
  Uniprot ID: O60861
  ENSP ID: ENSP00000407552
MSGARCRTLYPFSGERHGQGLRFAAGELITLLQVPDGGWWEGEKEDGLRGWFPASYVQLLEKPGMVPPPPGEESQTVILPPGWQSYLSPQGRRYYVNTTTNETTWERPSSSPGIPASPGSHRSSLPPTVNGYHASGTPAHPPETAHMSVRKSTGDSQNLGSSSPSKKQSKENTITINCVTFPHPDTMPEQQLLKPTEWSYCDYFWADKKDPQGNGTVAGFELLLQKQLKGKQMQKEMSEFIRERIKIEEDYAKNLAKLSQNSLASQEEGSLGEAWAQVKKSLADEAEVHLKFSAKLHSEVEKPLMNFRENFKKDMKKCDHHIADLRKQLASRYASVEKARKALTERQRDLEMKTQQLEIKLSNKTEEDIKKARRKSTQAGDDLMRCVDLYNQAQSKWFEEMVTTTLELERLEVERVEMIRQHLCQYTQLRHETDMFNQSTVEPVDQLLRKVDPAKDRELWVREHKTGNIRPVDMEI

SEQ ID NO: 36415 - protein, 412 aa, Homo sapiens
  Payload ID: 7204
  Gene Symbol: GAS7
  Gene Name: growth arrest-specific 7
  Uniprot ID: O60861
  ENSP ID: ENSP00000410108
MVPPPPGEESQTVILPPGWQSYLSPQGRRYYVNTTTNETTWERPSSSPGIPASPGSHRSSLPPTVNGYHASGTPAHPPETAHMSVRKSTGDSQNLGSSSPSKKQSKENTITINCVTFPHPDTMPEQQLLKPTEWSYCDYFWADKKDPQGNGTVAGFELLLQKQLKGKQMQKEMSEFIRERIKIEEDYAKNLAKLSQNSLASQEEGSLGEAWAQVKKSLADEAEVHLKFSAKLHSEVEKPLMNFRENFKKDMKKCDHHIADLRKQLASRYASVEKARKALTERQRDLEMKTQQLEIKLSNKTEEDIKKARRKSTQAGDDLMRCVDLYNQAQSKWFEEMVTTTLELERLEVERVEMIRQHLCQYTQLRHETDMFNQSTVEPVDQLLRKVDPAKDRELWVREHKTGNIRPVDMEI

SEQ ID NO: 36416 - protein, 412 aa, Homo sapiens; identical to SEQ ID NO: 36415
  Payload ID: 7204
  Gene Symbol: GAS7
  Gene Name: growth arrest-specific 7
  Uniprot ID: O60861
  ENSP ID: ENSP00000443265

SEQ ID NO: 36417 - protein, 179 aa, Homo sapiens
  Payload ID: 7204
  Gene Symbol: GAS7
  Gene Name: growth arrest-specific 7
  ENSP ID: ENSP00000462304
MVPPPPGEESQTVILPPGWQSYLSPQGRRYYVNTTTNETTWERPSSSPGIPASPGSHRSSLPPTVNGYHASGTPAHPPETAHMSVRKSTGDSQNLGSSSPSKKQSKENTITINCVTFPHPDTMPEQQLLKPTEWSYCDYFWADKKDPQGNGTVAGFELLLQKQLKGKQMQKEMSEFIRE

SEQ ID NO: 36418 - protein, 128 aa, Homo sapiens
  Payload ID: 7204
  Gene Symbol: GAS7
  Gene Name: growth arrest-specific 7
  ENSP ID: ENSP00000462897
MVPPPPGEESQTVILPPGWQSYLSPQGRRYYVNTTTNETTWERPSSSPGIPASPGSHRSSLPPTVNGYHASGTPAHPPETAHMSVRKSTGDSQNLGSSSPSKKQSKENTITINCVTFPHPDTMPEQQL

SEQ ID NO: 36419 - protein, 412 aa, Homo sapiens; identical to SEQ ID NO: 36415
  Payload ID: 7204
  Gene Symbol: GAS7
  Gene Name: growth arrest-specific 7
  Uniprot ID: O60861
  ENSP ID: ENSP00000463527

SEQ ID NO: 36420 - protein, 106 aa, Homo sapiens
  Payload ID: 7204
  Gene Symbol: GAS7
  Gene Name: growth arrest-specific 7
  ENSP ID: ENSP00000463551
MVPPPPGEESQTVILPPGWQSYLSPQGRRYYVNTTTNETTWERPSSSPGIPASPGSHRSSLPPTVNGYHASGTPAHPPETAHMSVRKSTGDSQNLGSSSPSKKQSK

SEQ ID NO: 36421 - protein, 336 aa, Homo sapiens
  Payload ID: 7204
  Gene Symbol: GAS7
  Gene Name: growth arrest-specific 7
  Uniprot ID: O60861
  ENSP ID: ENSP00000463873
MSNMENSFDDVSCLSPQNLGSSSPSKKQSKENTITINCVTFPHPDTMPEQQLLKPTEWSYCDYFWADKKDPQGNGTVAGFELLLQKQLKGKQMQKEMSEFIRERIKIEEDYAKNLAKLSQNSLASQEEGSLGEAWAQVKKSLADEAEVHLKFSAKLHSEVEKPLMNFRENFKKDMKKCDHHIADLRKQLASRYASVEKARKALTERQRDLEMKTQQLEIKLSNKTEEDIKKARRKSTQAGDDLMRCVDLYNQAQSKWFEEMVTTTLELERLEVERVEMIRQHLCQYTQLRHETDMFNQSTVEPVDQLLRKVDPAKDRELWVREHKTGNIRPVDMEI

SEQ ID NO: 36422 - protein, 78 aa, Homo sapiens
  Payload ID: 7204
  Gene Symbol: GAS7
  Gene Name: growth arrest-specific 7
  ENSP ID: ENSP00000464088
MSNMENSFDDVSCLSPQNLGSSSPSKKQSKENTITINCVTFPHPDTMPEQQLLKPTEWSYCDYFWAEDPLTPMLCLPL

SEQ ID NO: 36423 - protein, 416 aa, Homo sapiens; identical to SEQ ID NO: 36412
  Payload ID: 7204
  Gene Symbol: GAS7
  Gene Name: growth arrest-specific 7
  Uniprot ID: O60861
  ENSP ID: ENSP00000464240

SEQ ID NO: 36424 - protein, 141 aa, Homo sapiens
  Payload ID: 7204
  Gene Symbol: GAS7
  Gene Name: growth arrest-specific 7
  ENSP ID: ENSP00000464494
MVPPPPGEESQTVILPPGWQSYLSPQGRRYYVNTTTNETTWERPSSSPGIPASPGSHRSSLPPTVNGYHASGTPAHPPETAHMSVRKSTGDSQNLGSSSPSKKQSKENTITINCVTFPHPDTMPEQQLLKPTEWSYCDYFW

SEQ ID NO: 36425 - protein, 478 aa, Homo sapiens
  Payload ID: 7205
  Gene Symbol: GAS8
  Gene Name: growth arrest-specific 8
  Uniprot ID: O95995
  ENSP ID: ENSP00000268699
MAPKKKGKKGKAKGTPIVDGLAPEDMSKEQVEEHVSRIREELDREREERNYFQLERDKIHTFWEITRRQLEEKKAELRNKDREMEEAEERHQVEIKVYKQKVKHLLYEHQNNLTEMKAEGTVVMKLAQKEHRIQESVLRKDMRALKVELKEQELASEVVVKNLRLKHTEEITRMRNDFERQVREIEAKYDKKMKMLRDELDLRRKTELHEVEERKNGQIHTLMQRHEEAFTDIKNYYNDITLNNLALINSLKEQMEDMRKKEDHLEREMAEVSGQNKRLADPLQKAREEMSEMQKQLANYERDKQILLCTKARLKVREKELKDLQWEHEVLEQRFTKVQQERDELYRKFTAAIQEVQQKTGFKNLVLERKLQALSAAVEKKEVQFNEVLAASNLDPAALTLVSRKLEDVLESKNSTIKDLQYELAQVCKAHNDLLRTYEAKLLAFGIPLDNVGFKPLETAVIGQTLGQGPAGLVGTPT

SEQ ID NO: 36426 - protein, 453 aa, Homo sapiens
  Payload ID: 7205
  Gene Symbol: GAS8
  Gene Name: growth arrest-specific 8
  Uniprot ID: O95995
  ENSP ID: ENSP00000440977
MSKEQVEEHVSRIREELDREREERNYFQLERDKIHTFWEITRRQLEEKKAELRNKDREMEEAEERHQVEIKVYKQKVKHLLYEHQNNLTEMKAEGTVVMKLAQKEHRIQESVLRKDMRALKVELKEQELASEVVVKNLRLKHTEEITRMRNDFERQVREIEAKYDKKMKMLRDELDLRRKTELHEVEERKNGQIHTLMQRHEEAFTDIKNYYNDITLNNLALINSLKEQMEDMRKKEDHLEREMAEVSGQNKRLADPLQKAREEMSEMQKQLANYERDKQILLCTKARLKVREKELKDLQWEHEVLEQRFTKVQQERDELYRKFTAAIQEVQQKTGFKNLVLERKLQALSAAVEKKEVQFNEVLAASNLDPAALTLVSRKLEDVLESKNSTIKDLQYELAQVCKAHNDLLRTYEAKLLAFGIPLDNVGFKPLETAVIGQTLGQGPAGLVGTPT

SEQ ID NO: 36427 - protein, 35 aa, Homo sapiens
  Payload ID: 7205
  Gene Symbol: GAS8
  Gene Name: growth arrest-specific 8
  ENSP ID: ENSP00000454343
MAPKKKGKKGKAKGTPIVDGLAPEDMSKEQLFIFR

SEQ ID NO: 36428 - protein, 117 aa, Homo sapiens
  Payload ID: 7205
  Gene Symbol: GAS8
  Gene Name: growth arrest-specific 8
  ENSP ID: ENSP00000454905
MSKEQVEEHVSRIREELDREREERNYFQLERDKIHTFWEITRRQLEEKKAELRNKDREMEEAEERHQVEIKVYKQKVKHLLYEHQNNLTEMKAEGTVVMKLAQKEHRIQESVLRKDM

SEQ ID NO: 36429 - protein, 95 aa, Homo sapiens
  Payload ID: 7205
  Gene Symbol: GAS8
  Gene Name: growth arrest-specific 8
  ENSP ID: ENSP00000455172
MSKEQVEEHVSRIREELDREREERNYFQLERDKIHTFWEITRRQLEEKKAELRNKDREMEEAEERHQVEIKVYKQKVKHLLYEHQNNLTEMKAEG

SEQ ID NO: 36430 - protein, 111 aa, Homo sapiens
  Payload ID: 7205
  Gene Symbol: GAS8
  Gene Name: growth arrest-specific 8
  ENSP ID: ENSP00000455936
MAPKKKGKKGKAKGTPIVDGLAPEDMSKEQVKLSPPSFFLAFRRPHAPLPCMGPCSVPHLTHCTWPGGGACQPHPGGAGPRAGGTKLLPAGAGQDPHLLGDHTEAAGGEEG

SEQ ID NO: 36431 - protein, 60 aa, Homo sapiens
  Payload ID: 7205
  Gene Symbol: GAS8
  Gene Name: growth arrest-specific 8
  ENSP ID: ENSP00000457554
MEEAEERHQVEIKVYKQKVKHLLYEHQNNLTEMKAEGTVVMKLAQKEHRIQESVLRKDMR

SEQ ID NO: 36432 - protein, 395 aa, Homo sapiens
  Payload ID: 7205
  Gene Symbol: GAS8
  Gene Name: growth arrest-specific 8
  ENSP ID: ENSP00000482877
MEEAEERHQVEIKVYKQKVKHLLYEHQNNLTEMKAEGTVVMKLAQKEHRIQESVLRKDMRALKVELKEQELASEVVVKNLRLKHTEEITRMRNDFERQVREIEAKYDKKMKMLRDELDLRRKTELHEVEERKNGQIHTLMQRHEEAFTDIKNYYNDITLNNLALINSLKEQMEDMRKKEDHLEREMAEVSGQNKRLADPLQKAREEMSEMQKQLANYERDKQILLCTKARLKVREKELKDLQWEHEVLEQRFTKVQQERDELYRKFTAAIQEVQQKTGFKNLVLERKLQALSAAVEKKEVQFNEVLAASNLDPAALTLVSRKLEDVLESKNSTIKDLQYELAQVCKAHNDLLRTYEAKLLAFGIPLDNVGFKPLETAVIGQTLGQGPAGLVGTPT

SEQ ID NO: 36433 - protein, 238 aa, Homo sapiens
  Payload ID: 7206
  Gene Symbol: GAP43
  Gene Name: growth associated protein 43
  Uniprot ID: P17677
  ENSP ID: ENSP00000305010
MLCCMRRTKQVEKNDDDQKIEQDGIKPEDKAHKAATKIQASFRGHITRKKLKGEKKDDVQAAEAEANKKDEAPVADGVEKKGEGTTTAEAAPATGSKPDEPGKAGETPSEEKKGEGDAATEQAAPQAPASSEEKAGSAETESATKASTDNSPSSKAEDAPAKEEPKQADVPAAVTAAAATTPAAEDAAAKATAQPPTETGESSQAEENIEAVDETKPKESARQDEGKEEEPEADQEHA

SEQ ID NO: 36434 - protein, 274 aa, Homo sapiens
  Payload ID: 7206
  Gene Symbol: GAP43
  Gene Name: growth associated protein 43
  Uniprot ID: P17677
  ENSP ID: ENSP00000377372
MTKSCSELCHPALHFLPCLGGLRKNLQRAVRPSPYSLGFLTFWISRVEKNDDDQKIEQDGIKPEDKAHKAATKIQASFRGHITRKKLKGEKKDDVQAAEAEANKKDEAPVADGVEKKGEGTTTAEAAPATGSKPDEPGKAGETPSEEKKGEGDAATEQAAPQAPASSEEKAGSAETESATKASTDNSPSSKAEDAPAKEEPKQADVPAAVTAAAATTPAAEDAAAKATAQPPTETGESSQAEENIEAVDETKPKESARQDEGKEEEPEADQEHA

SEQ ID NO: 36435 - protein, 372 aa, Homo sapiens; identical to SEQ ID NO: 14250
  Payload ID: 7207
  Gene Symbol: GDF1
  Gene Name: growth differentiation factor 1
  Uniprot ID: P27539
  ENSP ID: ENSP00000247005

SEQ ID NO: 36436 - protein, 478 aa, Homo sapiens
  Payload ID: 7208
  Gene Symbol: GDF10
  Gene Name: growth differentiation factor 10
  Uniprot ID: P55107
  ENSP ID: ENSP00000464145
MAHVPARTSPGPGPQLLLLLLPLFLLLLRDVAGSHRAPAWSALPAAADGLQGDRDLQRHPGDAAATLGPSAQDMVAVHMHRLYEKYSRQGARPGGGNTVRSFRARLEVVDQKAVYFFNLTSMQDSEMILTATFHFYSEPPRWPRALEVLCKPRAKNASGRPLPLGPPTRQHLLFRSLSQNTATQGLLRGAMALAPPPRGLWQAKDISPIVKAARRDGELLLSAQLDSEERDPGVPRPSPYAPYILVYANDLAISEPNSVAVTLQRYDPFPAGDPEPRAAPNNSADPRVRRAAQATGPLQDNELPGLDERPPRAHAQHFHKHQLWPSPFRALKPRPGRKDRRKKGQEVFMAASQVLDFDEKTMQKARRKQWDEPRVCSRRYLKVDFADIGWNEWIISPKSFDAYYCAGACEFPMPKIVRPSNHATIQSIVRAVGIIPGIPEPCCVPDKMNSLGVLFLDENRNVVLKVYPNMSVDTCACR

SEQ ID NO: 36437 - protein, 407 aa, Homo sapiens
  Payload ID: 7209
  Gene Symbol: GDF11
  Gene Name: growth differentiation factor 11
  Uniprot ID: O95390
  ENSP ID: ENSP00000257868
MVLAAPLLLGFLLLALELRPRGEAAEGPAAAAAAAAAAAAAGVGGERSSRPAPSVAPEPDGCPVCVWRQHSRELRLESIKSQILSKLRLKEAPNISREVVKQLLPKAPPLQQILDLHDFQGDALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKRSRRNLGLDCDEHSSESRCCRYPLTVDFEAFGWDWIIAPKRYKANYCSGQCEYMFMQKYPHTHLVQQANPRGSAGPCCTPTKMSPINMLYFNDKQQIIYGKIPGMVVDRCGCS

SEQ ID NO: 36438 - protein, 380 aa, Homo sapiens
  Payload ID: 7209
  Gene Symbol: GDF11
  Gene Name: growth differentiation factor 11
  ENSP ID: ENSP00000448390
  MOD_RES (1)..(1): Any amino acid
XAAAAAAAAAAAAAGVGGERSSRPAPSVAPEPDGCPVCVWRQHSRELRLESIKSQILSKLRLKEAPNISREVVKQLLPKAPPLQQILDLHDFQGDALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKRSRRNLGLDCDEHSSESRCCRYPLTVDFEAFGWDWIIAPKRYKANYCSGQCEYMFMQKYPHTHLVQQANPRGSAGPCCTPTKMSPINMLYFNDKQQIIYGKIPGMVVDRCGCS

SEQ ID NO: 36439 - protein, 308 aa, Homo sapiens
  Payload ID: 7210
  Gene Symbol: GDF15
  Gene Name: growth differentiation factor 15
  Uniprot ID: Q99988
  ENSP ID: ENSP00000252809
MPGQELRTVNGSQMLLVLLVLSWLPHGGALSLAEASRASFPGPSELHSEDSRFRELRKRYEDLLTRLRANQSWEDSNTDLVPAPAVRILTPEVRLGSGGHLHLRISRAALPEGLPEASRLHRALFRLSPTASRSWDVTRPLRRQLSLARPQAPALHLRLSPPPSQSDQLLAESSSARPQLELHLRPQAARGRRRARARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 36440 - protein, 6 aa, Homo sapiens
  Payload ID: 7210
  Gene Symbol: GDF15
  Gene Name: growth differentiation factor 15
  ENSP ID: ENSP00000469819
MPGQEL

SEQ ID NO: 36441 - protein, 113 aa, Homo sapiens
  Payload ID: 7210
  Gene Symbol: GDF15
  Gene Name: growth differentiation factor 15
  ENSP ID: ENSP00000470531
MPGQELRTVNGSQMLLVLLVLSWLPHGGALSLAEASRASFPGPSELHSEDSRFRELRKRYEDLLTRLRANQSWEDSNTDLVPAPAVRILTPEVRLGSGGHLHLRISRAALPEG

SEQ ID NO: 36442 - protein, 429 aa, Homo sapiens
  Payload ID: 7211
  Gene Symbol: GDF2
  Gene Name: growth differentiation factor 2
  Uniprot ID: Q9UK05
  ENSP ID: ENSP00000463051
MCPGALWVALPLLSLLAGSLQGKPLQSWGRGSAGGNAHSPLGVPGGGLPEHTFNLKMFLENVKVDFLRSLNLSGVPSQDKTRVEPPQYMIDLYNRYTSDKSTTPASNIVRSFSMEDAISITATEDFPFQKHILLFNISIPRHEQITRAELRLYVSCQNHVDPSHDLKGSVVIYDVLDGTDAWDSATETKTFLVSQDIQDEGWETLEVSSAVKRWVRSDSTKSKNKLEVTVESHRKGCDTLDISVPPGSRNLPFFVVFSNDHSSGTKETRLELREMISHEQESVLKKLSKDGSTEAGESSHEEDTDGHVAAGSTLARRKRSAGAGSHCQKTSLRVNFEDIGWDSWIIAPKEYEAYECKGGCFFPLADDVTPTKHAIVQTLVHLKFPTKVGKACCVPTKLSPISVLYKDDMGVPTLKYHYEGMSVAECGCR

SEQ ID NO: 36443 - protein, 364 aa, Homo sapiens
  Payload ID: 7212
  Gene Symbol: GDF3
  Gene Name: growth differentiation factor 3
  Uniprot ID: Q9NR23
  ENSP ID: ENSP00000331745
MLRFLPDLAFSFLLILALGQAVQFQEYVFLQFLGLDKAPSPQKFQPVPYILKKIFQDREAAATTGVSRDLCYVKELGVRGNVLRFLPDQGFFLYPKKISQASSCLQKLLYFNLSAIKEREQLTLAQLGLDLGPNSYYNLGPELELALFLVQEPHVWGQTTPKPGKMFVLRSVPWPQGAVHFNLLDVAKDWNDNPRKNFGLFLEILVKEDRDSGVNFQPEDTCARLRCSLHASLLVVTLNPDQCHPSRKRRAAIPVPKLSCKNLCHRHQLFINFRDLGWHKWIIAPKGFMANYCHGECPFSLTISLNSSNYAFMQALMHAVDPEIPQAVCIPTKLSPISMLYQDNNDNVILRHYEDMVVDECGCG

SEQ ID NO: 36444 - protein, 501 aa, Homo sapiens
  Payload ID: 7213
  Gene Symbol: GDF5
  Gene Name: growth differentiation factor 5
  Uniprot ID: P43026
  ENSP ID: ENSP00000363489
MRLPKLLTFLLWYLAWLDLEFICTVLGAPDLGQRPQGTRPGLAKAEAKERPPLARNVFRPGGHSYGGGATNANARAKGGTGQTGGLTQPKKDEPKKLPPRPGGPEPKPGHPPQTRQATARTVTPKGQLPGGKAPPKAGSVPSSFLLKKAREPGPPREPKEPFRPPPITPHEYMLSLYRTLSDADRKGGNSSVKLEAGLANTITSFIDKGQDDRGPVVRKQRYVFDISALEKDGLLGAELRILRKKPSDTAKPAAPGGGRAAQLKLSSCPSGRQPAALLDVRSVPGLDGSGWEVFDIWKLFRNFKNSAQLCLELEAWERGRAVDLRGLGFDRAARQVHEKALFLVFGRTKKRDLFFNEIKARSGQDDKTVYEYLFSQRRKRRAPLATRQGKRPSKNLKARCSRKALHVNFKDMGWDDWIIAPLEYEAFHCEGLCEFPLRSHLEPTNHAVIQTLMNSMDPESTPPTCCVPTRLSPISILFIDSANNVVYKQYEDMVVESCGCR

SEQ ID NO: 36445 - protein, 501 aa, Homo sapiens; identical to SEQ ID NO: 36444
  Payload ID: 7213
  Gene Symbol: GDF5
  Gene Name: growth differentiation factor 5
  Uniprot ID: P43026
  ENSP ID: ENSP00000363492

SEQ ID NO: 36446 - protein, 250 aa, Homo sapiens
  Payload ID: 7214
  Gene Symbol: GDF5OS
  Gene Name: growth differentiation factor 5 opposite strand
  Uniprot ID: Q5U4N7
  ENSP ID: ENSP00000363495
MIQSSQPMSLKLTCSAFRLQRALRFLLGRLPWRVASGARRFRRWLNRYSYTVLSSWPERALISLKNRSRFLVRPNTRNRAFSWTCRAARSKPRPRRSTALPRSQASSSRHSWAEFLKFRKSFQMSNTSQPDPSRPGTERTSSKAAGCRPLGQLDSFSWAARPPPGAAGLAVSEGFFRKIRSSAPSSPSFSRALMSNTYLCFLTTGPRSSRENTQKSFPATSPREPVTSRLRGKAPALSQSRELSFTSAPF

SEQ ID NO: 36447 - protein, 455 aa, Homo sapiens
  Payload ID: 7215
  Gene Symbol: GDF6
  Gene Name: growth differentiation factor 6
  Uniprot ID: Q6KF10
  ENSP ID: ENSP00000287020
MDTPRVLLSAVFLISFLWDLPGFQQASISSSSSSAELGSTKGMRSRKEGKMQRAPRDSDAGREGQEPQPRPQDEPRAQQPRAQEPPGRGPRVVPHEYMLSIYRTYSIAEKLGINASFFQSSKSANTITSFVDRGLDDLSHTPLRRQKYLFDVSMLSDKEELVGAELRLFRQAPSAPWGPPAGPLHVQLFPCLSPLLLDARTLDPQGAPPAGWEVFDVWQGLRHQPWKQLCLELRAAWGELDAGEAEARARGPQQPPPPDLRSLGFGRRVRPPQERALLVVFTRSQRKNLFAEMREQLGSAEAAGPGAGAEGSWPPPSGAPDARPWLPSPGRRRRRTAFASRHGKRHGKKSRLRCSKKPLHVNFKELGWDDWIIAPLEYEAYHCEGVCDFPLRSHLEPTNHAIIQTLMNSMDPGSTPPSCCVPTKLTPISILYIDAGNNVVYKQYEDMVVESCGCR

SEQ ID NO: 36448 - protein, 271 aa, Homo sapiens [sequence omitted]

SEQ ID NO: 36449 - protein, 353 aa, Homo sapiens [sequence omitted]

SEQ ID NO: 36450 - protein, 450 aa, Homo sapiens
  Payload ID: 7216
  Gene Symbol: GDF7
  Gene Name: growth differentiation factor 7
  Uniprot ID: Q7Z4P5
  ENSP ID: ENSP00000272224
MDLSAAAALCLWLLSACRPRDGLEAAAVLRAAGAGPVRSPGGGGGGGGGGRTLAQAAGAAAVPAAAVPRARAARRAAGSGFRNGSVVPHHFMMSLYRSLAGRAPAGAAAVSASGHGRADTITGFTDQATQDESAAETGQSFLFDVSSLNDADEVVGAELRVLRRGSPESGPGSWTSPPLLLLSTCPGAARAPRLLYSRAAEPLVGQRWEAFDVADAMRRHRREPRPPRAFCLLLRAVAGPVPSPLALRRLGFGWPGGGGSAAEERAVLVVSSRTQRKESLFREIRAQARALGAALASEPLPDPGTGTASPRAVIGGRRRRRTALAGTRTAQGSGGGAGRGHGRRGRSRCSRKPLHVDFKELGWDDWIIAPLDYEAYHCEGLCDFPLRSHLEPTNHAIIQTLLNSMAPDAAPASCCVPARLSPISILYIDAANNVVYKQYEDMVVEACGCR

SEQ ID NO: 36451 - protein, 366 aa, Homo sapiens
  Payload ID: 7217
  Gene Symbol: GDF9
  Gene Name: growth differentiation factor 9
  ENSP ID: ENSP00000296875
MKKLYKTYATKEGIPKSNRSHLYNTVRLFTPCTRHKQAPGDQVTGILPSVELLFNLDRITTVEHLLKSVLLYNINNSVSFSSAVKCVCNLMIKEPKSSSRTLGRAPYSFTFNSQFEFGKKHKWIQIDVTSLLQPLVASNKRSIHMSINFTCMKDQLEHPSAQNGLFNMTLVSPSLILYLNDTSAQAYHSWYSLHYKRRPSQGPDQERSLSAYPVGEEAAEDGRSSHHRHRRGQETVSSELKKPLGPASFNLSEYFRQFLLPQNECELHDFRLSFSQLKWDNWIVAPHRYNPRYCKGDCPRAVGHRYGSPVHTMVQNIIYEKLDSSVPRPSCVPAKYSPLSVLTIEPDGSIAYKEYEDMIATKCTCR

SEQ ID NO: 36452 - protein, 454 aa, Homo sapiens
  Payload ID: 7217
  Gene Symbol: GDF9
  Gene Name: growth differentiation factor 9
  Uniprot ID: O60383
  ENSP ID: ENSP00000367942
MARPNKFLLWFCCFAWLCFPISLGSQASGGEAQIAASAELESGAMPWSLLQHIDERDRAGLLPALFKVLSVGRGGSPRLQPDSRALHYMKKLYKTYATKEGIPKSNRSHLYNTVRLFTPCTRHKQAPGDQVTGILPSVELLFNLDRITTVEHLLKSVLLYNINNSVSFSSAVKCVCNLMIKEPKSSSRTLGRAPYSFTFNSQFEFGKKHKWIQIDVTSLLQPLVASNKRSIHMSINFTCMKDQLEHPSAQNGLFNMTLVSPSLILYLNDTSAQAYHSWYSLHYKRRPSQGPDQERSLSAYPVGEEAAEDGRSSHHRHRRGQETVSSELKKPLGPASFNLSEYFRQFLLPQNECELHDFRLSFSQLKWDNWIVAPHRYNPRYCKGDCPRAVGHRYGSPVHTMVQNIIYEKLDSSVPRPSCVPAKYSPLSVLTIEPDGSIAYKEYEDMIATKCTCR

SEQ ID NO: 36453 - protein, 366 aa, Homo sapiens; identical to SEQ ID NO: 36451
  Payload ID: 7217
  Gene Symbol: GDF9
  Gene Name: growth differentiation factor 9
  ENSP ID: ENSP00000484339

SEQ ID NO: 36454 - protein, 366 aa, Homo sapiens; identical to SEQ ID NO: 36451
  Payload ID: 7217
  Gene Symbol: GDF9
  Gene Name: growth differentiation factor 9
  ENSP ID: ENSP00000485037

SEQ ID NO: 36455 - protein, 366 aa, Homo sapiens; identical to SEQ ID NO: 36451
  Payload ID: 7217
  Gene Symbol: GDF9
  Gene Name: growth differentiation factor 9
  ENSP ID: ENSP00000485231

SEQ ID NO: 36456 - protein, 422 aa, Homo sapiens
  Payload ID: 7218
  Gene Symbol: GFI1
  Gene Name: growth factor independent 1 transcription repressor
  Uniprot ID: Q99684
  ENSP ID: ENSP00000294702
MPRSFLVKSKKAHSYHQPRSPGPDYSLRLENVPAPSRADSTSNAGGAKAEPRDRLSPESQLTEAPDRASASPDSCEGSVCERSSEFEDFWRPPSPSASPASEKSMCPSLDEAQPFPLPFKPYSWSGLAGSDLRHLVQSYRPCGALERGAGLGLFCEPAPEPGHPAALYGPKRAAGGAGAGAPGSCSAGAGATAGPGLGLYGDFGSAAAGLYERPTAAAGLLYPERGHGLHADKGAGVKVESELLCTRLLLGGGSYKCIKCSKVFSTPHGLEVHVRRSHSGTRPFACEMCGKTFGHAVSLEQHKAVHSQERSFDCKICGKSFKRSSTLSTHLLIHSDTRPYPCQYCGKRFHQKSDMKKHTFIHTGEKPHKCQVCGKAFSQSSNLITHSRKHTGFKPFGCDLCGKGFQRKVDLRRHRETQHGLK

SEQ ID NO: 36457 - protein, 422 aa, Homo sapiens; identical to SEQ ID NO: 36456
  Payload ID: 7218
  Gene Symbol: GFI1
  Gene Name: growth factor independent 1 transcription repressor
  Uniprot ID: Q99684
  ENSP ID: ENSP00000359357

SEQ ID NO: 36458 - protein, 422 aa, Homo sapiens; identical to SEQ ID NO: 36456
  Payload ID: 7218
  Gene Symbol: GFI1
  Gene Name: growth factor independent 1 transcription repressor
  Uniprot ID: Q99684
  ENSP ID: ENSP00000399719

SEQ ID NO: 36459 - protein, 330 aa, Homo sapiens
  Payload ID: 7219
  Gene Symbol: GFI1B
  Gene Name: growth factor independent 1B transcription repressor
  Uniprot ID: Q5VTD9
  ENSP ID: ENSP00000344782
MPRSFLVKSKKAHTYHQPRVQEDEPLWPPALTPVPRDQAPSNSPVLSTLFPNQCLDWTNLKREPELEQDQNLARMAPAPEGPIVLSRPQDGDSPLSDSPPFYKPSFSWDTLATTYGHSYRQAPSTMQSAFLEHSVSLYGSPLVPSTEPALDFSLRYSPGMDAYHCVKCNKVFSTPHGLEVHVRRSHSGTRPFACDICGKTFGHAVSLEQHTHVHSQERSFECRMCGKAFKRSSTLSTHLLIHSDTRPYPCQFCGKRFHQKSDMKKHTYIHTGEKPHKCQVCGKAFSQSSNLITHSRKHTGFKPFSCELCTKGFQRKVDLRRHRESQHNLK

SEQ ID NO: 36460 - protein, 330 aa, Homo sapiens; identical to SEQ ID NO: 36459
  Payload ID: 7219
  Gene Symbol: GFI1B
  Gene Name: growth factor independent 1B transcription repressor
  Uniprot ID: Q5VTD9
  ENSP ID: ENSP00000361195

SEQ ID NO: 36461 - protein, 284 aa, Homo sapiens
  Payload ID: 7219
  Gene Symbol: GFI1B
  Gene Name: growth factor independent 1B transcription repressor
  Uniprot ID: Q5VTD9
  ENSP ID: ENSP00000361196
MPRSFLVKSKKAHTYHQPRVQEDEPLWPPALTPVPRDQAPSNSPVLSTLFPNQCLDWTNLKREPELEQDQNLARMAPAPEGPIVLSRPQDGDSPLSDSPPFYKPSFSWDTLATTYGHSYRQAPSTMQSAFLEHSVSLYGSPLVPSTEPALDFSLRYSPGMDAYHCVKCNKERSFECRMCGKAFKRSSTLSTHLLIHSDTRPYPCQFCGKRFHQKSDMKKHTYIHTGEKPHKCQVCGKAFSQSSNLITHSRKHTGFKPFSCELCTKGFQRKVDLRRHRESQHNLK

SEQ ID NO: 36462 - protein, 536 aa, Homo sapiens
  Payload ID: 7220
  Gene Symbol: GRB10
  Gene Name: growth factor receptor-bound protein 10
  Uniprot ID: Q13322
  ENSP ID: ENSP00000338543
MNASLESLYSACSMQSDTVPLLQNGQHARSQPRASGPPRSIQPQVSPRQRVQRSQPVHILAVRRLQEEDQQFRTSSLPAIPNPFPELCGPGSPPVLTPGSLPPSQAAAKQDVKVFSEDGTSKVVEILADMTARDLCQLLVYKSHCVDDNSWTLVEHHPHLGLERCLEDHELVVQVESTMASESKFLFRKNYAKYEFFKNPMNFFPEQMVTWCQQSNGSQTQLLQNFLNSSSCPEIQGFLHVKELGKKSWKKLYVCLRRSGLYCSTKGTSKEPRHLQLLADLEDSNIFSLIAGRKQYNAPTDHGLCIKPNKVRNETKELRLLCAEDEQTRTCWMTAFRLLKYGMLLYQNYRIPQQRKALLSPFSTPVRSVSENSLVAMDFSGQTGRVIENPAEAQSAALEEGHAWRKRSTRMNILGSQSPLHPSTLSTVIHRTQHWFHGRISREESHRIIKQQGLVDGLFLLRDSQSNPKAFVLTLCHHQKIKNFQILPCEDDGQTFFSLDDGNTKFSDLIQLVDFYQLNKGVLPCKLKHHCIRVAL

SEQ ID NO: 36463 - protein, 548 aa, Homo sapiens
  Payload ID: 7220
  Gene Symbol: GRB10
  Gene Name: growth factor receptor-bound protein 10
  Uniprot ID: Q13322
  ENSP ID: ENSP00000349818
MALAGCPDSFLHHPYYQDKVEQTPRSQQDPAGPGLPAQSDRLANHQEDDVDLEALVNDMNASLESLYSACSMQSDTVPLLQNGQHARSQPRASGPPRSIQPQVSPRQRVQRSQPVHILAVRRLQEEDQQFRTSSLPAIPNPFPELCGPGSPPVLTPGSLPPSQAAAKQDVKVFSEDGTSKVVEILADMTARDLCQLLVYKSHCVDDNSWTLVEHHPHLGLERCLEDHELVVQVESTMASESKFLFRKNYAKYEFFKNPMNFFPEQMVTWCQQSNGSQTQLLQEPRHLQLLADLEDSNIFSLIAGRKQYNAPTDHGLCIKPNKVRNETKELRLLCAEDEQTRTCWMTAFRLLKYGMLLYQNYRIPQQRKALLSPFSTPVRSVSENSLVAMDFSGQTGRVIENPAEAQSAALEEGHAWRKRSTRMNILGSQSPLHPSTLSTVIHRTQHWFHGRISREESHRIIKQQGLVDGLFLLRDSQSNPKAFVLTLCHHQKIKNFQILPCEDDGQTFFSLDDGNTKFSDLIQLVDFYQLNKGVLPCKLKHHCIRVAL

SEQ ID NO: 36464 - protein, 536 aa, Homo sapiens; identical to SEQ ID NO: 36462
  Payload ID: 7220
  Gene Symbol: GRB10
  Gene Name: growth factor receptor-bound protein 10
  Uniprot ID: Q13322
  ENSP ID: ENSP00000381790

SEQ ID NO: 36465 - protein, 594 aa, Homo sapiens
  Payload ID: 7220
  Gene Symbol: GRB10
  Gene Name: growth factor receptor-bound protein 10
  Uniprot ID: Q13322
  ENSP ID: ENSP00000381793
MALAGCPDSFLHHPYYQDKVEQTPRSQQDPAGPGLPAQSDRLANHQEDDVDLEALVNDMNASLESLYSACSMQSDTVPLLQNGQHARSQPRASGPPRSIQPQVSPRQRVQRSQPVHILAVRRLQEEDQQFRTSSLPAIPNPFPELCGPGSPPVLTPGSLPPSQAAAKQDVKVFSEDGTSKVVEILADMTARDLCQLLVYKSHCVDDNSWTLVEHHPHLGLERCLEDHELVVQVESTMASESKFLFRKNYAKYEFFKNPMNFFPEQMVTWCQQSNGSQTQLLQNFLNSSSCPEIQGFLHVKELGKKSWKKLYVCLRRSGLYCSTKGTSKEPRHLQLLADLEDSNIFSLIAGRKQYNAPTDHGLCIKPNKVRNETKELRLLCAEDEQTRTCWMTAFRLLKYGMLLYQNYRIPQQRKALLSPFSTPVRSVSENSLVAMDFSGQTGRVIENPAEAQSAALEEGHAWRKRSTRMNILGSQSPLHPSTLSTVIHRTQHWFHGRISREESHRIIKQQGLVDGLFLLRDSQSNPKAFVLTLCHHQKIKNFQILPCEDDGQTFFSLDDGNTKFSDLIQLVDFYQLNKGVLPCKLKHHCIRVAL

SEQ ID NO: 36466 - protein, 536 aa, Homo sapiens; identical to SEQ ID NO: 36462
  Payload ID: 7220
  Gene Symbol: GRB10
  Gene Name: growth factor receptor-bound protein 10
  Uniprot ID: Q13322
  ENSP ID: ENSP00000385046

SEQ ID NO: 36467 - protein, 536 aa, Homo sapiens; identical to SEQ ID NO: 36462
  Payload ID: 7220
  Gene Symbol: GRB10
  Gene Name: growth factor receptor-bound protein 10
  Uniprot ID: Q13322
  ENSP ID: ENSP00000385189

SEQ ID NO: 36468 - protein, 536 aa, Homo sapiens; identical to SEQ ID NO: 36462
  Payload ID: 7220
  Gene Symbol: GRB10
  Gene Name: growth factor receptor-bound protein 10
  Uniprot ID: Q13322
  ENSP ID: ENSP00000385366

SEQ ID NO: 36469 - protein, 588 aa, Homo sapiens
  Payload ID: 7220
  Gene Symbol: GRB10
  Gene Name: growth factor receptor-bound protein 10
  Uniprot ID: Q13322
  ENSP ID: ENSP00000385544
MQAAGPLFRSKDKVEQTPRSQQDPAGPGLPAQSDRLANHQEDDVDLEALVNDMNASLESLYSACSMQSDTVPLLQNGQHARSQPRASGPPRSIQPQVSPRQRVQRSQPVHILAVRRLQEEDQQFRTSSLPAIPNPFPELCGPGSPPVLTPGSLPPSQAAAKQDVKVFSEDGTSKVVEILADMTARDLCQLLVYKSHCVDDNSWTLVEHHPHLGLERCLEDHELVVQVESTMASESKFLFRKNYAKYEFFKNPMNFFPEQMVTWCQQSNGSQTQLLQNFLNSSSCPEIQGFLHVKELGKKSWKKLYVCLRRSGLYCSTKGTSKEPRHLQLLADLEDSNIFSLIAGRKQYNAPTDHGLCIKPNKVRNETKELRLLCAEDEQTRTCWMTAFRLLKYGMLLYQNYRIPQQRKALLSPFSTPVRSVSENSLVAMDFSGQTGRVIENPAEAQSAALEEGHAWRKRSTRMNILGSQSPLHPSTLSTVIHRTQHWFHGRISREESHRIIKQQGLVDGLFLLRDSQSNPKAFVLTLCHHQKIKNFQILPCEDDGQTFFSLDDGNTKFSDLIQLVDFYQLNKGVLPCKLKHHCIRVAL

SEQ ID NO: 36470 - protein, 536 aa, Homo sapiens; identical to SEQ ID NO: 36462
  Payload ID: 7220
  Gene Symbol: GRB10
  Gene Name: growth factor receptor-bound protein 10
  Uniprot ID: Q13322
  ENSP ID: ENSP00000385748

SEQ ID NO: 36471 - protein, 594 aa, Homo sapiens; identical to SEQ ID NO: 36465
  Payload ID: 7220
  Gene Symbol: GRB10
  Gene Name: growth factor receptor-bound protein 10
  Uniprot ID: Q13322
  ENSP ID: ENSP00000385770

SEQ ID NO: 36472 - protein, 108 aa, Homo sapiens
  Payload ID: 7220
  Gene Symbol: GRB10
  Gene Name: growth factor receptor-bound protein 10
  ENSP ID: ENSP00000410920
LADMTARDLCQLLVYKSHCVDDNSWTLVEHHPHLGLERCLEDHELVVQVESTMASESKFLFRKNYAKYEFFKNPMNFFPEQMVTWCQQSNGSQTQLLQVLGHNRSLLK

SEQ ID NO: 36473 - protein, 114 aa, Homo sapiens
  Payload ID: 7220
  Gene Symbol: GRB10
  Gene Name: growth factor receptor-bound protein 10
  ENSP ID: ENSP00000413023
MQAAGPLFRSKDKVEQTPRSQQDPAGPGLPAQSDRLANHQEDDVDLEALVNDMNASLESLYSACSMQSDTVPLLQNGQHARSQPRASGPPRSIQPQVSPRQRVQRSQPVHILAV

SEQ ID NO: 36474 - protein, 540 aa, Homo sapiens
  Payload ID: 7221
  Gene Symbol: GRB14
  Gene Name: growth factor receptor-bound protein 14
  Uniprot ID: Q14449
  ENSP ID: ENSP00000263915
MTTSLQDGQSAASRAAARDSPLAAQVCGAAQGRGDAHDLAPAPWLHARALLPLPDGTRGCAADRRKKKDLDVPEMPSIPNPFPELCCSPFTSVLSADLFPKANSRKKQVIKVYSEDETSRALDVPSDITARDVCQLLILKNHYIDDHSWTLFEHLPHIGVERTIEDHELVIEVLSNWGIEEENKLYFRKNYAKYEFFKNPMYFFPEHMVSFATETNGEISPTQILQMFLSSSTYPEIHGFLHAKEQGKKSWKKIYFFLRRSGLYFSTKGTSKEPRHLQFFSEFGNSDIYVSLAGKKKHGAPTNYGFCFKPNKAGGPRDLKMLCAEEEQSRTCWVTAIRLLKYGMQLYQNYMHPYQGRSGCSSQSISPMRSISENSLVAMDFSGQKSRVIENPTEALSVAVEEGLAWRKKGCLRLGTHGSPTASSQSSATNMAIHRSQPWFHHKISRDEAQRLIIQQGLVDGVFLVRDSQSNPKTFVLSMSHGQKIKHFQIIPVEDDGEMFHTLDDGHTRFTDLIQLVEFYQLNKGVLPCKLKHYCARIAL

SEQ ID NO: 36475 - protein, 155 aa, Homo sapiens
  Payload ID: 7221
  Gene Symbol: GRB14
  Gene Name: growth factor receptor-bound protein 14
  ENSP ID: ENSP00000401702
MFSYCRRKKKDLDVPEMPSIPNPFPELCCSPFTSVLSADLFPKANSRKKQVIKVYSEDETSRALDVPSDITARDVCQLLILKNHYIDDHSWTLFEHLPHIGVERTIEDHELVIEVLSNWGIEEENKLYFRKNYAKYEFFKNPMYFFPEHMVSFAT

SEQ ID NO: 36476 - protein, 415 aa, Homo sapiens
  Payload ID: 7221
  Gene Symbol: GRB14
  Gene Name: growth factor receptor-bound protein 14
  ENSP ID: ENSP00000416786
MGRAPRAGRLPGIRRWPPRRKKKDLDVPEMPSIPNPFPELCCSPFTSVLSADLFPKANSRKKQVIKVYSEDETSRALDVPSDITARDVCQLLILKNHYIDDHSWTLFEHLPHIGVERTIEDHELVIEVLSNWGIEEENKLYFRKNYAKYEFFKNPMYFFPEHMVSFATETNGEISPTQILQMFLSSSTYPEIHGFLHAKEQGKKSWKKIYFFLRRSGLYFSTKGTSKEPRHLQFFSEFGNSDIYVSLAGKKKHGAPTNYGFCFKPNKAGGPRDLKMLCAEEEQSRTCWVTAIRLLKYGMQLYQNYMHPYQGRSGCSSQSISPMRSISENSLVAMDFSGQKSRVIENPTEALSVAVEEGLAWRKKGCLRLGTHGSPTASSQSSATNMAIHRSQPWFHHKISRDEAQRLIIQQGLVD

SEQ ID NO: 36477 - protein, 176 aa, Homo sapiens
  Payload ID: 7222
  Gene Symbol: GRB2
  Gene Name: growth factor receptor-bound protein 2
  Uniprot ID: P62993
  ENSP ID: ENSP00000317360
MEAIAKYDFKATADDELSFKRGDILKVLNEECDQNWYKAELNGKDGFIPKNYIEMKPHPFGNDVQHFKVLRDGAGKYFLWVVKFNSLNELVDYHRSTSVSRNQQIFLRDIEQVPQQPTYVQALFDFDPQEDGELGFRRGDFIHVMDNSDPNWWKGACHGQTGMFPRNYVTPVNRNV

SEQ ID NO: 36478 - protein, 217 aa, Homo sapiens [sequence omitted]

SEQ ID NO: 36479 - protein, 217 aa, Homo sapiens [sequence omitted]

SEQ ID NO: 36480 - protein, 176 aa, Homo sapiens; identical to SEQ ID NO: 36477
  Payload ID: 7222
  Gene Symbol: GRB2
  Gene Name: growth factor receptor-bound protein 2
  Uniprot ID: P62993
  ENSP ID: ENSP00000376346

SEQ ID NO: 36481 - protein, 217 aa, Homo sapiens [sequence omitted]

SEQ ID NO: 36482 - protein, 110 aa, Homo sapiens
  Payload ID: 7222
  Gene Symbol: GRB2
  Gene Name: growth factor receptor-bound protein 2
  ENSP ID: ENSP00000462785
MEAIAKYDFKATADDELSFKRGDILKVLNEECDQNWYKAELNGKDGFIPKNYIEMKPHPWFFGKIPRAKAEEMLSKQRHDGAFLIRESESAPGDFSLSVKFGNDVQHFKV

SEQ ID NO: 36483 - protein, 42 aa, Homo sapiens
  Payload ID: 7222
  Gene Symbol: GRB2
  Gene Name: growth factor receptor-bound protein 2
  ENSP ID: ENSP00000463525
  MOD_RES (1)..(1): Any amino acid
XNSLNELVDYHRSTSVSRNQQIFLRDIEQVPQIGPWLSSCVP

SEQ ID NO: 36484 - protein, 156 aa, Homo sapiens
  Payload ID: 7222
  Gene Symbol: GRB2
  Gene Name: growth factor receptor-bound protein 2
  ENSP ID: ENSP00000464279
MEAIAKYDFKATADDELSFKRGDILKVLNEECDQNWYKAELNGKDGFIPKNYIEMKPHPWFFGKIPRAKAEEMLSKQRHDGAFLIRESESAPGDFSLSVNSRHTSRPSLTLIPRRMESWASAGEILSMSWITQTPTGGKELATGRPACFPAIMSPP

SEQ ID NO: 36485 - protein, 532 aa, Homo sapiens
  Payload ID: 7223
  Gene Symbol: GRB7
  Gene Name: growth factor receptor-bound protein 7
  Uniprot ID: Q14451
  ENSP ID: ENSP00000310771
MELDLSPPHLSSSPEDLCPAPGTPPGTPRPPDTPLPEEVKRSQPLLIPTTGRKLREEERRATSLPSIPNPFPELCSPPSQSPILGGPSSARGLLPRDASRPHVVKVYSEDGACRSVEVAAGATARHVCEMLVQRAHALSDETWGLVECHPHLALERGLEDHESVVEVQAAWPVGGDSRFVFRKNFAKYELFKSSPHSLFPEKMVSSCLDAHTGISHEDLIQNFLNAGSFPEIQGFLQLRGSGRKLWKRFFCFLRRSGLYYSTKGTSKDPRHLQYVADVNESNVYVVTQGRKLYGMPTDFGFCVKPNKLRNGHKGLRIFCSEDEQSRTCWLAAFRLFKYGVQLYKNYQQAQSRHLHPSCLGSPPLRSASDNTLVAMDFSGHAGRVIENPREALSVALEEAQAWRKKTNHRLSLPMPASGTSLSAAIHRTQLWFHGRISREESQRLIGQQGLVDGLFLVRESQRNPQGFVLSLCHLQKVKHYLILPSEEEGRLYFSMDDGQTRFTDLLQLVEFHQLNRGILPCLLRHCCTRVAL

SEQ ID NO: 36486 - protein, 447 aa, Homo sapiens
  Payload ID: 7223
  Gene Symbol: GRB7
  Gene Name: growth factor receptor-bound protein 7
  Uniprot ID: Q14451
  ENSP ID: ENSP00000377754
MELDLSPPHLSSSPEDLCPAPGTPPGTPRPPDTPLPEEVKRSQPLLIPTTGRKLREEERRATSLPSIPNPFPELCSPPSQSPILGGPSSARGLLPRDASRPHVVKVYSEDGACRSVEVAAGATARHVCEMLVQRAHALSDETWGLVECHPHLALERGLEDHESVVEVQAAWPVGGDSRFVFRKNFAKYELFKSSPHSLFPEKMVSSCLDAHTGISHEDLIQNFLNAGSFPEIQGFLQLRGSGRKLWKRFFCFLRRSGLYYSTKGTSKDPRHLQYVADVNESNVYVVTQGRKLYGMPTDFGFCVKPNKLRNGHKGLRIFCSEDEQSRTCWLAAFRLFKYGVQLYKNYQQAQSRHLHPSCLGSPPLRSASDNTLVAMDFSGHAGRVIENPREALSVALEEAQAWRKKTNHRLSLPMPASGTSLSAACSWSGRVSGTPRALSSLCATCRK

SEQ ID NO: 36487 - protein, 532 aa, Homo sapiens; identical to SEQ ID NO: 36485
  Payload ID: 7223
  Gene Symbol: GRB7
  Gene Name: growth factor receptor-bound protein 7
  Uniprot ID: Q14451
  ENSP ID: ENSP00000377759

SEQ ID NO: 36488 - protein, 532 aa, Homo sapiens; identical to SEQ ID NO: 36485
  Payload ID: 7223
  Gene Symbol: GRB7
  Gene Name: growth factor receptor-bound protein 7
  Uniprot ID: Q14451
  ENSP ID: ENSP00000377761

SEQ ID NO: 36489 - protein, 555 aa, Homo sapiens
  Payload ID: 7223
  Gene Symbol: GRB7
  Gene Name: growth factor receptor-bound protein 7
  Uniprot ID: Q14451
  ENSP ID: ENSP00000403459
MGKWRPGQGHTTGSVKPLSCSDAMELDLSPPHLSSSPEDLCPAPGTPPGTPRPPDTPLPEEVKRSQPLLIPTTGRKLREEERRATSLPSIPNPFPELCSPPSQSPILGGPSSARGLLPRDASRPHVVKVYSEDGACRSVEVAAGATARHVCEMLVQRAHALSDETWGLVECHPHLALERGLEDHESVVEVQAAWPVGGDSRFVFRKNFAKYELFKSSPHSLFPEKMVSSCLDAHTGISHEDLIQNFLNAGSFPEIQGFLQLRGSGRKLWKRFFCFLRRSGLYYSTKGTSKDPRHLQYVADVNESNVYVVTQGRKLYGMPTDFGFCVKPNKLRNGHKGLRIFCSEDEQSRTCWLAAFRLFKYGVQLYKNYQQAQSRHLHPSCLGSPPLRSASDNTLVAMDFSGHAGRVIENPREALSVALEEAQAWRKKTNHRLSLPMPASGTSLSAAIHRTQLWFHGRISREESQRLIGQQGLVDGLFLVRESQRNPQGFVLSLCHLQKVKHYLILPSEEEGRLYFSMDDGQTRFTDLLQLVEFHQLNRGILPCLLRHCCTRVAL

SEQ ID NO: 36490 - protein, 52 aa, Homo sapiens
  Payload ID: 7223
  Gene Symbol: GRB7
  Gene Name: growth factor receptor-bound protein 7
  ENSP ID: ENSP00000463126
MELDLSPPHLSSSPEDLCPAPGTPPGTPRPPDTPLPEEVCGGGSRCHSSPRV

SEQ ID NO: 36491 - protein, 118 aa, Homo sapiens
  Payload ID: 7223
  Gene Symbol: GRB7
  Gene Name: growth factor receptor-bound protein 7
  ENSP ID: ENSP00000463416
MELDLSPPHLSSSPEDLCPAPGTPPGTPRPPDTPLPEEVKRSQPLLIPTTGRKLREEERRATSLPSIPNPFPELCSPPSQSPILGGPSSARGLLPRDASRPHSCAIPGAQVVKVYSED

SEQ ID NO: 36492 - protein, 205 aa, Homo sapiens
  Payload ID: 7224
  Gene Symbol: GFER
  Gene Name: growth factor, augmenter of liver regeneration
  Uniprot ID: P55789
  ENSP ID: ENSP00000248114
MAAPGERGRFHGGNLFFLPGGARSEMMDDLATDARGRGAGRRDAAASASTPAQAPTSDSPVAEDASRRRPCRACVDFKTWMRTQQKRDTKFREDCPPDREELGRHSWAVLHTLAAYYPDLPTPEQQQDMAQFIHLFSKFYPCEECAEDLRKRLCRNHPDTRTRACFTQWLCHLHNEVNRKLGKPDFDCSKVDERWRDGWKDGSCD

SEQ ID NO: 36493 - protein, 130 aa, Homo sapiens
  Payload ID: 7224
  Gene Symbol: GFER
  Gene Name: growth factor, augmenter of liver regeneration
  ENSP ID: ENSP00000455885
MNSLSVGLLPQRDTKFREDCPPDREELGRHSWAVLHTLAAYYPDLPTPEQQQDMAQFIHLFSKFYPCEECAEDLRKRLCRNHPDTRTRACFTQWLCHLHNEVNRKLGKPDFDCSKVDERWRDGWKDGSCD

SEQ ID NO: 36494 - protein, 139 aa, Homo sapiens
  Payload ID: 7224
  Gene Symbol: GFER
  Gene Name: growth factor, augmenter of liver regeneration
  ENSP ID: ENSP00000456189
NLFFLPGGARSEMMDDLATDARGRGAGRRDAAASASTPAQAPTSDSPVAEDASRRRPCRACVDFKTWMRTQQKRDTKFREDCPPDREELGRHSWAVLHTLAAYYPDLPTPEQQQDMAQFIHLFSKFYPCEECAEDLRKR

SEQ ID NO: 36495 - protein, 109 aa, Homo sapiens
  Payload ID: 7224
  Gene Symbol: GFER
  Gene Name: growth factor, augmenter of liver regeneration
  ENSP ID: ENSP00000456432
MAAPGERGRFHGGNLFFLPGGARSEMMDDLATDARGRGAGRRDAAASASTPAQAPTSDSPVAEDASRRRPCRACVDFKTWMRTQQKAVQEPPRHPHPGMLHTVAVPPAQ

SEQ ID NO: 36496 - protein, 217 aa, Homo sapiens
  Payload ID: 7225
  Gene Symbol: GH1
  Gene Name: growth hormone 1
  Uniprot ID: P01241
  ENSP ID: ENSP00000312673
MATGSRTSLLLAFGLLCLPWLQEGSAFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 36497 - protein, 122 aa, Homo sapiens
  Payload ID: 7225
  Gene Symbol: GH1
  Gene Name: growth hormone 1
  ENSP ID: ENSP00000339278
MATGSRTSLLLAFGLLCLPWLQEGSAFPTIPLSRLFDNAMLRAHRLHQLAFDTYQEFRLEDGSPRTGQIFKQTYSKFDTNSHNDDALLKNYGLLYCFRKDMDKVETFLRIVQCRSVEGSCGF

SEQ ID NO: 36498 - protein, 177 aa, Homo sapiens
  Payload ID: 7225
  Gene Symbol: GH1
  Gene Name: growth hormone 1
  Uniprot ID: P01241
  ENSP ID: ENSP00000343791
MATGSRTSLLLAFGLLCLPWLQEGSAFPTIPLSRLFDNAMLRAHRLHQLAFDTYQEFNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 36499 - protein, 202 aa, Homo sapiens
  Payload ID: 7225
  Gene Symbol: GH1
  Gene Name: growth hormone 1
  Uniprot ID: P01241
  ENSP ID: ENSP00000408486
MATGSRTSLLLAFGLLCLPWLQEGSAFPTIPLSRLFDNAMLRAHRLHQLAFDTYQEFNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 36500 - protein, 30 aa, Homo sapiens
  Payload ID: 7225
  Gene Symbol: GH1
  Gene Name: growth hormone 1
  ENSP ID: ENSP00000481276
MATEAGRWQPPDWADLQADLQQVRHKLTQR

SEQ ID NO: 36501 - protein, 256 aa, Homo sapiens
  Payload ID: 7226
  Gene Symbol: GH2
  Gene Name: growth hormone 2
  Uniprot ID: P01242
  ENSP ID: ENSP00000333157
MAAGSRTSLLLAFGLLCLSWLQEGSAFPTIPLSRLFDNAMLRARRLYQLAYDTYQEFEEAYILKEQKYSFLQNPQTSLCFSESIPTPSNRVKTQQKSNLELLRISLLLIQSWLEPVQLLRSVFANSLVYGASDSNVYRHLKDLEEGIQTLMWVRVAPGIPNPGAPLASRDWGEKHCCPLFSSQALTQENSPYSSFPLVNPPGLSLQPGGEGGKWMNERGREQCPSAWPLLLFLHFAEAGRWQPPDWADLQSVLQQV

SEQ ID NO: 36502 - protein, 245 aa, Homo sapiens
  Payload ID: 7226
  Gene Symbol: GH2
  Gene Name: growth hormone 2
  Uniprot ID: P01242
  ENSP ID: ENSP00000394122
MAAGSRTSLLLAFGLLCLSWLQEGSAFPTIPLSRLFDNAMLRARRLYQLAYDTYQEFEEAYILKEQKYSFLQNPQTSLCFSESIPTPSNRVKTQQKSNLELLRISLLLIQSWLEPVQLLRSVFANSLVYGASDSNVYRHLKDLEEGIQTLIGWKMAAPGLGRSSISPTASLTQNRTTMTHCSRTTGCSTASGRTWTRSRHSCASCSAALWRAAVASSCPGGIPVTPPQCLSWSWKVLLQCPPALS

SEQ ID NO: 36503 - protein, 217 aa, Homo sapiens
  Payload ID: 7226
  Gene Symbol: GH2
  Gene Name: growth hormone 2
  Uniprot ID: P01242
  ENSP ID: ENSP00000409294
MAAGSRTSLLLAFGLLCLSWLQEGSAFPTIPLSRLFDNAMLRARRLYQLAYDTYQEFEEAYILKEQKYSFLQNPQTSLCFSESIPTPSNRVKTQQKSNLELLRISLLLIQSWLEPVQLLRSVFANSLVYGASDSNVYRHLKDLEEGIQTLMWRLEDGSPRTGQIFNQSYSKFDTKSHNDDALLKNYGLLYCFRKDMDKVETFLRIVQCRSVEGSCGF

SEQ ID NO: 36504 - protein, 202 aa, Homo sapiens
  Payload ID: 7226
  Gene Symbol: GH2
  Gene Name: growth hormone 2
  Uniprot ID: P01242
  ENSP ID: ENSP00000410618
MAAGSRTSLLLAFGLLCLSWLQEGSAFPTIPLSRLFDNAMLRARRLYQLAYDTYQEFNPQTSLCFSESIPTPSNRVKTQQKSNLELLRISLLLIQSWLEPVQLLRSVFANSLVYGASDSNVYRHLKDLEEGIQTLMWRLEDGSPRTGQIFNQSYSKFDTKSHNDDALLKNYGLLYCFRKDMDKVETFLRIVQCRSVEGSCGF

SEQ ID NO: 36505 - protein, 177 aa, Homo sapiens
  Payload ID: 7226
  Gene Symbol: GH2
  Gene Name: growth hormone 2
  ENSP ID: ENSP00000481086
MAAGSRTSLLLAFGLLCLSWLQEGSAFPTIPLSRLFDNAMLRARRLYQLAYDTYQEFNLELLRISLLLIQSWLEPVQLLRSVFANSLVYGASDSNVYRHLKDLEEGIQTLMWRLEDGSPRTGQIFNQSYSKFDTKSHNDDALLKNYGLLYCFRKDMDKVETFLRIVQCRSVEGSCGF

SEQ ID NO: 36506 - protein, 345 aa, Homo sapiens
  Payload ID: 7227
  Gene Symbol: GHITM
  Gene Name: growth hormone inducible transmembrane protein
  Uniprot ID: Q9H3K2
  ENSP ID: ENSP00000361207
MLAARLVCLRTLPSRVFHPAFTKASPVVKNSITKNQWLLTPSREYATKTRIGIRRGRTGQELKEAALEPSMEKIFKIDQMGRWFVAGGAAVGLGALCYYGLGLSNEIGAIEKAVIWPQYVKDRIHSTYMYLAGSIGLTALSAIAISRTPVLMNFMMRGSWVTIGVTFAAMVGAGMLVRSIPYDQSPGPKHLAWLLHSGVMGAVVAPLTILGGPLLIRAAWYTAGIVGGLSTVAMCAPSEKFLNMGAPLGVGLGLVFVSSLGSMFLPPTTVAGATLYSVAMYGGLVLFSMFLLYDTQKVIKRAEVSPMYGVQKYDPINSMLSIYMDTLNIFMRVATMLATGGNRKK

SEQ ID NO: 36507 - protein, 319 aa, Homo sapiens
  Payload ID: 7227
  Gene Symbol: GHITM
  Gene Name: growth hormone inducible transmembrane protein
  ENSP ID: ENSP00000482834
MLAARLVCLRTLPSRVFHPAFTKASPVVKNSITKNQWLLTPSREYATKTRIGIRRGRTGQELKEAALEPSMEKIFKIDQMGRWFVAGGAAVGLGALCYYGLGLSNEIGAIEKAVIWPQYVKDRIHSTYMYLAGSIGLTALSAIAISRTPVLMNFMMRGSWVTIGVTFAAMVGAGMLVRSIPYDQSPGPKHLAWLLHSGVMGAVVAPLTILGGPLLIRAAWYTAGIVGGLSTVAMCAPSEKFLNMGAPLGVGLGLVFVSSLGSMFLPPTTVAGATLYSVAMYGGLVLFSMFLLYDTQKVSSVQKYHQCMEFKNMIPLTRC

SEQ ID NO: 36508 - protein, 638 aa, Homo sapiens
  Payload ID: 7228
  Gene Symbol: GHR
  Gene Name: growth hormone receptor
  Uniprot ID: P10912
  ENSP ID: ENSP00000230882
MDLWQLLLTLALAGSSDAFSGSEATAAILSRAPWSLQSVNPGLKTNSSKEPKFTKCRSPERETFSCHWTDEVHHGTKNLGPIQLFYTRRNTQEWTQEWKECPDYVSAGENSCYFNSSFTSIWIPYCIKLTSNGGTVDEKCFSVDEIVQPDPPIALNWTLLNVSLTGIHADIQVRWEAPRNADIQKGWMVLEYELQYKEVNETKWKMMDPILTTSVPVYSLKVDKEYEVRVRSKQRNSGNYGEFSEVLYVTLPQMSQFTCEEDFYFPWLLIIIFGIFGLTVMLFVFLFSKQQRIKMLILPPVPVPKIKGIDPDLLKEGKLEEVNTILAIHDSYKPEFHSDDSWVEFIELDIDEPDEKTEESDTDRLLSSDHEKSHSNLGVKDGDSGRTSCCEPDILETDFNANDIHEGTSEVAQPQRLKGEADLLCLDQKNQNNSPYHDACPATQQPSVIQAEKNKPQPLPTEGAESTHQAAHIQLSNPSSLSNIDFYAQVSDITPAGSVVLSPGQKNKAGMSQCDMHPEMVSLCQENFLMDNAYFCEADAKKCIPVAPHIKVESHIQPSLNQEDIYITTESLTTAAGRPGTGEHVPGSEMPVPDYTSIHIVQSPQGLILNATALPLPDKEFLSSCGYVSTDQLNKIMP

SEQ ID NO: 36509 - protein, 616 aa, Homo sapiens
  Payload ID: 7228
  Gene Symbol: GHR
  Gene Name: growth hormone receptor
  Uniprot ID: P10912
  ENSP ID: ENSP00000350335
MDLWQLLLTLALAGSSDAFSGSEDSSKEPKFTKCRSPERETFSCHWTDEVHHGTKNLGPIQLFYTRRNTQEWTQEWKECPDYVSAGENSCYFNSSFTSIWIPYCIKLTSNGGTVDEKCFSVDEIVQPDPPIALNWTLLNVSLTGIHADIQVRWEAPRNADIQKGWMVLEYELQYKEVNETKWKMMDPILTTSVPVYSLKVDKEYEVRVRSKQRNSGNYGEFSEVLYVTLPQMSQFTCEEDFYFPWLLIIIFGIFGLTVMLFVFLFSKQQRIKMLILPPVPVPKIKGIDPDLLKEGKLEEVNTILAIHDSYKPEFHSDDSWVEFIELDIDEPDEKTEESDTDRLLSSDHEKSHSNLGVKDGDSGRTSCCEPDILETDFNANDIHEGTSEVAQPQRLKGEADLLCLDQKNQNNSPYHDACPATQQPSVIQAEKNKPQPLPTEGAESTHQAAHIQLSNPSSLSNIDFYAQVSDITPAGSVVLSPGQKNKAGMSQCDMHPEMVSLCQENFLMDNAYFCEADAKKCIPVAPHIKVESHIQPSLNQEDIYITTESLTTAAGRPGTGEHVPGSEMPVPDYTSIHIVQSPQGLILNATALPLPDKEFLSSCGYVSTDQLNKIMP

SEQ ID NO: 36510 - protein, 85 aa, Homo sapiens
  Payload ID: 7228
  Gene Symbol: GHR
  Gene Name: growth hormone receptor
  ENSP ID: ENSP00000422333
MDLWQLLLTLALAGSSDAFSGSEATAAILSRAPWSLQSVNPGLKTRTLKNGLKNGKNALIMFLLGKTAVTLIHRLPPSGYLIVSS

SEQ ID NO: 36511 - protein, 62 aa, Homo sapiens
  Payload ID: 7228
  Gene Symbol: GHR
  Gene Name: growth hormone receptor
  ENSP ID: ENSP00000426739
MDLWQLLLTLALAGSSDAFSGSEATAAILSRAPWSLQSVNPGLKTRWGPCSHIKKMESYMQA

SEQ ID NO: 36512 - protein, 638 aa, Homo sapiens; identical to SEQ ID NO: 36508
  Payload ID: 7228
  Gene Symbol: GHR
  Gene Name: growth hormone receptor
  Uniprot ID: P10912
  ENSP ID: ENSP00000442206

SEQ ID NO: 36513 - protein, 638 aa, Homo sapiens; identical to SEQ ID NO: 36508
  Payload ID: 7228
  Gene Symbol: GHR
  Gene Name: growth hormone receptor
  Uniprot ID: P10912
  ENSP ID: ENSP00000478291

SEQ ID NO: 36514 - protein, 638 aa, Homo sapiens; identical to SEQ ID NO: 36508
  Payload ID: 7228
  Gene Symbol: GHR
  Gene Name: growth hormone receptor
  Uniprot ID: P10912
  ENSP ID: ENSP00000478332

SEQ ID NO: 36515 - protein, 638 aa, Homo sapiens; identical to SEQ ID NO: 36508
  Payload ID: 7228
  Gene Symbol: GHR
  Gene Name: growth hormone receptor
  Uniprot ID: P10912
  ENSP ID: ENSP00000479846

SEQ ID NO: 36516 - protein, 638 aa, Homo sapiens; identical to SEQ ID NO: 36508
  Payload ID: 7228
  Gene Symbol: GHR
  Gene Name: growth hormone receptor
  Uniprot ID: P10912
  ENSP ID: ENSP00000482373

SEQ ID NO: 36517 - protein, 645 aa, Homo sapiens
  Payload ID: 7228
  Gene Symbol: GHR
  Gene Name: growth hormone receptor
  ENSP ID: ENSP00000483403
MNWGPTGMDLWQLLLTLALAGSSDAFSGSEATAAILSRAPWSLQSVNPGLKTNSSKEPKFTKCRSPERETFSCHWTDEVHHGTKNLGPIQLFYTRRNTQEWTQEWKECPDYVSAGENSCYFNSSFTSIWIPYCIKLTSNGGTVDEKCFSVDEIVQPDPPIALNWTLLNVSLTGIHADIQVRWEAPRNADIQKGWMVLEYELQYKEVNETKWKMMDPILTTSVPVYSLKVDKEYEVRVRSKQRNSGNYGEFSEVLYVTLPQMSQFTCEEDFYFPWLLIIIFGIFGLTVMLFVFLFSKQQRIKMLILPPVPVPKIKGIDPDLLKEGKLEEVNTILAIHDSYKPEFHSDDSWVEFIELDIDEPDEKTEESDTDRLLSSDHEKSHSNLGVKDGDSGRTSCCEPDILETDFNANDIHEGTSEVAQPQRLKGEADLLCLDQKNQNNSPYHDACPATQQPSVIQAEKNKPQPLPTEGAESTHQAAHIQLSNPSSLSNIDFYAQVSDITPAGSVVLSPGQKNKAGMSQCDMHPEMVSLCQENFLMDNAYFCEADAKKCIPVAPHIKVESHIQPSLNQEDIYITTESLTTAAGRPGTGEHVPGSEMPVPDYTSIHIVQSPQGLILNATALPLPDKEFLSSCGYVSTDQLNKIMP

SEQ ID NO: 36518 - protein, 295 aa, Homo sapiens
  Payload ID: 7228
  Gene Symbol: GHR
  Gene Name: growth hormone receptor
  ENSP ID: ENSP00000483926
MDLWQLLLTLALAGSSDAFSGSEATAAILSRAPWSLQSVNPGLKTNSSKEPKFTKCRSPERETFSCHWTDEVHHGTKNLGPIQLFYTRRNTQEWTQEWKECPDYVSAGENSCYFNSSFTSIWIPYCIKLTSNGGTVDEKCFSVDEIVQPDPPIALNWTLLNVSLTGIHADIQVRWEAPRNADIQKGWMVLEYELQYKEVNETKWKMMDPILTTSVPVYSLKVDKEYEVRVRSKQRNSGNYGEFSEVLYVTLPQMSQFTCEEDFYFPWLLIIIFGIFGLTVMLFVFLFSKQQRKEN

SEQ ID NO: 36519 - protein, 266 aa, Homo sapiens
  Payload ID: 7229
  Gene Symbol: GRTP1
  Gene Name: growth hormone regulated TBC protein 1
  Uniprot ID: Q5TC63
  ENSP ID: ENSP00000321850
MVLSGAQAQMDQNPGYYHQLLQGERNPRLEDAIRTDLNRTFPDNVKFRKTTDPCLQRTLYNVLLAYGHHNQGVGYCQGMNFIAGYLILITNNEEESFWLLDALVGRILPDYYSPAMLGLKTDQEVLGELVRAKLPAVGALMERLGVLWTLLVSRWFICLFVDILPVETVLRIWDCLFNEGSKIIFRVALTLIKQHQELILEATSVPDICDKFKQITKGSFVMECHTFMQVCGAARGSVPSQGAPPHLQPGGCSDHPEGAQDGHQWA

SEQ ID NO: 36520 - protein, 344 aa, Homo sapiens
  Payload ID: 7229
  Gene Symbol: GRTP1
  Gene Name: growth hormone regulated TBC protein 1
  Uniprot ID: Q5TC63
  ENSP ID: ENSP00000364579
MQPAERSRVPRIDPYGFERPEDFDDAAYEKFFSSYLVTLTRRAIKWSRLLQGGGVPRSRTVKRYVRKGVPLEHRARVWMVLSGAQAQMDQNPGYYHQLLQGERNPRLEDAIRTDLNRTFPDNVKFRKTTDPCLQRTLYNVLLAYGHHNQGVGYCQGMNFIAGYLILITNNEEESFWLLDALVGRILPDYYSPAMLGLKTDQEVLGELVRAKLPAVGALMERLGVLWTLLVSRWFICLFVDILPVETVLRIWDCLFNEGSKIIFRVALTLIKQHQELILEATSVPDICDKFKQITKGSFVMECHTFMQVCGAARGSVPSQGAPPHLQPGGCSDHPEGAQDGHQWA

SEQ ID NO: 36521 - protein, 336 aa, Homo sapiens
  Payload ID: 7229
  Gene Symbol: GRTP1
  Gene Name: growth hormone regulated TBC protein 1
  Uniprot ID: Q5TC63
  ENSP ID: ENSP00000364580
MQPAERSRVPRIDPYGFERPEDFDDAAYEKFFSSYLVTLTRRAIKWSRLLQGGGVPRSRTVKRYVRKGVPLEHRARVWMVLSGAQAQMDQNPGYYHQLLQGERNPRLEDAIRTDLNRTFPDNVKFRKTTDPCLQRTLYNVLLAYGHHNQGVGYCQGMNFIAGYLILITNNEEESFWLLDALVGRILPDYYSPAMLGLKTDQEVLGELVRAKLPAVGALMERLGVLWTLLVSRWFICLFVDILPVETVLRIWDCLFNEGSKIIFRVALTLIKQHQELILEATSVPDICDKFKQITKGSFVMECHTFMQKIFSEPGSLSMATVAKLRESCRARLLAQG

SEQ ID NO: 36522 - protein, 236 aa, Homo sapiens
  Payload ID: 7229
  Gene Symbol: GRTP1
  Gene Name: growth hormone regulated TBC protein 1
  ENSP ID: ENSP00000483734
MQPAERSRVPRIDPYGFERPEDFDDAAYEKFFSSYLVTLTRRAIKWSRLLQGGGVPRSRTVKRYVRKGVPLEHRARVWMVLSGAQAQMDQNPGYYHQLLQGERNPRLEDAIRTDLNRTFPDNVKFRKTTDPCLQRTLYNVLLAYGHHNQGVGYCQGMNFIAGYLILITNNEEESFWLLDALVGRILPENIFRTWKLIHGHRRQAPRELQGPAAGTGVSVPVPCVARLYTDDAPFQS

SEQ ID NO: 36523 - protein, 108 aa, Homo sapiens
  Payload ID: 7230
  Gene Symbol: GHRH
  Gene Name: growth hormone releasing hormone
  Uniprot ID: P01286
  ENSP ID: ENSP00000237527
MPLWVFFFVILTLSNSSHCSPPPPLTLRMRRYADAIFTNSYRKVLGQLSARKLLQDIMSRQQGESNQERGARARLGRQVDSMWAEQKQMELESILVALLQKHSRNSQG

SEQ ID NO: 36524 - protein, 107 aa, Homo sapiens
  Payload ID: 7230
  Gene Symbol: GHRH
  Gene Name: growth hormone releasing hormone
  Uniprot ID: P01286
  ENSP ID: ENSP00000362713
MPLWVFFFVILTLSNSSHCSPPPPLTLRMRRYADAIFTNSYRKVLGQLSARKLLQDIMSRQQGESNQERGARARLGRQVDSMWAEQKQMELESILVALLQKHRNSQG

SEQ ID NO: 36525 - protein, 108 aa, Homo sapiens; identical to SEQ ID NO: 36523
  Payload ID: 7230
  Gene Symbol: GHRH
  Gene Name: growth hormone releasing hormone
  Uniprot ID: P01286
  ENSP ID: ENSP00000362716

SEQ ID NO: 36526 - protein, 423 aa, Homo sapiens
  Payload ID: 7231
  Gene Symbol: GHRHR
  Gene Name: growth hormone releasing hormone receptor
  Uniprot ID: Q02643
  ENSP ID: ENSP00000320180
MDRRMWGAHVFCVLSPLPTVLGHMHPECDFITQLREDESACLQAAEEMPNTTLGCPATWDGLLCWPTAGSGEWVTLPCPDFFSHFSSESGAVKRDCTITGWSEPFPPYPVACPVPLELLAEEESYFSTVKIIYTVGHSISIVALFVAITILVALRRLHCPRNYVHTQLFTTFILKAGAVFLKDAALFHSDDTDHCSFSTVLCKVSVAASHFATMTNFSWLLAEAVYLNCLLASTSPSSRRAFWWLVLAGWGLPVLFTGTWVSCKLAFEDIACWDLDDTSPYWWIIKGPIVLSVGVNFGLFLNIIRILVRKLEPAQGSLHTQSQYWRLSKSTLFLIPLFGIHYIIFNFLPDNAGLGIRLPLELGLGSFQGFIVAILYCFLNQEVRTEISRKWHGHDPELLPAWRTRAKWTTPSRSAAKVLTSMC

SEQ ID NO: 36527 - protein, 68 aa, Homo sapiens
  Payload ID: 7231
  Gene Symbol: GHRHR
  Gene Name: growth hormone releasing hormone receptor
  ENSP ID: ENSP00000338184
MVPGTPSPLLGRGKELWLESLACLPGAVKRDCTITGWSEPFPPYPVACPVPLELLAEEGCPCSSLARG

SEQ ID NO: 36528 - protein, 145 aa, Homo sapiens
  Payload ID: 7231
  Gene Symbol: GHRHR
  Gene Name: growth hormone releasing hormone receptor
  ENSP ID: ENSP00000379529
MVPGTPSPLLGRGKELWLESLACLPGAVKRDCTITGWSEPFPPYPVACPVPLELLAEEESYFSTVKIIYTVGHSISIVALFVAITILVALRRLHCPRNYVHTQLFTTFILKAGAVFLKDAALFHSDDTDHCSFSTGCPCSSLARG

SEQ ID NO: 36529 - protein, 151 aa, Homo sapiens
  Payload ID: 7231
  Gene Symbol: GHRHR
  Gene Name: growth hormone releasing hormone receptor
  ENSP ID: ENSP00000386602
MLPFSTATTLTTAASPLAARALHWHVGELQTGLRGHRVLGPGRHLPLLVDHQRAHCPLGRGELWAFSQYYPHPGEETGASSGQPPYPVSVLASLQVDTFPDPTLWNSLHHLQLPARQCWPGHPPPPGAGTGFLPGLHCCHPLLLPQPRGED

SEQ ID NO: 36530 - protein, 359 aa, Homo sapiens
  Payload ID: 7231
  Gene Symbol: GHRHR
  Gene Name: growth hormone releasing hormone receptor
  ENSP ID: ENSP00000387113
MVPGTPSPLLGRGKELWLESLACLPGAVKRDCTITGWSEPFPPYPVACPVPLELLAEEESYFSTVKIIYTVGHSISIVALFVAITILVALRRLHCPRNYVHTQLFTTFILKAGAVFLKDAALFHSDDTDHCSFSTVLCKVSVAASHFATMTNFSWLLAEAVYLNCLLASTSPSSRRAFWWLVLAGWGLPVLFTGTWVSCKLAFEDIACWDLDDTSPYWWIIKGPIVLSVGVNFGLFLNIIRILVRKLEPAQGSLHTQSQYWRLSKSTLFLIPLFGIHYIIFNFLPDNAGLGIRLPLELGLGSFQGFIVAILYCFLNQEVRTEISRKWHGHDPELLPAWRTRAKWTTPSRSAAKVLTSMC

SEQ ID NO: 36531 - protein, 207 aa, Homo sapiens
  Payload ID: 7231
  Gene Symbol: GHRHR
  Gene Name: growth hormone releasing hormone receptor
  ENSP ID: ENSP00000480159
MAMGEGAGQVGERGGSMQGLCGRLPFRHHDQLQLAVGRSRLPELPPGLHLPQLKESLLVAGSRWLGAARALHWHVGELQTGLRGHRVLGPGRHLPLLVDHQRAHCPLGRGELWAFSQYYPHPGEETGASSGQPPYPVSVLASLQVDTFPDPTLWNSLHHLQLPARQCWPGHPPPPGAGTGFLPGIRRLGLRCRFLGRSFDCQPPRGS

SEQ ID NO: 36532 - protein, 366 aa, Homo sapiens
  Payload ID: 7232
  Gene Symbol: GHSR
  Gene Name: growth hormone secretagogue receptor
  Uniprot ID: Q92847
  ENSP ID: ENSP00000241256
MWNATPSEEPGFNLTLADLDWDASPGNDSLGDELLQLFPAPLLAGVTATCVALFVVGIAGNLLTMLVVSRFRELRTTTNLYLSSMAFSDLLIFLCMPLDLVRLWQYRPWNFGDLLCKLFQFVSESCTYATVLTITALSVERYFAICFPLRAKVVVTKGRVKLVIFVIWAVAFCSAGPIFVLVGVEHENGTDPWDTNECRPTEFAVRSGLLTVMVWVSSIFFFLPVFCLTVLYSLIGRKLWRRRRGDAVVGASLRDQNHKQTVKMLAVVVFAFILCWLPFHVGRYLFSKSFEPGSLEIAQISQYCNLVSFVLFYLSAAINPILYNIMSKKYRVAVFRLLGFEPFSQRKLSTLKDESSRAWTESSINT

SEQ ID NO: 36533 - protein, 289 aa, Homo sapiens
  Payload ID: 7232
  Gene Symbol: GHSR
  Gene Name: growth hormone secretagogue receptor
  Uniprot ID: Q92847
  ENSP ID: ENSP00000395344
MWNATPSEEPGFNLTLADLDWDASPGNDSLGDELLQLFPAPLLAGVTATCVALFVVGIAGNLLTMLVVSRFRELRTTTNLYLSSMAFSDLLIFLCMPLDLVRLWQYRPWNFGDLLCKLFQFVSESCTYATVLTITALSVERYFAICFPLRAKVVVTKGRVKLVIFVIWAVAFCSAGPIFVLVGVEHENGTDPWDTNECRPTEFAVRSGLLTVMVWVSSIFFFLPVFCLTVLYSLIGRKLWRRRRGDAVVGASLRDQNHKQTVKMLGGSQRALRLSLAGPILSLCLLPSL

SEQ ID NO: 36534 - protein, 1949 aa, Homo sapiens
  Payload ID: 7233
  Gene Symbol: GREB1
  Gene Name: growth regulation by estrogen in breast cancer 1
  Uniprot ID: Q4ZG55
  ENSP ID: ENSP00000234142
MGNSYAGQLKTTRFEEVLHNSIEASLRSNNLVPRPIFSQLYLEAEQQLAALEGGSRVDNEEEEEEGEGGLETNGPPNPFQLHPLPEGCCTTDGFCQAGKDLRLVSISNEPMDVPAGFLLVGVKSPSLPDHLLVCAVDKRFLPDDNGHNALLGFSGNCVGCGKKGFCYFTEFSNHINLKLTTQPKKQKHLKYYLVRNAQGTLTKGPLICWKGSEFRSRQIPASTCSSSLFPALESTAAFPSEPVPGTNPSILMGAQQAGPASDHPSLNAAMGPAVFNGKDSPKCQQLAKNNLLALPRPSALGILSNSGPPKKRHKGWSPESPSAPDGGCPQGGGNRAKYESAGMSCVPQVGLVGPASVTFPVVASGEPVSVPDNLLKICKAKPVIFKGHGNFPYLCGNLNDVVVSPLLYTCYQNSQSVSRAYEQYGASAIQPISEEMQLLLTVYYLVQLAADQVPLMEDLEQIFLRSWRESHLTEIRQYQQAPPQPFPPAPSAAAPVTSAQLPWLASLAASSCNDSVHVIECAYSLAEGLSEMFRLLVEGKLAKTNYVVIICACRSAAIDSCIAVTGKYQARILSESLLTPAEYQKEVNYELVTGKVDSLGAFFSTLCPEGDIDILLDKFHQENQGHISSSLAASSVTKAASLDVSGTPVCTSYNLEPHSIRPFQLAVAQKLLSHVCSIADSSTQNLDLGSFEKVDFLICIPPSEVTYQQTLLHVWHSGVLLELGLKKEHMTKQRVEQYVLKLDTEAQTKFKAFLQNSFQNPHTLFVLIHDHAHWDLVSSTVHNLYSQSDPSVGLVDRLLNCREVKEAPNIVTLHVTSFPYALQTQHTLISPYNEIHWPASCSNGVDLYHENKKYFGLSEFIESTLSGHSLPLLRYDSSFEAMVTALGKRFPRLHSAVIRTFVLVQHYAAALMAVSGLPQMKNYTSVETLEITQNLLNSPKQCPCGHGLMVLLRVPCSPLAVVAYERLAHVRARLALEEHFEIILGSPSSGVTVGKHFVKQLRMWQKIEDVEWRPQTYLELEGLPCILIFSGMDPHGESLPRSLRYCDLRLINSSCLVRTALEQELGLAAYFVSNEVPLEKGARNEALESDAEKLSSTDNEDEELGTEGSTSEKRSPMKRERSRSHDSASSSLSSKASGSALGGESSAQPTALPQGEHARSPQPRGPAEEGRAPGEKQRPRASQGPPSAISRHSPGPTPQPDCSLRTGQRSVQVSVTSSCSQLSSSSGSSSSSVAPAAGTWVLQASQCSLTKACRQPPIVFLPKLVYDMVVSTDSSGLPKAASLLPSPSVMWASSFRPLLSKTMTSTEQSLYYRQWTVPRPSHMDYGNRAEGRVDGFHPRRLLLSGPPQIGKTGAYLQFLSVLSRMLVRLTEVDVYDEEEININLREESDWHYLQLSDPWPDLELFKKLPFDYIIHDPKYEDASLICSHYQGIKSEDRGMSRKPEDLYVRRQTARMRLSKYAAYNTYHHCEQCHQYMGFHPRYQLYESTLHAFAFSYSMLGEEIQLHFIIPKSKEHHFVFSQPGGQLESMRLPLVTDKSHEYIKSPTFTPTTGRHEHGLFNLYHAMDGASHLHVLVVKEYEMAIYKKYWPNHIMLVLPSIFNSAGVGAAHFLIKELSYHNLELERNRQEELGIKPQDIWPFIVISDDSCVMWNVVDVNSAGERSREFSWSERNVSLKHIMQHIEAAPDIMHYALLGLRKWSSKTRASEVQEPFSRCHVHNFIILNVDLTQNVQYNQNRFLCDDVDFNLRVHSAGLLLCRFNRFSVMKKQIVVGGHRSFHITSKVSDNSAAVVPAQYICAPDSKHTFLAAPAQLLLEKFLQHHSHLFFPLSLKNHDHPVLSVDCYLNLGSQISVCYVSSRPHSLNISCSDLLFSGLLLYLCDSFVGASFLKKFHFLKGATLCVICQDRSSLRQTVVRLELEDEWQFRLRDEFQTANAREDRPLFFLTGRHI

SEQ ID NO: 36535 - protein, 409 aa, Homo sapiens
  Payload ID: 7233
  Gene Symbol: GREB1
  Gene Name: growth regulation by estrogen in breast cancer 1
  Uniprot ID: Q4ZG55
  ENSP ID: ENSP00000263834
MGNSYAGQLKTTRFEEVLHNSIEASLRSNNLVPRPIFSQLYLEAEQQLAALEGGSRVDNEEEEEEGEGGLETNGPPNPFQLHPLPEGCCTTDGFCQAGKDLRLVSISNEPMDVPAGFLLVGVKSPSLPDHLLVCAVDKRFLPDDNGHNALLGFSGNCVGCGKKGFCYFTEFSNHINLKLTTQPKKQKHLKYYLVRNAQGTLTKGPLICWKGSEFRSRQIPASTCSSSLFPALESTAAFPSEPVPGTNPSILMGAQQAGPASDHPSLNAAMGPAVFNGKDSPKCQQLAKNNLLALPRPSALGILSNSGPPKKRHKGWSPESPSAPDGGCPQGGGNRAKYESAGMSCVPQVGLVGPASVTFPVVASGEPVSVPDNLLKICKAKPVIFKVFVNGATQMVALGPAEPASPRSL

SEQ ID NO: 36536 - protein, 457 aa, Homo sapiens
  Payload ID: 7233
  Gene Symbol: GREB1
  Gene Name: growth regulation by estrogen in breast cancer 1
  Uniprot ID: Q4ZG55
  ENSP ID: ENSP00000370892
MGNSYAGQLKTTRFEEVLHNSIEASLRSNNLVPRPIFSQLYLEAEQQLAALEGGSRVDNEEEEEEGEGGLETNGPPNPFQLHPLPEGCCTTDGFCQAGKDLRLVSISNEPMDVPAGFLLVGVKSPSLPDHLLVCAVDKRFLPDDNGHNALLGFSGNCVGCGKKGFCYFTEFSNHINLKLTTQPKKQKHLKYYLVRNAQGTLTKGPLICWKGSEFRSRQIPASTCSSSLFPALESTAAFPSEPVPGTNPSILMGAQQAGPASDHPSLNAAMGPAVFNGKDSPKCQQLAKNNLLALPRPSALGILSNSGPPKKRHKGWSPESPSAPDGGCPQGGGNRAKYESAGMSCVPQVGLVGPASVTFPVVASGEPVSVPDNLLKICKAKPVIFKGHGNFPYLCGNLNDVVVSPLLYTCYQNSQSVSRAYEQYGASAIQPISEEMQLLLTVYYLVQLAHQIRNPDV

SEQ ID NO: 36537 - protein, 1949 aa, Homo sapiens; identical to SEQ ID NO: 36534
  Payload ID: 7233
  Gene Symbol: GREB1
  Gene Name: growth regulation by estrogen in breast cancer 1
  Uniprot ID: Q4ZG55
  ENSP ID: ENSP00000370896

SEQ ID NO: 36538 - protein, 253 aa, Homo sapiens
  Payload ID: 7233
  Gene Symbol: GREB1
  Gene Name: growth regulation by estrogen in breast cancer 1
  ENSP ID: ENSP00000374475
MDVPAGFLLVGVKSPSLPDHLLVCAVDKRFLPDDNGHNALLGFSGNCVGCGKKGFCYFTEFSNHINLKLTTQPKKQKHLKYYLVRNAQGTLTKGPLICWKGSEFRSRQIPASTCSSSLFPALESTAAFPSEPVPGTNPSILMGAQQAGPASDHPSLNAAMGPAVFNGKDSPKCQQLAKNNLLALPRPSALGSSACPGRPGDPALLWAKARGGMGAAGLGPLSLLESDVASMRVRPGPQVPPESVGLGPGPGAL

SEQ ID NO: 36539 - protein, 947 aa, Homo sapiens
  Payload ID: 7233
  Gene Symbol: GREB1
  Gene Name: growth regulation by estrogen in breast cancer 1
  Uniprot ID: Q4ZG55
  ENSP ID: ENSP00000379429
MWQKIEDVEWRPQTYLELEGLPCILIFSGMDPHGESLPRSLRYCDLRLINSSCLVRTALEQELGLAAYFVSNEVPLEKGARNEALESDAEKLSSTDNEDEELGTEGSTSEKRSPMKRERSRSHDSASSSLSSKASGSALGGESSAQPTALPQGEHARSPQPRGPAEEGRAPGEKQRPRASQGPPSAISRHSPGPTPQPDCSLRTGQRSVQVSVTSSCSQLSSSSGSSSSSVAPAAGTWVLQASQCSLTKACRQPPIVFLPKLVYDMVVSTDSSGLPKAASLLPSPSVMWASSFRPLLSKTMTSTEQSLYYRQWTVPRPSHMDYGNRAEGRVDGFHPRRLLLSGPPQIGKTGAYLQFLSVLSRMLVRLTEVDVYDEEEININLREESDWHYLQLSDPWPDLELFKKLPFDYIIHDPKYEDASLICSHYQGIKSEDRGMSRKPEDLYVRRQTARMRLSKYAAYNTYHHCEQCHQYMGFHPRYQLYESTLHAFAFSYSMLGEEIQLHFIIPKSKEHHFVFSQPGGQLESMRLPLVTDKSHEYIKSPTFTPTTGRHEHGLFNLYHAMDGASHLHVLVVKEYEMAIYKKYWPNHIMLVLPSIFNSAGVGAAHFLIKELSYHNLELERNRQEELGIKPQDIWPFIVISDDSCVMWNVVDVNSAGERSREFSWSERNVSLKHIMQHIEAAPDIMHYALLGLRKWSSKTRASEVQEPFSRCHVHNFIILNVDLTQNVQYNQNRFLCDDVDFNLRVHSAGLLLCRFNRFSVMKKQIVVGGHRSFHITSKVSDNSAAVVPAQYICAPDSKHTFLAAPAQLLLEKFLQHHSHLFFPLSLKNHDHPVLSVDCYLNLGSQISVCYVSSRPHSLNISCSDLLFSGLLLYLCDSFVGASFLKKFHFLKGATLCVICQDRSSLRQTVVRLELEDEWQFRLRDEFQTANAREDRPLFFLTGRHI

SEQ ID NO: 36540 - protein, 541 aa, Homo sapiens
  Payload ID: 7233
  Gene Symbol: GREB1
  Gene Name: growth regulation by estrogen in breast cancer 1
  ENSP ID: ENSP00000403886
MYGTVSCAQDWVPSRCCSSAGHGNFPYLCGNLNDVVVSPLLYTCYQNSQSVSRAYEQYGASAIQPISEEMQLLLTVYYLVQLAADQVPLMEDLEQIFLRSWRESHLTEIRQYQQAPPQPFPPAPSAAAPVTSAQLPWLASLAASSCNDSVHVIECAYSLAEGLSEMFRLLVEGKLAKTNYVVIICACRSAAIDSCIAVTGKYQARILSESLLTPAEYQKEVNYELVTGKVDSLGAFFSTLCPEGDIDILLDKFHQENQGHISSSLAASSVTKAASLDVSGTPVCTSYNLEPHSIRPFQLAVAQKLLSHVCSIADSSTQNLDLGSFEKVDFLICIPPSEVTYQQTLLHVWHSGVLLELGLKKEHMTKQRVEQYVLKLDTEAQTKFKAFLQNSFQNPHTLFVLIHDHAHWDLVSSTVHNLYSQSDPSVGLVDRLLNCREVKEAPNIVTLHVTSFPYALQTQHTLISPYNEIHWPASCSNGVDLYHENKKYFGLSEFIESTLSGHSLPLLRYDSSFEAMVTALGKRFPRLHSAVIRTFVLVQHY

SEQ ID NO: 36541 - protein, 79 aa, Homo sapiens
  Payload ID: 7233
  Gene Symbol: GREB1
  Gene Name: growth regulation by estrogen in breast cancer 1
  ENSP ID: ENSP00000487278
MGNSYAGQLKTTRFEEVLHNSIEASLRSNNLVPRPIFSQLYLEAEQQLAALEGGSRVDNEEEEEEGEGGLETNGPPNPF

SEQ ID NO: 36542 - protein, 1814 aa, Homo sapiens
  Payload ID: 7234
  Gene Symbol: GREB1L
  Gene Name: growth regulation by estrogen in breast cancer-like
  Uniprot ID: Q9C091
  ENSP ID: ENSP00000269218
MGNSYAGQLKSARFEEALHNSIEASLRCSSVVPRPIFSQLYLDPDQHPFSSADVKPKVEDLDKDLVNRYTQNGSLDFSNNLTVNEMEDDEDDEEMSDSNSPPIPYSQKPAPEGSCTTDGFCQAGKDLRLVSLCMEQIDIPAGFLLVGAKSPNLPEHILVCAVDKRFLPDDHGKNALLGFSGNCIGCGERGFRYFTEFSNHINLKLTTQPKKQKHLKYYLVRSSQGVLSKGPLICWKECRSRQSSASCHSIKPSSSVSSTVTPENGTTNGYKSGFTQTDAANGNSSHGGKGSASSSTPAHTGNYSLSPRPSYASGDQATMFISGPPKKRHRGWYPGSPLPQPGLVVPVPTVRPLSRTEPLLSAPVPQTPLTGILQPRPIPAGETVIVPENLLSNSGVRPVILIGYGTLPYFYGNVGDIVVSPLLVNCYKIPQLENKDLEKLGLTGSQFLSVENMILLTIQYLVRLGQHQSRALAESMLTTSEFLKEISYELITGKVSFLASHFKTTSLGDDLDKLLEKMQQRRGDSVVTPFDGDLNECVSPQEAAAMIPTQNLDLDNETFHIYQPQLTVARKLLSQVCAIADSGSQSLDLGHFSKVDFIIIVPRSEVLVQQTLQRIRQSGVLVDLGLEENGTAHQRAEKYVVRLDNEIQTKFEVFMRRVKQNPYTLFVLVHDNSHVELTSVISGSLSHSEPSHGLADRVINCREVLEAFNLLVLQVSSFPYTLQTQQSRISSSNEVHWIQLDTGEDVGCEEKLYFGLSEYSKSLQWGITSPLLRCDETFEKMVNTLLERYPRLHSMVVRCYLLIQQYSEALMALTTMASLRDHSTPETLSIMDDLISSPGKNKSGRGHMLIIRVPSVQLAMLAKERLQEVRDKLGLQYRFEIILGNPATELSVATHFVARLKSWRGNEPEEWIPRTYQDLDGLPCIVILTGKDPLGETFPRSLKYCDLRLIDSSYLTRTALEQEVGLACCYVSKEVIRGPTVALDLSGKEQERAAVSENDSDELLIDLERPQSNSSAVTGTSGSIMENGVSSSSTADKSQKQSLTPSFQSPATSLGLDEGVSASSAGAGAGETLKQECDSLGPQMASSTTSKPSSSSSGPRTLPWPGQPIRGCRGPQAALPPVVILSKAAYSLLGSQKSGKLPSSSSLLPHADVAWVSSLRPLLNKDMSSEEQSLYYRQWTLARQHHADYSNQLDPASGTRNFHPRRLLLTGPPQVGKTGSYLQFLRILFRMLIRLLEVDVYDEEEINTDHNESSEVSQSEGEPWPDIESFSKMPFDVSVHDPKYSLMSLVYTEKLAGVKQEVIKESKVEEPRKRETVSIMLTKYAAYNTFHHCEQCRQYMDFTSASQMSDSTLHAFTFSSSMLGEEVQLYFIIPKSKESHFVFSKQGKHLESMRLPLVSDKNLNAVKSPIFTPSSGRHEHGLLNLFHAMEGISHLHLLVVKEYEMPLYRKYWPNHIMLVLPGMFNNAGVGAARFLIKELSYHNLELERNRLEELGIKRQCVWPFIVMMDDSCVLWNIHSVQEPSSQPMEVGVSSKNVSLKTVLQHIEATPKIVHYAILGIQKWSSKLTSQSLKAPFSRCHVHDFILLNTDLTQNVQYDFNRYFCEDADFNLRTNSSGLLICRFNNFSLMKKHVQVGGQRDFIIKPKIMVSESLAPILPLQYICAPDSEHTLLAAPAQFLLEKFLQHASYKLFPKAIHNFRSPVLAIDCYLNIGPEVAICYISSRPHSSNVNCEGVFFSGLLLYLCDSFVGADLKKFKFLKGATLCVICQDRSSLRQTIVRLELEDEWQFRLRDEFQTANSSDDKPLYFLTGRHV

SEQ ID NO: 36543 - protein, 1923 aa, Homo sapiens
  Payload ID: 7234
  Gene Symbol: GREB1L
  Gene Name: growth regulation by estrogen in breast cancer-like
  Uniprot ID: Q9C091
  ENSP ID: ENSP00000412060
MGNSYAGQLKSARFEEALHNSIEASLRCSSVVPRPIFSQLYLDPDQHPFSSADVKPKVEDLDKDLVNRYTQNGSLDFSNNLTVNEMEDDEDDEEMSDSNSPPIPYSQKPAPEGSCTTDGFCQAGKDLRLVSLCMEQIDIPAGFLLVGAKSPNLPEHILVCAVDKRFLPDDHGKNALLGFSGNCIGCGERGFRYFTEFSNHINLKLTTQPKKQKHLKYYLVRSSQGVLSKGPLICWKECRSRQSSASCHSIKPSSSVSSTVTPENGTTNGYKSGFTQTDAANGNSSHGGKGSASSSTPAHTGNYSLSPRPSYASGDQATMFISGPPKKRHRGWYPGSPLPQPGLVVPVPTVRPLSRTEPLLSAPVPQTPLTGILQPRPIPAGETVIVPENLLSNSGVRPVILIGYGTLPYFYGNVGDIVVSPLLVNCYKIPQLENKDLEKLGLTGSQFLSVENMILLTIQYLVRLGPDQVPLREEFEQIMLKAMQEFTLRERALQIGAQCVPVSPGQLPWLARLIASVSQDLVHVVVTQNSLAEGISETLRTLSEMRHYQRLPDYVVVICASKIRGNEFCVVVLGQHQSRALAESMLTTSEFLKEISYELITGKVSFLASHFKTTSLGDDLDKLLEKMQQRRGDSVVTPFDGDLNECVSPQEAAAMIPTQNLDLDNETFHIYQPQLTVARKLLSQVCAIADSGSQSLDLGHFSKVDFIIIVPRSEVLVQQTLQRIRQSGVLVDLGLEENGTAHQRAEKYVVRLDNEIQTKFEVFMRRVKQNPYTLFVLVHDNSHVELTSVISGSLSHSEPSHGLADRVINCREVLEAFNLLVLQVSSFPYTLQTQQSRISSSNEVHWIQLDTGEDVGCEEKLYFGLSEYSKSLQWGITSPLLRCDETFEKMVNTLLERYPRLHSMVVRCYLLIQQYSEALMALTTMASLRDHSTPETLSIMDDLISSPGKNKSGRGHMLIIRVPSVQLAMLAKERLQEVRDKLGLQYRFEIILGNPATELSVATHFVARLKSWRGNEPEEWIPRTYQDLDGLPCIVILTGKDPLGETFPRSLKYCDLRLIDSSYLTRTALEQEVGLACCYVSKEVIRGPTVALDLSGKEQERAAVSENDSDELLIDLERPQSNSSAVTGTSGSIMENGVSSSSTADKSQKQSLTPSFQSPATSLGLDEGVSASSAGAGAGETLKQECDSLGPQMASSTTSKPSSSSSGPRTLPWPGQPIRGCRGPQAALPPVVILSKAAYSLLGSQKSGKLPSSSSLLPHADVAWVSSLRPLLNKDMSSEEQSLYYRQWTLARQHHADYSNQLDPASGTRNFHPRRLLLTGPPQVGKTGSYLQFLRILFRMLIRLLEVDVYDEEEINTDHNESSEVSQSEGEPWPDIESFSKMPFDVSVHDPKYSLMSLVYTEKLAGVKQEVIKESKVEEPRKRETVSIMLTKYAAYNTFHHCEQCRQYMDFTSASQMSDSTLHAFTFSSSMLGEEVQLYFIIPKSKESHFVFSKQGKHLESMRLPLVSDKNLNAVKSPIFTPSSGRHEHGLLNLFHAMEGISHLHLLVVKEYEMPLYRKYWPNHIMLVLPGMFNNAGVGAARFLIKELSYHNLELERNRLEELGIKRQCVWPFIVMMDDSCVLWNIHSVQEPSSQPMEVGVSSKNVSLKTVLQHIEATPKIVHYAILGIQKWSSKLTSQSLKAPFSRCHVHDFILLNTDLTQNVQYDFNRYFCEDADFNLRTNSSGLLICRFNNFSLMKKHVQVGGQRDFIIKPKIMVSESLAPILPLQYICAPDSEHTLLAAPAQFLLEKFLQHASYKLFPKAIHNFRSPVLAIDCYLNIGPEVAICYISSRPHSSNVNCEGVFFSGLLLYLCDSFVGADLKKFKFLKGATLCVICQDRSSLRQTIVRLELEDEWQFRLRDEFQTANSSDDKPLYFLTGRHV

SEQ ID NO: 36544 - protein, 190 aa, Homo sapiens
  Payload ID: 7234
  Gene Symbol: GREB1L
  Gene Name: growth regulation by estrogen in breast cancer-like
  ENSP ID: ENSP00000462152
  MOD_RES (1)..(1): Any amino acid
XRQCVWPFIVMMDDSCVLWNIHSVQEPSSQPMEVGVSSKNVSLKTVLQHIEATPKIVHYAILGIQKWSSKLTSQSLKAPFSRCHVHDFILLNTDLTQNVQYDFNRYFCEDADFNLRTNSSGLLICRFNNFSLMKKHVQVGGQRDFIIKPKIMPSITSGVLCWPLTATLTLDQRWPYAISAPDPTPAMSTV

SEQ ID NO: 36545 - protein, 200 aa, Homo sapiens
  Payload ID: 7234
  Gene Symbol: GREB1L
  Gene Name: growth regulation by estrogen in breast cancer-like
  ENSP ID: ENSP00000463926
  MOD_RES (1)..(1): Any amino acid
XKLTTQPKKQKHLKYYLVRSSQGVLSKGPLICWKECRSRQSSASCHSIKPSSSVSSTVTPENGTTNGYKSGFTQTDSPILSPANSAINLSGAQDLTRNNNVVKPLALSLQVVGKTFAADAANGNSSHGGKGSASSSTPAHTGNYSLSPRPSYASGDQATMFISGPPKKRHRGWYPGSPLPQPGLVVPVPTVRPLSRTEPL

SEQ ID NO: 36546 - protein, 175 aa, Homo sapiens
  Payload ID: 7234
  Gene Symbol: GREB1L
  Gene Name: growth regulation by estrogen in breast cancer-like
  ENSP ID: ENSP00000463976
LPWLARLIASVSQDLVHVVVTQNSLAEGISETLRTLSEMRHYQRLPDYVVVICASKIRGNEFCVVVLGQHQSRALAESMLTTSEFLKEISYELITGKVSFLASHFKTTSLGDDLDKLLEKMQQRRGDSVVTPFDGDLNECVSPQEAAAMIPTQNLGNVISDQEEEVSPWDRHCKN

SEQ ID NO: 36547 - protein, 1923 aa, Homo sapiens; identical to SEQ ID NO: 36543
  Payload ID: 7234
  Gene Symbol: GREB1L
  Gene Name: growth regulation by estrogen in breast cancer-like
  Uniprot ID: Q9C091
  ENSP ID: ENSP00000464162

SEQ ID NO: 36548 - protein, 395 aa, Homo sapiens
  Payload ID: 7235
  Gene Symbol: GRASP
  Gene Name: GRP1 (general receptor for phosphoinositides 1)-associated scaffold protein
  Uniprot ID: Q7Z6J2
  ENSP ID: ENSP00000293662
MTLRRLRKLQQKEEAAATPDPAARTPDSEVAPAAPVPTPGPPAAAATPGPPADELYAALEDYHPAELYRALAVSGGTLPRRKGSGFRWKNLSQSPEQQRKVLTLEKEDNQTFGFEIQTYGLHHREEQRVEMVTFVCRVHESSPAQLAGLTPGDTIASVNGLNVEGIRHREIVDIIKASGNVLRLETLYGTSIRKAELEARLQYLKQTLYEKWGEYRSLMVQEQRLVHGLVVKDPSIYDTLESVRSCLYGAGLLPGSLPFGPLLAVPGRPRGGARRARGDADDAVYHTCFFGDSEPPALPPPPPPARAFGPGPAETPAVGPGPGPRAALSRSASVRCAGPGGGGGGGAPGALWTEAREQALCGPGLRKTKYRSFRRRLLKFIPGLNRSLEEEESQL

SEQ ID NO: 36549 - protein, 221 aa, Homo sapiens
  Payload ID: 7235
  Gene Symbol: GRASP
  Gene Name: GRP1 (general receptor for phosphoinositides 1)-associated scaffold protein
  ENSP ID: ENSP00000448476
MVTFVCRVHESSPAQLAGLTPGDTIASVNGLNVEGIRHREIVDIIKASGNVLRLETLYGTSIRKAELEARLQYLKQTLYEKWGEYRSLMVQEQRLVHGLVVKDPSIYDTLESVRSCLYGAGLLPGSLPFGPLLAVPGRPRGGARRARGDADDAVYHTCFFGDSEPPALPPPPPPARAFGPGPAETPAVGPGPGPRAALSRSASVRCAGPGGGGGGGAPGAL

SEQ ID NO: 36550 - protein, 252 aa, Homo sapiens
  Payload ID: 7235
  Gene Symbol: GRASP
  Gene Name: GRP1 (general receptor for phosphoinositides 1)-associated scaffold protein
  Uniprot ID: Q7Z6J2
  ENSP ID: ENSP00000449492
MTLLPSKGGDTIASVNGLNVEGIRHREIVDIIKASGNVLRLETLYGTSIRKAELEARLQYLKQTLYEKWGEYRSLMVQEQRLVHGLVVKDPSIYDTLESVRSCLYGAGLLPGSLPFGPLLAVPGRPRGGARRARGDADDAVYHTCFFGDSEPPALPPPPPPARAFGPGPAETPAVGPGPGPRAALSRSASVRCAGPGGGGGGGAPGALWTEAREQALCGPGLRKTKYRSFRRRLLKFIPGLNRSLEEEESQL

SEQ ID NO: 36551 - protein, 217 aa, Homo sapiens
  Payload ID: 7236
  Gene Symbol: GRPEL1
  Gene Name: GrpE-like 1, mitochondrial (E. coli)
  Uniprot ID: Q9HAV7
  ENSP ID: ENSP00000264954
MAAQCVRLARRSLPALALSLRPSPRLLCTATKQKNSGQNLEEDMGQSEQKADPPATEKTLLEEKVKLEEQLKETVEKYKRALADTENLRQRSQKLVEEAKLYGIQAFCKDLLEVADVLEKATQCVPKEEIKDDNPHLKNLYEGLVMTEVQIQKVFTKHGLLKLNPVGAKFDPYEHEALFHTPVEGKEPGTVALVSKVGYKLHGRTLRPALVGVVKEA

SEQ ID NO: 36552 - protein, 225 aa, Homo sapiens
  Payload ID: 7237
  Gene Symbol: GRPEL2
  Gene Name: GrpE-like 2, mitochondrial (E. coli)
  Uniprot ID: Q8TAA5
  ENSP ID: ENSP00000329558
MAVRSLWAGRLRVQRLLAWSAAWESKGWPLPFSTATQRTAGEDCRSEDPPDELGPPLAERALRVKAVKLEKEVQDLTVRYQRAIADCENIRRRTQRCVEDAKIFGIQSFCKDLVEVADILEKTTECISEESEPEDQKLTLEKVFRGLLLLEAKLKSVFAKHGLEKLTPIGDKYDPHEHELICHVPAGVGVQPGTVALVRQDGYKLHGRTIRLARVEVAVESQRRL

SEQ ID NO: 36553 - protein, 122 aa, Homo sapiens
  Payload ID: 7237
  Gene Symbol: GRPEL2
  Gene Name: GrpE-like 2, mitochondrial (E. coli)
  Uniprot ID: Q8TAA5
  ENSP ID: ENSP00000397302
MAVRSLWAGRLRVQRLLAWSAAWESKGWPLPFSTATQRTAGEDCRSEDPPDELGPPLAERALRVKAVKLEKEVQDLTESRVSVRTWWRWLTFWRRLQSAFLKNRSLRTKSSLWRRSSEGCCF

SEQ ID NO: 36554 - protein, 128 aa, Homo sapiens
  Payload ID: 7237
  Gene Symbol: GRPEL2
  Gene Name: GrpE-like 2, mitochondrial (E. coli)
  ENSP ID: ENSP00000426331
MAVRSLWAGRLRVQRLLAWSAAWESKGWPLPFSTATQRTAGEDCRSEDPPDELGPPLAERALRVKAVKLEKEVQDLTVRYQRAIADCENIRRRTQRCVEDAKIFGERFIYNKNVFGWAQWLMPVIPAL

SEQ ID NO: 36555 - protein, 264 aa, Homo sapiens
  Payload ID: 7238
  Gene Symbol: GSX1
  Gene Name: GS homeobox 1
  Uniprot ID: Q9H4S2
  ENSP ID: ENSP00000304331
MPRSFLVDSLVLREAGEKKAPEGSPPPLFPYAVPPPHALHGLSPGACHARKAGLLCVCPLCVTASQLHGPPGPPALPLLKASFPPFGSQYCHAPLGRQHSAVSPGVAHGPAAAAAAAALYQTSYPLPDPRQFHCISVDSSSNQLPSSKRMRTAFTSTQLLELEREFASNMYLSRLRRIEIATYLNLSEKQVKIWFQNRRVKHKKEGKGSNHRGGGGGGAGGGGSAPQGCKCASLSSAKCSEDDDELPMSPSSSGKDDRDLTVTP

SEQ ID NO: 36556 - protein, 304 aa, Homo sapiens
  Payload ID: 7239
  Gene Symbol: GSX2
  Gene Name: GS homeobox 2
  Uniprot ID: Q9BZM3
  ENSP ID: ENSP00000319118
MSRSFYVDSLIIKDTSRPAPSLPEPHPGPDFFIPLGMPPPLVMSVSGPGCPSRKSGAFCVCPLCVTSHLHSSRGSVGAGSGGAGAGVTGAGGSGVAGAAGALPLLKGQFSSAPGDAQFCPRVNHAHHHHHPPQHHHHHHQPQQPGSAAAAAAAAAAAAAAAALGHPQHHAPVCTATTYNVADPRRFHCLTMGGSDASQVPNGKRMRTAFTSTQLLELEREFSSNMYLSRLRRIEIATYLNLSEKQVKIWFQNRRVKHKKEGKGTQRNSHAGCKCVGSQVHYARSEDEDSLSPASANDDKEISPL

SEQ ID NO: 36557 - protein, 134 aa, Homo sapiens
  Payload ID: 7239
  Gene Symbol: GSX2
  Gene Name: GS homeobox 2
  ENSP ID: ENSP00000422213
MSRSFYVDSLIIKDTSRPAPSLPEPHPGPDFFIPLGMPPPLVMSVSGPGCPSRKSGAFCVCPLCVTSHLHSSRGSVGAGSGGAGAGVTGAGGSGVAGAAGALPLLKGQFSSAPGDAQFCPREALTPARYPMARG

SEQ ID NO: 36558 - protein, 304 aa, Homo sapiens; identical to SEQ ID NO: 36556
  Payload ID: 7239
  Gene Symbol: GSX2
  Gene Name: GS homeobox 2
  Uniprot ID: Q9BZM3
  ENSP ID: ENSP00000483522

SEQ ID NO: 36559 - protein, 11 aa, Homo sapiens
  Payload ID: 7240
  Gene Symbol:
  Gene Name: GS1-114I9.3
  ENSP ID: ENSP00000456371
  MOD_RES (1)..(1): Any amino acid
XNRSCPEHPSD

SEQ ID NO: 36560 - protein, 126 aa, Homo sapiens
  Payload ID: 7241
  Gene Symbol:
  Gene Name: GS1-259H13.13
  ENSP ID: ENSP00000401282
MEEIPAQEAAGSPRVQFQSLETQSECLSPEPQFVQDTDMEQGLTGVPRASEFLPFFISESPPLAYIGSGATCDADVRGQGHEGILLGHSPSLNLPRLPDYTGGLHLSLLGATDKRGVPRSLFQWPI

SEQ ID NO: 36561 - protein, 26 aa, Homo sapiens
  Payload ID: 7242
  Gene Symbol:
  Gene Name: GS1-393G12.13
  ENSP ID: ENSP00000436572
  MOD_RES (1)..(1): Any amino acid
XLKRAYRGLEEVQWCLEQLLTSPSPS

SEQ ID NO: 36562 - protein, 1217 aa, Homo sapiens
  Payload ID: 7243
  Gene Symbol: GSE1
  Gene Name: Gse1 coiled-coil protein
  Uniprot ID: Q14687
  ENSP ID: ENSP00000253458
MKGMSHEPKSPSLGMLSTATRTTATVNPLTPSPLNGALVPSGSPATSSALSAQAAPSSSFAAALRKLAKQAEEPRGSSLSSESSPVSSPATNHSSPASTPKRVPMGPIIVPPGGHSVPSTPPVVTIAPTKTVNGVWRSESRQDAGSRSSSGGRERLIVEPPLPQEKAGGPAIPSHLLSTPYPFGLSPSSVVQDSRFPPLNLQRPVHHVVPPSTVTEDYLRSFRPYHTTDDLRMSSLPPLGLDPATAAAYYHPSYLAPHPFPHPAFRMDDSYCLSALRSPFYPIPTPGSLPPLHPSAMHLHLSGVRYPPELSHSSLAALHSERMSGLSAERLQMDEELRREREREREREREREADREREKEREREREKEREQEKEREREKERERELERQREQRAREKELLAAKALEPSFLPVAELHGLRGHATEERGKPSEQLTPTRAEKLKDAGLQAPKPVQHPLHPVPTPHHTVPSLISNHGIFSLPSSSAATALLIQRTNEEEKWLARQRRLRQEKEDRQSQVSEFRQQVLEQHLDMGRPPVPAEAEHRPESTTRPGPNRHEPGGRDPPQHFGGPPPLISPKPQLHAAPTALWNPVSLMDNTLETRRAESHSLHSHPAAFEPSRQAAVPLVKVERVFCPEKAEEGPRKREPAPLDKYQPPPPPPREGGSLEHQPFLPGPGPFLAELEKSTQTILGQQRASLPQAATFGELSGPLKPGSPYRPPVPRAPDPAYIYDEFLQQRRRLVSKLDLEERRRREAQEKGYYYDLDDSYDESDEEEVRAHLRCVAEQPPLKLDTSSEKLEFLQLFGLTTQQQKEELVAQKRRKRRRMLRERSPSPPTIQSKRQTPSPRLALSTRYSPDEMNNSPNFEEKKKFLTIFNLTHISAEKRKDKERLVEMLRAMKQKALSAAVADSLTNSPRDSPAVSLSEPATQQASLDVEKPVGVAASLSDIPKAAEPGKLEQVRPQELSRVQELAPASGEKARLSEAPGGKKSLSMLHYIRGAAPKDIPVPLSHSTNGKSKPWEPFVAEEFAHQFHESVLQSTQKALQKHKGSVAVLSAEQNHKVDTSVHYNIPELQSSSRAPPPQHNGQQEPPTARKGPPTQELDRDSEEEEEEDDEDGEDEEEVPKRKWQGIEAVFEAYQEHIEEQNLERQVLQTQCRRLEARHYSLSLTAEQLSHSVAELRSQKQKMVSERERLQAELDHLRKCLALPAMHWPRGYLKGYPR

SEQ ID NO: 36563 - protein, 1144 aa, Homo sapiens
  Payload ID: 7243
  Gene Symbol: GSE1
  Gene Name: Gse1 coiled-coil protein
  Uniprot ID: Q14687
  ENSP ID: ENSP00000376934
MKGSSLSSESSPVSSPATNHSSPASTPKRVPMGPIIVPPGGHSVPSTPPVVTIAPTKTVNGVWRSESRQDAGSRSSSGGRERLIVEPPLPQEKAGGPAIPSHLLSTPYPFGLSPSSVVQDSRFPPLNLQRPVHHVVPPSTVTEDYLRSFRPYHTTDDLRMSSLPPLGLDPATAAAYYHPSYLAPHPFPHPAFRMDDSYCLSALRSPFYPIPTPGSLPPLHPSAMHLHLSGVRYPPELSHSSLAALHSERMSGLSAERLQMDEELRREREREREREREREADREREKEREREREKEREQEKEREREKERERELERQREQRAREKELLAAKALEPSFLPVAELHGLRGHATEERGKPSEQLTPTRAEKLKDAGLQAPKPVQHPLHPVPTPHHTVPSLISNHGIFSLPSSSAATALLIQRTNEEEKWLARQRRLRQEKEDRQSQVSEFRQQVLEQHLDMGRPPVPAEAEHRPESTTRPGPNRHEPGGRDPPQHFGGPPPLISPKPQLHAAPTALWNPVSLMDNTLETRRAESHSLHSHPAAFEPSRQAAVPLVKVERVFCPEKAEEGPRKREPAPLDKYQPPPPPPREGGSLEHQPFLPGPGPFLAELEKSTQTILGQQRASLPQAATFGELSGPLKPGSPYRPPVPRAPDPAYIYDEFLQQRRRLVSKLDLEERRRREAQEKGYYYDLDDSYDESDEEEVRAHLRCVAEQPPLKLDTSSEKLEFLQLFGLTTQQQKEELVAQKRRKRRRMLRERSPSPPTIQSKRQTPSPRLALSTRYSPDEMNNSPNFEEKKKFLTIFNLTHISAEKRKDKERLVEMLRAMKQKALSAAVADSLTNSPRDSPAVSLSEPATQQASLDVEKPVGVAASLSDIPKAAEPGKLEQVRPQELSRVQELAPASGEKARLSEAPGGKKSLSMLHYIRGAAPKDIPVPLSHSTNGKSKPWEPFVAEEFAHQFHESVLQSTQKALQKHKGSVAVLSAEQNHKVDTSVHYNIPELQSSSRAPPPQHNGQQEPPTARKGPPTQELDRDSEEEEEEDDEDGEDEEEVPKRKWQGIEAVFEAYQEHIEEQNLERQVLQTQCRRLEARHYSLSLTAEQLSHSVAELRSQKQKMVSERERLQAELDHLRKCLALPAMHWPRGYLKGYPR

SEQ ID NO: 36564 - protein, 1113 aa, Homo sapiens
  Payload ID: 7243
  Gene Symbol: GSE1
  Gene Name: Gse1 coiled-coil protein
  Uniprot ID: Q14687
  ENSP ID: ENSP00000384839
MGPIIVPPGGHSVPSTPPVVTIAPTKTVNGVWRSESRQDAGSRSSSGGRERLIVEPPLPQEKAGGPAIPSHLLSTPYPFGLSPSSVVQDSRFPPLNLQRPVHHVVPPSTVTEDYLRSFRPYHTTDDLRMSSLPPLGLDPATAAAYYHPSYLAPHPFPHPAFRMDDSYCLSALRSPFYPIPTPGSLPPLHPSAMHLHLSGVRYPPELSHSSLAALHSERMSGLSAERLQMDEELRREREREREREREREADREREKEREREREKEREQEKEREREKERERELERQREQRAREKELLAAKALEPSFLPVAELHGLRGHATEERGKPSEQLTPTRAEKLKDAGLQAPKPVQHPLHPVPTPHHTVPSLISNHGIFSLPSSSAATALLIQRTNEEEKWLARQRRLRQEKEDRQSQVSEFRQQVLEQHLDMGRPPVPAEAEHRPESTTRPGPNRHEPGGRDPPQHFGGPPPLISPKPQLHAAPTALWNPVSLMDNTLETRRAESHSLHSHPAAFEPSRQAAVPLVKVERVFCPEKAEEGPRKREPAPLDKYQPPPPPPREGGSLEHQPFLPGPGPFLAELEKSTQTILGQQRASLPQAATFGELSGPLKPGSPYRPPVPRAPDPAYIYDEFLQQRRRLVSKLDLEERRRREAQEKGYYYDLDDSYDESDEEEVRAHLRCVAEQPPLKLDTSSEKLEFLQLFGLTTQQQKEELVAQKRRKRRRMLRERSPSPPTIQSKRQTPSPRLALSTRYSPDEMNNSPNFEEKKKFLTIFNLTHISAEKRKDKERLVEMLRAMKQKALSAAVADSLTNSPRDSPAVSLSEPATQQASLDVEKPVGVAASLSDIPKAAEPGKLEQVRPQELSRVQELAPASGEKARLSEAPGGKKSLSMLHYIRGAAPKDIPVPLSHSTNGKSKPWEPFVAEEFAHQFHESVLQSTQKALQKHKGSVAVLSAEQNHKVDTSVHYNIPELQSSSRAPPPQHNGQQEPPTARKGPPTQELDRDSEEEEEEDDEDGEDEEEVPKRKWQGIEAVFEAYQEHIEEQNLERQVLQTQCRRLEARHYSLSLTAEQLSHSVAELRSQKQKMVSERERLQAELDHLRKCLALPAMHWPRGYLKGYPR

SEQ ID NO: 36565 - protein, 986 aa, Homo sapiens
  Payload ID: 7243
  Gene Symbol: GSE1
  Gene Name: Gse1 coiled-coil protein
  ENSP ID: ENSP00000402367
  MOD_RES (1)..(1): Any amino acid
XRFPPLNLQRPVHHVVPPSTVTEDYLRSFRPYHTTDDLRMSSLPPLGLDPATAAAYYHPSYLAPHPFPHPAFRMDDSYCLSALRSPFYPIPTPGSLPPLHPSAMHLHLSGVRYPPELSHSSLAALHSERMSGLSAERLQMDEELRREREREREREREREADREREKEREREREKEREQEKEREREKERERELERQREQRAREKELLAAKALEPSFLPVAELHGLRGHATEERGKPSEQLTPTRAEKLKDAGLQAPKPVQHPLHPVPTPHHTVPSLISNHGIFSLPSSSAATALLIQRTNEEEKWLARQRRLRQEKEDRQSQVSEFRQQVLEQHLDMGRPPVPAEAEHRPESTTRPGPNRHEPGGRDPPQHFGGPPPLISPKPQLHAAPTALWNPVSLMDNTLETRRAESHSLHSHPAAFEPSRQAAVPLVKVERVFCPEKAEEGPRKREPAPLDKYQPPPPPPREGGSLEHQPFLPGPGPFLAELEKSTQTILGQQRASLPQAATFGELSGPLKPGSPYRPPVPRAPDPAYIYDEFLQQRRRLVSKLDLEERRRREAQEKGYYYDLDDSYDESDEEEVRAHLRCVAEQPPLKLDTSSEKLEFLQLFGLTTQQQKEELVAQKRRKRRRMLRERSPSPPTIQSKRQTPSPRLALSTRYSPDEMNNSPNFEEKKKFLTIFNLTHISAEKRKEPATQQASLDVEKPVGVAASLSDIPKAAEPGKLEQVRPQELSRVQELAPASGEKARLSEAPGGKKSLSMLHYIRGAAPKDIPVPLSHSTNGKSKPWEPFVAEEFAHQFHESVLQSTQKALQKHKGSVAVLSAEQNHKVDTSVHYNIPELQSSSRAPPPQHNGQQEPPTARKGPPTQELDRDSEEEEEEDDEDGEDEEEVPKRKWQGIEAVFEAYQEHIEEQNLERQVLQTQCRRLEARHYSLSLTAEQLSHSVAELRSQKQKMVSERERLQAELDHLRKCLALPAMHWPRGYLKGYPR

SEQ ID NO: 36566 - protein, 210 aa, Homo sapiens
  Payload ID: 7243
  Gene Symbol: GSE1
  Gene Name: Gse1 coiled-coil protein
  ENSP ID: ENSP00000409006
MGPIIVPPGGHSVPSTPPVVTIAPTKTVNGVWRSESRQDAGSRSSSGGRERLIVEPPLPQEKAGGPAIPSHLLSTPYPFGLSPSSVVQDSRFPPLNLQRPVHHVVPPSTVTEDYLRSFRPYHTTDDLRMSSLPPLGLDPATAAAYYHPSYLAPHPFPHPAFRMDDSYCLSALRSPFYPIPTPGSLPPLHPSAMHLHLSGVRYPPELSHSS

SEQ ID NO: 36567 - protein, 419 aa, Homo sapiens
  Payload ID: 7243
  Gene Symbol: GSE1
  Gene Name: Gse1 coiled-coil protein
  ENSP ID: ENSP00000410812
  MOD_RES (1)..(1): Any amino acid
XGLTTQQQKEELVAQKRRKRRRMLRERSPSPPTIQSKRQTPSPRLALSTRYSPDEMNNSPNFEEKKKFLTIFNLTHISAEKRKDKERLVEMLRAMKQKALSAAVADSLTNSPRDSPAVSLSEPATQQASLDVEKPVGVAASLSDIPKAAEPGKLEQVRPQELSRVQELAPASGEKARLSEAPGGKKSLSMLHYIRGAAPKDIPVPLSHSTNGKSKPWEPFVAEEFAHQFHESVLQSTQKALQKHKGSVAVLSAEQNHKVDTSVHYNIPELQSSSRAPPPQHNGQQEPPTARKGPPTQELDRDSEEEEEEDDEDGEDEEEVPKRKWQGIEAVFEAYQEHIEEQNLERQVLQTQCRRLEARHYSLSLTAEQLSHSVAMGFPHVGQAGLELLTTGDLPASTSKSAGITGVSHHARPGHFQMS

SEQ ID NO: 36568 - protein, 176 aa, Homo sapiens
  Payload ID: 7244
  Gene Symbol: GSG1L
  Gene Name: GSG1-like
  Uniprot ID: Q6UXU4
  ENSP ID: ENSP00000370282
MCLELFHSSNVIDGLKLNAFAAVFTVLSGLLGMVAHMMYTQVFQVTVSLGPEDWRPHSWDYGWSFCLAWGSFTCCMAASVTTLNSYTKTVIEFRHKRKVFEQGYREEPTFIDPEAIKYFRERMEKRDGSEEDFHLDCRHERYPARHQPHMADSWPRSSAQEAPELNRQCWVLGHWV

SEQ ID NO: 36569 - protein, 280 aa, Homo sapiens
  Payload ID: 7244
  Gene Symbol: GSG1L
  Gene Name: GSG1-like
  Uniprot ID: Q6UXU4
  ENSP ID: ENSP00000379074
MKTSRRGRALLAVALNLLALLFATTAFLTTHWCQGTQRVPKPGCGQGGRANCPNSGANATANGTAAPAAAAAAATASGNGPPGGALYSWETGDDRFLFRNFHTGIWYSCEEELSGLGEKCRSFIDLAPASEKGLLGMVAHMMYTQVFQVTVSLGPEDWRPHSWDYGWSFCLAWGSFTCCMAASVTTLNSYTKTVIEFRHKRKVFEQGYREEPTFIDPEAIKYFRERMEKRDGSEEDFHLDCRHERYPARHQPHMADSWPRSSAQEAPELNRQCWVLGHWV

SEQ ID NO: 36570 - protein, 331 aa, Homo sapiens
  Payload ID: 7244
  Gene Symbol: GSG1L
  Gene Name: GSG1-like
  Uniprot ID: Q6UXU4
  ENSP ID: ENSP00000394954
MKTSRRGRALLAVALNLLALLFATTAFLTTHWCQGTQRVPKPGCGQGGRANCPNSGANATANGTAAPAAAAAAATASGNGPPGGALYSWETGDDRFLFRNFHTGIWYSCEEELSGLGEKCRSFIDLAPASEKGVLWLSVVSEVLYILLLVVGFSLMCLELFHSSNVIDGLKLNAFAAVFTVLSGLLGMVAHMMYTQVFQVTVSLGPEDWRPHSWDYGWSFCLAWGSFTCCMAASVTTLNSYTKTVIEFRHKRKVFEQGYREEPTFIDPEAIKYFRERMEKRDGSEEDFHLDCRHERYPARHQPHMADSWPRSSAQEAPELNRQCWVLGHWV

SEQ ID NO: 36571 - protein, 194 aa, Homo sapiens
  Payload ID: 7244
  Gene Symbol: GSG1L
  Gene Name: GSG1-like
  Uniprot ID: Q6UXU4
  ENSP ID: ENSP00000454880
MCLELFHSSNVIDGLKLNAFAAVFTVLSGLLGMVAHMMYTQVFQVTVSLGPEDWRPHSWDYGWSFCLAWGSFTCCMAASVTTLNSYTKTVIEFRHKRKVFEQGYREEPTFIDPEAIKYFRERWQIEAQRGRATCPRSHSWMEKRDGSEEDFHLDCRHERYPARHQPHMADSWPRSSAQEAPELNRQCWVLGHWV

SEQ ID NO: 36572 - protein, 176 aa, Homo sapiens
  Payload ID: 7244
  Gene Symbol: GSG1L
  Gene Name: GSG1-like
  ENSP ID: ENSP00000454942
  MOD_RES (1)..(1): Any amino acid
XGPPGGALYSWETGDDRFLFRNFHTGIWYSCEEELSGLGEKCRSFIDLAPASEKGVLWLSVVSEVLYILLLVVGFSLMCLELFHSSNVIDGLKLNAFAAVFTVLSVEDSTLVFPQPPWPLCLSFLCWSLLLCLISDVGFILGPFSLLFLQSLSRPPGNGRPHDVHAGVPGHREPRS

SEQ ID NO: 36573 - protein, 293 aa, Homo sapiens
  Payload ID: 7245
  Gene Symbol: GSG1L2
  Gene Name: GSG1-like 2
  Uniprot ID: A8MUP6
  ENSP ID: ENSP00000465978
MDRAKQQQALLLLPVCLALTFSLTAVVSSHWCEGTRRVVKPLCQDQPGGQHCIHFKRDNSSNGRMDNNSQAVLYIWELGDDKFIQRGFHVGLWQSCEESLNGEDEKCRSFRSVVPAEEQGVLWLSIGGEVLDIVLILTSAILLGSRVSCRSPGFHWLRVDALVAIFMVLAGLLGMVAHMMYTTIFQITVNLGPEDWKPQTWDYGWSYCLAWGSFALCLAVSVSAMSRFTAARLEFTEKQQAQNGSRHSQHSFLEPEASESIWKTGAAPCPAEQAFRNVSGHLPPGAPGKVSIC

SEQ ID NO: 36574 - protein, 139 aa, Homo sapiens
  Payload ID: 7246
  Gene Symbol: GSKIP
  Gene Name: GSK3B interacting protein
  Uniprot ID: Q9P0R6
  ENSP ID: ENSP00000412315
METDCNPMELSSMSGFEEGSELNGFEGTDMKDMRLEAEAVVNDVLFAVNNMFVSKSLRCADDVAYINVETKERNRYCLELTEAGLKVVGYAFDQVDDHLQTPYHETVYSLLDTLSPAYREAFGNALLQRLEALKRDGQS

SEQ ID NO: 36575 - protein, 139 aa, Homo sapiens; identical to SEQ ID NO: 36574
  Payload ID: 7246
  Gene Symbol: GSKIP
  Gene Name: GSK3B interacting protein
  Uniprot ID: Q9P0R6
  ENSP ID: ENSP00000450420

SEQ ID NO: 36576 - protein, 78 aa, Homo sapiens
  Payload ID: 7246
  Gene Symbol: GSKIP
  Gene Name: GSK3B interacting protein
  ENSP ID: ENSP00000451072
METDCNPMELSSMSGFEEGSELNGFEGTDMKDMRLEAEAVVNDVLFAVNNMFVSKSLRCADDVAYINVETKERNRYCL

SEQ ID NO: 36577 - protein, 139 aa, Homo sapiens; identical to SEQ ID NO: 36574
  Payload ID: 7246
  Gene Symbol: GSKIP
  Gene Name: GSK3B interacting protein
  Uniprot ID: Q9P0R6
  ENSP ID: ENSP00000451188

SEQ ID NO: 36578 - protein, 139 aa, Homo sapiens; identical to SEQ ID NO: 36574
  Payload ID: 7246
  Gene Symbol: GSKIP
  Gene Name: GSK3B interacting protein
  Uniprot ID: Q9P0R6
  ENSP ID: ENSP00000451384

SEQ ID NO: 36579 - protein, 109 aa, Homo sapiens
  Payload ID: 7246
  Gene Symbol: GSKIP
  Gene Name: GSK3B interacting protein
  ENSP ID: ENSP00000451820
METDCNPMELSSMSGFEEGSELNGFEGTDMKDMRLEAEAVVNDVLFAVNNMFVSKSLRCADDVAYINVETKERNRYCLELTEAGLKVVGYAFDQVDDHLQTPYHETVYS

SEQ ID NO: 36580 - protein, 395 aa, Homo sapiens
  Payload ID: 7247
  Gene Symbol: GTF2H2C
  Gene Name: GTF2H2 family member C
  Uniprot ID: Q6P1K8
  ENSP ID: ENSP00000370105
MDEEPERTKRWEGGYERTWEILKEDESGSLKATIEDILFKAKRKRVFEHHGQVRLGMMRHLYVVVDGSRTMEDQDLKPNRLTCTLKLLEYFVEEYFDQNPISQIGIIVTKSKRAEKLTELSGNPRKHITSLKEAVDMTCHGEPSLYNSLSMAMQTLKHMPGHTSREVLIIFSSLTTCDPSNIYDLIKTLKAAKIRVSVIGLSAEVRVCTVLARETGGTYHVILDESHYKELLTHHLSPPPASSSSECSLIRMGFPQHTIASLSDQDAKPSFSMAHLDGNTEPGLTLGGYFCPQCRAKYCELPVECKICGLTLVSAPHLARSYHHLFPLDAFQEIPLEEYNGERFCYGCQGELKDQHVYVCAVCQNVFCVDCDVFVHDSLHCCPGCIHKIPAPSGV

SEQ ID NO: 36581 - protein, 51 aa, Homo sapiens; identical to SEQ ID NO: 34427
  Payload ID: 7247
  Gene Symbol: GTF2H2C
  Gene Name: GTF2H2 family member C
  ENSP ID: ENSP00000403328

SEQ ID NO: 36582 - protein, 123 aa, Homo sapiens; identical to SEQ ID NO: 34429
  Payload ID: 7247
  Gene Symbol: GTF2H2C
  Gene Name: GTF2H2 family member C
  ENSP ID: ENSP00000421312

SEQ ID NO: 36583 - protein, 395 aa, Homo sapiens; identical to SEQ ID NO: 36580
  Payload ID: 7247
  Gene Symbol: GTF2H2C
  Gene Name: GTF2H2 family member C
  Uniprot ID: Q6P1K8
  ENSP ID: ENSP00000422907

SEQ ID NO: 36584 - protein, 51 aa, Homo sapiens; identical to SEQ ID NO: 34427
  Payload ID: 7247
  Gene Symbol: GTF2H2C
  Gene Name: GTF2H2 family member C
  ENSP ID: ENSP00000426434

SEQ ID NO: 36585 - protein, 165 aa, Homo sapiens
  Payload ID: 7247
  Gene Symbol: GTF2H2C
  Gene Name: GTF2H2 family member C
  ENSP ID: ENSP00000427224
MDEEPERTKRWEGGYERTWEILKEDESGSLKATIEDILFKAKRKRVFEHHGQVRLGMMRHLYVVVDGSRTMEDQDLKPNRLTCTLKLLEYFVEEYFDQNPISQIGIIVTKSKRAEKLTELSGNPRKHITSLKEAVDMTCHGEPSLYNSLSMAMQTLKLVLYIMYN

SEQ ID NO: 36586 - protein, 92 aa, Homo sapiens
  Payload ID: 7247
  Gene Symbol: GTF2H2C
  Gene Name: GTF2H2 family member C
  ENSP ID: ENSP00000427393
MDEEPERTKRWEGGYERTWEILKEDESGSLKATIEDILFKAKRKRVFEHHGQVRLGMMRHLYVVVDGSRTMEDQDLKPNRLTCTLKETQENI

SEQ ID NO: 36587 - protein, 253 aa, Homo sapiens
  Payload ID: 7247
  Gene Symbol: GTF2H2C
  Gene Name: GTF2H2 family member C
  ENSP ID: ENSP00000427456
MDEEPERTKRWEGGYERTWEILKEDESGSLKATIEDILFKAKRKRVFEHHGQVRLGMMRHLYVVVDGSRTMEDQDLKPNRLTCTLKIGIIVTKSKRAEKLTELSGNPRKHITSLKEAVDMTCHGEPSLYNSLSMAMQTLKHMPGHTSREVLIIFSSLTTCDPSNIYDLIKTLKAAKIRVSVIGLSAEVRVCTVLARETGGTYHVILDESHYKELLTHHLSPPPASSSSECSLIRMGFPQHTIASLSDQDAKPS

SEQ ID NO: 36588 - protein, 51 aa, Homo sapiens; identical to SEQ ID NO: 34427
  Payload ID: 7247
  Gene Symbol: GTF2H2C
  Gene Name: GTF2H2 family member C
  ENSP ID: ENSP00000427486

SEQ ID NO: 36589 - protein, 395 aa, Homo sapiens; identical to SEQ ID NO: 36580
  Payload ID: 7248
  Gene Symbol: GTF2H2C_2
  Gene Name: GTF2H2 family member C, copy 2
  Uniprot ID: Q6P1K8
  ENSP ID: ENSP00000480471

SEQ ID NO: 36590 - protein, 165 aa, Homo sapiens; identical to SEQ ID NO: 36585
  Payload ID: 7248
  Gene Symbol: GTF2H2C_2
  Gene Name: GTF2H2 family member C, copy 2
  ENSP ID: ENSP00000481241

SEQ ID NO: 36591 - protein, 51 aa, Homo sapiens; identical to SEQ ID NO: 34427
  Payload ID: 7248
  Gene Symbol: GTF2H2C_2
  Gene Name: GTF2H2 family member C, copy 2
  ENSP ID: ENSP00000481828

SEQ ID NO: 36592 - protein, 51 aa, Homo sapiens; identical to SEQ ID NO: 34427
  Payload ID: 7248
  Gene Symbol: GTF2H2C_2
  Gene Name: GTF2H2 family member C, copy 2
  ENSP ID: ENSP00000483026

SEQ ID NO: 36593 - protein, 395 aa, Homo sapiens; identical to SEQ ID NO: 36580
  Payload ID: 7248
  Gene Symbol: GTF2H2C_2
  Gene Name: GTF2H2 family member C, copy 2
  Uniprot ID: Q6P1K8
  ENSP ID: ENSP00000483148

SEQ ID NO: 36594 - protein, 959 aa, Homo sapiens
  Payload ID: 7249
  Gene Symbol: GTF2IRD1
  Gene Name: GTF2I repeat domain containing 1
  Uniprot ID: Q9UHL9
  ENSP ID: ENSP00000265755
MALLGKRCDVPTNGCGPDRWNSAFTRKDEIITSLVSALDSMCSALSKLNAEVACVAVHDESAFVVGTEKGRMFLNARKELQSDFLRFCRGPPWKDPEAEHPKKVQRGEGGGRSLPRSSLEHGSDVYLLRKMVEEVFDVLYSEALGRASVVPLPYERLLREPGLLAVQGLPEGLAFRRPAEYDPKALMAILEHSHRIRFKLKRPLEDGGRDSKALVELNGVSLIPKGSRDCGLHGQAPKVPPQDLPPTATSSSMASFLYSTALPNHAIRELKQEAPSCPLAPSDLGLSRPMPEPKATGAQDFSDCCGQKPTGPGGPLIQNVHASKRILFSIVHDKSEKWDAFIKETEDINTLRECVQILFNSRYAEALGLDHMVPVPYRKIACDPEAVEIVGIPDKIPFKRPCTYGVPKLKRILEERHSIHFIIKRMFDERIFTGNKFTKDTTKLEPASPPEDTSAEVSRATVLDLAGNARSDKGSMSEDCGPGTSGELGGLRPIKIEPEDLDIIQVTVPDPSPTSEEMTDSMPGHLPSEDSGYGMEMLTDKGLSEDARPEERPVEDSHGDVIRPLRKQVELLFNTRYAKAIGISEPVKVPYSKFLMHPEELFVVGLPEGISLRRPNCFGIAKLRKILEASNSIQFVIKRPELLTEGVKEPIMDSQGTASSLGFSPPALPPERDSGDPLVDESLKRQGFQENYDARLSRIDIANTLREQVQDLFNKKYGEALGIKYPVQVPYKRIKSNPGSVIIEGLPPGIPFRKPCTFGSQNLERILAVADKIKFTVTRPFQGLIPKPDEDDANRLGEKVILREQVKELFNEKYGEALGLNRPVLVPYKLIRDSPDAVEVTGLPDDIPFRNPNTYDIHRLEKILKAREHVRMVIINQLQPFAEICNDAKVPAKDSSIPKRKRKRVSEGNSVSSSSSSSSSSSSNPDSVASANQISLVQWPMYMVDYAGLNVQLPGPLNY

SEQ ID NO: 36595 - protein, 976 aa, Homo sapiens
  Payload ID: 7249
  Gene Symbol: GTF2IRD1
  Gene Name: GTF2I repeat domain containing 1
  Uniprot ID: Q9UHL9
  ENSP ID: ENSP00000397566
MALLGKRCDVPTNGCGPDRWNSAFTRKDEIITSLVSALDSMCSALSKLNAEVACVAVHDESAFVVGTEKGRMFLNARKELQSDFLRFCLSAAQHRAATSQLEGRVVRRVLTVASRALCPTGGPPWKDPEAEHPKKVQRGEGGGRSLPRSSLEHGSDVYLLRKMVEEVFDVLYSEALGRASVVPLPYERLLREPGLLAVQGLPEGLAFRRPAEYDPKALMAILEHSHRIRFKLKRPLEDGGRDSKALVELNGVSLIPKGSRDCGLHGQAPKVPPQDLPPTATSSSMASFLYSTALPNHAIRELKQEAPSCPLAPSDLGLSRPMPEPKATGAQDFSDCCGQKPTGPGGPLIQNVHASKRILFSIVHDKSEKWDAFIKETEDINTLRECVQILFNSRYAEALGLDHMVPVPYRKIACDPEAVEIVGIPDKIPFKRPCTYGVPKLKRILEERHSIHFIIKRMFDERIFTGNKFTKDTTKLEPASPPEDTSAEVSRATVLDLAGNARSDKGSMSEDCGPGTSGELGGLRPIKIEPEDLDIIQVTVPDPSPTSEEMTDSMPGHLPSEDSGYGMEMLTDKGLSEDARPEERPVEDSHGDVIRPLRKQVELLFNTRYAKAIGISEPVKVPYSKFLMHPEELFVVGLPEGISLRRPNCFGIAKLRKILEASNSIQFVIKRPELLTEGVKEPIMDSQERDSGDPLVDESLKRQGFQENYDARLSRIDIANTLREQVQDLFNKKYGEALGIKYPVQVPYKRIKSNPGSVIIEGLPPGIPFRKPCTFGSQNLERILAVADKIKFTVTRPFQGLIPKPDEDDANRLGEKVILREQVKELFNEKYGEALGLNRPVLVPYKLIRDSPDAVEVTGLPDDIPFRNPNTYDIHRLEKILKAREHVRMVIINQLQPFAEICNDAKVPAKDSSIPKRKRKRVSEGNSVSSSSSSSSSSSSNPDSVASANQISLVQWPMYMVDYAGLNVQLPGPLNY

SEQ ID NO: 36596 - protein, 944 aa, Homo sapiens
  Payload ID: 7249
  Gene Symbol: GTF2IRD1
  Gene Name: GTF2I repeat domain containing 1
  Uniprot ID: Q9UHL9
  ENSP ID: ENSP00000408477
MALLGKRCDVPTNGCGPDRWNSAFTRKDEIITSLVSALDSMCSALSKLNAEVACVAVHDESAFVVGTEKGRMFLNARKELQSDFLRFCRGPPWKDPEAEHPKKVQRGEGGGRSLPRSSLEHGSDVYLLRKMVEEVFDVLYSEALGRASVVPLPYERLLREPGLLAVQGLPEGLAFRRPAEYDPKALMAILEHSHRIRFKLKRPLEDGGRDSKALVELNGVSLIPKGSRDCGLHGQAPKVPPQDLPPTATSSSMASFLYSTALPNHAIRELKQEAPSCPLAPSDLGLSRPMPEPKATGAQDFSDCCGQKPTGPGGPLIQNVHASKRILFSIVHDKSEKWDAFIKETEDINTLRECVQILFNSRYAEALGLDHMVPVPYRKIACDPEAVEIVGIPDKIPFKRPCTYGVPKLKRILEERHSIHFIIKRMFDERIFTGNKFTKDTTKLEPASPPEDTSAEVSRATVLDLAGNARSDKGSMSEDCGPGTSGELGGLRPIKIEPEDLDIIQVTVPDPSPTSEEMTDSMPGHLPSEDSGYGMEMLTDKGLSEDARPEERPVEDSHGDVIRPLRKQVELLFNTRYAKAIGISEPVKVPYSKFLMHPEELFVVGLPEGISLRRPNCFGIAKLRKILEASNSIQFVIKRPELLTEGVKEPIMDSQERDSGDPLVDESLKRQGFQENYDARLSRIDIANTLREQVQDLFNKKYGEALGIKYPVQVPYKRIKSNPGSVIIEGLPPGIPFRKPCTFGSQNLERILAVADKIKFTVTRPFQGLIPKPDEDDANRLGEKVILREQVKELFNEKYGEALGLNRPVLVPYKLIRDSPDAVEVTGLPDDIPFRNPNTYDIHRLEKILKAREHVRMVIINQLQPFAEICNDAKVPAKDSSIPKRKRKRVSEGNSVSSSSSSSSSSSSNPDSVASANQISLVQWPMYMVDYAGLNVQLPGPLNY

SEQ ID NO: 36597 - protein, 275 aa, Homo sapiens
  Payload ID: 7249
  Gene Symbol: GTF2IRD1
  Gene Name: GTF2I repeat domain containing 1
  ENSP ID: ENSP00000417909
  MOD_RES (1)..(1): Any amino acid
XPAPAEAGGAALQHTIRPELLTEGVKEPIMDSQERDSGDPLVDESLKRQGFQENYDARLSRIDIANTLREQVQDLFNKKYGEALGIKYPVQVPYKRIKSNPGSVIIEGLPPGIPFRKPCTFGSQNLERILAVADKIKFTVTRPFQGLIPKPDEDDANRLGEKVILREQVKELFNEKYGEALGLNRPVLVPYKLIRDSPDAVEVTGLPDDIPFRNPNTYDIHRLEKILKAREHVRMVIINQLQPFAEICNDAKVPAKDSSIPKRKRKRVSEGNSVS

SEQ ID NO: 36598 - protein, 960 aa, Homo sapiens
  Payload ID: 7249
  Gene Symbol: GTF2IRD1
  Gene Name: GTF2I repeat domain containing 1
  ENSP ID: ENSP00000418383
MALLGKRCDVPTNGCGPDRWNSAFTRKDEIITSLVSALDSMCSALSKLNAEVACVAVHDESAFVVGTEKGRMFLNARKELQSDFLRFCRGPPWKDPEAEHPKKVQRGEGGGRSLPRSSLEHGSDVYLLRKMVEEVFDVLYSEALGRASVVPLPYERLLREPGLLAVQGLPEGLAFRRPAEYDPKALMAILEHSHRIRFKLKRPLEDGGRDSKALVELNGVSLIPKGSRDCGLHGQAPKVPPQDLPPTATSSSMASFLYSTALPNHAIRELKQEAPSCPLAPSDLGLSRPMPEPKATGAQDFSDCCGQKPTGPGGPLIQNVHASKRILFSIVHDKSEKWDAFIKETEDINTLRECVQILFNSRYAEALGLDHMVPVPYRKIACDPEAVEIVGIPDKIPFKRPCTYGVPKLKRILEERHSIHFIIKRMFDERIFTGNKFTKDTTKLEPASPPEDTSAEVSRATVLDLAGNARSDKGSMSEDCGPGTSGELGGLRPIKIEPEDLDIIQVTVPDPSPTSEEMTDSMPGHLPSEDSGYGMEMLTDKGLSEDARPEERPVEDSHGDVIRPLRKQVELLFNTRYAKAIGISEPVKVPYSKFLMHPEELFVVGLPEGISLRRPNCFGIAKLRKILEASNSIQFVIKRPELLTEGVKEPIMDSQERDSGDPLVDESLKRQGFQENYDARLSRIDIANTLREQVQDLFNKKYGEALGIKYPVQVPYKRIKSNPGSVIIEGLPPGIPFRKPCTFGSQNLERILAVADKIKFTVTRPFQGLIPKPDEDDANRLGEKVILREQVKELFNEKYGEALGLNRPVLVPYKLIRDSPDAVEVTGLPDDIPFRNPNTYDIHRLEKILKAREHVRMVIINQLQPFAEICNDAKVPAKDSSIPKRKRKRVSEGNSVSSSSSSSSSSSSNPDSVASANQISLVVKLHRFGLRHSSLWPSPLCLAGPSTLGCGPRGRGGTGL

SEQ ID NO: 36599 - protein, 949 aa, Homo sapiens
  Payload ID: 7250
  Gene Symbol: GTF2IRD2
  Gene Name: GTF2I repeat domain containing 2
  ENSP ID: ENSP00000406723
MAQVAVSTLPVEEESSSETRMVVTFLVSALESMCKELAKSKAEVACIAVYETDVFVVGTERGCAFVNARTDFQKDFAKYCVAEGLCEVKPPCPVNGMQVHSGETEILRKAVEDYFCFCYGKALGTTVMVPVPYEKMLRDQSAVVVQGLPEGVAFQHPENYDLATLKWILENKAGISFIINRPFLGPESQLGGPGMVTDAERSIVSPSESCGPINVKTEPMEDSGISLKAEAVSVKKESEDPNYYQYNMQGSHPSSTSNEVIEMELPMEDSTPLVPSEEPNEDPEAEVKIEGNTNSSSVTNSAAGVEDLNIVQVTVPDNEKERLSSIEKIKQLREQVNDLFSRKFGEAIGVDFPVKVPYRKITFNPGCVVIDGMPPGVVFKAPGYLEISSMRRILEAAEFIKFTVIRPLPGLELSNVGKRKIDQEGRVFQEKWERAYFFVEVQNIPTCLICKQSMSVSKEYNLRRHYQTNHSKHYDQYMERMRDEKLHELKKGLRKYLLGSSDTECPEQKQVFANPSPTQKSPVQPVEDLAGNLWEKLREKIRSFVAYSIAIDEITDINNTTQLAIFIRGVDENFDVSEELLDTVPMTGTKSGNEIFSRVEKSLKNFCIDWSKLVSVASTGTPAMVDANNGLVTKLKSRVATFCKGAELKSICCIIHPESLCAQKLKMDHVMDVVVKSVNWICSRGLNHSEFTTLLYELDSQYGSLLYYTEIKWLSRGLVLKRFFESLEEIDSFMSSRGKPLPQLSSIDWIRDLAFLVDMTMHLNALNISLQGHSQIVTQMYDLIRAFLAKLCLWETHLTRNNLAHFPTLKLASRNESDGLNYIPKIAELQTEFQKRLSDFKLYESELTLFSSPFSTKIDSVHEELQMEVIDLQCNTVLKTKYDKVGIPEFYKYLWGSYPKYKHHCAKILSMFGSTYICEQLFSIMKLSKTKYCSQLKDSQWDSVLHIAT

SEQ ID NO: 36600 - protein, 108 aa, Homo sapiens
  Payload ID: 7250
  Gene Symbol: GTF2IRD2
  Gene Name: GTF2I repeat domain containing 2
  Uniprot ID: Q86UP8
  ENSP ID: ENSP00000481017
MAQVAVSTLPVEEESSSETRMVVTFLVSALESMCKELAKSKAEVACIAVYETDVFVVGTERGCAFVNARTDFQKDFAKYCRCFNFILCIPNLKRIAGKTSTVFSSKLS

SEQ ID NO: 36601 - protein, 497 aa, Homo sapiens
  Payload ID: 7250
  Gene Symbol: GTF2IRD2
  Gene Name: GTF2I repeat domain containing 2
  ENSP ID: ENSP00000486581
MAQVAVSTLPVEEESSSETRMVVTFLVSALESMCKELAKSKAEVACIAVYETDVFVVGTERGCAFVNARTDFQKDFAKYCVAEGLCEVKPPCPVNGMQVHSGETEILRKAVEDYFCFCYGKALGTTVMVPVPYEKMLRDQSAVVVQGLPEGVAFQHPENYDLATLKWILENKAGISFIINRPFLGPESQLGGPGMVTDAERSIVSPSESCGPINVKTEPMEDSGISLKAEAVSVKKESEDPNYYQYNMQGSHPSSTSNEVIEMELPMEDSTPLVPSEEPNEDPEAEVKIEGNTNSSSVTNSAAGVEDLNIVQVTVPDNEKERLSSIEKIKQLREQVNDLFSRKFGEAIGVDFPVKVPYRKITFNPGCVVIDGMPPGVVFKAPGYLEISSMRRILEAAEFIKFTVIRPLPGLELSNGLLEAKARGLLEARSLRPAWATQDPISTKNLKISWKQWLTPVAPATWQAKAGGSLKLRSLRQQRTIIAILHSSLGDRTRPCL

SEQ ID NO: 36602 - protein, 226 aa, Homo sapiens
  Payload ID: 7251
  Gene Symbol: GTF2IRD2B
  Gene Name: GTF2I repeat domain containing 2B
  Uniprot ID: Q6EKJ0
  ENSP ID: ENSP00000411454
MAQVAVSTLPVEEESSSETRMVVTFLVSALESMCKELAKSKAEVACIAVYETDVFVVGTERGCAFVNARTDFQKDFAKYCVAEGLCEVKPPCPVNGMQVHSGETEILRKAVEDYFCFCYGKALGTTVMVPVPYEKMLRDQSAVVVQGLPEGVAFQHPENYDLATLKWILENKAGISFIINRPFLGPESQLGGPGMVTDAERSIVSPSERHFTESRSCLSQERIRRS

SEQ ID NO: 36603 - protein, 437 aa, Homo sapiens
  Payload ID: 7251
  Gene Symbol: GTF2IRD2B
  Gene Name: GTF2I repeat domain containing 2B
  ENSP ID: ENSP00000480037
MAQVAVSTLPVEEESSSETRMVVTFLVSALESMCKELAKSKAEVACIAVYETDVFVVGTERGCAFVNARTDFQKDFAKYCVAEGLCEVKPPCPVNGMQVHSGETEILRKAVEDYFCFCYGKALGTTVMVPVPYEKMLRDQSAVVVQGLPEGVAFQHPENYDLATLKWILENKAGISFIINRPFLGPESQLGGPGMVTDAERSIVSPSESCGPINVKTEPMEDSGISLKAEAVSVKKESEDPNYYQYNMQGSHPSSTSNEVIEMELPMEDSTPLVPSEEPNEDPEAEVKIEGNTNSSSVTNSAAGVEDLNIVQVTVPDNEKERLSSIEKIKQLREQVNDLFSRKFGEAIGVDFPVKVPYRKITFNPGCVVIDGMPPGVVFKAPGYLEISSMRRILEAAEFIKFTVIRPLPGLELSNGLLEAKARGLLEARSLRPAWAT

SEQ ID NO: 36604 - protein, 949 aa, Homo sapiens
  Payload ID: 7251
  Gene Symbol: GTF2IRD2B
  Gene Name: GTF2I repeat domain containing 2B
  Uniprot ID: Q6EKJ0
  ENSP ID: ENSP00000480524
MAQVAVSTLPVEEESSSETRMVVTFLVSALESMCKELAKSKAEVACIAVYETDVFVVGTERGCAFVNARTDFQKDFAKYCVAEGLCEVKPPCPVNGMQVHSGETEILRKAVEDYFCFCYGKALGTTVMVPVPYEKMLRDQSAVVVQGLPEGVAFQHPENYDLATLKWILENKAGISFIINRPFLGPESQLGGPGMVTDAERSIVSPSESCGPINVKTEPMEDSGISLKAEAVSVKKESEDPNYYQYNMQGSHPSSTSNEVIEMELPMEDSTPLVPSEEPNEDPEAEVKIEGNTNSSSVTNSAAGVEDLNIVQVTVPDNEKERLSSIEKIKQLREQVNDLFSRKFGEAIGVDFPVKVPYRKITFNPGCVVIDGMPPGVVFKAPGYLEISSMRRILEAAEFIKFTVIRPLPGLELSNVGKRKIDQEGRVFQEKWERAYFFVEVQNIPTCLICKQSMSVSKEYNLRRHYQTNHSKHYDQYTERMRDEKLHELKKGLRKYLLGSSDTECPEQKQVFANPSPTQKSPVQPVEDLAGNLWEKLREKIRSFVAYSIAIDEITDINNTTQLAIFIRGVDENFDVSEELLDTVPMTGTKSGNEIFLRVEKSLKKFCINWSRLVSVASTGTPAMVDANNGLVTKLKSRVATFCKGAELKSICCIIHPESLCAQKLKMDHVMDVVVKSVNWICSRGLNHSEFTTLLYELDSQYGSLLYYTEIKWLSRGLVLKRFFESLEEIDSFMSSRGKPLPQLSSIDWIRDLAFLVDMTMHLNALNISLQGHSQIVTQMYDLIRAFLAKLCLWETHLTRNNLAHFPTLKLVSRNESDGLNYIPKIAELKTEFQKRLSDFKLYESELTLFSSPFSTKIDSVHEELQMEVIDLQCNTVLKTKYDKVGIPEFYKYLWGSYPKYKHHCAKILSMFGSTYICEQLFSIMKLSKTKYCSQLKDSQWDSVLHIAT

SEQ ID NO: 36605 - protein, 108 aa, Homo sapiens; identical to SEQ ID NO: 36600
  Payload ID: 7251
  Gene Symbol: GTF2IRD2B
  Gene Name: GTF2I repeat domain containing 2B
  ENSP ID: ENSP00000481706

SEQ ID NO: 36606 - protein, 497 aa, Homo sapiens; identical to SEQ ID NO: 36601
  Payload ID: 7251
  Gene Symbol: GTF2IRD2B
  Gene Name: GTF2I repeat domain containing 2B
  ENSP ID: ENSP00000486360

SEQ ID NO: 36607 - protein, 669 aa, Homo sapiens
  Payload ID: 7252
  Gene Symbol: GTPBP1
  Gene Name: GTP binding protein 1
  Uniprot ID: O00178
  ENSP ID: ENSP00000216044
MATERSRSAMDSPVPASMFAPEPSSPGAARAAAAAARLHGGFDSDCSEDGEALNGEPELDLTSKLVLVSPTSEQYDSLLRQMWERMDEGCGETIYVIGQGSDGTEYGLSEADMEASYATVKSMAEQIEADVILLRERQEAGGRVRDYLVRKRVGDNDFLEVRVAVVGNVDAGKSTLLGVLTHGELDNGRGFARQKLFRHKHEIESGRTSSVGNDILGFDSEGNVVNKPDSHGGSLEWTKICEKSTKVITFIDLAGHEKYLKTTVFGMTGHLPDFCMLMVGSNAGIVGMTKEHLGLALALNVPVFVVVTKIDMCPANILQETLKLLQRLLKSPGCRKIPVLVQSKDDVIVTASNFSSERMCPIFQISNVTGENLDLLKMFLNLLSPRTSYREEEPAEFQIDDTYSVPGVGTVVSGTTLRGLIKLNDTLLLGPDPLGNFLSIAVKSIHRKRMPVKEVRGGQTASFALKKIKRSSIRKGMVMVSPRLNPQASWEFEAEILVLHHPTTISPRYQAMVHCGSIRQTATILSMDKDCLRTGDKATVHFRFIKTPEYLHIDQRLVFREGRTKAVGTITKLLQTTNNSPMNSKPQQIKMQSTKKGPLTKRDEGGPSGGPAVGAPPPGDEASSVGAGQPAASSNLQPQPKPSSGGRRRGGQRHKVKSQGACVTPASGC

SEQ ID NO: 36608 - protein, 349 aa, Homo sapiens
  Payload ID: 7252
  Gene Symbol: GTPBP1
  Gene Name: GTP binding protein 1
  ENSP ID: ENSP00000388147
LNDTLLLGPDPLGNFLSIAVKSIHRKRMPVKEVRGGQTASFALKKIKRSSIRKGMVMVSPRLNPQASWEFEAEILVLHHPTTISPRYQAMVHCGSIRQTATILSMDKDCLRTGDKATVHFRFIKTPEYLHIDQRLVFREGRTKAVGTITKLLQTTNNSPMNSKPQQIKMQSTKKGPLTKRDEGGPSGGPAVGAPPPGDEASSVGAGQPAASSNLQPQPKPSSGGRRRGGQRHKSQVQGANSEFPWRRITALQVDVAGRMGSRRHGHRGKEEGSCWSLLTASSHLLLRRPCPSFSSAWGHRLLSCAPRSQSAEQACGGSGGVLFTHSQMAGSRHQKLPSCCPSGRCLPLC

SEQ ID NO: 36609 - protein, 70 aa, Homo sapiens
  Payload ID: 7252
  Gene Symbol: GTPBP1
  Gene Name: GTP binding protein 1
  ENSP ID: ENSP00000397891
MATERSRSAMDSPVPASMFAPEPSSPGAARAAAAAARLHGGFDSDCSEDGEALNGEPELDLTSKMGLSMG

SEQ ID NO: 36610 - protein, 40 aa, Homo sapiens
  Payload ID: 7252
  Gene Symbol: GTPBP1
  Gene Name: GTP binding protein 1
  ENSP ID: ENSP00000437430
  MOD_RES (1)..(1): Any amino acid
XQVQGANSEFPWRRITALQVDVAGRKLPSCCPSGRCLPLC

SEQ ID NO: 36611 - protein, 86 aa, Homo sapiens
  Payload ID: 7252
  Gene Symbol: GTPBP1
  Gene Name: GTP binding protein 1
  ENSP ID: ENSP00000439505
MWERMDEGCGETIYVIGQGSDGTEYGLSEADMEASYATVKSMAEQIEADVILLRERQEAGGRVRDYLVRKRVGDNDFLEVRVAVVG

SEQ ID NO: 36612 - protein, 30 aa, Homo sapiens
  Payload ID: 7252
  Gene Symbol: GTPBP1
  Gene Name: GTP binding protein 1
  ENSP ID: ENSP00000442394
  MOD_RES (1)..(1): Any amino acid
XKPSSGGRRRGGQRHKVKSQGACVTPASGC

SEQ ID NO: 36613 - protein, 39 aa, Homo sapiens
  Payload ID: 7252
  Gene Symbol: GTPBP1
  Gene Name: GTP binding protein 1
  ENSP ID: ENSP00000442628
MWERMDEGCGETIYVIGQGSDGTEYGLSEADMEASYATV

SEQ ID NO: 36614 - protein, 152 aa, Homo sapiens
  Payload ID: 7252
  Gene Symbol: GTPBP1
  Gene Name: GTP binding protein 1
  ENSP ID: ENSP00000442881
MWERMDEGCGETIYVIGQGSDGTEYGLSEADMEASYATVKSMAEQIEADVILLRERQEAGGRVRDYLVRKRVGDNDFLEVRVAVVGNVDAGKSTLLGVLTHGELDNGRGFARQKLFRHKHEIESGRTSSVGNDILGFDSEGNVVNKPDSHGG

SEQ ID NO: 36615 - protein, 90 aa, Homo sapiens
  Payload ID: 7252
  Gene Symbol: GTPBP1
  Gene Name: GTP binding protein 1
  ENSP ID: ENSP00000445610
SQVQGANSEFPWRRITALQVDVAGRVTSASLFPQPPPTAPQRTNQKGDYLNKSCKSPRGQPERTTPTSGPGWEADATGTEGRKKGAAGAC

SEQ ID NO: 36616 - protein, 602 aa, Homo sapiens
  Payload ID: 7253
  Gene Symbol: GTPBP2
  Gene Name: GTP binding protein 2
  Uniprot ID: Q9BX10
  ENSP ID: ENSP00000303997
MDSRVSELFGGCCRPGGGPAVGGTLKARGAGSSSGCGGPKGKKKNGRNRGGKANNPPYLPPEAEDGNIEYKLKLVNPSQYRFEHLVTQMKWRLQEGRGEAVYQIGVEDNGLLVGLAEEEMRASLKTLHRMAEKVGADITVLREREVDYDSDMPRKITEVLVRKVPDNQQFLDLRVAVLGNVDSGKSTLLGVLTQGELDNGRGRARLNLFRHLHEIQSGRTSSISFEILGFNSKGEVVNYSDSRTAEEICESSSKMITFIDLAGHHKYLHTTIFGLTSYCPDCALLLVSANTGIAGTTREHLGLALALKVPFFIVVSKIDLCAKTTVERTVRQLERVLKQPGCHKVPMLVTSEDDAVTAAQQFAQSPNVTPIFTLSSVSGESLDLLKVFLNILPPLTNSKEQEELMQQLTEFQVDEIYTVPEVGTVVGGTLSSGICREGDQLVVGPTDDGCFLELRVCSIQRNRSACRVLRAGQAATLALGDFDRALLRKGMVMVSPEMNPTICSVFEAEIVLLFHATTFRRGFQVTVHVGNVRQTAVVEKIHAKDKLRTGEKAVVRFRFLKHPEYLKVGAKLLFREGVTKGIGHVTDVQAITAGEAQANMGF

SEQ ID NO: 36617 - protein, 514 aa, Homo sapiens
  Payload ID: 7253
  Gene Symbol: GTPBP2
  Gene Name: GTP binding protein 2
  Uniprot ID: Q9BX10
  ENSP ID: ENSP00000304893
MKWRLQEGRGEAVYQIGVEDNGLLVGLAEEEMRASLKTLHRMAEKVGADITVLREREVDYDSDMPRKITEVLVRKVPDNQQFLDLRVAVLGNVDSGKSTLLGVLTQGELDNGRGRARLNLFRHLHEIQSGRTSSISFEILGFNSKGEVVNYSDSRTAEEICESSSKMITFIDLAGHHKYLHTTIFGLTSYCPDCALLLVSANTGIAGTTREHLGLALALKVPFFIVVSKIDLCAKTTVERTVRQLERVLKQPGCHKVPMLVTSEDDAVTAAQQFAQSPNVTPIFTLSSVSGESLDLLKVFLNILPPLTNSKEQEELMQQLTEFQVDEIYTVPEVGTVVGGTLSSGICREGDQLVVGPTDDGCFLELRVCSIQRNRSACRVLRAGQAATLALGDFDRALLRKGMVMVSPEMNPTICSVFEAEIVLLFHATTFRRGFQVTVHVGNVRQTAVVEKIHAKDKLRTGEKAVVRFRFLKHPEYLKVGAKLLFREGVTKGIGHVTDVQAITAGEAQANMGF

SEQ ID NO: 36618 - protein, 153 aa, Homo sapiens
  Payload ID: 7253
  Gene Symbol: GTPBP2
  Gene Name: GTP binding protein 2
  ENSP ID: ENSP00000392944
  MOD_RES (1)..(1): Any amino acid
XGICREGDQLVVGPTDDGCFLELRVCSIQRNRSACRVLRAGQAATLALGDFDRALLRKGMVMVSPEMNPTICSVFEAEIVLLFHATTFRRGFQVTVHVGNVRQTAVVEKIHAKDKLRTGEKAVARERGVLSATCSLPTFWRGAKLGVARKGQS

SEQ ID NO: 36619 - protein, 154 aa, Homo sapiens
  Payload ID: 7253
  Gene Symbol: GTPBP2
  Gene Name: GTP binding protein 2
  ENSP ID: ENSP00000398905
  MOD_RES (1)..(1): Any amino acid
XGICREGDQLVVGPTDDGCFLELRVCSIQRNRSACRVLRAGQAATLALGDFDRALLRKGMVMVSPEMNPTICSVFEAEIVLLFHATTFRRGFQVTVHVGNVRQTAVVEKIHAKVRGTWPSISPEVRKEGGLPQTGRELLDPTMGIKPHLGWVAA

SEQ ID NO: 36620 - protein, 227 aa, Homo sapiens
  Payload ID: 7253
  Gene Symbol: GTPBP2
  Gene Name: GTP binding protein 2
  ENSP ID: ENSP00000410676
MDSRVSELFGGCCRPGGGPAVGGTLKARGAGSSSGCGGPKGKKKNGRNRGGKANNPPYLPPEAEDGNIEYKYRFEHLVTQMKWRLQEGRGEAVYQIGVEDNGLLVGLAEEEMRASLKTLHRMAEKVGADITVLREREVDYDSDMPRKITEVLVRKVPDNQQFLDLRVAVLGNVDSGKSTLLGVLTQGELDNGRGRARLNLFRHLHEIQSGRTSSISFEILGFNSKGE

SEQ ID NO: 36621 - protein, 315 aa, Homo sapiens
  Payload ID: 7253
  Gene Symbol: GTPBP2
  Gene Name: GTP binding protein 2
  ENSP ID: ENSP00000411358
  MOD_RES (1)..(1): Any amino acid
XQGGGAREENTSFRSRDPREEGQRLDSQAEDGNIEYKLKLVNPSQYRFEHLVTQMKWRLQEGRGEAVYQIGVEDNGLLVGLAEEEMRASLKTLHRMAEKVGADITVLREREVDYDSDMPRKITEVLVRKVPDNQQFLDLRVAVLGNVDSGKSTLLGVLTQGELDNGRGRARLNLFRHLHEIQSGRTSSISFEILGFNSKGEVVNYSDSRTAEEICESSSKMITFIDLAGHHKYLHTTIFGLTSYCPDCALLLVSANTGIAGTTREHLGLALALKVPFFIVVSKIDLCAKTTVERTVRQLERVLKQPGCHKVPMLV

SEQ ID NO: 36622 - protein, 105 aa, Homo sapiens
  Payload ID: 7253
  Gene Symbol: GTPBP2
  Gene Name: GTP binding protein 2
  ENSP ID: ENSP00000436973
GMVMVSPEMNPTICSVFEAEIVLLFHATTFRRGFQVTVHVGNVRQTAVVEKIHAKDKLRTGEKAVVRFRFLKHPEYLKVQSSSIVTKYCGLFSVVQVSRILRPFT

SEQ ID NO: 36623 - protein, 492 aa, Homo sapiens
  Payload ID: 7254
  Gene Symbol: GTPBP3
  Gene Name: GTP binding protein 3 (mitochondrial)
  Uniprot ID: Q969Y2
  ENSP ID: ENSP00000313818
MWRGLWTLAAQAARGPRRLCTRRSSGAPAPGSGATIFALSSGQGRCGIAVIRTSGPASGHALRILTAPRDLPLARHASLRLLSDPRSGEPLDRALVLWFPGPQSFTGEDCVEFHVHGGPAVVSGVLQALGSVPGLRPAEAGEFTRRAFANGKLNLTEVEGLADLIHAETEAQRRQALRQLDGELGHLCRGWAETLTKALAHVEAYIDFGEDDNLEEGVLEQADIEVRALQVALGAHLRDARRGQRLRSGVHVVVTGPPNAGKSSLVNLLSRKPVSIVSPEPGTTRDVLETPVDLAGFPVLLSDTAGLREGVGPVEQEGVRRARERLEQADLILAMLDASDLASPSSCNFLATVVASVGAQSPSDSSQRLLLVLNKSDLLSPEGPGPGPDLPPHLLLSCLTGEGLDGLLEALRKELAAVCGDPSTDPPLLTRARHQHHLQGCLDALGHYKQSKDLALAAEALRVARGHLTRLTGGGGTEEILDIIFQDFCVGK

SEQ ID NO: 36624 - protein, 524 aa, Homo sapiens
  Payload ID: 7254
  Gene Symbol: GTPBP3
  Gene Name: GTP binding protein 3 (mitochondrial)
  Uniprot ID: Q969Y2
  ENSP ID: ENSP00000351644
MWRGLWTLAAQAARGPRRLCTRRSSGAPAPGSGATIFALSSGQGRCGIAVIRTSGPASGHALRILTAPRDLPLARHASLRLLSDPRSGEPLDRALVLWFPGPQSFTGEDCVEFHVHGGPAVVSGVLQALGSVPGLRPAEAGEFTRRAFANGKLNLTEVEGLADLIHAETEAQRRQALRQLDGELGHLCRGWAETLTKALAHVEAYIDFGEDDNLEEGVLEQGGSTWWWGRKTPHISPQRLPSLSLSACLLSPTADIEVRALQVALGAHLRDARRGQRLRSGVHVVVTGPPNAGKSSLVNLLSRKPVSIVSPEPGTTRDVLETPVDLAGFPVLLSDTAGLREGVGPVEQEGVRRARERLEQADLILAMLDASDLASPSSCNFLATVVASVGAQSPSDSSQRLLLVLNKSDLLSPEGPGPGPDLPPHLLLSCLTGEGLDGLLEALRKELAAVCGDPSTDPPLLTRARHQHHLQGCLDALGHYKQSKDLALAAEALRVARGHLTRLTGGGGTEEILDIIFQDFCVGK

SEQ ID NO: 36625 - protein, 514 aa, Homo sapiens
  Payload ID: 7254
  Gene Symbol: GTPBP3
  Gene Name: GTP binding protein 3 (mitochondrial)
  Uniprot ID: Q969Y2
  ENSP ID: ENSP00000354598
MVHSPTCPHPCFLLVPASEPQFPHLQTPDPGDAVWNVRWALCTRRSSGAPAPGSGATIFALSSGQGRCGIAVIRTSGPASGHALRILTAPRDLPLARHASLRLLSDPRSGEPLDRALVLWFPGPQSFTGEDCVEFHVHGGPAVVSGVLQALGSVPGLRPAEAGEFTRRAFANGKLNLTEVEGLADLIHAETEAQRRQALRQLDGELGHLCRGWAETLTKALAHVEAYIDFGEDDNLEEGVLEQADIEVRALQVALGAHLRDARRGQRLRSGVHVVVTGPPNAGKSSLVNLLSRKPVSIVSPEPGTTRDVLETPVDLAGFPVLLSDTAGLREGVGPVEQEGVRRARERLEQADLILAMLDASDLASPSSCNFLATVVASVGAQSPSDSSQRLLLVLNKSDLLSPEGPGPGPDLPPHLLLSCLTGEGLDGLLEALRKELAAVCGDPSTDPPLLTRARHQHHLQGCLDALGHYKQSKDLALAAEALRVARGHLTRLTGGGGTEEILDIIFQDFCVGK

SEQ ID NO: 36626 - protein, 44 aa, Homo sapiens
  Payload ID: 7254
  Gene Symbol: GTPBP3
  Gene Name: GTP binding protein 3 (mitochondrial)
  ENSP ID: ENSP00000469008
MWRGLWTLAAQAARGPRRTSNLCIPQPQNPPTWSISRSSSPRST

SEQ ID NO: 36627 - protein, 101 aa, Homo sapiens
  Payload ID: 7254
  Gene Symbol: GTPBP3
  Gene Name: GTP binding protein 3 (mitochondrial)
  ENSP ID: ENSP00000470109
MWRGLWTLAAQAIVHAPEQRRTSPRLRRHHLRAKLWPRPLRHRSDPDQRPRQRPRPPNSHSTPRPAPCSPRQPAPAQRSPLRGASGPRTGALVPRSPEFHR

SEQ ID NO: 36628 - protein, 227 aa, Homo sapiens
  Payload ID: 7254
  Gene Symbol: GTPBP3
  Gene Name: GTP binding protein 3 (mitochondrial)
  ENSP ID: ENSP00000471421
MWRGLWTLAAQAARGPRRLCTRRSSGAPAPGSGATIFALSSGQGRCGIAVIRTSGPASGHALRILTAPRDLPLARHASLRLLSDPRSGEPLDRALVLWFPGPQSFTGEDCVEFHVHGGPAVVSGVLQALGSVPGLRPAEAGEFTRRAFANGKLNLTEVEGLADLIHAETEAQRRQALRQLDGELGHLCRGWAETLTKPTSKYGHCRWPWVHIYEMPGAGRGSAQGCT

SEQ ID NO: 36629 - protein, 125 aa, Homo sapiens
  Payload ID: 7254
  Gene Symbol: GTPBP3
  Gene Name: GTP binding protein 3 (mitochondrial)
  ENSP ID: ENSP00000471657
MVHSPTCPHPCFLLVPASEPQFPHLQTPDPGDAVWNIVHAPEQRRTSPRLRRHHLRAKLWPRPLRHRSDPDQRPRQRPRPPNSHSTPRPAPCSPRQPAPAQRSPLRGASGPRTGALVPRSPEFHR

SEQ ID NO: 36630 - protein, 151 aa, Homo sapiens
  Payload ID: 7254
  Gene Symbol: GTPBP3
  Gene Name: GTP binding protein 3 (mitochondrial)
  ENSP ID: ENSP00000472156
MWRGLWTLAAQAARGPRRLCTRRSSGAPAPGSGATIFALSSGQGRCGIAVIRTSGPASGHALRILTAPRDLPLARHASLRLLSDPRSGEPLDRALVLWFPGPQSFTGEDCVEFHVHGGPAVVSGVLQALGSVPGLRPAEAGAGRGSAQGCT

SEQ ID NO: 36631 - protein, 471 aa, Homo sapiens
  Payload ID: 7254
  Gene Symbol: GTPBP3
  Gene Name: GTP binding protein 3 (mitochondrial)
  Uniprot ID: Q969Y2
  ENSP ID: ENSP00000473150
MWRGLWTLAAQAARGPRRLCTRRSSGAPAPGSGATIFALSSGQGRCGIAVIRTSGPASGHALRILTAPRDLPLARHASLRLLSDPRSGEPLDRALVLWFPGPQSFTGEDCVEFHVHGGPAVVSGVLQALGSVPGLRPAEAGEFTRRAFANGKLNLTEVEGLADLIHAETEAQRRQALRQLDGELGHLCRGWAETLTKALAHVEAYIDFGEDDNLEEGVLEQADIEVRALQVALGAHLRDARRGQRLRSGVHVVVTGPPNAGKSSLVNLLSRKPVSIVSPEPGTTRDVLETPVDLAGFPVLLSDTAGLREGVGPVEQEGVRRARESCNFLATVVASVGAQSPSDSSQRLLLVLNKSDLLSPEGPGPGPDLPPHLLLSCLTGEGLDGLLEALRKELAAVCGDPSTDPPLLTRARHQHHLQGCLDALGHYKQSKDLALAAEALRVARGHLTRLTGGGGTEEILDIIFQDFCVGK

SEQ ID NO: 36632 - protein, 140 aa, Homo sapiens
  Payload ID: 7255
  Gene Symbol: GTPBP4
  Gene Name: GTP binding protein 4
  ENSP ID: ENSP00000353168
MRKVKFTQQNYHDRLSQILTDFPKLDDIHPFYADLMNILYDKDHYKLALGQINIAKNLVDNVAKDYVRLMKYGDSLYRCKQLKRAALGRMCTVIKRQKQSLEYLEQVRQHLSRLPTIDPNTRTLLLCGYPNVGKSSFINK

SEQ ID NO: 36633 - protein, 634 aa, Homo sapiens
  Payload ID: 7255
  Gene Symbol: GTPBP4
  Gene Name: GTP binding protein 4
  Uniprot ID: Q9BZE4
  ENSP ID: ENSP00000354040
MAHYNFKKITVVPSAKDFIDLTLSKTQRKTPTVIHKHYQIHRIRHFYMRKVKFTQQNYHDRLSQILTDFPKLDDIHPFYADLMNILYDKDHYKLALGQINIAKNLVDNVAKDYVRLMKYGDSLYRCKQLKRAALGRMCTVIKRQKQSLEYLEQVRQHLSRLPTIDPNTRTLLLCGYPNVGKSSFINKVTRADVDVQPYAFTTKSLFVGHMDYKYLRWQVVDTPGILDHPLEDRNTIEMQAITALAHLRAAVLYVMDLSEQCGHGLREQLELFQNIRPLFINKPLIVVANKCDVKRIAELSEDDQKIFTDLQSEGFPVIETSTLTEEGVIKVKTEACDRLLAHRVETKMKGNKVNEVLNRLHLAIPTRRDDKERPPFIPEGVVARRKRMETEESRKKRERDLELEMGDDYILDLQKYWDLMNLSEKHDKIPEIWEGHNIADYIDPAIMKKLEELEKEEELRTAAGEYDSVSESEDEEMLEIRQLAKQIREKKKLKILESKEKNTQGPRMPRTAKKVQRTVLEKEMRSLGVDMDDKDDAHYAVQARRSRSITRKRKREDSAPPSSVARSGSCSRTPRDVSGLRDVKMVKKAKTMMKNAQKKMNRLGKKGEADRHVFDMKPKHLLSGKRKAGKKDRR

SEQ ID NO: 36634 - protein, 516 aa, Homo sapiens
  Payload ID: 7256
  Gene Symbol: GTPBP6
  Gene Name: GTP binding protein 6 (putative)
  ENSP ID: ENSP00000316598
MWALRAAVRPGLRLSRVGRGRSAPRAAAPSCPARALAAVGRRSPGNLEGPWGGGRGLRADGGRSRTGDDEEEPEDADENAEEELLRGEPLLPAGTQRVCLVHPDVKWGPGKSQMTRAEWQVAEATALVHTLDGWSVVQTMVVSTKTPDRKLIFGKGNFEHLTEKIRGSPDITCVFLNVERMAAPTKKELEAAWGVEVFDRFTVVLHIFRCNARTKEARLQVALAEMPLHRSNLKRDVAHLYRGVGSRYIMGSGESFMQLQQRLLREKEAKIRKALDRLRKKRHLLRRQRTRREFPVISVVGYTNCGKTTLIKALTGDAAIQPRDQLFATLDVTAHAGTLPSRMTVLYVDTIGFLSQLPHGLIESFSATLEDVAHSDLILHVRDVSHPEAELQKCSVLSTLRGLQLPAPLLDSMVEVHNKVDLVPGYSPTEPNVVPVSALRGHGLQELKAELDAAVLKATGRQILTLRVRLAGAQLSWLYKEATVQEVDVIPEDGAADVRVIISNSAYGKFRKLFPG

SEQ ID NO: 36635 - protein, 296 aa, Homo sapiens
  Payload ID: 7257
  Gene Symbol: GEM
  Gene Name: GTP binding protein overexpressed in skeletal muscle
  Uniprot ID: P55040
  ENSP ID: ENSP00000297596
MTLNNVTMRQGTVGMQPQQQRWSIPADGRHLMVQKEPHQYSHRNRHSATPEDHCRRSWSSDSTDSVISSESGNTYYRVVLIGEQGVGKSTLANIFAGVHDSMDSDCEVLGEDTYERTLMVDGESATIILLDMWENKGENEWLHDHCMQVGDAYLIVYSITDRASFEKASELRIQLRRARQTEDIPIILVGNKSDLVRCREVSVSEGRACAVVFDCKFIETSAAVQHNVKELFEGIVRQVRLRRDSKEKNERRLAYQKRKESMPRKARRFWGKIVAKNNKNMAFKLKSKSCHDLSVL

SEQ ID NO: 36636 - protein, 296 aa, Homo sapiens; identical to SEQ ID NO: 36635
  Payload ID: 7257
  Gene Symbol: GEM
  Gene Name: GTP binding protein overexpressed in skeletal muscle
  Uniprot ID: P55040
  ENSP ID: ENSP00000379497

SEQ ID NO: 36637 - protein, 93 aa, Homo sapiens
  Payload ID: 7257
  Gene Symbol: GEM
  Gene Name: GTP binding protein overexpressed in skeletal muscle
  ENSP ID: ENSP00000428258
MTLNNVTMRQGTVGMQPQQQRWSIPADGRHLMVQKEPHQYSHRNRHSATPEDHCRRSWSSDSTDSVISSESGNTYYRVVLIGEQGVGKSTLAN

SEQ ID NO: 36638 - protein, 250 aa, Homo sapiens
  Payload ID: 7258
  Gene Symbol: GCH1
  Gene Name: GTP cyclohydrolase 1
  Uniprot ID: P30793
  ENSP ID: ENSP00000378890
MEKGPVRAPAEKPRGARCSNGFPERDPPRPGPSRPAEKPPRPEAKSAQPADGWKGERPRSEEDNELNLPNLAAAYSSILSSLGENPQRQGLLKTPWRAASAMQFFTKGYQETISDVLNDAIFDEDHDEMVIVKDIDMFSMCEHHLVPFVGKVHIGYLPNKQVLGLSKLARIVEIYSRRLQVQERLTKQIAVAITEALRPAGVGVVVEATHMCMVMRGVQKMNSKTVTSTMLGVFREDPKTREEFLTLIRS

SEQ ID NO: 36639 - protein, 250 aa, Homo sapiens; identical to SEQ ID NO: 36638
  Payload ID: 7258
  Gene Symbol: GCH1
  Gene Name: GTP cyclohydrolase 1
  Uniprot ID: P30793
  ENSP ID: ENSP00000419045

SEQ ID NO: 36640 - protein, 233 aa, Homo sapiens
  Payload ID: 7258
  Gene Symbol: GCH1
  Gene Name: GTP cyclohydrolase 1
  Uniprot ID: P30793
  ENSP ID: ENSP00000444011
MEKGPVRAPAEKPRGARCSNGFPERDPPRPGPSRPAEKPPRPEAKSAQPADGWKGERPRSEEDNELNLPNLAAAYSSILSSLGENPQRQGLLKTPWRAASAMQFFTKGYQETISDVLNDAIFDEDHDEMVIVKDIDMFSMCEHHLVPFVGKVHIGYLPNKQVLGLSKLARIVEIYSRRLQVQERLTKQIAVAITEALRPAGVGVVVEATKSNKYNKGLSPLLSSCHLFVAILK

SEQ ID NO: 36641 - protein, 213 aa, Homo sapiens
  Payload ID: 7258
  Gene Symbol: GCH1
  Gene Name: GTP cyclohydrolase 1
  Uniprot ID: P30793
  ENSP ID: ENSP00000445246
MEKGPVRAPAEKPRGARCSNGFPERDPPRPGPSRPAEKPPRPEAKSAQPADGWKGERPRSEEDNELNLPNLAAAYSSILSSLGENPQRQGLLKTPWRAASAMQFFTKGYQETISDVLNDAIFDEDHDEMVIVKDIDMFSMCEHHLVPFVGKVHIGYLPNKQVLGLSKLARIVEIYSRRLQVQERLTKQIAVAITEALRPAGVGVVVEATSAEP

SEQ ID NO: 36642 - protein, 250 aa, Homo sapiens; identical to SEQ ID NO: 36638
  Payload ID: 7258
  Gene Symbol: GCH1
  Gene Name: GTP cyclohydrolase 1
  Uniprot ID: P30793
  ENSP ID: ENSP00000477796

SEQ ID NO: 36643 - protein, 84 aa, Homo sapiens
  Payload ID: 7259
  Gene Symbol: GCHFR
  Gene Name: GTP cyclohydrolase I feedback regulator
  Uniprot ID: P30047
  ENSP ID: ENSP00000260447
MPYLLISTQIRMEVGPTMVGDEQSDPELMQHLGASKRRALGNNFYEYYVDDPPRIVLDKLERRGFRVLSMTGVGQTLVWCLHKE

SEQ ID NO: 36644 - protein, 67 aa, Homo sapiens
  Payload ID: 7259
  Gene Symbol: GCHFR
  Gene Name: GTP cyclohydrolase I feedback regulator
  ENSP ID: ENSP00000453640
MVGDEQSDPELMQHLGASKRRALGNNFYEYYVDDPPRIVLDKLERRGFRVLSMTGVGQTLVWCLHKE

SEQ ID NO: 36645 - protein, 73 aa, Homo sapiens
  Payload ID: 7259
  Gene Symbol: GCHFR
  Gene Name: GTP cyclohydrolase I feedback regulator
  Uniprot ID: P30047
  ENSP ID: ENSP00000453871
MPYLLISTQIRMSDPELMQHLGASKRRALGNNFYEYYVDDPPRIVLDKLERRGFRVLSMTGVGQTLVWCLHKE

SEQ ID NO: 36646 - protein, 44 aa, Homo sapiens
  Payload ID: 7259
  Gene Symbol: GCHFR
  Gene Name: GTP cyclohydrolase I feedback regulator
  ENSP ID: ENSP00000454067
MPYLLISTQIRMEVGPTMVGDEQSDPELMQHLGASKRRALGNNL

SEQ ID NO: 36647 - protein, 67 aa, Homo sapiens; identical to SEQ ID NO: 36644
  Payload ID: 7259
  Gene Symbol: GCHFR
  Gene Name: GTP cyclohydrolase I feedback regulator
  ENSP ID: ENSP00000454195

SEQ ID NO: 36648 - protein, 13 aa, Homo sapiens
  Payload ID: 7259
  Gene Symbol: GCHFR
  Gene Name: GTP cyclohydrolase I feedback regulator
  ENSP ID: ENSP00000477896
MPYLLISTQIRML

SEQ ID NO: 36649 - protein, 466 aa, Homo sapiens
  Payload ID: 7260
  Gene Symbol: G3BP1
  Gene Name: GTPase activating protein (SH3 domain) binding protein 1
  Uniprot ID: Q13283
  ENSP ID: ENSP00000348578
MVMEKPSPLLVGREFVRQYYTLLNQAPDMLHRFYGKNSSYVHGGLDSNGKPADAVYGQKEIHRKVMSQNFTNCHTKIRHVDAHATLNDGVVVQVMGLLSNNNQALRRFMQTFVLAPEGSVANKFYVHNDIFRYQDEVFGGFVTEPQEESEEEVEEPEERQQTPEVVPDDSGTFYDQAVVSNDMEEHLEEPVAEPEPDPEPEPEQEPVSEIQEEKPEPVLEETAPEDAQKSSSPAPADIAQTVQEDLRTFSWASVTSKNLPPSGAVPVTGIPPHVVKVPASQPRPESKPESQIPPQRPQRDQRVREQRINIPPQRGPRPIREAGEQGDIEPRRMVRHPDSHQLFIGNLPHEVDKSELKDFFQSYGNVVELRINSGGKLPNFGFVVFDDSEPVQKVLSNRPIMFRGEVRLNVEEKKTRAAREGDRRDNRLRGPGGPRGGLGGGMRGPPRGGMVQKPGFGVGRGLAPRQ

SEQ ID NO: 36650 - protein, 466 aa, Homo sapiens; identical to SEQ ID NO: 36649
  Payload ID: 7260
  Gene Symbol: G3BP1
  Gene Name: GTPase activating protein (SH3 domain) binding protein 1
  Uniprot ID: Q13283
  ENSP ID: ENSP00000377681

SEQ ID NO: 36651 - protein, 122 aa, Homo sapiens
  Payload ID: 7260
  Gene Symbol: G3BP1
  Gene Name: GTPase activating protein (SH3 domain) binding protein 1
  Uniprot ID: Q13283
  ENSP ID: ENSP00000427810
MVMEKPSPLLVGREFVRQYYTLLNQAPDMLHRFYGKNSSYVHGGLDSNGKPADAVYGQKEIHRKVMSQNFTNCHTKIRHVDAHATLNDGVVVQVMGLLSNNNQALRRFMQTFVLAPESLKKK

SEQ ID NO: 36652 - protein, 105 aa, Homo sapiens
  Payload ID: 7260
  Gene Symbol: G3BP1
  Gene Name: GTPase activating protein (SH3 domain) binding protein 1
  ENSP ID: ENSP00000428469
MVMEKPSPLLVGREFVRQYYTLLNQAPDMLHRFYGKNSSYVHGGLDSNGKPADAVYGQKEIHRKVMSQNFTNCHTKIRHVDAHATLNDGVVVQVMGLLSNNNQAL

SEQ ID NO: 36653 - protein, 122 aa, Homo sapiens; identical to SEQ ID NO: 36651
  Payload ID: 7260
  Gene Symbol: G3BP1
  Gene Name: GTPase activating protein (SH3 domain) binding protein 1
  Uniprot ID: Q13283
  ENSP ID: ENSP00000428926

SEQ ID NO: 36654 - protein, 148 aa, Homo sapiens
  Payload ID: 7260
  Gene Symbol: G3BP1
  Gene Name: GTPase activating protein (SH3 domain) binding protein 1
  ENSP ID: ENSP00000429250
MVMEKPSPLLVGREFVRQYYTLLNQAPDMLHSLHIGYHMIIRFYGKNSSYVHGGLDSNGKPADAVYGQKEIHRKVMSQNFTNCHTKIRHVDAHATLNDGVVVQVMGLLSNNNQALRRFMQTFVLAPEGSVANKFYVHNDIFRYQDEVF

SEQ ID NO: 36655 - protein, 37 aa, Homo sapiens
  Payload ID: 7260
  Gene Symbol: G3BP1
  Gene Name: GTPase activating protein (SH3 domain) binding protein 1
  ENSP ID: ENSP00000429316
MVMEKPSPLLVGREFVRQYYTLLNQAPDMLHRKSTGK

SEQ ID NO: 36656 - protein, 117 aa, Homo sapiens
  Payload ID: 7260
  Gene Symbol: G3BP1
  Gene Name: GTPase activating protein (SH3 domain) binding protein 1
  ENSP ID: ENSP00000429920
MVMEKPSPLLVGREFVRQYYTLLNQAPDMLHRFYGKNSSYVHGGLDSNGKPADAVYGQKEIHRKVMSQNFTNCHTKIRHVDAHATLNDGVVVQVMGLLSNNNQALRRFMQTFVLAPE

SEQ ID NO: 36657 - protein, 37 aa, Homo sapiens; identical to SEQ ID NO: 36655
  Payload ID: 7260
  Gene Symbol: G3BP1
  Gene Name: GTPase activating protein (SH3 domain) binding protein 1
  ENSP ID: ENSP00000430045

SEQ ID NO: 36658 - protein, 153 aa, Homo sapiens
  Payload ID: 7260
  Gene Symbol: G3BP1
  Gene Name: GTPase activating protein (SH3 domain) binding protein 1
  ENSP ID: ENSP00000430480
MVMEKPSPLLVGREFVRQYYTLLNQAPDMLHRFYGKNSSYVHGGLDSNGKPADAVYGQKEIHRKVMSQNFTNCHTKIRHVDAHATLNDGVVVQVMGLLSNNNQALRRFMQTFVLAPEVHLALFLAQSLFLNQLFLQGGLVLFSYTYERTTSLC

SEQ ID NO: 36659 - protein, 106 aa, Homo sapiens
  Payload ID: 7260
  Gene Symbol: G3BP1
  Gene Name: GTPase activating protein (SH3 domain) binding protein 1
  ENSP ID: ENSP00000430738
MVMEKPSPLLVGREFVRQYYTLLNQAPDMLHRFYGKNSSYVHGGLDSNGKPADAVYGQKEIHRKVMSQNFTNCHTKIRHVDAHATLNDGVVVQVMGLLSNNNQALR

SEQ ID NO: 36660 - protein, 37 aa, Homo sapiens; identical to SEQ ID NO: 36655
  Payload ID: 7260
  Gene Symbol: G3BP1
  Gene Name: GTPase activating protein (SH3 domain) binding protein 1
  ENSP ID: ENSP00000486887

SEQ ID NO: 36661 - protein, 449 aa, Homo sapiens
  Payload ID: 7261
  Gene Symbol: G3BP2
  Gene Name: GTPase activating protein (SH3 domain) binding protein 2
  Uniprot ID: Q9UN86
  ENSP ID: ENSP00000350518
MVMEKPSPLLVGREFVRQYYTLLNKAPEYLHRFYGRNSSYVHGGVDASGKPQEAVYGQNDIHHKVLSLNFSECHTKIRHVDAHATLSDGVVVQVMGLLSNSGQPERKFMQTFVLAPEGSVPNKFYVHNDMFRYEDEVFGDSEPELDEESEDEVEEEQEERQPSPEPVQENANSGYYEAHPVTNGIEEPLEESSHEPEPEPESETKTEELKPQVEEKNLEELEEKSTTPPPAEPVSLPQEPPKPRVEAKPEVQSQPPRVREQRPRERPGFPPRGPRPGRGDMEQNDSDNRRIIRYPDSHQLFVGNLPHDIDENELKEFFMSFGNVVELRINTKGVGGKLPNFGFVVFDDSEPVQRILIAKPIMFRGEVRLNVEEKKTRAARERETRGGGDDRRDIRRNDRGPGGPRGIVGGGMMRDRDGRGPPPRGGMAQKLGSGRGTGQMEGRFTGQRR

SEQ ID NO: 36662 - protein, 482 aa, Homo sapiens
  Payload ID: 7261
  Gene Symbol: G3BP2
  Gene Name: GTPase activating protein (SH3 domain) binding protein 2
  Uniprot ID: Q9UN86
  ENSP ID: ENSP00000352738
MVMEKPSPLLVGREFVRQYYTLLNKAPEYLHRFYGRNSSYVHGGVDASGKPQEAVYGQNDIHHKVLSLNFSECHTKIRHVDAHATLSDGVVVQVMGLLSNSGQPERKFMQTFVLAPEGSVPNKFYVHNDMFRYEDEVFGDSEPELDEESEDEVEEEQEERQPSPEPVQENANSGYYEAHPVTNGIEEPLEESSHEPEPEPESETKTEELKPQVEEKNLEELEEKSTTPPPAEPVSLPQEPPKAFSWASVTSKNLPPSGTVSSSGIPPHVKAPVSQPRVEAKPEVQSQPPRVREQRPRERPGFPPRGPRPGRGDMEQNDSDNRRIIRYPDSHQLFVGNLPHDIDENELKEFFMSFGNVVELRINTKGVGGKLPNFGFVVFDDSEPVQRILIAKPIMFRGEVRLNVEEKKTRAARERETRGGGDDRRDIRRNDRGPGGPRGIVGGGMMRDRDGRGPPPRGGMAQKLGSGRGTGQMEGRFTGQRR

SEQ ID NO: 36663 - protein, 482 aa, Homo sapiens; identical to SEQ ID NO: 36662
  Payload ID: 7261
  Gene Symbol: G3BP2
  Gene Name: GTPase activating protein (SH3 domain) binding protein 2
  Uniprot ID: Q9UN86
  ENSP ID: ENSP00000379069

SEQ ID NO: 36664 - protein, 99 aa, Homo sapiens
  Payload ID: 7261
  Gene Symbol: G3BP2
  Gene Name: GTPase activating protein (SH3 domain) binding protein 2
  ENSP ID: ENSP00000421621
MVMEKPSPLLVGREFVRQYYTLLNKAPEYLHRFYGRNSSYVHGGVDASGKPQEAVYGQNDIHHKVLSLNFSECHTKIRHVDAHATLSDGVVVQVMGLLS

SEQ ID NO: 36665 - protein, 102 aa, Homo sapiens
  Payload ID: 7261
  Gene Symbol: G3BP2
  Gene Name: GTPase activating protein (SH3 domain) binding protein 2
  ENSP ID: ENSP00000422614
MVMEKPSPLLVGREFVRQYYTLLNKAPEYLHRFYGRNSSYVHGGVDASGKPQEAVYGQNDIHHKVLSLNFSECHTKIRHVDAHATLSDGVVVQVMGLLSNSG

SEQ ID NO: 36666 - protein, 141 aa, Homo sapiens
  Payload ID: 7261
  Gene Symbol: G3BP2
  Gene Name: GTPase activating protein (SH3 domain) binding protein 2
  ENSP ID: ENSP00000422748
MVMEKPSPLLVGREFVRQYYTLLNKAPEYLHRFYGRNSSYVHGGVDASGKPQEAVYGQNDIHHKVLSLNFSECHTKIRHVDAHATLSDGVVVQVMGLLSNSGQPERKFMQTFVLAPEGSVPNKFYVHNDMFRYEDEVFGDS

SEQ ID NO: 36667 - protein, 56 aa, Homo sapiens
  Payload ID: 7261
  Gene Symbol: G3BP2
  Gene Name: GTPase activating protein (SH3 domain) binding protein 2
  ENSP ID: ENSP00000422830
MVMEKPSPLLVGREFVRQYYTLLNKAPEYLHRFYGRNSSYVHGGVDASGKPQEAVY

SEQ ID NO: 36668 - protein, 59 aa, Homo sapiens
  Payload ID: 7261
  Gene Symbol: G3BP2
  Gene Name: GTPase activating protein (SH3 domain) binding protein 2
  ENSP ID: ENSP00000423245
MVMEKPSPLLVGREFVRQYYTLLNKAPEYLHRFYGRNSSYVHGGVDASGKPQEAVYGQN

SEQ ID NO: 36669 - protein, 115 aa, Homo sapiens
  Payload ID: 7261
  Gene Symbol: G3BP2
  Gene Name: GTPase activating protein (SH3 domain) binding protein 2
  ENSP ID: ENSP00000423960
MVMEKPSPLLVGREFVRQYYTLLNKAPEYLHRFYGRNSSYVHGGVDASGKPQEAVYGQNDIHHKVLSLNFSECHTKIRHVDAHATLSDGVVVQVMGLLSNSGQPERKFMQTFVLA

SEQ ID NO: 36670 - protein, 77 aa, Homo sapiens
  Payload ID: 7261
  Gene Symbol: G3BP2
  Gene Name: GTPase activating protein (SH3 domain) binding protein 2
  ENSP ID: ENSP00000424060
MVMEKPSPLLVGREFVRQYYTLLNKAPEYLHRFYGRNSSYVHGGVDASGKPQEAVYGQNDIHHKVLSLNFSECHTKI

SEQ ID NO: 36671 - protein, 198 aa, Homo sapiens
  Payload ID: 7261
  Gene Symbol: G3BP2
  Gene Name: GTPase activating protein (SH3 domain) binding protein 2
  ENSP ID: ENSP00000424522
MVMEKPSPLLVGREFVRQYYTLLNKAPEYLHRFYGRNSSYVHGGVDASGKPQEAVYGQNDIHHKVLSLNFSECHTKIRHVDAHATLSDGVVVQVMGLLSNSGQPERKFMQTFVLAPEGSVPNKFYVHNDMFRYEDEVFGDSEPELDEESEDEVEEEQEERQPSPEPVQENANSGYYEAHPVTNGIEEPLEESSHEPEP

SEQ ID NO: 36672 - protein, 110 aa, Homo sapiens
  Payload ID: 7261
  Gene Symbol: G3BP2
  Gene Name: GTPase activating protein (SH3 domain) binding protein 2
  ENSP ID: ENSP00000425122
MVMEKPSPLLVGREFVRQYYTLLNKAPEYLHRFYGRNSSYVHGGVDASGKPQEAVYGQNDIHHKVLSLNFSECHTKIRHVDAHATLSDGVVVQVMGLLSNSGQPERKFMQ

SEQ ID NO: 36673 - protein, 125 aa, Homo sapiens
  Payload ID: 7261
  Gene Symbol: G3BP2
  Gene Name: GTPase activating protein (SH3 domain) binding protein 2
  ENSP ID: ENSP00000426311
MVMEKPSPLLVGREFVRQYYTLLNKAPEYLHRFYGRNSSYVHGGVDASGKPQEAVYGQNDIHHKVLSLNFSECHTKIRHVDAHATLSDGVVVQVMGLLSNSGQPERKFMQTFVLAPEGSVPNKFY

SEQ ID NO: 36674 - protein, 23 aa, Homo sapiens
  Payload ID: 7261
  Gene Symbol: G3BP2
  Gene Name: GTPase activating protein (SH3 domain) binding protein 2
  ENSP ID: ENSP00000426843
HGGVDASGKPQEAVYGQNNQKMK

SEQ ID NO: 36675 - protein, 629 aa, Homo sapiens [sequence omitted]

SEQ ID NO: 36676 - protein, 1460 aa, Homo sapiens
  Payload ID: 7262
  Gene Symbol: GAPVD1
  Gene Name: GTPase activating protein and VPS9 domains 1
  Uniprot ID: Q14C86
  ENSP ID: ENSP00000297933
MVKLDIHTLAHHLKQERLYVNSEKQLIQRLNADVLKTAEKLYRTAWIAKQQRINLDRLIITSAEASPAECCQHAKILEDTQFVDGYKQLGFQETAYGEFLSRLRENPRLIASSLVAGEKLNQENTQSVIYTVFTSLYGNCIMQEDESYLLQVLRYLIEFELKESDNPRRLLRRGTCAFSILFKLFSEGLFSAKLFLTATLHEPIMQLLVEDEDHLETDPNKLIERFSPSQQEKLFGEKGSDRFRQKVQEMVESNEAKLVALVNKFIGYLKQNTYCFPHSLRWIVSQMYKTLSCVDRLEVGEVRAMCTDLLLACFICPAVVNPEQYGIISDAPINEVARFNLMQVGRLLQQLAMTGSEEGDPRTKSSLGKFDKSCVAAFLDVVIGGRAVETPPLSSVNLLEGLSRTVVYITYSQLITLVNFMKSVMSGDQLREDRMALDNLLANLPPAKPGKSSSLEMTPYNTPQLSPATTPANKKNRLPIATRSRSRTNMLMDLHMDHEGSSQETIQEVQPEEVLVISLGTGPQLTPGMMSENEVLNMQLSDGGQGDVPVDENKLHGKPDKTLRFSLCSDNLEGISEGPSNRSNSVSSLDLEGESVSELGAGPSGSNGVEALQLLEHEQATTQDNLDDKLRKFEIRDMMGLTDDRDISETVSETWSTDVLGSDFDPNIDEDRLQEIAGAAAENMLGSLLCLPGSGSVLLDPCTGSTISETTSEAWSVEVLPSDSEAPDLKQEERLQELESCSGLGSTSDDTDVREVSSRPSTPGLSVVSGISATSEDIPNKIEDLRSECSSDFGGKDSVTSPDMDEITHGAHQLTSPPSQSESLLAMFDPLSSHEGASAVVRPKVHYARPSHPPPDPPILEGAVGGNEARLPNFGSHVLTPAEMEAFKQRHSYPERLVRSRSSDIVSSVRRPMSDPSWNRRPGNEERELPPAAAIGATSLVAAPHSSSSSPSKDSSRGETEERKDSDDEKSDRNRPWWRKRFVSAMPKAPIPFRKKEKQEKDKDDLGPDRFSTLTDDPSPRLSAQAQVAEDILDKYRNAIKRTSPSDGAMANYESTEVMGDGESAHDSPRDEALQNISADDLPDSASQAAHPQDSAFSYRDAKKKLRLALCSADSVAFPVLTHSTRNGLPDHTDPEDNEIVCFLKVQIAEAINLQDKNLMAQLQETMRCVCRFDNRTCRKLLASIAEDYRKRAPYIAYLTRCRQGLQTTQAHLERLLQRVLRDKEVANRYFTTVCVRLLLESKEKKIREFIQDFQKLTAADDKTAQVEDFLQFLYGAMAQDVIWQNASEEQLQDAQLAIERSVMNRIFKLAFYPNQDGDILRDQVLHEHIQRLSKVVTANHRALQIPEVYLREAPWPSAQSEIRTISAYKTPRDKVQCILRMCSTIMNLLSLANEDSVPGADDFVPVLVFVLIKANPPCLLSTVQYISSFYASCLSGEESYWWMQFTAAVEFIKTIDDRK

SEQ ID NO: 36677 - protein, 1439 aa, Homo sapiens
  Payload ID: 7262
  Gene Symbol: GAPVD1
  Gene Name: GTPase activating protein and VPS9 domains 1
  Uniprot ID: Q14C86
  ENSP ID: ENSP00000309582
MVKLDIHTLAHHLKQERLYVNSEKQLIQRLNADVLKTAEKLYRTAWIAKQQRINLDRLIITSAEASPAECCQHAKILEDTQFVDGYKQLGFQETAYGEFLSRLRENPRLIASSLVAGEKLNQENTQSVIYTVFTSLYGNCIMQEDESYLLQVLRYLIEFELKESDNPRRLLRRGTCAFSILFKLFSEGLFSAKLFLTATLHEPIMQLLVEDEDHLETDPNKLIERFSPSQQEKLFGEKGSDRFRQKVQEMVESNEAKLVALVNKFIGYLKQNTYCFPHSLRWIVSQMYKTLSCVDRLEVGEVRAMCTDLLLACFICPAVVNPEQYGIISDAPINEVARFNLMQVGRLLQQLAMTGSEEGDPRTKSSLGKFDKSCVAAFLDVVIGGRAVETPPLSSVNLLEGLSRTVVYITYSQLITLVNFMKSVMSGDQLREDRMALDNLLANLPPAKPGKSSSLEMTPYNTPQLSPATTPANKKNRLPIATRSRSRTNMLMDLHMDHEGSSQETIQEVQPEEVLVISLGTGPQLTPGMMSENEVLNMQLSDGGQGDVPVDENKLHGPSNRSNSVSSLDLEGESVSELGAGPSGSNGVEALQLLEHEQATTQDNLDDKLRKFEIRDMMGLTDDRDISETVSETWSTDVLGSDFDPNIDEDRLQEIAGAAAENMLGSLLCLPGSGSVLLDPCTGSTISETTSEAWSVEVLPSDSEAPDLKQEERLQELESCSGLGSTSDDTDVREVSSRPSTPGLSVVSGISATSEDIPNKIEDLRSECSSDFGGKDSVTSPDMDEITHGAHQLTSPPSQSESLLAMFDPLSSHEGASAVVRPKVHYARPSHPPPDPPILEGAVGGNEARLPNFGSHVLTPAEMEAFKQRHSYPERLVRSRSSDIVSSVRRPMSDPSWNRRPGNEERELPPAAAIGATSLVAAPHSSSSSPSKDSSRGETEERKDSDDEKSDRNRPWWRKRFVSAMPKAPIPFRKKEKQEKDKDDLGPDRFSTLTDDPSPRLSAQAQVAEDILDKYRNAIKRTSPSDGAMANYESTEVMGDGESAHDSPRDEALQNISADDLPDSASQAAHPQDSAFSYRDAKKKLRLALCSADSVAFPVLTHSTRNGLPDHTDPEDNEIVCFLKVQIAEAINLQDKNLMAQLQETMRCVCRFDNRTCRKLLASIAEDYRKRAPYIAYLTRCRQGLQTTQAHLERLLQRVLRDKEVANRYFTTVCVRLLLESKEKKIREFIQDFQKLTAADDKTAQVEDFLQFLYGAMAQDVIWQNASEEQLQDAQLAIERSVMNRIFKLAFYPNQDGDILRDQVLHEHIQRLSKVVTANHRALQIPEVYLREAPWPSAQSEIRTISAYKTPRDKVQCILRMCSTIMNLLSLANEDSVPGADDFVPVLVFVLIKANPPCLLSTVQYISSFYASCLSGEESYWWMQFTAAVEFIKTIDDRK

SEQ ID NO: 36678 - protein, 1412 aa, Homo sapiens
  Payload ID: 7262
  Gene Symbol: GAPVD1
  Gene Name: GTPase activating protein and VPS9 domains 1
  ENSP ID: ENSP00000377645
MVKLDIHTLAHHLKQERLYVNSEKQLIQRLNADVLKTAEKLYRTAWIAKQQRINLDRLIITSAEASPAECCQHAKILEDTQFVDGYKQLGFQETAYGEFLSRLRENPRLIASSLVAGEKLNQENTQSVIYTVFTSLYGNCIMQEDESYLLQVLRYLIEFELKESDNPRRLLRRGTCAFSILFKLFSEGLFSAKLFLTATLHEPIMQLLVEDEDHLETDPNKLIERFSPSQQEKLFGEKGSDRFRQKVQEMVESNEAKLVALVNKFIGYLKQNTYCFPHSLRWIVSQMYKTLSCVDRLEVGEVRAMCTDLLLACFICPAVVNPEQYGIISDAPINEVARFNLMQVGRLLQQLAMTGSEEGDPRTKSSLGKFDKSCVAAFLDVVIGGRAVETPPLSSVNLLEGLSRTVVYITYSQLITLVNFMKSVMSGDQLREDRMALDNLLANLPPAKPGKSSSLEMTPYNTPQLSPATTPANKKNRLPIATRSRSRTNMLMDLHMDHEGSSQETIQEVQPEEVLVISLGTGPQLTPGMMSENEVLNMQLSDGGQGDVPVDENKLHGPSNRSNSVSSLDLEGESVSELGAGPSGSNGVEALQLLEHEQATTQDNLDDKLRKFEIRDMMGLTDDRDISETVSETWSTDVLGSDFDPNIDEDRLQEIAGAAAENMLGSLLCLPGSGSVLLDPCTGSTISETTSEAWSVEVLPSDSEAPDLKQEERLQELESCSGLGSTSDDTDVREVSSRPSTPGLSVVSGISATSEDIPNKIEDLRSECSSDFGGKDSVTSPDMDEITHGAHQLTSPPSQSESLLAMFDPLSSHEGASAVVRPKVHYARPSHPPPDPPILEGAVGGNEARLPNFGSHVLTPAEMEAFKQRHSYPERLVRSRSSDIVSSVRRPMSDPSWNRRPGNEERELPPAAAIGATSLVAAPHSSSSSPSKDSSRGETEERKDSDDEKSDRNRPWWRKRFVSAMPKDDPSPRLSAQAQVAEDILDKYRNAIKRTSPSDGAMANYESTEVMGDGESAHDSPRDEALQNISADDLPDSASQAAHPQDSAFSYRDAKKKLRLALCSADSVAFPVLTHSTRNGLPDHTDPEDNEIVCFLKVQIAEAINLQDKNLMAQLQETMRCVCRFDNRTCRKLLASIAEDYRKRAPYIAYLTRCRQGLQTTQAHLERLLQRVLRDKEVANRYFTTVCVRLLLESKEKKIREFIQDFQKLTAADDKTAQVEDFLQFLYGAMAQDVIWQNASEEQLQDAQLAIERSVMNRIFKLAFYPNQDGDILRDQVLHEHIQRLSKVVTANHRALQIPEVYLREAPWPSAQSEIRTISAYKTPRDKVQCILRMCSTIMNLLSLANEDSVPGADDFVPVLVFVLIKANPPCLLSTVQYISSFYASCLSGEESYWWMQFTAAVEFIKTIDDRK

SEQ ID NO: 36679 - protein, 497 aa, Homo sapiens
  Payload ID: 7262
  Gene Symbol: GAPVD1
  Gene Name: GTPase activating protein and VPS9 domains 1
  ENSP ID: ENSP00000377646
MVKLDIHTLAHHLKQERLYVNSEKQLIQRLNADVLKTAEKLYRTAWIAKQQRINLDRLIITSAEASPAECCQHAKILEDTQFVDGYKQLGFQETAYGEFLSRLRENPRLIASSLVAGEKLNQENTQSVIYTVFTSLYGNCIMQEDESYLLQVLRYLIEFELKESDNPRRLLRRGTCAFSILFKLFSEGLFSAKLFLTATLHEPIMQLLVEDEDHLETDPNKLIERFSPSQQEKLFGEKGSDRFRQKVQEMVESNEAKLVALVNKFIGYLKQNTYCFPHSLRWIVSQMYKTLSCVDRLEVGEVRAMCTDLLLACFICPAVVNPEQYGIISDAPINEVARFNLMQVGRLLQQLAMTGSEEGDPRTKSSLGKFDKSCVAAFLDVVIGGRAVETPPLSSVNLLEGLSRTVVYITYSQLITLVNFMKSVMSGDQLREDRMALDNLLANLPPAKPGKSSSLEMTPYNTPQLSPATTPANKKNRLPIGKENFSYWSFLLNLIFH

SEQ ID NO: 36680 - protein, 1478 aa, Homo sapiens
  Payload ID: 7262
  Gene Symbol: GAPVD1
  Gene Name: GTPase activating protein and VPS9 domains 1
  Uniprot ID: Q14C86
  ENSP ID: ENSP00000377664
MVKLDIHTLAHHLKQERLYVNSEKQLIQRLNADVLKTAEKLYRTAWIAKQQRINLDRLIITSAEASPAECCQHAKILEDTQFVDGYKQLGFQETAYGEFLSRLRENPRLIASSLVAGEKLNQENTQSVIYTVFTSLYGNCIMQEDESYLLQVLRYLIEFELKESDNPRRLLRRGTCAFSILFKLFSEGLFSAKLFLTATLHEPIMQLLVEDEDHLETDPNKLIERFSPSQQEKLFGEKGSDRFRQKVQEMVESNEAKLVALVNKFIGYLKQNTYCFPHSLRWIVSQMYKTLSCVDRLEVGEVRAMCTDLLLACFICPAVVNPEQYGIISDAPINEVARFNLMQVGRLLQQLAMTGSEEGDPRTKSSLGKFDKSCVAAFLDVVIGGRAVETPPLSSVNLLEGLSRTVVYITYSQLITLVNFMKSVMSGDQLREDRMALDNLLANLPPAKPGKSSSLEMTPYNTPQLSPATTPANKKNRLPIATRSRSRTNMLMDLHMDHEGSSQETIQEVQPEEVLVISLGTGPQLTPGMMSENEVLNMQLSDGGQGDVPVDENKLHGKPDKTLRFSLCSDNLEGISEGPSNRSNSVSSLDLEGESVSELGAGPSGSNGVEALQLLEHEQATTQDNLDDKLRKFEIRDMMGLTDDRDISETVSETWSTDVLGSDFDPNIDEDRLQEIAGAAAENMLGSLLCLPGSGSVLLDPCTGSTISETTSEAWSVEVLPSDSEAPDLKQEERLQELESCSGLGSTSDDTDVREVSSRPSTPGLSVVSGISATSEDIPNKIEDLRSECSSDFGGKDSVTSPDMDEITHGAHQLTSPPSQSESLLAMFDPLSSHEGASAVVRPKVHYARPSHPPPDPPILEGAVGGNEARLPNFGSHVLTPAEMEAFKQRHSYPERLVRSRSSDIVSSVRRPMSDPSWNRRPGNEERELPPAAAIGATSLVAAPHSSSSSPSKDSSRGETEERKDSDDEKSDRNRPWWRKRFVSAMPKAPIPFRKKEKQEKDKDDLGPDRFSTLTDDPSPRLSAQAQVAEDILDKYRNAIKRTSPSDGAMANYESTGDNHDRDLSSKLLYHSDKEVMGDGESAHDSPRDEALQNISADDLPDSASQAAHPQDSAFSYRDAKKKLRLALCSADSVAFPVLTHSTRNGLPDHTDPEDNEIVCFLKVQIAEAINLQDKNLMAQLQETMRCVCRFDNRTCRKLLASIAEDYRKRAPYIAYLTRCRQGLQTTQAHLERLLQRVLRDKEVANRYFTTVCVRLLLESKEKKIREFIQDFQKLTAADDKTAQVEDFLQFLYGAMAQDVIWQNASEEQLQDAQLAIERSVMNRIFKLAFYPNQDGDILRDQVLHEHIQRLSKVVTANHRALQIPEVYLREAPWPSAQSEIRTISAYKTPRDKVQCILRMCSTIMNLLSLANEDSVPGADDFVPVLVFVLIKANPPCLLSTVQYISSFYASCLSGEESYWWMQFTAAVEFIKTIDDRK

SEQ ID NO: 36681 - protein, 1487 aa, Homo sapiens
  Payload ID: 7262
  Gene Symbol: GAPVD1
  Gene Name: GTPase activating protein and VPS9 domains 1
  Uniprot ID: Q14C86
  ENSP ID: ENSP00000377665
MVKLDIHTLAHHLKQERLYVNSEKQLIQRLNADVLKTAEKLYRTAWIAKQQRINLDRLIITSAEASPAECCQHAKILEDTQFVDGYKQLGFQETAYGEFLSRLRENPRLIASSLVAGEKLNQENTQSVIYTVFTSLYGNCIMQEDESYLLQVLRYLIEFELKESDNPRRLLRRGTCAFSILFKLFSEGLFSAKLFLTATLHEPIMQLLVEDEDHLETDPNKLIERFSPSQQEKLFGEKGSDRFRQKVQEMVESNEAKLVALVNKFIGYLKQNTYCFPHSLRWIVSQMYKTLSCVDRLEVGEVRAMCTDLLLACFICPAVVNPEQYGIISDAPINEVARFNLMQVGRLLQQLAMTGSEEGDPRTKSSLGKFDKSCVAAFLDVVIGGRAVETPPLSSVNLLEGLSRTVVYITYSQLITLVNFMKSVMSGDQLREDRMALDNLLANLPPAKPGKSSSLEMTPYNTPQLSPATTPANKKNRLPIATRSRSRTNMLMDLHMDHEGSSQETIQEVQPEEVLVISLGTGPQLTPGMMSENEVLNMQLSDGGQGDVPVDENKLHGKPDKTLRFSLCSDNLEGISEGPSNRSNSVSSLDLEGESVSELGAGPSGSNGVEALQLLEHEQATTQDNLDDKLRKFEIRDMMGLTDDRDISETVSETWSTDVLGSDFDPNIDEDRLQEIAGAAAENMLGSLLCLPGSGSVLLDPCTGSTISETTSEAWSVEVLPSDSEAPDLKQEERLQELESCSGLGSTSDDTDVREVSSRPSTPGLSVVSGISATSEDIPNKIEDLRSECSSDFGGKDSVTSPDMDEITHDFLYILQPKQHFQHIEAEADMRIQLSSSAHQLTSPPSQSESLLAMFDPLSSHEGASAVVRPKVHYARPSHPPPDPPILEGAVGGNEARLPNFGSHVLTPAEMEAFKQRHSYPERLVRSRSSDIVSSVRRPMSDPSWNRRPGNEERELPPAAAIGATSLVAAPHSSSSSPSKDSSRGETEERKDSDDEKSDRNRPWWRKRFVSAMPKAPIPFRKKEKQEKDKDDLGPDRFSTLTDDPSPRLSAQAQVAEDILDKYRNAIKRTSPSDGAMANYESTEVMGDGESAHDSPRDEALQNISADDLPDSASQAAHPQDSAFSYRDAKKKLRLALCSADSVAFPVLTHSTRNGLPDHTDPEDNEIVCFLKVQIAEAINLQDKNLMAQLQETMRCVCRFDNRTCRKLLASIAEDYRKRAPYIAYLTRCRQGLQTTQAHLERLLQRVLRDKEVANRYFTTVCVRLLLESKEKKIREFIQDFQKLTAADDKTAQVEDFLQFLYGAMAQDVIWQNASEEQLQDAQLAIERSVMNRIFKLAFYPNQDGDILRDQVLHEHIQRLSKVVTANHRALQIPEVYLREAPWPSAQSEIRTISAYKTPRDKVQCILRMCSTIMNLLSLANEDSVPGADDFVPVLVFVLIKANPPCLLSTVQYISSFYASCLSGEESYWWMQFTAAVEFIKTIDDRK

SEQ ID NO: 36682 - protein, 830 aa, Homo sapiens
  Payload ID: 7262
  Gene Symbol: GAPVD1
  Gene Name: GTPase activating protein and VPS9 domains 1
  ENSP ID: ENSP00000391251
  MOD_RES (1)..(1): Any amino acid
XLRRGTCAFSILFKLFSEGLFSAKLFLTATLHEPIMQLLVEDEDHLETDPNKLIERFSPSQQEKLFGEKGSDRFRQKVQEMVESNEAKLVALVNKFIGYLKQNTYCFPHSLRWIVSQMYKTLSCVDRLEVGEVRAMCTDLLLACFICPAVVNPEQYGIISDAPINEVARFNLMQVGRLLQQLAMTGSEEGDPRTKSSLGKFDKSCVAAFLDVVIGGRAVETPPLSSVNLLEGLSRTVVYITYSQLITLVNFMKSVMSGDQLREDRMALDNLLANLPPAKPGKSSSLEMTPYNTPQLSPATTPANKKNRLPIGQQLAAITAWDSSATNITSHITVVTPFATRSRSRTNMLMDLHMDHEGSSQETIQEVQPEEVLVISLGTGPQLTPGMMSENEVLNMQLSDGGQGDVPVDENKLHGPSNRSNSVSSLDLEGESVSELGAGPSGSNGVEALQLLEHEQATTQDNLDDKLRKFEIRDMMGLTDDRDISETVSETWSTDVLGSDFDPNIDEDRLQEIAGAAAENMLGSLLCLPGSGSVLLDPCTGSTISETTSEAWSVEVLPSDSEAPDLKQEERLQELESCSGLGSTSDDTDVREVSSRPSTPGLSVVSGISATSEDIPNKIEDLRSECSSDFGGKDSVTSPDMDEITHGAHQLTSPPSQSESLLAMFDPLSSHEGASAVVRPKVHYARPSHPPPDPPILEGAVGGNEARLPNFGSHVLTPAEMEAFKQRHSYPERLVRSRSSDIVSSVRRPMSDPSWNRRPGNEERELPPAAAIGATSLVAAPHSSSSSPSKDSSRGETEERKDSDDEKSDRNRPWWRKRFVSAMPKAPIPF

SEQ ID NO: 36683 - protein, 837 aa, Homo sapiens
  Payload ID: 7262
  Gene Symbol: GAPVD1
  Gene Name: GTPase activating protein and VPS9 domains 1
  ENSP ID: ENSP00000413082
  MOD_RES (1)..(1): Any amino acid
XNCIMQEDESYLLQVLRYLIEFELKESDNPRRLLRRGTCAFSILFKLFSEGLFSAKLFLTATLHEPIMQLLVEDEDHLETDPNKLIERFSPSQQEKLFGEKGSDRFRQKVQEMVESNEAKLVALVNKFIGYLKQNTYCFPHSLRWIVSQMYKTLSCVDRLEVGEVRAMCTDLLLACFICPAVVNPEQYGIISDAPINEVARFNLMQVGRLLQQLAMTGSEEGDPRTKSSLGKFDKSCVAAFLDVVIGGRAVETPPLSSVNLLEGLSRTVVYITYSQLITLVNFMKSVMSGDQLREDRMALDNLLANLPPAKPGKSSSLEMTPYNTPQLSPATTPANKKNRLPIATRSRSRTNMLMDLHMDHEGSSQETIQEVQPEEVLVISLGTGPQLTPGMMSENEVLNMQLSDGGQGDVPVDENKLHGKPDKTLRFSLCSDNLEGISEGPSNRSNSVSSLDLEGESVSELGAGPSGSNGVEALQLLEHEQATTQDNLDDKLRKFEIRDMMGLTDDRDISETVSETWSTDVLGSDFDPNIDEDRLQEIAGAAAENMLGSLLCLPGSGSVLLDPCTGSTISETTSEAWSVEVLPSDSEAPDLKQEERLQELESCSGLGSTSDDTDVREVSSRPSTPGLSVVSGISATSEDIPNKIEDLRSECSSDFGGKDSVTSPDMDEITHGASAVVRPKVHYARPSHPPPDPPILEGAVGGNEARLPNFGSHVLTPAEMEAFKQRHSYPERLVRSRSSDIVSSVRRPMSDPSWNRRPGNEERELPPAAAIGATSLVAAPHSSSSSPSKDSSRGETEERKDSDDEKSDRNRPWWRKRFVSAMPKAPIPFRKKEKQE

SEQ ID NO: 36684 - protein, 988 aa, Homo sapiens
  Payload ID: 7262
  Gene Symbol: GAPVD1
  Gene Name: GTPase activating protein and VPS9 domains 1
  ENSP ID: ENSP00000418747
MVKLDIHTLAHHLKQERLYVNSEKQLIQRLNADVLKTAEKLYRTAWIAKQQRINLDRLIITSAEASPAECCQHAKILEDTQFVDGYKQLGFQETAYGEFLSRLRENPRLIASSLVAGEKLNQENTQSVIYTVFTSLYGNCIMQEDESYLLQVLRYLIEFELKESDNPRRLLRRGTCAFSILFKLFSEGLFSAKLFLTATLHEPIMQLLVEDEDHLETDPNKLIERFSPSQQEKLFGEKGSDRFRQKVQEMVESNEAKLVALVNKFIGYLKQNTYCFPHSLRWIVSQMYKTLSCVDRLEVGEVRAMCTDLLLACFICPAVVNPEQYGIISDAPINEVARFNLMQVGRLLQQLAMTGSEEGDPRTKSSLGKFDKSCVAAFLDVVIGGRAVETPPLSSVNLLEGLSRTVVYITYSQLITLVNFMKSVMSGDQLREDRMALDNLLANLPPAKPGKSSSLEMTPYNTPQLSPATTPANKKNRLPIATRSRSRTNMLMDLHMDHEGSSQETIQEVQPEEVLVISLGTGPQLTPGMMSENEVLNMQLSDGGQGDVPVDENKLHGKPDKTLRFSLCSDNLEGISEGPSNRSNSVSSLDLEGESVSELGAGPSGSNGVEALQLLEHEQATTQDNLDDKLRKFEIRDMMGLTDDRDISETVSETWSTDVLGSDFDPNIDEDRLQEIAGAAAENMLGSLLCLPGSGSVLLDPCTGSTISETTSEAWSVEVLPSDSEAPDLKQEERLQELESCSGLGSTSDDTDVREVSSRPSTPGLSVVSGISATSEDIPNKIEDLRSECSSDFGGKDSVTSPDMDEITHGAHQLTSPPSQSESLLAMFDPLSSHEGASAVVRPKVHYARPSHPPPDPPILEGAVGGNEARLPNFGSHVLTPAEMEAFKQRHSYPERLVRSRSSDIVSSVRRPMSDPSWNRRPGNEERELPPAAAIGATSLVAAPHSSSSSPSKDSSRGETEERKDSDDEKSDRNRPWWRKRFVSAMPK

SEQ ID NO: 36685 - protein, 117 aa, Homo sapiens
  Payload ID: 7262
  Gene Symbol: GAPVD1
  Gene Name: GTPase activating protein and VPS9 domains 1
  ENSP ID: ENSP00000418969
MVKLDIHTLAHHLKQERLYVNSEKQLIQRLNADVLKTAEKLYRTAWIAKQQRINLDRLIITSAEASPAECCQHAKILEDTQFVDGYKQLGFQETAYGEFLSRLRENPRLIASSLVAG

SEQ ID NO: 36686 - protein, 1478 aa, Homo sapiens; identical to SEQ ID NO: 36680
  Payload ID: 7262
  Gene Symbol: GAPVD1
  Gene Name: GTPase activating protein and VPS9 domains 1
  Uniprot ID: Q14C86
  ENSP ID: ENSP00000419063

SEQ ID NO: 36687 - protein, 1433 aa, Homo sapiens
  Payload ID: 7262
  Gene Symbol: GAPVD1
  Gene Name: GTPase activating protein and VPS9 domains 1
  Uniprot ID: Q14C86
  ENSP ID: ENSP00000419767
MVKLDIHTLAHHLKQERLYVNSEKQLIQRLNADVLKTAEKLYRTAWIAKQQRINLDRLIITSAEASPAECCQHAKILEDTQFVDGYKQLGFQETAYGEFLSRLRENPRLIASSLVAGEKLNQENTQSVIYTVFTSLYGNCIMQEDESYLLQVLRYLIEFELKESDNPRRLLRRGTCAFSILFKLFSEGLFSAKLFLTATLHEPIMQLLVEDEDHLETDPNKLIERFSPSQQEKLFGEKGSDRFRQKVQEMVESNEAKLVALVNKFIGYLKQNTYCFPHSLRWIVSQMYKTLSCVDRLEVGEVRAMCTDLLLACFICPAVVNPEQYGIISDAPINEVARFNLMQVGRLLQQLAMTGSEEGDPRTKSSLGKFDKSCVAAFLDVVIGGRAVETPPLSSVNLLEGLSRTVVYITYSQLITLVNFMKSVMSGDQLREDRMALDNLLANLPPAKPGKSSSLEMTPYNTPQLSPATTPANKKNRLPIATRSRSRTNMLMDLHMDHEGSSQETIQEVQPEEVLVISLGTGPQLTPGMMSENEVLNMQLSDGGQGDVPVDENKLHGKPDKTLRFSLCSDNLEGISEGPSNRSNSVSSLDLEGESVSELGAGPSGSNGVEALQLLEHEQATTQDNLDDKLRKFEIRDMMGLTDDRDISETVSETWSTDVLGSDFDPNIDEDRLQEIAGAAAENMLGSLLCLPGSGSVLLDPCTGSTISETTSEAWSVEVLPSDSEAPDLKQEERLQELESCSGLGSTSDDTDVREVSSRPSTPGLSVVSGISATSEDIPNKIEDLRSECSSDFGGKDSVTSPDMDEITHGAHQLTSPPSQSESLLAMFDPLSSHEGASAVVRPKVHYARPSHPPPDPPILEGAVGGNEARLPNFGSHVLTPAEMEAFKQRHSYPERLVRSRSSDIVSSVRRPMSDPSWNRRPGNEERELPPAAAIGATSLVAAPHSSSSSPSKDSSRGETEERKDSDDEKSDRNRPWWRKRFVSAMPKDDPSPRLSAQAQVAEDILDKYRNAIKRTSPSDGAMANYESTEVMGDGESAHDSPRDEALQNISADDLPDSASQAAHPQDSAFSYRDAKKKLRLALCSADSVAFPVLTHSTRNGLPDHTDPEDNEIVCFLKVQIAEAINLQDKNLMAQLQETMRCVCRFDNRTCRKLLASIAEDYRKRAPYIAYLTRCRQGLQTTQAHLERLLQRVLRDKEVANRYFTTVCVRLLLESKEKKIREFIQDFQKLTAADDKTAQVEDFLQFLYGAMAQDVIWQNASEEQLQDAQLAIERSVMNRIFKLAFYPNQDGDILRDQVLHEHIQRLSKVVTANHRALQIPEVYLREAPWPSAQSEIRTISAYKTPRDKVQCILRMCSTIMNLLSLANEDSVPGADDFVPVLVFVLIKANPPCLLSTVQYISSFYASCLSGEESYWWMQFTAAVEFIKTIDDRK

SEQ ID NO: 36688 - protein, 756 aa, Homo sapiens
  Payload ID: 7262
  Gene Symbol: GAPVD1
  Gene Name: GTPase activating protein and VPS9 domains 1
  ENSP ID: ENSP00000419799
MVKLDIHTLAHHLKQERLYVNSEKQLIQRLNADVLKTAEKLYRTAWIAKQQRINLDRLIITSAEASPAECCQHAKILEDTQFVDGYKQLGFQETAYGEFLSRLRENPRLIASSLVAGEKLNQENTQSVIYTVFTSLYGNCIMQEDESYLLQVLRYLIEFELKESDNPRRLLRRGTCAFSILFKLFSEGLFSAKLFLTATLHEPIMQLLVEDEDHLETDPNKLIERFSPSQQEKLFGEKGSDRFRQKVQEMVESNEAKLVALVNKFIGYLKQNTYCFPHSLRWIVSQMYKTLSCVDRLEVGEVRAMCTDLLLACFICPAVVNPEQYGIISDAPINEVARFNLMQVGRLLQQLAMTGSEEGDPRTKSSLGKFDKSCVAAFLDVVIGGRAVETPPLSSVNLLEGLSRTVVYITYSQLITLVNFMKSVMSGDQLREDRMALDNLLANLPPAKPGKSSSLEMTPYNTPQLSPATTPANKKNRLPIATRSRSRTNMLMDLHMDHEGSSQETIQEVQPEEVLVISLGTGPQLTPGMMSENEVLNMQLSDGGQGDVPVDENKLHGKPDKTLRFSLCSDNLEGISEGPSNRSNSVSSLDLEGESVSELGAGPSGSNGVEALQLLEHEQATTQDNLDDKLRKFEIRDMMGLTDDRDISETVSETWSTDVLGSDFDPNIDEDRLQEIAGAAAENMLGSLLCLPGSGSVLLDPCTGSTISETTSEAWSVEVLPSDSEAPDLKQEERLQELESCSGLGSTSDDTDVREA

SEQ ID NO: 36689 - protein, 802 aa, Homo sapiens
  Payload ID: 7263
  Gene Symbol: GARNL3
  Gene Name: GTPase activating Rap/RanGAP domain-like 3
  ENSP ID: ENSP00000362484
MKHFCSSSVSEDLGCRRGDFSRKHYGSVELLISSDADGAIQRAGRFRVENGSSDENATALPGTWRRTDVHLENPEYHTRWYFKYFLGQVHQNYIGNDAEKSPFFLSVTLSDQNNQRVPQYRAILWRKTGTQKICLPYSPTKTLSVKSILSAMNLDKFEKGPREIFHPEIQKDLLVLEEQEGSVNFKFGVLFAKDGQLTDDEMFSNEIGSEPFQKFLNLLGDTITLKGWTGYRGGLDTKNDTTGIHSVYTVYQGHEIMFHVSTMLPYSKENKQQVERKRHIGNDIVTIVFQEGEESSPAFKPSMIRSHFTHIFALVRYNQQNDNYRLKIFSEESVPLFGPPLPTPPVFTDHQEFRDFLLVKLINGEKATLETPTFAQKRRRTLDMLIRSLHQDLMPDLHKNMLNRRSFSDVLPESPKSARKKEEARQAEFVRIGQALKLKSIVRGDAPSSLAASGICKKEPWEPQCFCSNFPHEAVCADPWGQALLVSTDAGVLLVDDDLPSVPVFDRTLPVKQMHVLETLDLLVLRADKGKDARLFVFRLSALQKGLEGKQAGKSRSDCRENKLEKTKGCHLYAINTHHSRELRIVVAIRNKLLLITRKHNKPSGVTSTSLLSPLSESPVEEFQYIREICLSDSPMVMTLVDGPAEESDNLICVAYRHQFDVVNESTGEAFRLHHVEANRVNFVAAIDVYEDGEAGLLLCYNYSCIYKKVCPFNGGSFLVQPSASDFQFCWNQAPYAIVCAFPYLLAFTTDSMEIRLVVNGNLVHTAVVPQLQLVASRVKFNQKICTRFHLETSWAEASNDL

SEQ ID NO: 36690 - protein, 1013 aa, Homo sapiens
  Payload ID: 7263
  Gene Symbol: GARNL3
  Gene Name: GTPase activating Rap/RanGAP domain-like 3
  Uniprot ID: Q5VVW2
  ENSP ID: ENSP00000362485
MVVDFCRRFVARSLCIILMKHFCSSSVSEDLGCRRGDFSRKHYGSVELLISSDADGAIQRAGRFRVENGSSDENATALPGTWRRTDVHLENPEYHTRWYFKYFLGQVHQNYIGNDAEKSPFFLSVTLSDQNNQRVPQYRAILWRKTGTQKICLPYSPTKTLSVKSILSAMNLDKFEKGPREIFHPEIQKDLLVLEEQEGSVNFKFGVLFAKDGQLTDDEMFSNEIGSEPFQKFLNLLGDTITLKGWTGYRGGLDTKNDTTGIHSVYTVYQGHEIMFHVSTMLPYSKENKQQVERKRHIGNDIVTIVFQEGEESSPAFKPSMIRSHFTHIFALVRYNQQNDNYRLKIFSEESVPLFGPPLPTPPVFTDHQEFRDFLLVKLINGEKATLETPTFAQKRRRTLDMLIRSLHQDLMPDLHKNMLNRRSFSDVLPESPKSARKKEEARQAEFVRIGQALKLKSIVRGDAPSSLAASGICKKEPWEPQCFCSNFPHEAVCADPWGQALLVSTDAGVLLVDDDLPSVPVFDRTLPVKQMHVLETLDLLVLRADKGKDARLFVFRLSALQKGLEGKQAGKSRSDCRENKLEKTKGCHLYAINTHHSRELRIVVAIRNKLLLITRKHNKPSGVTSTSLLSPLSESPVEEFQYIREICLSDSPMVMTLVDGPAEESDNLICVAYRHQFDVVNESTGEAFRLHHVEANRVNFVAAIDVYEDGEAGLLLCYNYSCIYKKVCPFNGGSFLVQPSASDFQFCWNQAPYAIVCAFPYLLAFTTDSMEIRLVVNGNLVHTAVVPQLQLVASRSDIYFTATAAVNEVSSGGSSKGASARNSPQTPPGRDTPVFPSSLGEGEIQSKNLYKIPLRNLVGRSIERPLKSPLVSKVITPPTPISVGLAAIPVTHSLSLSRMEIKEIASRTRRELLGLSDEGGPKSEGAPKAKSKPRKRLEESQGGPKPGAVRSSSSDRIPSGSLESASTSEANPEGHSASSDQDPVADREGSPVSGSSPFQLTAFSDEDIIDLK

SEQ ID NO: 36691 - protein, 48 aa, Homo sapiens
  Payload ID: 7263
  Gene Symbol: GARNL3
  Gene Name: GTPase activating Rap/RanGAP domain-like 3
  ENSP ID: ENSP00000389679
MDPLTKVPCGSQIAQTILWKAKSSLSFGIQPLQTWPTKDPELESQVNL

SEQ ID NO: 36692 - protein, 991 aa, Homo sapiens
  Payload ID: 7263
  Gene Symbol: GARNL3
  Gene Name: GTPase activating Rap/RanGAP domain-like 3
  Uniprot ID: Q5VVW2
  ENSP ID: ENSP00000396205
MKSSVSEDLGCRRGDFSRKHYGSVELLISSDADGAIQRAGRFRVENGSSDENATALPGTWRRTDVHLENPEYHTRWYFKYFLGQVHQNYIGNDAEKSPFFLSVTLSDQNNQRVPQYRAILWRKTGTQKICLPYSPTKTLSVKSILSAMNLDKFEKGPREIFHPEIQKDLLVLEEQEGSVNFKFGVLFAKDGQLTDDEMFSNEIGSEPFQKFLNLLGDTITLKGWTGYRGGLDTKNDTTGIHSVYTVYQGHEIMFHVSTMLPYSKENKQQVERKRHIGNDIVTIVFQEGEESSPAFKPSMIRSHFTHIFALVRYNQQNDNYRLKIFSEESVPLFGPPLPTPPVFTDHQEFRDFLLVKLINGEKATLETPTFAQKRRRTLDMLIRSLHQDLMPDLHKNMLNRRSFSDVLPESPKSARKKEEARQAEFVRIGQALKLKSIVRGDAPSSLAASGICKKEPWEPQCFCSNFPHEAVCADPWGQALLVSTDAGVLLVDDDLPSVPVFDRTLPVKQMHVLETLDLLVLRADKGKDARLFVFRLSALQKGLEGKQAGKSRSDCRENKLEKTKGCHLYAINTHHSRELRIVVAIRNKLLLITRKHNKPSGVTSTSLLSPLSESPVEEFQYIREICLSDSPMVMTLVDGPAEESDNLICVAYRHQFDVVNESTGEAFRLHHVEANRVNFVAAIDVYEDGEAGLLLCYNYSCIYKKVCPFNGGSFLVQPSASDFQFCWNQAPYAIVCAFPYLLAFTTDSMEIRLVVNGNLVHTAVVPQLQLVASRSDIYFTATAAVNEVSSGGSSKGASARNSPQTPPGRDTPVFPSSLGEGEIQSKNLYKIPLRNLVGRSIERPLKSPLVSKVITPPTPISVGLAAIPVTHSLSLSRMEIKEIASRTRRELLGLSDEGGPKSEGAPKAKSKPRKRLEESQGGPKPGAVRSSSSDRIPSGSLESASTSEANPEGHSASSDQDPVADREGSPVSGSSPFQLTAFSDEDIIDLK

SEQ ID NO: 36693 - protein, 48 aa, Homo sapiens; identical to SEQ ID NO: 36691
  Payload ID: 7263
  Gene Symbol: GARNL3
  Gene Name: GTPase activating Rap/RanGAP domain-like 3
  ENSP ID: ENSP00000396319

SEQ ID NO: 36694 - protein, 88 aa, Homo sapiens
  Payload ID: 7263
  Gene Symbol: GARNL3
  Gene Name: GTPase activating Rap/RanGAP domain-like 3
  ENSP ID: ENSP00000397246
MDPLTKVPCGSQIAQTILWKAKSSLSFGIQPLQTWPTKDPELESQVNLLFPVMLMEPSKGLEDSEWKMALQMRMQLPCLVLGEEQTCT

SEQ ID NO: 36695 - protein, 267 aa, Homo sapiens
  Payload ID: 7263
  Gene Symbol: GARNL3
  Gene Name: GTPase activating Rap/RanGAP domain-like 3
  ENSP ID: ENSP00000400579
MDPLTKVPCGSQIAQTILWKAKSSLSFGIQPLQTWPTKDPELESQVNLSVSEDLGCRRGDFSRKHYGSVELLISSDADGAIQRAGRFRVENGSSDENATALPGTWRRTDVHLENPEYHTRWYFKYFLGQVHQNYIGNDAEKSPFFLSVTLSDQNNQRVPQYRAILWRKTGTQKICLPYSPTKTLSVKSILSAMNLDKFEKGPREIFHPEIQKDLLVLEEQEGSVNFKFGVLFAKDGQLTDDEMFSNEIGSEPFQKFLNLLGDTITLK

SEQ ID NO: 36696 - protein, 139 aa, Homo sapiens
  Payload ID: 7263
  Gene Symbol: GARNL3
  Gene Name: GTPase activating Rap/RanGAP domain-like 3
  ENSP ID: ENSP00000411160
MDPLTKVPCGSQIAQTILWKAKSSLSFGIQPLQTWPTKDPELESQVNLSVSEDLGCRRGDFSRKHYGSVELLISSDADGAIQRAGRFRVENGSSDENATALPGTWRRTDVHLENPEYHTRWYFKYFLGQVHQNYIGNDA

SEQ ID NO: 36697 - protein, 167 aa, Homo sapiens
  Payload ID: 7263
  Gene Symbol: GARNL3
  Gene Name: GTPase activating Rap/RanGAP domain-like 3
  ENSP ID: ENSP00000411329
MKSSVSEDLGCRRGDFSRKHYGSVELLISSDADGAIQRAGRFRVENGSSDENATALPGTWRRTDVHLENPEYHTRWYFKYFLGQVHQNYIGNDAEKSPFFLSVTLSDQNNQRVPQYRAILWRKTGTQKICLPYSPTKTLSVKSILSAMNLDKFEKGPREIFHPEIQK

SEQ ID NO: 36698 - protein, 110 aa, Homo sapiens
  Payload ID: 7263
  Gene Symbol: GARNL3
  Gene Name: GTPase activating Rap/RanGAP domain-like 3
  ENSP ID: ENSP00000416473
MDPLTKVPCGSQIAQTILWKAKSSLSFGIQPLQTWPTKDPELESQVNLSVSEDLGCRRGDFSRKHYGSVELLISSDADGAIQRAGRFRVENGSSDENATALPGTWRRTDV

SEQ ID NO: 36699 - protein, 81 aa, Homo sapiens
  Payload ID: 7263
  Gene Symbol: GARNL3
  Gene Name: GTPase activating Rap/RanGAP domain-like 3
  ENSP ID: ENSP00000474589
  MOD_RES (1)..(1): Any amino acid
XMPDLHKNMLNRRSFSDVLPESPKSARKKEEARQAEFVRIGQALKLKSIVRGDAPSSLAASGICKKEMTFHQCPCLTELCQ

SEQ ID NO: 36700 - protein, 306 aa, Homo sapiens
  Payload ID: 7264
  Gene Symbol: GIMAP1
  Gene Name: GTPase, IMAP family member 1
  Uniprot ID: Q8WWP7
  ENSP ID: ENSP00000302833
MGGRKMATDEENVYGLEENAQSRQESTRRLILVGRTGAGKSATGNSILGQRRFFSRLGATSVTRACTTGSRRWDKCHVEVVDTPDIFSSQVSKTDPGCEERGHCYLLSAPGPHALLLVTQLGRFTAQDQQAVRQVRDMFGEDVLKWMVIVFTRKEDLAGGSLHDYVSNTENRALRELVAECGGRVCAFDNRATGREQEAQVEQLLGMVEGLVLEHKGAHYSNEVYELAQVLRWAGPEERLRRVAERVAARVQRRPWGAWLSARLWKWLKSPRSWRLGLALLLGGALLFWVLLHRRWSEAVAEVGPD

SEQ ID NO: 36701 - protein, 337 aa, Homo sapiens
  Payload ID: 7265
  Gene Symbol: GIMAP2
  Gene Name: GTPase, IMAP family member 2
  Uniprot ID: Q9UG22
  ENSP ID: ENSP00000223293
MDQNEHSHWGPHAKGQCASRSELRIILVGKTGTGKSAAGNSILRKQAFESKLGSQTLTKTCSKSQGSWGNREIVIIDTPDMFSWKDHCEALYKEVQRCYLLSAPGPHVLLLVTQLGRYTSQDQQAAQRVKEIFGEDAMGHTIVLFTHKEDLNGGSLMDYMHDSDNKALSKLVAACGGRICAFNNRAEGSNQDDQVKELMDCIEDLLMEKNGDHYTNGLYSLIQRSKCGPVGSDERVKEFKQSLIKYMETQRSYTALAEANCLKGALIKTQLCVLFCIQLFLRLIILWLCILHSMCNLFCCLLFSMCNLFCSLLFIIPKKLMIFLRTVIRLERKTPRL

SEQ ID NO: 36702 - protein, 43 aa, Homo sapiens
  Payload ID: 7265
  Gene Symbol: GIMAP2
  Gene Name: GTPase, IMAP family member 2
  ENSP ID: ENSP00000420423
MDQNEHSHWGERKVKRAIWLPLSKLQRGVSGAAWLLFSEYRNV

SEQ ID NO: 36703 - protein, 329 aa, Homo sapiens
  Payload ID: 7266
  Gene Symbol: GIMAP4
  Gene Name: GTPase, IMAP family member 4
  Uniprot ID: Q9NUV9
  ENSP ID: ENSP00000255945
MAAQYGSMSFNPSTPGASYGPGRQEPRNSQLRIVLVGKTGAGKSATGNSILGRKVFHSGTAAKSITKKCEKRSSSWKETELVVVDTPGIFDTEVPNAETSKEIIRCILLTSPGPHALLLVVPLGRYTEEEHKATEKILKMFGERARSFMILIFTRKDDLGDTNLHDYLREAPEDIQDLMDIFGDRYCALNNKATGAEQEAQRAQLLGLIQRVVRENKEGCYTNRMYQRAEEEIQKQTQAMQELHRVELEREKARIREEYEEKIRKLEDKVEQEKRKKQMEKKLAEQEAHYAVRQQRARTEVESKDGILELIMTALQIASFILLRLFAED

SEQ ID NO: 36704 - protein, 151 aa, Homo sapiens
  Payload ID: 7266
  Gene Symbol: GIMAP4
  Gene Name: GTPase, IMAP family member 4
  ENSP ID: ENSP00000418615
MAAQYGSMSFNPSTPGASYGERAFSAPQTRLQGGPGRQEPRNSQLRIVLVGKTGAGKSATGNSILGRKVFHSGTAAKSITKKCEKRSSSWKETELVVVDTPGIFDTEVPNAETSKEIIRCILLTSPGPHALLLVVPLGRYTEEEHKATEKI

SEQ ID NO: 36705 - protein, 343 aa, Homo sapiens
  Payload ID: 7266
  Gene Symbol: GIMAP4
  Gene Name: GTPase, IMAP family member 4
  ENSP ID: ENSP00000419545
MAAQYGSMSFNPSTPGASYGERAFSAPQTRLQGGPGRQEPRNSQLRIVLVGKTGAGKSATGNSILGRKVFHSGTAAKSITKKCEKRSSSWKETELVVVDTPGIFDTEVPNAETSKEIIRCILLTSPGPHALLLVVPLGRYTEEEHKATEKILKMFGERARSFMILIFTRKDDLGDTNLHDYLREAPEDIQDLMDIFGDRYCALNNKATGAEQEAQRAQLLGLIQRVVRENKEGCYTNRMYQRAEEEIQKQTQAMQELHRVELEREKARIREEYEEKIRKLEDKVEQEKRKKQMEKKLAEQEAHYAVRQQRARTEVESKDGILELIMTALQIASFILLRLFAED

SEQ ID NO: 36706 - protein, 307 aa, Homo sapiens
  Payload ID: 7267
  Gene Symbol: GIMAP5
  Gene Name: GTPase, IMAP family member 5
  Uniprot ID: Q96F15
  ENSP ID: ENSP00000351473
MGGFQRGKYGTMAEGRSEDNLSATPPALRIILVGKTGCGKSATGNSILGQPVFESKLRAQSVTRTCQVKTGTWNGRKVLVVDTPSIFESQADTQELYKNIGDCYLLSAPGPHVLLLVIQLGRFTAQDTVAIRKVKEVFGTGAMRHVVILFTHKEDLGGQALDDYVANTDNCSLKDLVRECERRYCAFNNWGSVEEQRQQQAELLAVIERLGREREGSFHSNDLFLDAQLLQRTGAGACQEDYRQYQAKVEWQVEKHKQELRENESNWAYKALLRVKHLMLLHYEIFVFLLLCSILFFIIFLFIFHYI

SEQ ID NO: 36707 - protein, 307 aa, Homo sapiens; identical to SEQ ID NO: 36706
  Payload ID: 7267
  Gene Symbol: GIMAP5
  Gene Name: GTPase, IMAP family member 5
  ENSP ID: ENSP00000487840

SEQ ID NO: 36708 - protein, 292 aa, Homo sapiens
  Payload ID: 7268
  Gene Symbol: GIMAP6
  Gene Name: GTPase, IMAP family member 6
  Uniprot ID: Q6P9H5
  ENSP ID: ENSP00000330374
MEEEEYEQIPQENPPEELSQDPVLELSGGLREKEQKTPRRLRLILMGKTGSGKSATGNSILGRDVFESKLSTRPVTKTSQRRSREWAGKELEVIDTPNILSPQVSPEVADAICQAIVLSAPGPHAVLLVTQLGRFTDEDQQVVRRLQEVFGVGVLGHTILVFTRKEDLAGGSLEDYVRETNNQALAWLDVTLARRHCGFNNRAQGEEQEAQLRELMEKVEAIMWENEGDYYSNKAYQYTQQNFRLKELQERQVSQGQGSEDVPGEESWLEGLSQIQKESEEAHRCLLGKADL

SEQ ID NO: 36709 - protein, 62 aa, Homo sapiens
  Payload ID: 7268
  Gene Symbol: GIMAP6
  Gene Name: GTPase, IMAP family member 6
  Uniprot ID: Q6P9H5
  ENSP ID: ENSP00000418304
MEEEEYEQIPQENPPEELSQDPVLELSGGLARGGRRYLPSHRLIRPRAPRRAPGDTTGPVHG

SEQ ID NO: 36710 - protein, 362 aa, Homo sapiens
  Payload ID: 7268
  Gene Symbol: GIMAP6
  Gene Name: GTPase, IMAP family member 6
  ENSP ID: ENSP00000479580
MEEEEYEQIPQENPPEELSQDPVLELSGGSALALGENVQPHLQGCGPRMVAQRWFQGRCWSFTICPCSLGVHPEAPGDDKMGYMGPYPSSLCFLWIFLGLREKEQKTPRRLRLILMGKTGSGKSATGNSILGRDVFESKLSTRPVTKTSQRRSREWAGKELEVIDTPNILSPQVSPEVADAICQAIVLSAPGPHAVLLVTQLGRFTDEDQQVVRRLQEVFGVGVLGHTILVFTRKEDLAGGSLEDYVRETNNQALAWLDVTLARRHCGFNNRAQGEEQEAQLRELMEKVEAIMWENEGDYYSNKAYQYTQQNFRLKELQERQVSQGQGSEDVPGEESWLEGLSQIQKESEEAHRCLLGKADL

SEQ ID NO: 36711 - protein, 300 aa, Homo sapiens
  Payload ID: 7269
  Gene Symbol: GIMAP7
  Gene Name: GTPase, IMAP family member 7
  Uniprot ID: Q8NHV1
  ENSP ID: ENSP00000315474
MAESEDRSLRIVLVGKTGSGKSATANTILGEEIFDSRIAAQAVTKNCQKASREWQGRDLLVVDTPGLFDTKESLDTTCKEISRCIISSCPGPHAIVLVLLLGRYTEEEQKTVALIKAVFGKSAMKHMVILFTRKEELEGQSFHDFIADADVGLKSIVKECGNRCCAFSNSKKTSKAEKESQVQELVELIEKMVQCNEGAYFSDDIYKDTEERLKQREEVLRKIYTDQLNEEIKLVEEDKHKSEEEKEKEIKLLKLKYDEKIKNIREEAERNIFKDVFNRIWKMLSEIWHRFLSKCKFYSS

SEQ ID NO: 36712 - protein, 665 aa, Homo sapiens
  Payload ID: 7270
  Gene Symbol: GIMAP8
  Gene Name: GTPase, IMAP family member 8
  Uniprot ID: Q8ND71
  ENSP ID: ENSP00000305107
MSEQSCQMSELRLLLLGKCRSGKSATGNAILGKHVFKSKFSDQTVIKMCQRESWVLRERKVVVIDTPDLFSSIACAEDKQRNIQHCLELSAPSLHALLLVIAIGHFTREDEETAKGIQQVFGAEARRHIIIVFTRKDDLGDDLLQDFIEKNKPLKQLVQDYEGRYCIFNNKTNSKDEQITQVLELLRKVESLVNTNGGPYHVNFKTEGSRFQDCVNEAASQEGDKPQGPRERQLQSTGPEQNPGTSELTVLLVGKRGAGKSAAGNSILGRQAFQTGFSEQSVTQSFLSESRSWRKKKVSIIDAPDISSLKNIDSEVRKHICTGPHAFLLVTPLGFYTKNDEAVLSTIQNNFGEKFFEYMIILLTRKEDLGDQDLDTFLRNSNKALYGLIQKCKNRYSAFNYRATGEEEQRQADELLEKIESMVHQNGNKHCVFREKETLNIVLVGRSGTGKSATGNSILGSLVFTSRLRAQPVTKTSQSGRRTWDGQEVVVVDTPSFNQMLDVEKDPSRLEEEVKRCLSCCEKGDTFFVLVFQLGRFTEEDKTAVAKLEAIFGADFTKYAIMLFTRKEDLGAGNLEDFMKNSDNKALRRIFKKCGRRVCAFNNKETGQAQETQVKALLTKVNDLRKESGWSGYPHTQENVSKLIKNVQEMSQAEKLLKNLIGILQ

SEQ ID NO: 36713 - protein, 387 aa, Homo sapiens
  Payload ID: 7271
  Gene Symbol: GTPBP10
  Gene Name: GTP-binding protein 10 (putative)
  Uniprot ID: A4D1E9
  ENSP ID: ENSP00000222511
MVHCSCVLFRKYGNFIDKLRLFTRGGSGGMGYPRLGGEGGKGGDVWVVAQNRMTLKQLKDRYPRKRFVAGVGANSKISALKGSKGKDCEIPVPVGISVTDENGKIIGELNKENDRILVAQGGLGGKLLTNFLPLKGQKRIIHLDLKLIADVGLVGFPNAGKSSLLSCVSHAKPAIADYAFTTLKPELGKIMYSDFKQISVADLPGLIEGAHMNKGMGHKFLKHIERTRQLLFVVDISGFQLSSHTQYRTAFETIILLTKELELYKEELQTKPALLAVNKMDLPDAQDKFHELMSQLQNPKDFLHLFEKNMIPERTVEFQHIIPISAVTGEGIEELKNCIRKSLDEQANQENDALHKKQLLNLWISDTMSSTEPPSKHAVTTSKMDII

SEQ ID NO: 36714 - protein, 308 aa, Homo sapiens
  Payload ID: 7271
  Gene Symbol: GTPBP10
  Gene Name: GTP-binding protein 10 (putative)
  Uniprot ID: A4D1E9
  ENSP ID: ENSP00000257659
MVHCSCVLFRKYGNFIDKLRLFTRGGSGGMGYPRLGGEGGKGGDVWVVAQNRMTLKQLKDRYPRKRFVAGVGANSKFPNAGKSSLLSCVSHAKPAIADYAFTTLKPELGKIMYSDFKQISVADLPGLIEGAHMNKGMGHKFLKHIERTRQLLFVVDISGFQLSSHTQYRTAFETIILLTKELELYKEELQTKPALLAVNKMDLPDAQDKFHELMSQLQNPKDFLHLFEKNMIPERTVEFQHIIPISAVTGEGIEELKNCIRKSLDEQANQENDALHKKQLLNLWISDTMSSTEPPSKHAVTTSKMDII

SEQ ID NO: 36715 - protein, 116 aa, Homo sapiens
  Payload ID: 7271
  Gene Symbol: GTPBP10
  Gene Name: GTP-binding protein 10 (putative)
  Uniprot ID: A4D1E9
  ENSP ID: ENSP00000369398
MVHCSCVLFRKYGNFIDKLRLFTRGGSGGMGYPRLGGEGGKGGDVWVVAQNRMTLKQLKDRYPRKRFVAGVGANSKISALKGSKGKDCEIPVPVGISVTDENGKIIDSQMLENPLC

SEQ ID NO: 36716 - protein, 236 aa, Homo sapiens
  Payload ID: 7271
  Gene Symbol: GTPBP10
  Gene Name: GTP-binding protein 10 (putative)
  ENSP ID: ENSP00000389510
MRTVSLCHPDWSALASSWLTAASTSWAQYGNFIDKLRLFTRGGSGGMGYPRLGGEGGKGGDVWVVAQNRMTLKQLKDRYPRKRFVAGVGANSKISALKGSKGKDCEIPVPVGISVTDENGKIIGELNKENDRILVAQGGLGGKLLTNFLPLKGQKRIIHLDLKLIADVGLVGFPNAGKSSLLSCVSHAKPAIADYAFTTLKPELGKIMYSDFKQISVADLPGLIEGAHMNKGMGHK

SEQ ID NO: 36717 - protein, 210 aa, Homo sapiens
  Payload ID: 7271
  Gene Symbol: GTPBP10
  Gene Name: GTP-binding protein 10 (putative)
  ENSP ID: ENSP00000405697
MRYGNFIDKLRLFTRGGSGGMGYPRLGGEGGKGGDVWVVAQNRMTLKQLKDRYPRKRFVAGVGANSKISALKGSKGKDCEIPVPVGISVTDENGKIIGELNKENDRILVAQGGLGGKLLTNFLPLKGQKRIIHLDLKLIADVGLVGFPNAGKSSLLSCVSHAKPAIADYAFTTLKPELGKIMYSDFKQISVADLPGLIEGAHMNKGMGHK

SEQ ID NO: 36718 - protein, 107 aa, Homo sapiens
  Payload ID: 7271
  Gene Symbol: GTPBP10
  Gene Name: GTP-binding protein 10 (putative)
  ENSP ID: ENSP00000410311
MRYGNFIDKLRLFTRGGSGGMGYPRLGGEGGKGGDVWVVAQNRMTLKQLKDRYPRKRFVAGVGANSKISALKGSKGKDCEIPVPVGISVTDENGKIIDSQMLENPLC

SEQ ID NO: 36719 - protein, 70 aa, Homo sapiens
  Payload ID: 7271
  Gene Symbol: GTPBP10
  Gene Name: GTP-binding protein 10 (putative)
  ENSP ID: ENSP00000411091
MRYGNFIDKLRLFTRGGSGGMGYPRLGGEGGKGGDVWVVAQNRMTLKQLKDRYPRKRFVAGVGANSKRTQ

SEQ ID NO: 36720 - protein, 242 aa, Homo sapiens
  Payload ID: 7271
  Gene Symbol: GTPBP10
  Gene Name: GTP-binding protein 10 (putative)
  ENSP ID: ENSP00000416596
MVHCSCVLFRKYGNFIDKLRLFTRGGSGGMGYPRLGGEGGKGGDVWVVAQNRMTLKQLKDRYPRKRFVAGVGANSKISALKGSKGKDCEIPVPVGISVTDENGKIIVTTLKPELGKIMYSDFKQISVADLPGLIEGAHMNKGMGHKFLKHIERTRQLLFVVDISGFQLSSHTQYRTAFETIILLTKELELYKEELQTKPALLAVNKMDLPDAQDKFHELMSQLQNPKDFLHLFEKNMIPERT

SEQ ID NO: 36721 - protein, 79 aa, Homo sapiens
  Payload ID: 7271
  Gene Symbol: GTPBP10
  Gene Name: GTP-binding protein 10 (putative)
  ENSP ID: ENSP00000416713
MVHCSCVLFRKYGNFIDKLRLFTRGGSGGMGYPRLGGEGGKGGDVWVVAQNRMTLKQLKDRYPRKRFVAGVGANSKRTQ

SEQ ID NO: 36722 - protein, 121 aa, Homo sapiens
  Payload ID: 7272
  Gene Symbol: GTPBP8
  Gene Name: GTP-binding protein 8 (putative)
  Uniprot ID: Q8N3Z3
  ENSP ID: ENSP00000295864
MAAPGLRLGAGRLFEMPAVLERLSRYNSTSQAFAEVLRLPKQQLRKLLYPLQEVERFLAPYGRQDLHLRIFDPSPEDIARADNIFTATERNRIDYVSSAVRIDHAPDLPRPELEENIFISG

SEQ ID NO: 36723 - protein, 251 aa, Homo sapiens
  Payload ID: 7272
  Gene Symbol: GTPBP8
  Gene Name: GTP-binding protein 8 (putative)
  Uniprot ID: Q8N3Z3
  ENSP ID: ENSP00000373175
MAAPGLRLGAGRLFEMPAVLERLSRYNSTSQAFAEVLRLPKQQLRKLLYPLQEVERFLAPYGRQDLHLRIFDPSPEDIARADNIFTATERNRIDYVSSAVRIDHAPDLPRPEGHTKKMNFFKVGKHFTVVDMPGYGFRAPEDFVDMVETYLKERRNLKRTFLLVDSVVGIQKTDNIAIEMCEEFALPYVIVLTKIDKSSKGHLLKQVLQIQKFVNMKTQGCFPQLFPVSAVTFSGIHLLRCFIASVTGSLD

SEQ ID NO: 36724 - protein, 284 aa, Homo sapiens
  Payload ID: 7272
  Gene Symbol: GTPBP8
  Gene Name: GTP-binding protein 8 (putative)
  Uniprot ID: Q8N3Z3
  ENSP ID: ENSP00000373176
MAAPGLRLGAGRLFEMPAVLERLSRYNSTSQAFAEVLRLPKQQLRKLLYPLQEVERFLAPYGRQDLHLRIFDPSPEDIARADNIFTATERNRIDYVSSAVRIDHAPDLPRPEVCFIGRSNVGKSSLIKALFSLAPEVEVRVSKKPGHTKKMNFFKVGKHFTVVDMPGYGFRAPEDFVDMVETYLKERRNLKRTFLLVDSVVGIQKTDNIAIEMCEEFALPYVIVLTKIDKSSKGHLLKQVLQIQKFVNMKTQGCFPQLFPVSAVTFSGIHLLRCFIASVTGSLD

SEQ ID NO: 36725 - protein, 173 aa, Homo sapiens
  Payload ID: 7272
  Gene Symbol: GTPBP8
  Gene Name: GTP-binding protein 8 (putative)
  ENSP ID: ENSP00000417632
MVCFIGRSNVGKSSLIKALFSLAPEVEVRVSKKPGHTKKMNFFKVGKHFTVVDMPGYGFRAPEDFVDMVETYLKERRNLKRTFLLVDSVVGIQKTDNIAIEMCEEFALPYVIVLTKIDKSSKGHLLKQVLQIQKFVNMKTQGCFPQLFPVSAVTFSGIHLLRCFIASVTGSLD

SEQ ID NO: 36726 - protein, 139 aa, Homo sapiens
  Payload ID: 7272
  Gene Symbol: GTPBP8
  Gene Name: GTP-binding protein 8 (putative)
  ENSP ID: ENSP00000418261
MPAVLERLSRYNSTSQAFAEVLRLPKQQLRKLLYPLQEVERFLAPYGRQDLHLRIFDPSPEDIARADNIFTATERNRIDYVSSAVRIDHAPDLPRPEVCFIGRSNVGKSSLIKALFSLAPEVEVRVSKKPLEENIFISG

SEQ ID NO: 36727 - protein, 134 aa, Homo sapiens
  Payload ID: 7272
  Gene Symbol: GTPBP8
  Gene Name: GTP-binding protein 8 (putative)
  ENSP ID: ENSP00000418514
MNFFKVGKHFTVVDMPGYGFRAPEDFVDMVETYLKERRNLKRTFLLVDSVVGIQKTDNIAIEMCEEFALPYVIVLTKIDKSSKGHLLKQVLQIQKFVNMKTQGCFPQLFPVSAVTFSGIHLLRCFIASVTGSLD

SEQ ID NO: 36728 - protein, 251 aa, Homo sapiens; identical to SEQ ID NO: 36723
  Payload ID: 7272
  Gene Symbol: GTPBP8
  Gene Name: GTP-binding protein 8 (putative)
  Uniprot ID: Q8N3Z3
  ENSP ID: ENSP00000418877

SEQ ID NO: 36729 - protein, 307 aa, Homo sapiens
  Payload ID: 7272
  Gene Symbol: GTPBP8
  Gene Name: GTP-binding protein 8 (putative)
  ENSP ID: ENSP00000478184
MAAPGLRLGAGRLFEMPAVLERLSRYNSTSQAFAEVLRLPKQQLRKLLYPLQEVERFLAPYGRQDLHLRIFDPSPEDIARADNIFTATERNRIDYVSSAVRIDHAPDLPRPEVRGDSTVHLRAGVTALPLPGRPARGVFYRQSNVGKSSLIKLYFHWPLRLKSESPKNQDTQENEFFKVGKHFTVVDMPGYGFRAPEDFVDMVETYLKERRNLKRTFLLVDSVVGIQKTDNIAIEMCEEFALPYVIVLTKIDKSSKGHLLKQVLQIQKFVNMKTQGCFPQLFPVSAVTFSGIHLLRCFIASVTGSLD

SEQ ID NO: 36730 - protein, 307 aa, Homo sapiens [sequence omitted]

SEQ ID NO: 36731 - protein, 304 aa, Homo sapiens
  Payload ID: 7273
  Gene Symbol:
  Gene Name: GU182339.12
  ENSP ID: ENSP00000477925
MSLMVISMACVGFFWLQGAWPHEGFRRKPSLLAHPGRLVKSEETVILQCWSDVMFEHFLLHREGTFNDTLRLIGEHIDGVSKANFSIGRMRQDLAGTYRCYGSVPHSPYQFSAPSDPLDIVITGLYEKPSLSAQPGPTVLAGESVTLSCSSWSSYDMYHLSTEGEAHERRFSAGPKVNGTFQADFPLGPATQGGTYRCFGSFHDSPYEWSKSSDPLLVSVTGNPSNSWPSPTEPSSKTGNPRHLHVLIGTSVVKLPFTILLFFLLHRWCSNKKNASVMDQGPAGNRTVNREDSDEQDHQEVSYA

SEQ ID NO: 36732 - protein, 293 aa, Homo sapiens
  Payload ID: 7274
  Gene Symbol:
  Gene Name: GU182343.1
  ENSP ID: ENSP00000482483
  MOD_RES (1)..(1): Any amino acid
XGVHRKPSLLAHPGLLVKSGETVILQCWSDVRFERFLLHREGITEDPLRLIGQLHDAGSQVNYSMGPMTPALAGTYRCFGSVTHLPYELSAPSDPLDIVVVGLYGKPSLSAQPGPTVQAGENVTLSCSSRSLFDIYHLSREAEAGELRLTAVLRVNGTFQANFPLGPVTHGGNYRCFGSFRALPHAWSDPSDPLPVSVTGNSRHLHVLIGTSVVIIPFAILLFFLLHRWCPNKKNAVVMDQEPAGNRTVNREDSDDQDPQEVTYAQLNHCVFTQRKITRPSQRPKTPPTDTSV

SEQ ID NO: 36733 - protein, 304 aa, Homo sapiens; identical to SEQ ID NO: 36731
  Payload ID: 7275
  Gene Symbol:
  Gene Name: GU182347.12
  ENSP ID: ENSP00000478314

SEQ ID NO: 36734 - protein, 328 aa, Homo sapiens
  Payload ID: 7276
  Gene Symbol:
  Gene Name: GU182353.5
  ENSP ID: ENSP00000479531
MSLMVVSMACVGFFLLQGAWPHEGGQDKPFLSAWPSPVVSEGEHVALQCRSRLGFNEFSLSKEDGVPVPELYNRVFRNTVFIGPVTPAHAGTYRCRGSHPHFLTGWSAPSNPLVIMVTGVHRKPSLLAHPGPLVKSEETVILQCWSDVMFEHFLLHREGKFNDTLRLTGELHDGVSKANFSIGRMTQDLAGTYRCYGSVPHSPYQLSAPSDPLDIVITGLCGKPSLSAQPRPMVKAGESVTLSCSSRSSYDIYHLSREGEAHELRFPAVPKVNGTFQANFPLGPATHGGTYRCFGSFRDSPYEWSDLSDPLLVSVTDSMKEKGKDVIL

SEQ ID NO: 36735 - protein, 328 aa, Homo sapiens
  Payload ID: 7277
  Gene Symbol:
  Gene Name: GU182355.5
  ENSP ID: ENSP00000479886
MSLMVVSMACVGFFLLQGAWPHEGGQDKPFLSAWPSPVVSEGEHVALQCRSRLGFNEFSLSKEDGMPVPELYNRVFRNTVFIGPVTPAHAGTYRCRGSHPHFLTGWSAPSNPLVIMVTGVHRKPSLLAHPGPLVKSEETVILQCWSDVMFEHFLLHREGKFNDTLRLTGELHDGVSKANFSIGRMTQDLAGTYRCYGSVPHSPYQLSAPSDPLDIVITGLCGKPSLSAQPRPMVKAGESVTLSCSSRSSYDIYHLSREGEAHELRFPAVPKVNGTFQANFPLGPATHGGTYRCFGSFRDSPYEWSDLSDPLLVSVTDSMKEKGKDVIL

SEQ ID NO: 36736 - protein, 398 aa, Homo sapiens
  Payload ID: 7278
  Gene Symbol:
  Gene Name: GU182357.6
  ENSP ID: ENSP00000477528
MSLMVISKACVAFFLLQGAWPHEGGQDKPLLSTWPSLVVPPEHVTLRCHSNLGFNNFSLYKDDGVPVPELYNRIFWKSLFMGPVTPSHTGTYRCRGSHTHSPSGGSAPSNPLVIVVTGFRRKPSLLAHPGPLVKSEETVILQCWSDVMFEHFLLHREGTFNHTLRLIGEHIDGVSKGNFSIGRMTQDLAGTYRCYGSVTHSPYQLSAPSDPLDIVITGLYEKPSLSAQPGPTVLAGESVTLSCSSRSSYDMYHLSREGEAHERRLPAGTKVNGTFQADFPLDPATHGGTYRCFGSFRDSPYEWSKSSDPLLVSVTGNSSNSWPSPTEPSSETGNPRHLHVLIGTSVVKLPFTILLFFLLHRWCSNKKNASVMDQGPAGNRTVNREDSDEQDHQEVSYA

SEQ ID NO: 36737 - protein, 349 aa, Homo sapiens
  Payload ID: 7278
  Gene Symbol:
  Gene Name: GU182357.6
  ENSP ID: ENSP00000480625
MSLMVVSMACVGFFLLQGAWTHEGFRRKPSLLAHPGPLVKSEETVILQCWSDVMFEHFLLHREGTFNHTLRLIGEHIDGVSKGNFSIGRMTQDLAGTYRCYGSVTHSPYQLSAPSDPLDIVITGLYEKPSLSAQPGPTVLAGESVTLSCSSRSSYDMYHLSREGEAHERRLPAGTKVNGTFQADFPLDPATHGGTYRCFGSFRDSPYEWSKSSDPLLVSVTGNPSNSWPSPTEPSSKTGNPRHLHVLIGTSVVIILFILLVFFLLHRWCSNKKNAAVMDQEPAGNRTANSEDSDEQDPQEVTYVQLDHCVFTQRKITRPSQRPKTPPTDTRVYTELPNAESRSKVVSCP

SEQ ID NO: 36738 - protein, 236 aa, Homo sapiens
  Payload ID: 7279
  Gene Symbol: GAMT
  Gene Name: guanidinoacetate N-methyltransferase
  Uniprot ID: Q14353
  ENSP ID: ENSP00000252288
MSAPSATPIFAPGENCSPAWGAAPAAYDAADTHLRILGKPVMERWETPYMHALAAAASSKGGRVLEVGFGMAIAASKVQEAPIDEHWIIECNDGVFQRLRDWAPRQTHKVIPLKGLWEDVAPTLPDGHFDGILYDTYPLSEETWHTHQFNFIKNHAFRLLKPGGVLTYCNLTSWGELMKSKYSDITIMFEETQVPALLEAGFRRENIRTEVMALVPPADCRYYAFPQMITPLVTKG

SEQ ID NO: 36739 - protein, 269 aa, Homo sapiens
  Payload ID: 7279
  Gene Symbol: GAMT
  Gene Name: guanidinoacetate N-methyltransferase
  Uniprot ID: Q14353
  ENSP ID: ENSP00000403536
MSAPSATPIFAPGENCSPAWGAAPAAYDAADTHLRILGKPVMERWETPYMHALAAAASSKGGRVLEVGFGMAIAASKVQEAPIDEHWIIECNDGVFQRLRDWAPRQTHKVIPLKGLWEDVAPTLPDGHFDGILYDTYPLSEETWHTHQFNFIKNHAFRLLKPGGVLTYCNLTSWGELMKSKYSDITIMFEVRPPEVPHGSPGSDLGWGWEGAAGATLLPGEGPFLTPWVGWTVLVHLEIKVLCLAQWLPGAVAQVYNPSTVEGRGGQIA

SEQ ID NO: 36740 - protein, 108 aa, Homo sapiens
  Payload ID: 7279
  Gene Symbol: GAMT
  Gene Name: guanidinoacetate N-methyltransferase
  ENSP ID: ENSP00000466341
QTHKVIPLKGLWEDVAPTLPDGHFDGILYDTYPLSEETWHTHQFNFIKNHAFRLLKPGGVLTYCNLTSWGELMKSKYSDITIMFEWLPGAVAQVYNPSTVEGRGGQIA

SEQ ID NO: 36741 - protein, 471 aa, Homo sapiens
  Payload ID: 7280
  Gene Symbol: GDA
  Gene Name: guanine deaminase
  Uniprot ID: Q9Y2T3
  ENSP ID: ENSP00000238018
MCAAQMPPLAHIFRGTFVHSTWTCPMEVLRDHLLGVSDSGKIVFLEEASQQEKLAKEWCFKPCEIRELSHHEFFMPGLVDTHIHASQYSFAGSSIDLPLLEWLTKYTFPAEHRFQNIDFAEEVYTRVVRRTLKNGTTTACYFATIHTDSSLLLADITDKFGQRAFVGKVCMDLNDTFPEYKETTEESIKETERFVSEMLQKNYSRVKPIVTPRFSLSCSETLMGELGNIAKTRDLHIQSHISENRDEVEAVKNLYPSYKNYTSVYDKNNLLTNKTVMAHGCYLSAEELNVFHERGASIAHCPNSNLSLSSGFLNVLEVLKHEVKIGLGTDVAGGYSYSMLDAIRRAVMVSNILLINKVNEKSLTLKEVFRLATLGGSQALGLDGEIGNFEVGKEFDAILINPKASDSPIDLFYGDFFGDISEAVIQKFLYLGDDRNIEEVYVGGKQVVPFSSSVKETIHLPASSPHPPPFP

SEQ ID NO: 36742 - protein, 454 aa, Homo sapiens
  Payload ID: 7280
  Gene Symbol: GDA
  Gene Name: guanine deaminase
  Uniprot ID: Q9Y2T3
  ENSP ID: ENSP00000351170
MCAAQMPPLAHIFRGTFVHSTWTCPMEVLRDHLLGVSDSGKIVFLEEASQQEKLAKEWCFKPCEIRELSHHEFFMPGLVDTHIHASQYSFAGSSIDLPLLEWLTKYTFPAEHRFQNIDFAEEVYTRVVRRTLKNGTTTACYFATIHTDSSLLLADITDKFGQRAFVGKVCMDLNDTFPEYKETTEESIKETERFVSEMLQKNYSRVKPIVTPRFSLSCSETLMGELGNIAKTRDLHIQSHISENRDEVEAVKNLYPSYKNYTSVYDKNNLLTNKTVMAHGCYLSAEELNVFHERGASIAHCPNSNLSLSSGFLNVLEVLKHEVKIGLGTDVAGGYSYSMLDAIRRAVMVSNILLINKVNEKSLTLKEVFRLATLGGSQALGLDGEIGNFEVGKEFDAILINPKASDSPIDLFYGDFFGDISEAVIQKFLYLGDDRNIEEVYVGGKQVVPFSSSV

SEQ ID NO: 36743 - protein, 393 aa, Homo sapiens
  Payload ID: 7280
  Gene Symbol: GDA
  Gene Name: guanine deaminase
  ENSP ID: ENSP00000366185
MFLEEASQQEKLAKEWCFKPCEIRELSHHEFFMPGLVDTHIHASQYSFAGSSIDLPLLEWLTKYTFPAEHRFQNIDFAEEVYTRVVRRTLKNGTTTACYFATIHTDSSLLLADITDKFGQRAFVGKVCMDLNDTFPEYKETTEESIKETERFVSEMLQKNSHISENRDEVEAVKNLYPSYKNYTSVYDKNNLLTNKTVMAHGCYLSAEELNVFHERGASIAHCPNSNLSLSSGFLNVLEVLKHEVKIGLGTDVAGGYSYSMLDAIRRAVMVSNILLINKVNEKSLTLKEVFRLATLGGSQALGLDGEIGNFEVGKEFDAILINPKASDSPIDLFYGDFFGDISEAVIQKFLYLGDDRNIEEVYVGGKQVVPFSSSVKETIHLPASSPHPPPFP

SEQ ID NO: 36744 - protein, 179 aa, Homo sapiens
  Payload ID: 7280
  Gene Symbol: GDA
  Gene Name: guanine deaminase
  ENSP ID: ENSP00000400857
ERGASIAHCPNSNLSLSSGFLNVLEVLKHEVKIGLGTDVAGGYSYSMLDAIRRAVMVSNILLINKVNEKSLTLKEVFRLATLGGSQALGLDGEIGNFEVGKEFDAILINPKASDSPIDLFYGDFFGDISEAVIQKFLYLGDDRNIEEVYVGGKQVVPFSSSVKETIHLPASSPHPPPFP

SEQ ID NO: 36745 - protein, 195 aa, Homo sapiens
  Payload ID: 7280
  Gene Symbol: GDA
  Gene Name: guanine deaminase
  ENSP ID: ENSP00000403897
MTLFQNTRRPLRNRSRKLRDCHSVTQAGVQWRDLSSLKPPPPVFKRFSCLSLPSSWDYRFVSEMLQKNYSRVKPIVTPRFSLSCSETLMGELGNIAKTRDLHIQSHISENRDEVEAVKNLYPSYKNYTSVYDKNNLLTNKTVMAHGCYLSAEELNVFHERGASIAHCPNSNLSLSSGFLNVLEVLKHEVKIGLGT

SEQ ID NO: 36746 - protein, 176 aa, Homo sapiens
  Payload ID: 7280
  Gene Symbol: GDA
  Gene Name: guanine deaminase
  ENSP ID: ENSP00000434682
  MOD_RES (1)..(1): Any amino acid
XGCYLSAEELNVFHERGASIAHCPNSNLSLSSGFLNVLEVLKHEVKIGLGTDVAGGYSYSMLDAIRRAVMVSNILLINKVNEKSLTLKEVFRLATLGGSQALGLDGEIGNFEVGKEFDAILINPKASDSPIDLFYGDFFGDISEAVIQKFLYLGDDRNIEEVYVGGKQVVPFSSSV

SEQ ID NO: 36747 - protein, 454 aa, Homo sapiens; identical to SEQ ID NO: 36742
  Payload ID: 7280
  Gene Symbol: GDA
  Gene Name: guanine deaminase
  Uniprot ID: Q9Y2T3
  ENSP ID: ENSP00000436619

SEQ ID NO: 36748 - protein, 380 aa, Homo sapiens
  Payload ID: 7280
  Gene Symbol: GDA
  Gene Name: guanine deaminase
  Uniprot ID: Q9Y2T3
  ENSP ID: ENSP00000437972
MPGLVDTHIHASQYSFAGSSIDLPLLEWLTKYTFPAEHRFQNIDFAEEVYTRVVRRTLKNGTTTACYFATIHTDSSLLLADITDKFGQRAFVGKVCMDLNDTFPEYKETTEESIKETERFVSEMLQKNYSRVKPIVTPRFSLSCSETLMGELGNIAKTRDLHIQSHISENRDEVEAVKNLYPSYKNYTSVYDKNNLLTNKTVMAHGCYLSAEELNVFHERGASIAHCPNSNLSLSSGFLNVLEVLKHEVKIGLGTDVAGGYSYSMLDAIRRAVMVSNILLINKVNEKSLTLKEVFRLATLGGSQALGLDGEIGNFEVGKEFDAILINPKASDSPIDLFYGDFFGDISEAVIQKFLYLGDDRNIEEVYVGGKQVVPFSSSV

SEQ ID NO: 36749 - protein, 594 aa, Homo sapiens
  Payload ID: 7281
  Gene Symbol: GMPS
  Gene Name: guanine monophosphate synthase
  Uniprot ID: P49915
  ENSP ID: ENSP00000295920
MALCNGDSKMMNKVFGGTVHKKSVREDGVFNISVDNTCSLFRGLQKEEVVLLTHGDSVDKVADGFKVVARSGNIVAGIANESKKLYGAQFHPEVGLTENGKVILKNFLYDIAGCSGTFTVQNRELECIREIKERVGTSKVLVLLSGGVDSTVCTALLNRALNQEQVIAVHIDNGFMRKRESQSVEEALKKLGIQVKVINAAHSFYNGTTTLPISDEDRTPRKRISKTLNMTTSPEEKRKIIGDTFVKIANEVIGEMNLKPEEVFLAQGTLRPDLIESASLVASGKAELIKTHHNDTELIRKLREEGKVIEPLKDFHKDEVRILGRELGLPEELVSRHPFPGPGLAIRVICAEEPYICKDFPETNNILKIVADFSASVKKPHTLLQRVKACTTEEDQEKLMQITSLHSLNAFLLPIKTVGVQGDCRSYSYVCGISSKDEPDWESLIFLARLIPRMCHNVNRVVYIFGPPVKEPPTDVTPTFLTTGVLSTLRQADFEAHNILRESGYAGKISQMPVILTPLHFDRDPLQKQPSCQRSVVIRTFITSDFMTGIPATPGNEIPVEVVLKMVTEIKKIPGISRIMYDLTSKPPGTTEWE

SEQ ID NO: 36750 - protein, 693 aa, Homo sapiens
  Payload ID: 7281
  Gene Symbol: GMPS
  Gene Name: guanine monophosphate synthase
  Uniprot ID: P49915
  ENSP ID: ENSP00000419851
MALCNGDSKLENAGGDLKDGHHHYEGAVVILDAGAQYGKVIDRRVRELFVQSEIFPLETPAFAIKEQGFRAIIISGGPNSVYAEDAPWFDPAIFTIGKPVLGICYGMQMMNKVFGGTVHKKSVREDGVFNISVDNTCSLFRGLQKEEVVLLTHGDSVDKVADGFKVVARSGNIVAGIANESKKLYGAQFHPEVGLTENGKVILKNFLYDIAGCSGTFTVQNRELECIREIKERVGTSKVLVLLSGGVDSTVCTALLNRALNQEQVIAVHIDNGFMRKRESQSVEEALKKLGIQVKVINAAHSFYNGTTTLPISDEDRTPRKRISKTLNMTTSPEEKRKIIGDTFVKIANEVIGEMNLKPEEVFLAQGTLRPDLIESASLVASGKAELIKTHHNDTELIRKLREEGKVIEPLKDFHKDEVRILGRELGLPEELVSRHPFPGPGLAIRVICAEEPYICKDFPETNNILKIVADFSASVKKPHTLLQRVKACTTEEDQEKLMQITSLHSLNAFLLPIKTVGVQGDCRSYSYVCGISSKDEPDWESLIFLARLIPRMCHNVNRVVYIFGPPVKEPPTDVTPTFLTTGVLSTLRQADFEAHNILRESGYAGKISQMPVILTPLHFDRDPLQKQPSCQRSVVIRTFITSDFMTGIPATPGNEIPVEVVLKMVTEIKKIPGISRIMYDLTSKPPGTTEWE

SEQ ID NO: 36751 - protein, 381 aa, Homo sapiens
  Payload ID: 7282
  Gene Symbol: GNA12
  Gene Name: guanine nucleotide binding protein (G protein) alpha 12
  Uniprot ID: Q03113
  ENSP ID: ENSP00000275364
MSGVVRTLSRCLLPAEAGGARERRAGSGARDAEREARRRSRDIDALLARERRAVRRLVKILLLGAGESGKSTFLKQMRIIHGREFDQKALLEFRDTIFDNILKGSRVLVDARDKLGIPWQYSENEKHGMFLMAFENKAGLPVEPATFQLYVPALSALWRDSGIREAFSRRSEFQLGESVKYFLDNLDRIGQLNYFPSKQDILLARKATKGIVEHDFVIKKIPFKMVDVGGQRSQRQKWFQCFDGITSILFMVSSSEYDQVLMEDRRTNRLVESMNIFETIVNNKLFFNVSIILFLNKMDLLVEKVKTVSIKKHFPDFRGDPHRLEDVQRYLVQCFDRKRRNRSKPLFHHFTTAIDTENVRFVFHAVKDTILQENLKDIMLQ

SEQ ID NO: 36752 - protein, 322 aa, Homo sapiens
  Payload ID: 7282
  Gene Symbol: GNA12
  Gene Name: guanine nucleotide binding protein (G protein) alpha 12
  Uniprot ID: Q03113
  ENSP ID: ENSP00000385935
MKRRMFPRPCLARMPGSRGSGSTPDGNRKCCRFEHLLIAHPGSRGSRVLVDARDKLGIPWQYSENEKHGMFLMAFENKAGLPVEPATFQLYVPALSALWRDSGIREAFSRRSEFQLGESVKYFLDNLDRIGQLNYFPSKQDILLARKATKGIVEHDFVIKKIPFKMVDVGGQRSQRQKWFQCFDGITSILFMVSSSEYDQVLMEDRRTNRLVESMNIFETIVNNKLFFNVSIILFLNKMDLLVEKVKTVSIKKHFPDFRGDPHRLEDVQRYLVQCFDRKRRNRSKPLFHHFTTAIDTENVRFVFHAVKDTILQENLKDIMLQ

SEQ ID NO: 36753 - protein, 305 aa, Homo sapiens
  Payload ID: 7282
  Gene Symbol: GNA12
  Gene Name: guanine nucleotide binding protein (G protein) alpha 12
  ENSP ID: ENSP00000386054
MAPRAGLGAGPLLLRSRADWVCGGWEAALSAPPPFCTAWVERTGLVHFLREGGHGACFPLALLHPGSVVSFQMIYPLIVLPLCASWHWGLIRKGIVLFWGESVKYFLDNLDRIGQLNYFPSKQDILLARKATKGIVEHDFVIKKIPFKMVDVGGQRSQRQKWFQCFDGITSILFMVSSSEYDQVLMEDRRTNRLVESMNIFETIVNNKLFFNVSIILFLNKMDLLVEKVKTVSIKKHFPDFRGDPHRLEDVQRYLVQCFDRKRRNRSKPLFHHFTTAIDTENVRFVFHAVKDTILQENLKDIMLQ

SEQ ID NO: 36754 - protein, 77 aa, Homo sapiens
  Payload ID: 7282
  Gene Symbol: GNA12
  Gene Name: guanine nucleotide binding protein (G protein) alpha 12
  ENSP ID: ENSP00000391462
MKRRMFPRPCLARMPGSRGSRVLVDARDKLGIPWQYSENEKHGMFLMAFENKAGLPVEPATFQLYVPALSALWRDSG

SEQ ID NO: 36755 - protein, 359 aa, Homo sapiens
  Payload ID: 7283
  Gene Symbol: GNA11
  Gene Name: guanine nucleotide binding protein (G protein), alpha 11 (Gq class)
  Uniprot ID: P29992
  ENSP ID: ENSP00000078429
MTLESMMACCLSDEVKESKRINAEIEKQLRRDKRDARRELKLLLLGTGESGKSTFIKQMRIIHGAGYSEEDKRGFTKLVYQNIFTAMQAMIRAMETLKILYKYEQNKANALLIREVDVEKVTTFEHQYVSAIKTLWEDPGIQECYDRRREYQLSDSAKYYLTDVDRIATLGYLPTQQDVLRVRVPTTGIIEYPFDLENIIFRMVDVGGQRSERRKWIHCFENVTSIMFLVALSEYDQVLVESDNENRMEESKALFRTIITYPWFQNSSVILFLNKKDLLEDKILYSHLVDYFPEFDGPQRDAQAAREFILKMFVDLNPDSDKIIYSHFTCATDTENIRFVFAAVKDTILQLNLKEYNLV

SEQ ID NO: 36756 - protein, 236 aa, Homo sapiens
  Payload ID: 7283
  Gene Symbol: GNA11
  Gene Name: guanine nucleotide binding protein (G protein), alpha 11 (Gq class)
  ENSP ID: ENSP00000465935
  MOD_RES (1)..(1): Any amino acid
XLSDSAKYYLTDVDRIATLGYLPTQQDVLRVRVPTTGIIEYPFDLENIIFRMVDVGGQRSERRKWIHCFENVTSIMFLVALSEYDQVLVESDNENRMEESKALFRTIITYPWFQNSSVILFLNKKDLLEDKILYSHLVDYFPEFDGPQRDAQAAREFILKMFVDLNPDSDKIIYSHFTCATDTENIRFVFAAVKDTILQLNLKEYNLLSGDVHLSLRTLRAPSHLLSTAKAAFFWP

SEQ ID NO: 36757 - protein, 72 aa, Homo sapiens
  Payload ID: 7283
  Gene Symbol: GNA11
  Gene Name: guanine nucleotide binding protein (G protein), alpha 11 (Gq class)
  ENSP ID: ENSP00000479797
  MOD_RES (1)..(1): Any amino acid
XLTDVDRIATLGYLPTQQDVLRVRVPTTGIIEYPFDLENIIFRWAWLCAPVVPATQEAEAGGSLKPRRLRLK

SEQ ID NO: 36758 - protein, 377 aa, Homo sapiens
  Payload ID: 7284
  Gene Symbol: GNA13
  Gene Name: guanine nucleotide binding protein (G protein), alpha 13
  Uniprot ID: Q14344
  ENSP ID: ENSP00000400717
MADFLPSRSVLSVCFPGCLLTSGEAEQQRKSKEIDKCLSREKTYVKRLVKILLLGAGESGKSTFLKQMRIIHGQDFDQRAREEFRPTIYSNVIKGMRVLVDAREKLHIPWGDNSNQQHGDKMMSFDTRAPMAAQGMVETRVFLQYLPAIRALWADSGIQNAYDRRREFQLGESVKYFLDNLDKLGEPDYIPSQQDILLARRPTKGIHEYDFEIKNVPFKMVDVGGQRSERKRWFECFDSVTSILFLVSSSEFDQVLMEDRLTNRLTESLNIFETIVNNRVFSNVSIILFLNKTDLLEEKVQIVSIKDYFLEFEGDPHCLRDVQKFLVECFRNKRRDQQQKPLYHHFTTAINTENIRLVFRDVKDTILHDNLKQLMLQ

SEQ ID NO: 36759 - protein, 282 aa, Homo sapiens
  Payload ID: 7284
  Gene Symbol: GNA13
  Gene Name: guanine nucleotide binding protein (G protein), alpha 13
  Uniprot ID: Q14344
  ENSP ID: ENSP00000439647
MRVLVDAREKLHIPWGDNSNQQHGDKMMSFDTRAPMAAQGMVETRVFLQYLPAIRALWADSGIQNAYDRRREFQLGESVKYFLDNLDKLGEPDYIPSQQDILLARRPTKGIHEYDFEIKNVPFKMVDVGGQRSERKRWFECFDSVTSILFLVSSSEFDQVLMEDRLTNRLTESLNIFETIVNNRVFSNVSIILFLNKTDLLEEKVQIVSIKDYFLEFEGDPHCLRDVQKFLVECFRNKRRDQQQKPLYHHFTTAINTENIRLVFRDVKDTILHDNLKQLMLQ

SEQ ID NO: 36760 - protein, 355 aa, Homo sapiens
  Payload ID: 7285
  Gene Symbol: GNA14
  Gene Name: guanine nucleotide binding protein (G protein), alpha 14
  Uniprot ID: O95837
  ENSP ID: ENSP00000365807
MAGCCCLSAEEKESQRISAEIERQLRRDKKDARRELKLLLLGTGESGKSTFIKQMRIIHGSGYSDEDRKGFTKLVYQNIFTAMQAMIRAMDTLRIQYVCEQNKENAQIIREVEVDKVSMLSREQVEAIKQLWQDPGIQECYDRRREYQLSDSAKYYLTDIDRIATPSFVPTQQDVLRVRVPTTGIIEYPFDLENIIFRMVDVGGQRSERRKWIHCFESVTSIIFLVALSEYDQVLAECDNENRMEESKALFKTIITYPWFLNSSVILFLNKKDLLEEKIMYSHLISYFPEYTGPKQDVRAARDFILKLYQDQNPDKEKVIYSHFTCATDTDNIRFVFAAVKDTILQLNLREFNLV

SEQ ID NO: 36761 - protein, 374 aa, Homo sapiens
  Payload ID: 7286
  Gene Symbol: GNA15
  Gene Name: guanine nucleotide binding protein (G protein), alpha 15 (Gq class)
  Uniprot ID: P30679
  ENSP ID: ENSP00000262958
MARSLTWRCCPWCLTEDEKAAARVDQEINRILLEQKKQDRGELKLLLLGPGESGKSTFIKQMRIIHGAGYSEEERKGFRPLVYQNIFVSMRAMIEAMERLQIPFSRPESKHHASLVMSQDPYKVTTFEKRYAAAMQWLWRDAGIRACYERRREFHLLDSAVYYLSHLERITEEGYVPTAQDVLRSRMPTTGINEYCFSVQKTNLRIVDVGGQKSERKKWIHCFENVIALIYLASLSEYDQCLEENNQENRMKESLALFGTILELPWFKSTSVILFLNKTDILEEKIPTSHLATYFPSFQGPKQDAEAAKRFILDMYTRMYTGCVDGPEGSKKGARSRRLFSHYTCATDTQNIRKVFKDVRDSVLARYLDEINLL

SEQ ID NO: 36762 - protein, 52 aa, Homo sapiens
  Payload ID: 7286
  Gene Symbol: GNA15
  Gene Name: guanine nucleotide binding protein (G protein), alpha 15 (Gq class)
  ENSP ID: ENSP00000467256
MARSLTWRCCPWCLTEDEKAAARVDQEINRILLEQKKQDRGELKLLLLVPGS

SEQ ID NO: 36763 - protein, 354 aa, Homo sapiens
  Payload ID: 7287
  Gene Symbol: GNAO1
  Gene Name: guanine nucleotide binding protein (G protein), alpha activating activity polypeptide O
  Uniprot ID: P09471
  ENSP ID: ENSP00000262493
MGCTLSAEERAALERSKAIEKNLKEDGISAAKDVKLLLLGAGESGKSTIVKQMKIIHEDGFSGEDVKQYKPVVYSNTIQSLAAIVRAMDTLGIEYGDKERKADAKMVCDVVSRMEDTEPFSAELLSAMMRLWGDSGIQECFNRSREYQLNDSAKYYLDSLDRIGAADYQPTEQDILRTRVKTTGIVETHFTFKNLHFRLFDVGGQRSERKKWIHCFEDVTAIIFCVALSGYDQVLHEDETTNRMHESLMLFDSICNNKFFIDTSIILFLNKKDLFGEKIKKSPLTICFPEYTGPNTYEDAAAYIQAQFESKNRSPNKEIYCHMTCATDTNNIQVVFDAVTDIIIANNLRGCGLY

SEQ ID NO: 36764 - protein, 354 aa, Homo sapiens
  Payload ID: 7287
  Gene Symbol: GNAO1
  Gene Name: guanine nucleotide binding protein (G protein), alpha activating activity polypeptide O
  Uniprot ID: P09471
  ENSP ID: ENSP00000262494
MGCTLSAEERAALERSKAIEKNLKEDGISAAKDVKLLLLGAGESGKSTIVKQMKIIHEDGFSGEDVKQYKPVVYSNTIQSLAAIVRAMDTLGIEYGDKERKADAKMVCDVVSRMEDTEPFSAELLSAMMRLWGDSGIQECFNRSREYQLNDSAKYYLDSLDRIGAADYQPTEQDILRTRVKTTGIVETHFTFKNLHFRLFDVGGQRSERKKWIHCFEDVTAIIFCVALSGYDQVLHEDETTNRMHESLKLFDSICNNKWFTDTSIILFLNKKDIFEEKIKKSPLTICFPEYTGPSAFTEAVAYIQAQYESKNKSAHKEIYTHVTCATDTNNIQFVFDAVTDVIIAKNLRGCGLY

SEQ ID NO: 36765 - protein, 128 aa, Homo sapiens
  Payload ID: 7287
  Gene Symbol: GNAO1
  Gene Name: guanine nucleotide binding protein (G protein), alpha activating activity polypeptide O
  ENSP ID: ENSP00000454728
MKKLNPAGTTRRIIHEDGFSGEDVKQYKPVVYSNTIQSLAAIVRAMDTLGIEYGDKERKADAKMVCDVVSRMEDTEPFSAELLSAMMRLWGDSGIQECFNRSREYQLNDSAKYYLDSLDRIGAADYQP

SEQ ID NO: 36766 - protein, 94 aa, Homo sapiens
  Payload ID: 7287
  Gene Symbol: GNAO1
  Gene Name: guanine nucleotide binding protein (G protein), alpha activating activity polypeptide O
  ENSP ID: ENSP00000454971
IDTSIILFLNKKDLFGEKIKKSPLTICFPEYTGPNTYEDAAAYIQAQFESKNRSPNKEIYCHMTCATDTNNIQVVFDAVTDIIIANNLRGCGLY

SEQ ID NO: 36767 - protein, 83 aa, Homo sapiens
  Payload ID: 7287
  Gene Symbol: GNAO1
  Gene Name: guanine nucleotide binding protein (G protein), alpha activating activity polypeptide O
  ENSP ID: ENSP00000455774
MDTLGIEYGDKERKADAKMVCDVVSRMEDTEPFSAELLSAMMRLWGDSGIQECFNRSREYQLNDSAKYYLDSLDRIGAADYQP

SEQ ID NO: 36768 - protein, 110 aa, Homo sapiens
  Payload ID: 7287
  Gene Symbol: GNAO1
  Gene Name: guanine nucleotide binding protein (G protein), alpha activating activity polypeptide O
  ENSP ID: ENSP00000457238
MDTLGIEYGDKERKADAKMVCDVVSRMEDTEPFSAELLSAMMRLWGDSGIQECFNRSREYQLNDSAKYYLDSLDRIGAADYQPTEQDILRTRVKTTGIVETHFTFKNLHF

SEQ ID NO: 36769 - protein, 54 aa, Homo sapiens
  Payload ID: 7287
  Gene Symbol: GNAO1
  Gene Name: guanine nucleotide binding protein (G protein), alpha activating activity polypeptide O
  ENSP ID: ENSP00000477740
MGCTLSAEERAALERSKAIEKNLKEDGISAAKDVKLLLLGAGESGKSTIVKQMK

SEQ ID NO: 36770 - protein, 381 aa, Homo sapiens
  Payload ID: 7288
  Gene Symbol: GNAL
  Gene Name: guanine nucleotide binding protein (G protein), alpha activating activity polypeptide, olfactory type
  Uniprot ID: P38405
  ENSP ID: ENSP00000269162
MGCLGGNSKTTEDQGVDEKERREANKKIEKQLQKERLAYKATHRLLLLGAGESGKSTIVKQMRILHVNGFNPEEKKQKILDIRKNVKDAIVTIVSAMSTIIPPVPLANPENQFRSDYIKSIAPITDFEYSQEFFDHVKKLWDDEGVKACFERSNEYQLIDCAQYFLERIDSVSLVDYTPTDQDLLRCRVLTSGIFETRFQVDKVNFHMFDVGGQRDERRKWIQCFNDVTAIIYVAACSSYNMVIREDNNTNRLRESLDLFESIWNNRWLRTISIILFLNKQDMLAEKVLAGKSKIEDYFPEYANYTVPEDATPDAGEDPKVTRAKFFIRDLFLRISTATGDGKHYCYPHFTCAVDTENIRRVFNDCRDIIQRMHLKQYELL

SEQ ID NO: 36771 - protein, 458 aa, Homo sapiens
  Payload ID: 7288
  Gene Symbol: GNAL
  Gene Name: guanine nucleotide binding protein (G protein), alpha activating activity polypeptide, olfactory type
  Uniprot ID: P38405
  ENSP ID: ENSP00000334051
MGLCYSLRPLLFGGPGDDPCAASEPPVEDAQPAPAPALAPVRAAARDTARTLLPRGGEGSPACARPKADKPKEKRQRTEQLSAEEREAAKEREAVKEARKVSRGIDRMLRDQKRDLQQTHRLLLLGAGESGKSTIVKQMRILHVNGFNPEEKKQKILDIRKNVKDAIVTIVSAMSTIIPPVPLANPENQFRSDYIKSIAPITDFEYSQEFFDHVKKLWDDEGVKACFERSNEYQLIDCAQYFLERIDSVSLVDYTPTDQDLLRCRVLTSGIFETRFQVDKVNFHMFDVGGQRDERRKWIQCFNDVTAIIYVAACSSYNMVIREDNNTNRLRESLDLFESIWNNRWLRTISIILFLNKQDMLAEKVLAGKSKIEDYFPEYANYTVPEDATPDAGEDPKVTRAKFFIRDLFLRISTATGDGKHYCYPHFTCAVDTENIRRVFNDCRDIIQRMHLKQYELL

SEQ ID NO: 36772 - protein, 381 aa, Homo sapiens; identical to SEQ ID NO: 36770
  Payload ID: 7288
  Gene Symbol: GNAL
  Gene Name: guanine nucleotide binding protein (G protein), alpha activating activity polypeptide, olfactory type
  Uniprot ID: P38405
  ENSP ID: ENSP00000408489

SEQ ID NO: 36773 - protein, 381 aa, Homo sapiens; identical to SEQ ID NO: 36770
  Payload ID: 7288
  Gene Symbol: GNAL
  Gene Name: guanine nucleotide binding protein (G protein), alpha activating activity polypeptide, olfactory type
  Uniprot ID: P38405
  ENSP ID: ENSP00000439023

SEQ ID NO: 36774 - protein, 54 aa, Homo sapiens
  Payload ID: 7288
  Gene Symbol: GNAL
  Gene Name: guanine nucleotide binding protein (G protein), alpha activating activity polypeptide, olfactory type
  ENSP ID: ENSP00000466709
  MOD_RES (1)..(1): Any amino acid
XTNKICWQKKSWQGNQKLKTISQNMQIILFLKTEHQGEAPPLADSQGHLPSRGC

SEQ ID NO: 36775 - protein, 179 aa, Homo sapiens
  Payload ID: 7288
  Gene Symbol: GNAL
  Gene Name: guanine nucleotide binding protein (G protein), alpha activating activity polypeptide, olfactory type
  ENSP ID: ENSP00000467345
MRILHVNGFNPEEKKQKILDIRKNVKDAIVTIVSAMSTIIPPVPLANPENQFRSDYIKSIAPITDFEYSQEFFDHVKKLWDDEGVKACFERSNEYQLIDCAQYFLERIDSVSLVDYTPTDQDLLRCRVLTSGIFETRFQVDKVNFHMFDVGGQRDERRKWIQCFNDVTAIIYVAACSSY

SEQ ID NO: 36776 - protein, 145 aa, Homo sapiens
  Payload ID: 7288
  Gene Symbol: GNAL
  Gene Name: guanine nucleotide binding protein (G protein), alpha activating activity polypeptide, olfactory type
  ENSP ID: ENSP00000467709
MSTIIPPVPLANPENQFRSDYIKSIAPITDFEYSQEFFDHVKKLWDDEGVKACFERSNEYQLIDCAQYFLERIDSVSLVDYTPTDQDLLRCRVLTSGIFETRFQVDKVNFHMFDVGGQRDERRKWIQCFNDVTAIIYVAACSSYN

SEQ ID NO: 36777 - protein, 174 aa, Homo sapiens
  Payload ID: 7288
  Gene Symbol: GNAL
  Gene Name: guanine nucleotide binding protein (G protein), alpha activating activity polypeptide, olfactory type
  Uniprot ID: P38405
  ENSP ID: ENSP00000473600
MFDVGGQRDERRKWIQCFNDVTAIIYVAACSSYNMVIREDNNTNRLRESLDLFESIWNNRWLRTISIILFLNKQDMLAEKVLAGKSKIEDYFPEYANYTVPEDATPDAGEDPKVTRAKFFIRDLFLRISTATGDGKHYCYPHFTCAVDTENIRRVFNDCRDIIQRMHLKQYELL

SEQ ID NO: 36778 - protein, 354 aa, Homo sapiens
  Payload ID: 7289
  Gene Symbol: GNAI1
  Gene Name: guanine nucleotide binding protein (G protein), alpha inhibiting activity polypeptide 1
  Uniprot ID: P63096
  ENSP ID: ENSP00000343027
MGCTLSAEDKAAVERSKMIDRNLREDGEKAAREVKLLLLGAGESGKSTIVKQMKIIHEAGYSEEECKQYKAVVYSNTIQSIIAIIRAMGRLKIDFGDSARADDARQLFVLAGAAEEGFMTAELAGVIKRLWKDSGVQACFNRSREYQLNDSAAYYLNDLDRIAQPNYIPTQQDVLRTRVKTTGIVETHFTFKDLHFKMFDVGGQRSERKKWIHCFEGVTAIIFCVALSDYDLVLAEDEEMNRMHESMKLFDSICNNKWFTDTSIILFLNKKDLFEEKIKKSPLTICYPEYAGSNTYEEAAAYIQCQFEDLNKRKDTKEIYTHFTCATDTKNVQFVFDAVTDVIIKNNLKDCGLF

SEQ ID NO: 36779 - protein, 41 aa, Homo sapiens
  Payload ID: 7289
  Gene Symbol: GNAI1
  Gene Name: guanine nucleotide binding protein (G protein), alpha inhibiting activity polypeptide 1
  ENSP ID: ENSP00000388347
MKIIHEAGYSEEECKQYKAVVYSNTIQSIIAIIRAMGRLKI

SEQ ID NO: 36780 - protein, 144 aa, Homo sapiens
  Payload ID: 7289
  Gene Symbol: GNAI1
  Gene Name: guanine nucleotide binding protein (G protein), alpha inhibiting activity polypeptide 1
  ENSP ID: ENSP00000389435
MKIIHEAGYSEEECKQYKAVVYSNTIQSIIAIIRAMGRLKIDFGDSARADDARQLFVLAGAAEEGFMTAELAGVIKRLWKDSGVQACFNRSREYQLNDSAAYYLNDLDRIAQPNYIPTQQDVLRTRVKTTGIVETHFTFKDLHF

SEQ ID NO: 36781 - protein, 22 aa, Homo sapiens
  Payload ID: 7289
  Gene Symbol: GNAI1
  Gene Name: guanine nucleotide binding protein (G protein), alpha inhibiting activity polypeptide 1
  ENSP ID: ENSP00000391439
MGCTLSAEDKAAVERSKMIDRN

SEQ ID NO: 36782 - protein, 302 aa, Homo sapiens
  Payload ID: 7289
  Gene Symbol: GNAI1
  Gene Name: guanine nucleotide binding protein (G protein), alpha inhibiting activity polypeptide 1
  Uniprot ID: P63096
  ENSP ID: ENSP00000410572
MKIIHEAGYSEEECKQYKAVVYSNTIQSIIAIIRAMGRLKIDFGDSARADDARQLFVLAGAAEEGFMTAELAGVIKRLWKDSGVQACFNRSREYQLNDSAAYYLNDLDRIAQPNYIPTQQDVLRTRVKTTGIVETHFTFKDLHFKMFDVGGQRSERKKWIHCFEGVTAIIFCVALSDYDLVLAEDEEMNRMHESMKLFDSICNNKWFTDTSIILFLNKKDLFEEKIKKSPLTICYPEYAGSNTYEEAAAYIQCQFEDLNKRKDTKEIYTHFTCATDTKNVQFVFDAVTDVIIKNNLKDCGLF

SEQ ID NO: 36783 - protein, 303 aa, Homo sapiens
  Payload ID: 7290
  Gene Symbol: GNAI2
  Gene Name: guanine nucleotide binding protein (G protein), alpha inhibiting activity polypeptide 2
  Uniprot ID: P04899
  ENSP ID: ENSP00000266027
MKIIHEDGYSEEECRQYRAVVYSNTIQSIMAIVKAMGNLQIDFADPSRADDARQLFALSCTAEEQGVLPDDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSKFEDLNKRKDTKEIYTHFTCATDTKNVQFVFDAVTDVIIKNNLKDCGLF

SEQ ID NO: 36784 - protein, 355 aa, Homo sapiens
  Payload ID: 7290
  Gene Symbol: GNAI2
  Gene Name: guanine nucleotide binding protein (G protein), alpha inhibiting activity polypeptide 2
  Uniprot ID: P04899
  ENSP ID: ENSP00000312999
MGCTVSAEDKAAAERSKMIDKNLREDGEKAAREVKLLLLGAGESGKSTIVKQMKIIHEDGYSEEECRQYRAVVYSNTIQSIMAIVKAMGNLQIDFADPSRADDARQLFALSCTAEEQGVLPDDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSKFEDLNKRKDTKEIYTHFTCATDTKNVQFVFDAVTDVIIKNNLKDCGLF

SEQ ID NO: 36785 - protein, 142 aa, Homo sapiens
  Payload ID: 7290
  Gene Symbol: GNAI2
  Gene Name: guanine nucleotide binding protein (G protein), alpha inhibiting activity polypeptide 2
  ENSP ID: ENSP00000394321
MGCTVSAEDKAAAERSKMIDKNLREDGEKAAREVKLLLLGSSTRMATPRRNAGSTGRLSTATPSSPSWPLSKPWATCRSTLPTPPERTTPGSYLHCPAPPRSKACSLMTCPASSGGSGLTMVCRPALAAQGNTSSTTQLPTT

SEQ ID NO: 36786 - protein, 303 aa, Homo sapiens; identical to SEQ ID NO: 36783
  Payload ID: 7290
  Gene Symbol: GNAI2
  Gene Name: guanine nucleotide binding protein (G protein), alpha inhibiting activity polypeptide 2
  Uniprot ID: P04899
  ENSP ID: ENSP00000395736

SEQ ID NO: 36787 - protein, 146 aa, Homo sapiens
  Payload ID: 7290
  Gene Symbol: GNAI2
  Gene Name: guanine nucleotide binding protein (G protein), alpha inhibiting activity polypeptide 2
  ENSP ID: ENSP00000406065
MTEGVKTLGWTKQKGGCHWGRSEGPWLLRLSVGRRRAATLLDGVCRASSCQLCPGHHIGMHQLHRCWGVREEHHRQADEDHPRGWLLRGGMPAVPGGCLQQHHPVHHGHCQSHGQPADRLCRPLQSGRRQAAICTVLHRRGARRAP

SEQ ID NO: 36788 - protein, 318 aa, Homo sapiens
  Payload ID: 7290
  Gene Symbol: GNAI2
  Gene Name: guanine nucleotide binding protein (G protein), alpha inhibiting activity polypeptide 2
  Uniprot ID: P04899
  ENSP ID: ENSP00000406369
MRGAGESGKSTIVKQMKIIHEDGYSEEECRQYRAVVYSNTIQSIMAIVKAMGNLQIDFADPSRADDARQLFALSCTAEEQGVLPDDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSKFEDLNKRKDTKEIYTHFTCATDTKNVQFVFDAVTDVIIKNNLKDCGLF

SEQ ID NO: 36789 - protein, 339 aa, Homo sapiens
  Payload ID: 7290
  Gene Symbol: GNAI2
  Gene Name: guanine nucleotide binding protein (G protein), alpha inhibiting activity polypeptide 2
  Uniprot ID: P04899
  ENSP ID: ENSP00000406871
MTEGVKTLGWTKQKGGCHWGRSEGAGESGKSTIVKQMKIIHEDGYSEEECRQYRAVVYSNTIQSIMAIVKAMGNLQIDFADPSRADDARQLFALSCTAEEQGVLPDDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSKFEDLNKRKDTKEIYTHFTCATDTKNVQFVFDAVTDVIIKNNLKDCGLF

SEQ ID NO: 36790 - protein, 354 aa, Homo sapiens
  Payload ID: 7291
  Gene Symbol: GNAI3
  Gene Name: guanine nucleotide binding protein (G protein), alpha inhibiting activity polypeptide 3
  Uniprot ID: P08754
  ENSP ID: ENSP00000358867
MGCTLSAEDKAAVERSKMIDRNLREDGEKAAKEVKLLLLGAGESGKSTIVKQMKIIHEDGYSEDECKQYKVVVYSNTIQSIIAIIRAMGRLKIDFGEAARADDARQLFVLAGSAEEGVMTPELAGVIKRLWRDGGVQACFSRSREYQLNDSASYYLNDLDRISQSNYIPTQQDVLRTRVKTTGIVETHFTFKDLYFKMFDVGGQRSERKKWIHCFEGVTAIIFCVALSDYDLVLAEDEEMNRMHESMKLFDSICNNKWFTETSIILFLNKKDLFEEKIKRSPLTICYPEYTGSNTYEEAAAYIQCQFEDLNRRKDTKEIYTHFTCATDTKNVQFVFDAVTDVIIKNNLKECGLY

SEQ ID NO: 36791 - protein, 350 aa, Homo sapiens
  Payload ID: 7292
  Gene Symbol: GNAT1
  Gene Name: guanine nucleotide binding protein (G protein), alpha transducing activity polypeptide 1
  Uniprot ID: P11488
  ENSP ID: ENSP00000232461
MGAGASAEEKHSRELEKKLKEDAEKDARTVKLLLLGAGESGKSTIVKQMKIIHQDGYSLEECLEFIAIIYGNTLQSILAIVRAMTTLNIQYGDSARQDDARKLMHMADTIEEGTMPKEMSDIIQRLWKDSGIQACFERASEYQLNDSAGYYLSDLERLVTPGYVPTEQDVLRSRVKTTGIIETQFSFKDLNFRMFDVGGQRSERKKWIHCFEGVTCIIFIAALSAYDMVLVEDDEVNRMHESLHLFNSICNHRYFATTSIVLFLNKKDVFFEKIKKAHLSICFPDYDGPNTYEDAGNYIKVQFLELNMRRDVKEIYSHMTCATDTQNVKFVFDAVTDIIIKENLKDCGLF

SEQ ID NO: 36792 - protein, 350 aa, Homo sapiens; identical to SEQ ID NO: 36791
  Payload ID: 7292
  Gene Symbol: GNAT1
  Gene Name: guanine nucleotide binding protein (G protein), alpha transducing activity polypeptide 1
  Uniprot ID: P11488
  ENSP ID: ENSP00000387555

SEQ ID NO: 36793 - protein, 130 aa, Homo sapiens
  Payload ID: 7292
  Gene Symbol: GNAT1
  Gene Name: guanine nucleotide binding protein (G protein), alpha transducing activity polypeptide 1
  ENSP ID: ENSP00000403537
MKIIHQDGYSLEECLEFIAIIYGNTLQSILAIVRAMTTLNIQYGDSARQDDARKLMHMADTIEEGTMPKEMSDIIQRLWKDSGIQACFERASEYQLNDSAGYYLSDLERLVTPGYVPTEQDVLRSRVKTT

SEQ ID NO: 36794 - protein, 354 aa, Homo sapiens
  Payload ID: 7293
  Gene Symbol: GNAT2
  Gene Name: guanine nucleotide binding protein (G protein), alpha transducing activity polypeptide 2
  Uniprot ID: P19087
  ENSP ID: ENSP00000251337
MGSGASAEDKELAKRSKELEKKLQEDADKEAKTVKLLLLGAGESGKSTIVKQMKIIHQDGYSPEECLEFKAIIYGNVLQSILAIIRAMTTLGIDYAEPSCADDGRQLNNLADSIEEGTMPPELVEVIRRLWKDGGVQACFERAAEYQLNDSASYYLNQLERITDPEYLPSEQDVLRSRVKTTGIIETKFSVKDLNFRMFDVGGQRSERKKWIHCFEGVTCIIFCAALSAYDMVLVEDDEVNRMHESLHLFNSICNHKFFAATSIVLFLNKKDLFEEKIKKVHLSICFPEYDGNNSYDDAGNYIKSQFLDLNMRKDVKEIYSHMTCATDTQNVKFVFDAVTDIIIKENLKDCGLF

SEQ ID NO: 36795 - protein, 123 aa, Homo sapiens
  Payload ID: 7293
  Gene Symbol: GNAT2
  Gene Name: guanine nucleotide binding protein (G protein), alpha transducing activity polypeptide 2
  ENSP ID: ENSP00000482596
MGSGASAEDKELAKRSKELEKKLQEDADKEAKTVKLLLLGAGESGKSTIVKQMKIIHQDGYSPEECLEFKAIIYGNVLQSILAIIRAMTTLGIDYAEPSCADDGRQLNNLADSIEEGTMPPEL

SEQ ID NO: 36796 - protein, 355 aa, Homo sapiens
  Payload ID: 7294
  Gene Symbol: GNAZ
  Gene Name: guanine nucleotide binding protein (G protein), alpha z polypeptide
  Uniprot ID: P19086
  ENSP ID: ENSP00000478892
MGCRQSSEEKEAARRSRRIDRHLRSESQRQRREIKLLLLGTSNSGKSTIVKQMKIIHSGGFNLEACKEYKPLIIYNAIDSLTRIIRALAALRIDFHNPDRAYDAVQLFALTGPAESKGEITPELLGVMRRLWADPGAQACFSRSSEYHLEDNAAYYLNDLERIAAADYIPTVEDILRSRDMTTGIVENKFTFKELTFKMVDVGGQRSERKKWIHCFEGVTAIIFCVELSGYDLKLYEDNQTSRMAESLRLFDSICNNNWFINTSLILFLNKKDLLAEKIRRIPLTICFPEYKGQNTYEEAAVYIQRQFEDLNRNKETKEIYSHFTCATDTSNIQFVFDAVTDVIIQNNLKYIGLC

SEQ ID NO: 36797 - protein, 395 aa, Homo sapiens
  Payload ID: 7295
  Gene Symbol: GNB5
  Gene Name: guanine nucleotide binding protein (G protein), beta 5
  Uniprot ID: O14775
  ENSP ID: ENSP00000261837
MCDQTFLVNVFGSCDKCFKQRALRPVFKKSQQLSYCSTCAEIMATEGLHENETLASLKSEAESLKGKLEEERAKLHDVELHQVAERVEALGQFVMKTRRTLKGHGNKVLCMDWCKDKRRIVSSSQDGKVIVWDSFTTNKEHAVTMPCTWVMACAYAPSGCAIACGGLDNKCSVYPLTFDKNENMAAKKKSVAMHTNYLSACSFTNSDMQILTASGDGTCALWDVESGQLLQSFHGHGADVLCLDLAPSETGNTFVSGGCDKKAMVWDMRSGQCVQAFETHESDINSVRYYPSGDAFASGSDDATCRLYDLRADREVAIYSKESIIFGASSVDFSLSGRLLFAGYNDYTINVWDVLKGSRVSILFGHENRVSTLRVSPDGTAFCSGSWDHTLRVWA

SEQ ID NO: 36798 - protein, 353 aa, Homo sapiens
  Payload ID: 7295
  Gene Symbol: GNB5
  Gene Name: guanine nucleotide binding protein (G protein), beta 5
  Uniprot ID: O14775
  ENSP ID: ENSP00000351635
MATEGLHENETLASLKSEAESLKGKLEEERAKLHDVELHQVAERVEALGQFVMKTRRTLKGHGNKVLCMDWCKDKRRIVSSSQDGKVIVWDSFTTNKEHAVTMPCTWVMACAYAPSGCAIACGGLDNKCSVYPLTFDKNENMAAKKKSVAMHTNYLSACSFTNSDMQILTASGDGTCALWDVESGQLLQSFHGHGADVLCLDLAPSETGNTFVSGGCDKKAMVWDMRSGQCVQAFETHESDINSVRYYPSGDAFASGSDDATCRLYDLRADREVAIYSKESIIFGASSVDFSLSGRLLFAGYNDYTINVWDVLKGSRVSILFGHENRVSTLRVSPDGTAFCSGSWDHTLRVWA

SEQ ID NO: 36799 - protein, 283 aa, Homo sapiens
  Payload ID: 7295
  Gene Symbol: GNB5
  Gene Name: guanine nucleotide binding protein (G protein), beta 5
  Uniprot ID: O14775
  ENSP ID: ENSP00000379626
MATEGLHENETLASLKSEAESLKGKLEEERAKLHDVELHQVAERVEALGQFVMKTRRTLKGHGNKVLCMDWCKDKRRIVSSSQDGKVIVWDSFTTNKILTASGDGTCALWDVESGQLLQSFHGHGADVLCLDLAPSETGNTFVSGGCDKKAMVWDMRSGQCVQAFETHESDINSVRYYPSGDAFASGSDDATCRLYDLRADREVAIYSKESIIFGASSVDFSLSGRLLFAGYNDYTINVWDVLKGSRVSILFGHENRVSTLRVSPDGTAFCSGSWDHTLRVWA

SEQ ID NO: 36800 - protein, 126 aa, Homo sapiens
  Payload ID: 7295
  Gene Symbol: GNB5
  Gene Name: guanine nucleotide binding protein (G protein), beta 5
  ENSP ID: ENSP00000453176
MATEGLHENETLASLKSEAESLKGKLEEERAKLHDVELHQVAERVEALGQFVMKTRRTLKGHGNKVLCMDWCKDKRRIVSSSQDGKVIVWDSFTTNKVRHCSQPRYRGFRIPAYLKVLWSSCPALS

SEQ ID NO: 36801 - protein, 103 aa, Homo sapiens
  Payload ID: 7295
  Gene Symbol: GNB5
  Gene Name: guanine nucleotide binding protein (G protein), beta 5
  ENSP ID: ENSP00000453339
AKKKSVAMHTNYLSACSFTNSDMQILTASGDGTCALWDVESGQLLQSFHGHGADVLCLDLAPSETGNTFVSGGCDKKAMVWDMRSGQCVQAFETHESDINSVR

SEQ ID NO: 36802 - protein, 100 aa, Homo sapiens
  Payload ID: 7295
  Gene Symbol: GNB5
  Gene Name: guanine nucleotide binding protein (G protein), beta 5
  ENSP ID: ENSP00000454185
MATEGLHENETLASLKSEAESLKGKLEEERAKLHDVELHQVAERVEALGQFVMKTRRTLKGHGNKVLCMDWCKDKRRIVSSSQDGKVIVWDSFTTNKWFG

SEQ ID NO: 36803 - protein, 340 aa, Homo sapiens [sequence omitted]

SEQ ID NO: 36804 - protein, 165 aa, Homo sapiens
  Payload ID: 7296
  Gene Symbol: GNB1
  Gene Name: guanine nucleotide binding protein (G protein), beta polypeptide 1
  ENSP ID: ENSP00000392765
MSELDQLRQEAEQLKNQIRDARKACADATLSQITNNIDPVGRIQMRTRRTLRGHLAKIYAMHWGTDSRLLVSASQDGKLIIWDSYTTNKVHAIPLRSSWVMTCAYAPSGNYVACGGLDNICSIYNLKTREGNVRVSRELAGHTGYLSCCRFLDDNQIVTSSGDTT

SEQ ID NO: 36805 - protein, 163 aa, Homo sapiens
  Payload ID: 7296
  Gene Symbol: GNB1
  Gene Name: guanine nucleotide binding protein (G protein), beta polypeptide 1
  ENSP ID: ENSP00000399741
MSELDQLRQEAEQLKNQIRITNNIDPVGRIQMRTRRTLRGHLAKIYAMHWGTDSRLLVSASQDGKLIIWDSYTTNKVHAIPLRSSWVMTCAYAPSGNYVACGGLDNICSIYNLKTREGNVRVSRELAGHTGYLSCCRFLDDNQIVTSSGDTTCALWDIETGQQ

SEQ ID NO: 36806 - protein, 107 aa, Homo sapiens
  Payload ID: 7296
  Gene Symbol: GNB1
  Gene Name: guanine nucleotide binding protein (G protein), beta polypeptide 1
  ENSP ID: ENSP00000416651
MSELDQLRQEAEQLKNQIRDARKACADATLSQITNNIDPVGRIQMRTRRTLRGHLAKIYAMHWGTDSRLLVSASQDGKLIIWDSYTTNKVHAIPLRSSWVMTCAYAP

SEQ ID NO: 36807 - protein, 340 aa, Homo sapiens [sequence omitted]

SEQ ID NO: 36808 - protein, 240 aa, Homo sapiens
  Payload ID: 7296
  Gene Symbol: GNB1
  Gene Name: guanine nucleotide binding protein (G protein), beta polypeptide 1
  ENSP ID: ENSP00000483532
MTCAYAPSGNYVACGGLDNICSIYNLKTREGNVRVSRELAGHTGYLSCCRFLDDNQIVTSSGDTTCALWDIETGQQTTTFTGHTGDVMSLSLAPDTRLFVSGACDASAKLWDVREGMCRQTFTGHESDINAICFFPNGNAFATGSDDATCRLFDLRADQELMTYSHDNIICGITSVSFSKSGRLLLAGYDDFNCNVWDALKADRAGVLAGHDNRVSCLGVTDDGMAVATGSWDSFLKIWN

SEQ ID NO: 36809 - protein, 327 aa, Homo sapiens
  Payload ID: 7297
  Gene Symbol: GNB1L
  Gene Name: guanine nucleotide binding protein (G protein), beta polypeptide 1-like
  Uniprot ID: Q9BYB4
  ENSP ID: ENSP00000331313
MTAPCPPPPPDPQFVLRGTQSPVHALHFCEGAQAQGRPLLFSGSQSGLVHIWSLQTRRAVTTLDGHGGQCVTWLQTLPQGRQLLSQGRDLKLCLWDLAEGRSAVVDSVCLESVGFCRSSILAGGQPRWTLAVPGRGSDEVQILEMPSKTSVCALKPKADAKLGMPMCLRLWQADCSSRPLLLAGYEDGSVVLWDVSEQKVCSRIACHEEPVMDLDFDSQKARGISGSAGKALAVWSLDWQQALQVRGTHELTNPGIAEVTIRPDRKILATAGWDHRIRVFHWRTMQPLAVLAFHSAAVQCVAFTADGLLAAGSKDQRISLWSLYPRA

SEQ ID NO: 36810 - protein, 212 aa, Homo sapiens
  Payload ID: 7297
  Gene Symbol: GNB1L
  Gene Name: guanine nucleotide binding protein (G protein), beta polypeptide 1-like
  Uniprot ID: Q9BYB4
  ENSP ID: ENSP00000384626
MTAPCPPPPPDPQFVLRGTQSPVHALHFCEGAQAQGRPLLFSGSQSGLVHIWSLQTRRAVTTLDGHGGQCVTWLQTLPQGRQLLSQGRDLKLCLWDLAEGRSAVVDSVCLESVGFCRSSILAGGQPRWTLAVPGRGSDEVQILEMPSKTSVCALKPKADAKLGMPMCLRLWQADCSSRPLLLAGYEDGSVVLWDVSEQKVCSRIACHEEPGL

SEQ ID NO: 36811 - protein, 327 aa, Homo sapiens; identical to SEQ ID NO: 36809
  Payload ID: 7297
  Gene Symbol: GNB1L
  Gene Name: guanine nucleotide binding protein (G protein), beta polypeptide 1-like
  Uniprot ID: Q9BYB4
  ENSP ID: ENSP00000385154

SEQ ID NO: 36812 - protein, 93 aa, Homo sapiens
  Payload ID: 7297
  Gene Symbol: GNB1L
  Gene Name: guanine nucleotide binding protein (G protein), beta polypeptide 1-like
  ENSP ID: ENSP00000389412
MTAPCPPPPPDPQFVLRGTQSPVHALHFCEGAQAQGRPLLFSGQGRDLKLCLWDLAEGRSAVVDSVCLESVGFCRSSILAGGQPRWTLAVPGR

SEQ ID NO: 36813 - protein, 340 aa, Homo sapiens
  Payload ID: 7298
  Gene Symbol: GNB2
  Gene Name: guanine nucleotide binding protein (G protein), beta polypeptide 2
  Uniprot ID: P62879
  ENSP ID: ENSP00000305260
MSELEQLRQEAEQLRNQIRDARKACGDSTLTQITAGLDPVGRIQMRTRRTLRGHLAKIYAMHWGTDSRLLVSASQDGKLIIWDSYTTNKVHAIPLRSSWVMTCAYAPSGNFVACGGLDNICSIYSLKTREGNVRVSRELPGHTGYLSCCRFLDDNQIITSSGDTTCALWDIETGQQTVGFAGHSGDVMSLSLAPDGRTFVSGACDASIKLWDVRDSMCRQTFIGHESDINAVAFFPNGYAFTTGSDDATCRLFDLRADQELLMYSHDNIICGITSVAFSRSGRLLLAGYDDFNCNIWDAMKGDRAGVLAGHDNRVSCLGVTDDGMAVATGSWDSFLKIWN

SEQ ID NO: 36814 - protein, 340 aa, Homo sapiens; identical to SEQ ID NO: 36813
  Payload ID: 7298
  Gene Symbol: GNB2
  Gene Name: guanine nucleotide binding protein (G protein), beta polypeptide 2
  Uniprot ID: P62879
  ENSP ID: ENSP00000377501

SEQ ID NO: 36815 - protein, 340 aa, Homo sapiens; identical to SEQ ID NO: 36813
  Payload ID: 7298
  Gene Symbol: GNB2
  Gene Name: guanine nucleotide binding protein (G protein), beta polypeptide 2
  Uniprot ID: P62879
  ENSP ID: ENSP00000377503

SEQ ID NO: 36816 - protein, 296 aa, Homo sapiens
  Payload ID: 7298
  Gene Symbol: GNB2
  Gene Name: guanine nucleotide binding protein (G protein), beta polypeptide 2
  ENSP ID: ENSP00000389391
MRTRRTLRGHLAKIYAMHWGTDSRLLVSASQDGKLIIWDSYTTNKVHAIPLRSSWVMTCAYAPSGNFVACGGLDNICSIYSLKTREGNVRVSRELPGHTGYLSCCRFLDDNQIITSSGDTTCALWDIETGQQTVGFAGHSGDVMSLSLAPDGRTFVSGACDASIKLWDVRDSMCRQTFIGHESDINAVAFFPNGYAFTTGSDDATCRLFDLRADQELLMYSHDNIICGITSVAFSRSGRLLLAGYDDFNCNIWDAMKGDRAGVLAGHDNRVSCLGVTDDGMAVATGSWDSFLKIWN

SEQ ID NO: 36817 - protein, 232 aa, Homo sapiens
  Payload ID: 7298
  Gene Symbol: GNB2
  Gene Name: guanine nucleotide binding protein (G protein), beta polypeptide 2
  ENSP ID: ENSP00000390077
MSELEQLRQEAEQLRNQIRDARKACGDSTLTQITAGLDPVGRIQMRTRRTLRGHLAKIYAMHWGTDSRLLVSASQDGKLIIWDSYTTNKVHAIPLRSSWVMTCAYAPSGNFVACGGLDNICSIYSLKTREGNVRVSRELPGHTGYLSCCRFLDDNQIITSSGDTTCALWDIETGQQTVGFAGHSGDVMSLSLAPDGRTFVSGACDASIKLWDVRDSMCRQTFIGHESDINAV

SEQ ID NO: 36818 - protein, 240 aa, Homo sapiens
  Payload ID: 7298
  Gene Symbol: GNB2
  Gene Name: guanine nucleotide binding protein (G protein), beta polypeptide 2
  Uniprot ID: P62879
  ENSP ID: ENSP00000390543
MTCAYAPSGNFVACGGLDNICSIYSLKTREGNVRVSRELPGHTGYLSCCRFLDDNQIITSSGDTTCALWDIETGQQTVGFAGHSGDVMSLSLAPDGRTFVSGACDASIKLWDVRDSMCRQTFIGHESDINAVAFFPNGYAFTTGSDDATCRLFDLRADQELLMYSHDNIICGITSVAFSRSGRLLLAGYDDFNCNIWDAMKGDRAGVLAGHDNRVSCLGVTDDGMAVATGSWDSFLKIWN

SEQ ID NO: 36819 - protein, 251 aa, Homo sapiens
  Payload ID: 7298
  Gene Symbol: GNB2
  Gene Name: guanine nucleotide binding protein (G protein), beta polypeptide 2
  ENSP ID: ENSP00000399904
MSELEQLRQEAEQLRNQIRDARKACGDSTLTQITAGLDPVGRIQMRTRRTLRGHLAKIYAMHWGTDSRLLVSASQDGKLIIWDSYTTNKVHAIPLRSSWVMTCAYAPSGNFVACGGLDNICSIYSLKTREGNVRVSRELPGHTGYLSCCRFLDDNQIITSSGDTTCALWDIETGQQTVGFAGHSGDVMSLSLAPDGRTFVSGACDASIKLWDVRDSMCRQTFIGHESDINAVAFFPNGYAFTTGSDDATCR

SEQ ID NO: 36820 - protein, 240 aa, Homo sapiens; identical to SEQ ID NO: 36818
  Payload ID: 7298
  Gene Symbol: GNB2
  Gene Name: guanine nucleotide binding protein (G protein), beta polypeptide 2
  Uniprot ID: P62879
  ENSP ID: ENSP00000400286

SEQ ID NO: 36821 - protein, 296 aa, Homo sapiens; identical to SEQ ID NO: 36816
  Payload ID: 7298
  Gene Symbol: GNB2
  Gene Name: guanine nucleotide binding protein (G protein), beta polypeptide 2
  ENSP ID: ENSP00000401873

SEQ ID NO: 36822 - protein, 152 aa, Homo sapiens
  Payload ID: 7298
  Gene Symbol: GNB2
  Gene Name: guanine nucleotide binding protein (G protein), beta polypeptide 2
  ENSP ID: ENSP00000413219
MSELEQLRQEAEQLRNQIRDARKACGDSTLTQITAGLDPVGRIQMRTRRTLRGHLAKIYAMHWGTDSRLLVSASQDGKLIIWDSYTTNKVHAIPLRSSWVMTCAYAPSGNFVACGGLDNICSIYSLKTREGNVRVSRELPGHTGYLSCCRFL

SEQ ID NO: 36823 - protein, 273 aa, Homo sapiens
  Payload ID: 7299
  Gene Symbol: GNB2L1
  Gene Name: guanine nucleotide binding protein (G protein), beta polypeptide 2-like 1
  ENSP ID: ENSP00000366013
MTEQMTLRGTLKGHNGWVTQIATTPQFPDMILSASRGSWDGTLRLWDLTTGTTTRRFVGHTKDVLSVAFSSDNRQIVSGSRDKTIKLWNTLGVCKYTVQDESHSEWVSCVRFSPNSSNPIIVSCGWDKLVKVWNLANCKLKTNHIGHTGYLNTVTVSPDGSLCASGGKDGQAMLWDLNEGKHLYTLDGGDIINALCFSPNRYWLCAATGPSIKIWDLEGKIIVDELKQEVISTSSKAEPPQCTSLAWSADGQTLFAGYTDNLVRVWQVTIGTR

SEQ ID NO: 36824 - protein, 39 aa, Homo sapiens
  Payload ID: 7299
  Gene Symbol: GNB2L1
  Gene Name: guanine nucleotide binding protein (G protein), beta polypeptide 2-like 1
  ENSP ID: ENSP00000420936
MTEQMTLRGTLKGHNGWVTQIATTPQFPDMILSASRGTD

SEQ ID NO: 36825 - protein, 197 aa, Homo sapiens
  Payload ID: 7299
  Gene Symbol: GNB2L1
  Gene Name: guanine nucleotide binding protein (G protein), beta polypeptide 2-like 1
  ENSP ID: ENSP00000421356
MTEQMTLRGTLKGHNGWVTQIATTPQFPDMILSASRVWPGAYGPGGAVMTPTCHLSVGAEIQRLFLSCRPAQGSWGDKTIIMWKLTRDETNYGIPQRALRGHSHFVSDVVISSDGQFALSGSWDGTLRLWDLTTGTTTRRFVGHTKDVLSVAFSSDNRQIVSGSRDKTIKLWNTLGVCKYTVQDESHSEWVSCVRFS

SEQ ID NO: 36826 - protein, 194 aa, Homo sapiens
  Payload ID: 7299
  Gene Symbol: GNB2L1
  Gene Name: guanine nucleotide binding protein (G protein), beta polypeptide 2-like 1
  ENSP ID: ENSP00000421416
MWKLTRDETNYGIPQRALRGHSHFVSDVVISSDGQFALSGSWDGTLRLWDLTTGTTTRRFVGHTKDVLSVAFSSDNRQIVSGSRDKTIKLWNTLGVCKYTVQDESHSEWVSCVRFSPNSSNPIIVSCGWDKLVKVWNLANCKLKTNHIGHTGYLNTVTVSPDGSLCASGGKDGQAMLWDLNEGKHLYTLDGGDI

SEQ ID NO: 36827 - protein, 138 aa, Homo sapiens
  Payload ID: 7299
  Gene Symbol: GNB2L1
  Gene Name: guanine nucleotide binding protein (G protein), beta polypeptide 2-like 1
  ENSP ID: ENSP00000421838
  MOD_RES (1)..(1): Any amino acid
XDESHSEWVSCVRFSPNSSNPIIVSCGWDKLVKVWNLANCKLKTNHIGHTGYLNTVTVSPDGSLCASGGKDGQAMLWDLNEGKHLYTLDGGDIINALCFSPNRYWLCAATGPSIKIWTLFAGYTDNLVRVWQVTIGTR

SEQ ID NO: 36828 - protein, 236 aa, Homo sapiens
  Payload ID: 7299
  Gene Symbol: GNB2L1
  Gene Name: guanine nucleotide binding protein (G protein), beta polypeptide 2-like 1
  ENSP ID: ENSP00000422029
MPLHSSLGDRARLHLKKKKSYQDKTIIMWKLTRDETNYGIPQRALRGHSHFVSDVVISSDGQFALSGSWDGTLRLWDLTTGTTTRRFVGHTKDVLSVAFSSDNRQIVSGSRDKTIKLWNTLGVCKYTVQDESHSEWVSCVRFSPNSSNPIIVSCGWDKLVKVWNLANCKLKTNHIGHTGYLNTVTVSPDGSLCASGGKDGQAMLWDLNEGKHLYTLDGGDIINALCFSPNRYWLCA

SEQ ID NO: 36829 - protein, 116 aa, Homo sapiens
  Payload ID: 7299
  Gene Symbol: GNB2L1
  Gene Name: guanine nucleotide binding protein (G protein), beta polypeptide 2-like 1
  ENSP ID: ENSP00000422198
MTEQMTLRGTLKGHNGWVTQIATTPQFPDMILSASRDKTIIMWKLTRDETNYGIPQRALRGHSHFVSDVVISSDGQFALSGSWDGTLRLWDLTTQGHHHEAICGPYQGCAECGLLL

SEQ ID NO: 36830 - protein, 274 aa, Homo sapiens
  Payload ID: 7299
  Gene Symbol: GNB2L1
  Gene Name: guanine nucleotide binding protein (G protein), beta polypeptide 2-like 1
  ENSP ID: ENSP00000422316
  MOD_RES (1)..(1): Any amino acid
XISSDGQFALSGSWDGTLRLWDLTTGTTTRRFVGHTKDVLSVAFSSDNRQIVSGSRDKTIKLWNTLGVCKYTVQDESHSEWVSCVRFSPNSSNPIIVSCGWDKLVKVWNLANCKLKTNHIGHTGYLNTVTVSPDGSLCASGGKDGQAMLWDLNEGKHLYTLDGGDIINALCFSPNRYWLCAATGPSIKIWDLEGKIIVDELKQEVISTSSKAEPPQCTSLAWSADGQEYITTTYKLAVEMRAVSYSLPGVVAHAYWRLRLCLLATRTTWCECGR

SEQ ID NO: 36831 - protein, 269 aa, Homo sapiens
  Payload ID: 7299
  Gene Symbol: GNB2L1
  Gene Name: guanine nucleotide binding protein (G protein), beta polypeptide 2-like 1
  ENSP ID: ENSP00000422768
MTEQMTLRGTLKGHNGWVTQIATTPQFPDMILSASRDKTIIMWKLTRDETNYGIPQRALRGHSHFVSDVVISSDGQFALSGSWDGTLRLWDLTTQDESHSEWVSCVRFSPNSSNPIIVSCGWDKLVKVWNLANCKLKTNHIGHTGYLNTVTVSPDGSLCASGGKDGQAMLWDLNEGKHLYTLDGGDIINALCFSPNRYWLCAATGPSIKIWDLEGKIIVDELKQEVISTSSKAEPPQCTSLAWSADGQTLFAGYTDNLVRVWQVTIGTR

SEQ ID NO: 36832 - protein, 300 aa, Homo sapiens
  Payload ID: 7299
  Gene Symbol: GNB2L1
  Gene Name: guanine nucleotide binding protein (G protein), beta polypeptide 2-like 1
  ENSP ID: ENSP00000423569
MEVVPLGSQTRERGSSPGAGRSGETQKNGGPSQEGSCQQGVGQPRGLPQKAGRGLQQASHLREAGEEAPWMRRKRPAGPAGAGTDKTIIMWKLTRDETNYGIPQRALRGHSHFVSDVVISSDGQFALSGSWDGTLRLWDLTTGTTTRRFVGHTKDVLSVAFSSDNRQIVSGSRDKTIKLWNTLGVCKYTVQDESHSEWVSCVRFSPNSSNPIIVSCGWDKLVKVWNLANCKLKTNHIGHTGYLNTVTVSPDGSLCASGGKDGQAMLWDLNEGKHLYTLDGGDIINALCFSPNRYWLCAAT

SEQ ID NO: 36833 - protein, 160 aa, Homo sapiens
  Payload ID: 7299
  Gene Symbol: GNB2L1
  Gene Name: guanine nucleotide binding protein (G protein), beta polypeptide 2-like 1
  ENSP ID: ENSP00000424237
MTEQMTLRGTLKGHNGWVTQIATTPQFPDMILSASRDKTIIMWKLTRDETNYGIPQRALRGHSHFVSDVVISSDGQFALSGSWDGTLRLWDLTTQIVSGSRDKTIKLWNTLGVCKYTVQDESHSEWVSCVRFSPNSSNPIIVSCGWDKLVKVWNLANCKL

SEQ ID NO: 36834 - protein, 83 aa, Homo sapiens
  Payload ID: 7299
  Gene Symbol: GNB2L1
  Gene Name: guanine nucleotide binding protein (G protein), beta polypeptide 2-like 1
  ENSP ID: ENSP00000424654
  MOD_RES (1)..(1): Any amino acid
XYTLDGGDIINALCFSPNRYWLCAATGPSIKIWDLEGKIIVDELKQEVISTSSKAEPPQCTSLAWSADGQVSGSVLSGDSASS

SEQ ID NO: 36835 - protein, 147 aa, Homo sapiens
  Payload ID: 7299
  Gene Symbol: GNB2L1
  Gene Name: guanine nucleotide binding protein (G protein), beta polypeptide 2-like 1
  ENSP ID: ENSP00000424760
MTEQMTLRGTLKGHNGWVTQIATTPQFPDMILSASRDKTIIMWKLTRDETNYGIPQRALRGHSHFVSDVVISSDGQFALSGSWDGTLRLWDLTTGTTTRRFVGHTKDVLSVAFSSDNRQIVSGSRDKTIKLWNTLGVCKYTVQAGVQ

SEQ ID NO: 36836 - protein, 321 aa, Homo sapiens
  Payload ID: 7299
  Gene Symbol: GNB2L1
  Gene Name: guanine nucleotide binding protein (G protein), beta polypeptide 2-like 1
  ENSP ID: ENSP00000425008
MTEQMTLRGTLKGHNGWVTQIATTPQFPDMILSASRDKTIIMWKLTRDETNYGIPQRALRGHSHFVSDVVISSDGQFALSGSWDGTLRLWDLTTLSLDLEIKPSSYGIPWVCANTLSSLILSPRLECSSAISAHCKLCFPGSRHSPASASRVAGTTGACHQDESHSEWVSCVRFSPNSSNPIIVSCGWDKLVKVWNLANCKLKTNHIGHTGYLNTVTVSPDGSLCASGGKDGQAMLWDLNEGKHLYTLDGGDIINALCFSPNRYWLCAATGPSIKIWDLEGKIIVDELKQEVISTSSKAEPPQCTSLAWSADGQTLFAGYT

SEQ ID NO: 36837 - protein, 86 aa, Homo sapiens
  Payload ID: 7299
  Gene Symbol: GNB2L1
  Gene Name: guanine nucleotide binding protein (G protein), beta polypeptide 2-like 1
  ENSP ID: ENSP00000426046
MTEQMTLRGTLKGHNGWVTQIATTPQFPDMILSASRDELKQEVISTSSKAEPPQCTSLAWSADGQTLFAGYTDNLVRVWQVTIGTR

SEQ ID NO: 36838 - protein, 233 aa, Homo sapiens
  Payload ID: 7299
  Gene Symbol: GNB2L1
  Gene Name: guanine nucleotide binding protein (G protein), beta polypeptide 2-like 1
  ENSP ID: ENSP00000426101
MTEQMTLRGTLKGHNGWVTQIATTPQFPDMILSASRDKTIIMWKLTRDETNYGIPQRALRGHSHFVSDVVISSDGQFALSGSWDGTLRLWDLTTGTTTRRFVGHTKDVLSVAFSSDNRQIVSGSRDKTIKLWNTLGVCKYTVQDESHSEWVSCVRFSPNSSNPIIVSCGWDKLVKVWNLANCKLKTNHIGHTGYLNTVTVSPDGSLCASGGKTLFAGYTDNLVRVWQVTIGTR

SEQ ID NO: 36839 - protein, 153 aa, Homo sapiens
  Payload ID: 7299
  Gene Symbol: GNB2L1
  Gene Name: guanine nucleotide binding protein (G protein), beta polypeptide 2-like 1
  ENSP ID: ENSP00000426111
MTEQMTLRGTLKGHNGWVTQIATTPQFPDMILSASRDKTIIMWKLTRDETNYGIPQRALRGHSHFVSDVVISSDGQFALSGSWDGTLRLWDLTTGTTTRRFVGHTKDVLSVAFSSDNRQIVSGSRDKTIKLWNTLGVCKYTVQSHSVAQAGVQ

SEQ ID NO: 36840 - protein, 71 aa, Homo sapiens
  Payload ID: 7299
  Gene Symbol: GNB2L1
  Gene Name: guanine nucleotide binding protein (G protein), beta polypeptide 2-like 1
  ENSP ID: ENSP00000426270
MTEQMTLRGTLKGHNGWVTQIATTPQFPDMILSASRDKTIIMWKLTRDETNYGIPQRAPPRGDLWAIPRMC

SEQ ID NO: 36841 - protein, 101 aa, Homo sapiens
  Payload ID: 7299
  Gene Symbol: GNB2L1
  Gene Name: guanine nucleotide binding protein (G protein), beta polypeptide 2-like 1
  ENSP ID: ENSP00000426708
MLWDLNEGKHLYTLDGGDIINALCFSPNRYWLCAATGPSIKIWDLEGKIIVDELKQEVISTSSKAEPPQCTSLAWSADGQTLFAGYTDNLVRVWQVTIGTR

SEQ ID NO: 36842 - protein, 317 aa, Homo sapiens [sequence omitted]

SEQ ID NO: 36843 - protein, 198 aa, Homo sapiens
  Payload ID: 7299
  Gene Symbol: GNB2L1
  Gene Name: guanine nucleotide binding protein (G protein), beta polypeptide 2-like 1
  ENSP ID: ENSP00000426960
  MOD_RES (1)..(1): Any amino acid
XDGTLRLWDLTTGTTTRRFVGHTKDVLSVAFSSDNRQIVSGSRDKTIKLWNTLGVCKYTVQDESHSEWVSCVRFSPNSSNPIIVSCGWDKLVKDGQAMLWDLNEGKHLYTLDGGDIINALCFSPNRYWLCAATGPSIKIWDLEGKIIVDELKQEVISTSSKAEPPQCTSLAWSADGQTLFAGYTDNLVRVWQVTIGTR

SEQ ID NO: 36844 - protein, 247 aa, Homo sapiens
  Payload ID: 7299
  Gene Symbol: GNB2L1
  Gene Name: guanine nucleotide binding protein (G protein), beta polypeptide 2-like 1
  ENSP ID: ENSP00000427677
  MOD_RES (1)..(1): Any amino acid
XGTTTRRFVGHTKDVLSVAFSSDNRQIVSGSRDKTIKLWNTLGVCKYTVQDESHSEWVSCVRFSPNSSNPIIVSCGWDKLVKVWNLANCKLKTNHIGHTGYLNTVTVSPDGSLCASGGKDGQAMLWDLNEGKHLYTLDGGDIINALCFSPNRYWLCAATGPSIKIWDLEGKIIVDELKQEVISTSSKAEPPQCTSLAWSADGQEYITTTYKLAVEMRAVSYSLPGVVAHAYWRLRWEDLLNCRGLRL

SEQ ID NO: 36845 - protein, 153 aa, Homo sapiens; identical to SEQ ID NO: 36839
  Payload ID: 7299
  Gene Symbol: GNB2L1
  Gene Name: guanine nucleotide binding protein (G protein), beta polypeptide 2-like 1
  ENSP ID: ENSP00000486170

SEQ ID NO: 36846 - protein, 340 aa, Homo sapiens [sequence omitted]

SEQ ID NO: 36847 - protein, 339 aa, Homo sapiens
  Payload ID: 7300
  Gene Symbol: GNB3
  Gene Name: guanine nucleotide binding protein (G protein), beta polypeptide 3
  ENSP ID: ENSP00000414734
MGEMEQLRQEAEQLKKQIADARKACADVTLAELVSGLEVVGRVQMRTRRTLRGHLAKIYAMHWATDSKLLVSASQDGKLIVWDSYTTNKVHAIPLRSSWVMTCAYAPSGNFVACGGLDNMCSIYNLKSREGNVKVSRELSAHTGYLSCCRFLDDNNIVTSSGDTTALWDIETGQQKTVFVGHTGDCMSLAVSPDFNLFISGACDASAKLWDVREGTCRQTFTGHESDINAICFFPNGEAICTGSDDASCRLFDLRADQELICFSHESIICGITSVAFSLSGRLLFAGYDDFNCNVWDSMKSERVGILSGHDNRVSCLGVTADGMAVATGSWDSFLKIWN

SEQ ID NO: 36848 - protein, 232 aa, Homo sapiens
  Payload ID: 7300
  Gene Symbol: GNB3
  Gene Name: guanine nucleotide binding protein (G protein), beta polypeptide 3
  ENSP ID: ENSP00000439753
MGEMEQLRQEAEQLKKQIADARKACADVTLAELVSGLEVVGRVQMRTRRTLRGHLAKIYAMHWATDSKLLVSASQDGKLIVWDSYTTNKVHAIPLRSSWVMTCAYAPSGNFVACGGLDNMCSIYNLKSREGNVKVSRELSAHTGYLSCCRFLDDNNIVTSSGDTTCALWDIETGQQKTVFVGHTGDCMSLAVSPDFNLFISGACDASAKLWDVREGTCRQTFTGHESDINAI

SEQ ID NO: 36849 - protein, 232 aa, Homo sapiens
  Payload ID: 7300
  Gene Symbol: GNB3
  Gene Name: guanine nucleotide binding protein (G protein), beta polypeptide 3
  ENSP ID: ENSP00000442002
MGEMEQLRQEAEQLKKQIADARKACADVTLAELVSGLEVVGRVQMRTRRTLRGHLAKIYAMHWATDSKLLVSASQDGKLIVWDSYTTNKVHAIPLRSSWVMTCAYAPSGNFVACGGLDNMCSIYNLKSREGNVKVSRELSAHTGYLSCCRFLDDNNIVTSSGDTTALWDIETGQQKTVFVGHTGDCMSLAVSPDFNLFISGACDASAKLWDVREGTCRQTFTGHESDINAIC

SEQ ID NO: 36850 - protein, 36 aa, Homo sapiens
  Payload ID: 7300
  Gene Symbol: GNB3
  Gene Name: guanine nucleotide binding protein (G protein), beta polypeptide 3
  ENSP ID: ENSP00000444325
MGEMEQLRQEAEQLKKQIADARKACADVTLAERDLL

SEQ ID NO: 36851 - protein, 264 aa, Homo sapiens
  Payload ID: 7300
  Gene Symbol: GNB3
  Gene Name: guanine nucleotide binding protein (G protein), beta polypeptide 3
  ENSP ID: ENSP00000445967
MGEMEQLRQEAEQLKKQIADARKACADVTLAELVSGLEVVGRVQMRTRRTLRGHLAKIYAMHWATDSKLLVSASQDGKLIVWDSYTTNKVHAIPLRSSWVMTCAYAPSGNFVACGGLDNMCSIYNLKSREGNVKVSRELSAHTGYLSCCRFLDDNNIVTSSGDTTCAKLWDVREGTCRQTFTGHESDINAICFFPNGEAICTGSDDASCRLFDLRADQELICFSHESIICGITSVAFSLSGRLLFAGYDDFNCNVWDSMKSERV

SEQ ID NO: 36852 - protein, 340 aa, Homo sapiens
  Payload ID: 7301
  Gene Symbol: GNB4
  Gene Name: guanine nucleotide binding protein (G protein), beta polypeptide 4
  Uniprot ID: Q9HAV0
  ENSP ID: ENSP00000232564
MSELEQLRQEAEQLRNQIQDARKACNDATLVQITSNMDSVGRIQMRTRRTLRGHLAKIYAMHWGYDSRLLVSASQDGKLIIWDSYTTNKMHAIPLRSSWVMTCAYAPSGNYVACGGLDNICSIYNLKTREGNVRVSRELPGHTGYLSCCRFLDDSQIVTSSGDTTCALWDIETAQQTTTFTGHSGDVMSLSLSPDMRTFVSGACDASSKLWDIRDGMCRQSFTGHVSDINAVSFFPNGYAFATGSDDATCRLFDLRADQELLLYSHDNIICGITSVAFSKSGRLLLAGYDDFNCNVWDTLKGDRAGVLAGHDNRVSCLGVTDDGMAVATGSWDSFLRIWN

SEQ ID NO: 36853 - protein, 340 aa, Homo sapiens; identical to SEQ ID NO: 36852
  Payload ID: 7301
  Gene Symbol: GNB4
  Gene Name: guanine nucleotide binding protein (G protein), beta polypeptide 4
  Uniprot ID: Q9HAV0
  ENSP ID: ENSP00000419693

SEQ ID NO: 36854 - protein, 165 aa, Homo sapiens
  Payload ID: 7301
  Gene Symbol: GNB4
  Gene Name: guanine nucleotide binding protein (G protein), beta polypeptide 4
  ENSP ID: ENSP00000420066
  MOD_RES (1)..(1): Any amino acid
XLIIWDSYTTNKMHAIPLRSSWVMTCAYAPSGNYVACGGLDNICSIYNLKTREGNVRVSRELPGHTGYLSCCRFLDDSQIVTSSGDTTCALWDIETAQQTTTFTGHSGDVMSLSLSPDMRTFVSGACDASSKLWDIRDGMCRQSFTGHVSDINAVSVSLLVMTTV

SEQ ID NO: 36855 - protein, 79 aa, Homo sapiens
  Payload ID: 7301
  Gene Symbol: GNB4
  Gene Name: guanine nucleotide binding protein (G protein), beta polypeptide 4
  ENSP ID: ENSP00000420606
MSELEQLRQEAEQLRNQIQDARKACNDATLVQITSNMDSVGRIQMRTRRTLRGHLAKIYAMHWGYDSRLLVSASQDGKL

SEQ ID NO: 36856 - protein, 68 aa, Homo sapiens
  Payload ID: 7302
  Gene Symbol: GNG10
  Gene Name: guanine nucleotide binding protein (G protein), gamma 10
  Uniprot ID: P50151
  ENSP ID: ENSP00000363411
MSSGASASALQRLVEQLKLEAGVERIKVSQAAAELQQYCMQNACKDALLVGVPAGSNPFREPRSCALL

SEQ ID NO: 36857 - protein, 73 aa, Homo sapiens
  Payload ID: 7303
  Gene Symbol: GNG11
  Gene Name: guanine nucleotide binding protein (G protein), gamma 11
  Uniprot ID: P61952
  ENSP ID: ENSP00000248564
MPALHIEDLPEKEKLKMEVEQLRKEVKLQRQQVSKCSEEIKNYIEERSGEDPLVKGIPEDKNPFKEKGSCVIS

SEQ ID NO: 36858 - protein, 72 aa, Homo sapiens
  Payload ID: 7304
  Gene Symbol: GNG12
  Gene Name: guanine nucleotide binding protein (G protein), gamma 12
  Uniprot ID: Q9UBI6
  ENSP ID: ENSP00000360021
MSSKTASTNNIAQARRTVQQLRLEASIERIKVSKASADLMSYCEEHARSDPLLIGIPTSENPFKDKKTCIIL

SEQ ID NO: 36859 - protein, 67 aa, Homo sapiens
  Payload ID: 7305
  Gene Symbol: GNG13
  Gene Name: guanine nucleotide binding protein (G protein), gamma 13
  Uniprot ID: Q9P2W3
  ENSP ID: ENSP00000248150
MEEWDVPQMKKEVESLKYQLAFQREMASKTIPELLKWIEDGIPKDPFLNPDLMKNNPWVEKGKCTIL

SEQ ID NO: 36860 - protein, 71 aa, Homo sapiens
  Payload ID: 7306
  Gene Symbol: GNG2
  Gene Name: guanine nucleotide binding protein (G protein), gamma 2
  Uniprot ID: P59768
  ENSP ID: ENSP00000334448
MASNNTASIAQARKLVEQLKMEANIDRIKVSKAAADLMAYCEAHAKEDPLLTPVPASENPFREKKFFCAIL

SEQ ID NO: 36861 - protein, 52 aa, Homo sapiens
  Payload ID: 7306
  Gene Symbol: GNG2
  Gene Name: guanine nucleotide binding protein (G protein), gamma 2
  ENSP ID: ENSP00000450586
MASNNTASIAQARKLVEQLKMEANIDRIKSALCWSVLRRRHIIASFVCRCSL

SEQ ID NO: 36862 - protein, 110 aa, Homo sapiens
  Payload ID: 7306
  Gene Symbol: GNG2
  Gene Name: guanine nucleotide binding protein (G protein), gamma 2
  ENSP ID: ENSP00000450758
MVYLQAKTRIPEHRKVTQLIKCWSPDLNPVFLKDLSSTPMASNNTASIAQARKLVEQLKMEANIDRIKVSKAAADLMAYCEAHAKEDPLLTPVPASENPFREKKFFCAIL

SEQ ID NO: 36863 - protein, 37 aa, Homo sapiens
  Payload ID: 7306
  Gene Symbol: GNG2
  Gene Name: guanine nucleotide binding protein (G protein), gamma 2
  ENSP ID: ENSP00000450904
MQGKLQPPMEREARDGVPSGKARSASEPQALGTEECF

SEQ ID NO: 36864 - protein, 71 aa, Homo sapiens; identical to SEQ ID NO: 36860
  Payload ID: 7306
  Gene Symbol: GNG2
  Gene Name: guanine nucleotide binding protein (G protein), gamma 2
  Uniprot ID: P59768
  ENSP ID: ENSP00000451102

SEQ ID NO: 36865 - protein, 71 aa, Homo sapiens; identical to SEQ ID NO: 36860
  Payload ID: 7306
  Gene Symbol: GNG2
  Gene Name: guanine nucleotide binding protein (G protein), gamma 2
  Uniprot ID: P59768
  ENSP ID: ENSP00000451231

SEQ ID NO: 36866 - protein, 102 aa, Homo sapiens
  Payload ID: 7306
  Gene Symbol: GNG2
  Gene Name: guanine nucleotide binding protein (G protein), gamma 2
  ENSP ID: ENSP00000451279
MQGKLQPPMEREARDGVPSGKVFLKDLSSTPMASNNTASIAQARKLVEQLKMEANIDRIKVSKAAADLMAYCEAHAKEDPLLTPVPASENPFREKKFFCAIL

SEQ ID NO: 36867 - protein, 61 aa, Homo sapiens
  Payload ID: 7306
  Gene Symbol: GNG2
  Gene Name: guanine nucleotide binding protein (G protein), gamma 2
  ENSP ID: ENSP00000451536
MTVPLNGVIRQHKTDKPDQVFLKDLSSTPMASNNTASIAQARKLVEQLKMEANIDRIKEVH

SEQ ID NO: 36868 - protein, 71 aa, Homo sapiens; identical to SEQ ID NO: 36860
  Payload ID: 7306
  Gene Symbol: GNG2
  Gene Name: guanine nucleotide binding protein (G protein), gamma 2
  Uniprot ID: P59768
  ENSP ID: ENSP00000451576

SEQ ID NO: 36869 - protein, 71 aa, Homo sapiens; identical to SEQ ID NO: 36860
  Payload ID: 7306
  Gene Symbol: GNG2
  Gene Name: guanine nucleotide binding protein (G protein), gamma 2
  Uniprot ID: P59768
  ENSP ID: ENSP00000452014

SEQ ID NO: 36870 - protein, 71 aa, Homo sapiens; identical to SEQ ID NO: 36860
  Payload ID: 7306
  Gene Symbol: GNG2
  Gene Name: guanine nucleotide binding protein (G protein), gamma 2
  Uniprot ID: P59768
  ENSP ID: ENSP00000484021

SEQ ID NO: 36871 - protein, 75 aa, Homo sapiens
  Payload ID: 7307
  Gene Symbol: GNG3
  Gene Name: guanine nucleotide binding protein (G protein), gamma 3
  Uniprot ID: P63215
  ENSP ID: ENSP00000294117
MKGETPVNSTMSIGQARKMVEQLKIEASLCRIKVSKAAADLMTYCDAHACEDPLITPVPTSENPFREKKFFCALL

SEQ ID NO: 36872 - protein, 75 aa, Homo sapiens; identical to SEQ ID NO: 35859
  Payload ID: 7308
  Gene Symbol: GNG4
  Gene Name: guanine nucleotide binding protein (G protein), gamma 4
  Uniprot ID: P50150
  ENSP ID: ENSP00000355556

SEQ ID NO: 36873 - protein, 75 aa, Homo sapiens; identical to SEQ ID NO: 35859
  Payload ID: 7308
  Gene Symbol: GNG4
  Gene Name: guanine nucleotide binding protein (G protein), gamma 4
  Uniprot ID: P50150
  ENSP ID: ENSP00000355557

SEQ ID NO: 36874 - protein, 75 aa, Homo sapiens; identical to SEQ ID NO: 35859
  Payload ID: 7308
  Gene Symbol: GNG4
  Gene Name: guanine nucleotide binding protein (G protein), gamma 4
  Uniprot ID: P50150
  ENSP ID: ENSP00000375727

SEQ ID NO: 36875 - protein, 75 aa, Homo sapiens; identical to SEQ ID NO: 35859
  Payload ID: 7308
  Gene Symbol: GNG4
  Gene Name: guanine nucleotide binding protein (G protein), gamma 4
  Uniprot ID: P50150
  ENSP ID: ENSP00000398629

SEQ ID NO: 36876 - protein, 75 aa, Homo sapiens; identical to SEQ ID NO: 35859
  Payload ID: 7308
  Gene Symbol: GNG4
  Gene Name: guanine nucleotide binding protein (G protein), gamma 4
  Uniprot ID: P50150
  ENSP ID: ENSP00000482192

SEQ ID NO: 36877 - protein, 68 aa, Homo sapiens
  Payload ID: 7309
  Gene Symbol: GNG5
  Gene Name: guanine nucleotide binding protein (G protein), gamma 5
  Uniprot ID: P63218
  ENSP ID: ENSP00000359675
MSGSSSVAAMKKVVQQLRLEAGLNRVKVSQAAADLKQFCLQNAQHDPLLTGVSSSTNPFRPQKVCSFL

SEQ ID NO: 36878 - protein, 68 aa, Homo sapiens; identical to SEQ ID NO: 36877
  Payload ID: 7309
  Gene Symbol: GNG5
  Gene Name: guanine nucleotide binding protein (G protein), gamma 5
  Uniprot ID: P63218
  ENSP ID: ENSP00000359679

SEQ ID NO: 36879 - protein, 68 aa, Homo sapiens
  Payload ID: 7310
  Gene Symbol: GNG7
  Gene Name: guanine nucleotide binding protein (G protein), gamma 7
  Uniprot ID: O60262
  ENSP ID: ENSP00000371594
MSATNNIAQARKLVEQLRIEAGIERIKVSKAASDLMSYCEQHARNDPLLVGVPASENPFKDKKPCIIL

SEQ ID NO: 36880 - protein, 36 aa, Homo sapiens
  Payload ID: 7310
  Gene Symbol: GNG7
  Gene Name: guanine nucleotide binding protein (G protein), gamma 7
  ENSP ID: ENSP00000468650
MSATNNIAQARKLVEQLRIEAGIERIKERKQGEKGR

SEQ ID NO: 36881 - protein, 70 aa, Homo sapiens
  Payload ID: 7311
  Gene Symbol: GNG8
  Gene Name: guanine nucleotide binding protein (G protein), gamma 8
  Uniprot ID: Q9UK08
  ENSP ID: ENSP00000300873
MSNNMAKIAEARKTVEQLKLEVNIDRMKVSQAAAELLAFCETHAKDDPLVTPVPAAENPFRDKRLFCVLL

SEQ ID NO: 36882 - protein, 74 aa, Homo sapiens
  Payload ID: 7312
  Gene Symbol: GNGT1
  Gene Name: guanine nucleotide binding protein (G protein), gamma transducing activity polypeptide 1
  Uniprot ID: P63211
  ENSP ID: ENSP00000248572
MPVINIEDLTEKDKLKMEVDQLKKEVTLERMLVSKCCEEVRDYVEERSGEDPLVKGIPEDKNPFKELKGGCVIS

SEQ ID NO: 36883 - protein, 74 aa, Homo sapiens; identical to SEQ ID NO: 36882
  Payload ID: 7312
  Gene Symbol: GNGT1
  Gene Name: guanine nucleotide binding protein (G protein), gamma transducing activity polypeptide 1
  Uniprot ID: P63211
  ENSP ID: ENSP00000388777

SEQ ID NO: 36884 - protein, 46 aa, Homo sapiens
  Payload ID: 7312
  Gene Symbol: GNGT1
  Gene Name: guanine nucleotide binding protein (G protein), gamma transducing activity polypeptide 1
  ENSP ID: ENSP00000395756
MPVINIEDLTEKDKLKMEVDQLKKEVTLERMLIPARHLQNQSLMDY

SEQ ID NO: 36885 - protein, 46 aa, Homo sapiens; identical to SEQ ID NO: 36884
  Payload ID: 7312
  Gene Symbol: GNGT1
  Gene Name: guanine nucleotide binding protein (G protein), gamma transducing activity polypeptide 1
  ENSP ID: ENSP00000395857

SEQ ID NO: 36886 - protein, 46 aa, Homo sapiens; identical to SEQ ID NO: 36884
  Payload ID: 7312
  Gene Symbol: GNGT1
  Gene Name: guanine nucleotide binding protein (G protein), gamma transducing activity polypeptide 1
  ENSP ID: ENSP00000401781

SEQ ID NO: 36887 - protein, 69 aa, Homo sapiens
  Payload ID: 7313
  Gene Symbol: GNGT2
  Gene Name: guanine nucleotide binding protein (G protein), gamma transducing activity polypeptide 2
  Uniprot ID: O14610
  ENSP ID: ENSP00000300406
MAQDLSEKDLLKMEVEQLKKEVKNTRIPISKAGKEIKEYVEAQAGNDPFLKGIPEDKNPFKEKGGCLIS

SEQ ID NO: 36888 - protein, 88 aa, Homo sapiens
  Payload ID: 7313
  Gene Symbol: GNGT2
  Gene Name: guanine nucleotide binding protein (G protein), gamma transducing activity polypeptide 2
  ENSP ID: ENSP00000420946
MAQDLSEKDLLKMEVEQLKKEVKNTRIPISKAGKEIKEYVEAQAGNDPFLKGIPEDKNPFKEKGPTFNALLLLLGRASWLELTWSRTP

SEQ ID NO: 36889 - protein, 69 aa, Homo sapiens; identical to SEQ ID NO: 36887
  Payload ID: 7313
  Gene Symbol: GNGT2
  Gene Name: guanine nucleotide binding protein (G protein), gamma transducing activity polypeptide 2
  Uniprot ID: O14610
  ENSP ID: ENSP00000421710

SEQ ID NO: 36890 - protein, 69 aa, Homo sapiens; identical to SEQ ID NO: 36887
  Payload ID: 7313
  Gene Symbol: GNGT2
  Gene Name: guanine nucleotide binding protein (G protein), gamma transducing activity polypeptide 2
  Uniprot ID: O14610
  ENSP ID: ENSP00000422879

SEQ ID NO: 36891 - protein, 69 aa, Homo sapiens; identical to SEQ ID NO: 36887
  Payload ID: 7313
  Gene Symbol: GNGT2
  Gene Name: guanine nucleotide binding protein (G protein), gamma transducing activity polypeptide 2
  Uniprot ID: O14610
  ENSP ID: ENSP00000423924

SEQ ID NO: 36892 - protein, 69 aa, Homo sapiens; identical to SEQ ID NO: 36887
  Payload ID: 7313
  Gene Symbol: GNGT2
  Gene Name: guanine nucleotide binding protein (G protein), gamma transducing activity polypeptide 2
  Uniprot ID: O14610
  ENSP ID: ENSP00000426022

SEQ ID NO: 36893 - protein, 359 aa, Homo sapiens
  Payload ID: 7314
  Gene Symbol: GNAQ
  Gene Name: guanine nucleotide binding protein (G protein), q polypeptide
  Uniprot ID: P50148
  ENSP ID: ENSP00000286548
MTLESIMACCLSEEAKEARRINDEIERQLRRDKRDARRELKLLLLGTGESGKSTFIKQMRIIHGSGYSDEDKRGFTKLVYQNIFTAMQAMIRAMDTLKIPYKYEHNKAHAQLVREVDVEKVSAFENPYVDAIKSLWNDPGIQECYDRRREYQLSDSTKYYLNDLDRVADPAYLPTQQDVLRVRVPTTGIIEYPFDLQSVIFRMVDVGGQRSERRKWIHCFENVTSIMFLVALSEYDQVLVESDNENRMEESKALFRTIITYPWFQNSSVILFLNKKDLLEEKIMYSHLVDYFPEYDGPQRDAQAAREFILKMFVDLNPDSDKIIYSHFTCATDTENIRFVFAAVKDTILQLNLKEYNLV

SEQ ID NO: 36894 - protein, 170 aa, Homo sapiens
  Payload ID: 7314
  Gene Symbol: GNAQ
  Gene Name: guanine nucleotide binding protein (G protein), q polypeptide
  ENSP ID: ENSP00000391501
MGERWADSQLDSRSTHGTGESGKSTFIKQMRIIHGSGYSDEDKRGFTKLVYQNIFTAMQAMIRAMDTLKIPYKYEHNKAHAQLVREVDVEKVSAFENPYVDAIKSLWNDPGIQECYDRRREYQLSDSTKYYLNDLDRVADPAYLPTQQDVLRVRVPTTGIIEYPFDLQSV

SEQ ID NO: 36895 - protein, 354 aa, Homo sapiens
  Payload ID: 7315
  Gene Symbol: GNAT3
  Gene Name: guanine nucleotide binding protein, alpha transducing 3
  Uniprot ID: A8MTJ3
  ENSP ID: ENSP00000381339
MGSGISSESKESAKRSKELEKKLQEDAERDARTVKLLLLGAGESGKSTIVKQMKIIHKNGYSEQECMEFKAVIYSNTLQSILAIVKAMTTLGIDYVNPRSAEDQRQLYAMANTLEDGGMTPQLAEVIKRLWRDPGIQACFERASEYQLNDSAAYYLNDLDRITASGYVPNEQDVLHSRVKTTGIIETQFSFKDLHFRMFDVGGQRSERKKWIHCFEGVTCIIFCAALSAYDMVLVEDEEVNRMHESLHLFNSICNHKYFSTTSIVLFLNKKDIFQEKVTKVHLSICFPEYTGPNTFEDAGNYIKNQFLDLNLKKEDKEIYSHMTCATDTQNVKFVFDAVTDIIIKENLKDCGLF

SEQ ID NO: 36896 - protein, 607 aa, Homo sapiens
  Payload ID: 7316
  Gene Symbol: GNL1
  Gene Name: guanine nucleotide binding protein-like 1
  Uniprot ID: P36915
  ENSP ID: ENSP00000365806
MPRKKPFSVKQKKKQLQDKRERKRGLQDGLRSSSNSRSGSRERREEQTDTSDGESVTHHIRRLNQQPSQGLGPRGYDPNRYRLHFERDSREEVERRKRAAREQVLQPVSAELLELDIREVYQPGSVLDFPRRPPWSYEMSKEQLMSQEERSFQDYLGKIHGAYSSEKLSYFEHNLETWRQLWRVLEMSDIVLLITDIRHPVVNFPPALYEYVTGELGLALVLVLNKVDLAPPALVVAWKHYFHQHYPQLHVVLFTSFPRDPRTPQDPSSVLKKSRRRGRGWTRALGPEQLLRACEAITVGKVDLSSWREKIARDVAGATWGNGSGEEEEEEDGPAVLVEQQTDSAMEPTGPTQERYKDGVVTIGCVGFPNVGKSSLINGLVGRKVVSVSRTPGHTRYFQTYFLTPSVKLCDCPGLIFPSLLPRQLQVLAGIYPIAQIQEPYTAVGYLASRIPVQALLHLRHPEAEDPSAEHPWCAWDICEAWAEKRGYKTAKAARNDVYRAANSLLRLAVDGRLSLCFHPPGYSEQKGTWESHPETTELVVLQGRVGPAGDEEEEEEEELSSSCEEEGEEDRDADEEGEGDEETPTSAPGSSLAGRNPYALLGEDEC

SEQ ID NO: 36897 - protein, 407 aa, Homo sapiens
  Payload ID: 7316
  Gene Symbol: GNL1
  Gene Name: guanine nucleotide binding protein-like 1
  ENSP ID: ENSP00000372942
VVNFPPALYEYVTGELGLALVLVLNKVDLAPPALVVAWKHYFHQHYPQLHVVLFTSFPRDPRTPQDPSSVLKKSRRRGRGWTRALGPEQLLRACEAITVGKVDLSSWREKIARDVAGATWGNGSGEEEEEEDGPAVLVEQQTDSAMEPTGPTQERYKDGVVTIGCVGFPNVGKSSLINGLVGRKVVSVSRTPGHTRYFQTYFLTPSVKLCDCPGLIFPSLLPRQLQVLAGIYPIAQIQEPYTAVGYLASRIPVQALLHLRHPEAEDPSAEHPWCAWDICEAWAEKRGYKTAKAARNDVYRAANSLLRLAVDGRLSLCFHPPGYSEQKGTWESHPETTELVVLQGRVGPAGDEEEEEEEELSSSCEEEGEEDRDADEEGEGDEETPTSAPGSSLAGRNPYALLGEDEC

SEQ ID NO: 36898 - protein, 607 aa, Homo sapiens; identical to SEQ ID NO: 36896
  Payload ID: 7316
  Gene Symbol: GNL1
  Gene Name: guanine nucleotide binding protein-like 1
  Uniprot ID: P36915
  ENSP ID: ENSP00000373090

SEQ ID NO: 36899 - protein, 264 aa, Homo sapiens
  Payload ID: 7316
  Gene Symbol: GNL1
  Gene Name: guanine nucleotide binding protein-like 1
  ENSP ID: ENSP00000392654
MGERVLWPLRAGQHWRHRPLPAGLQDGLRSSSNSRSGSRERREEQTDTSDGESVTHHIRRLNQQPSQGLGPRGYDPNRYRLHFERDSREEVERRKRAAREQVLQPVSAELLELDIREVYQPGSVLDFPRRPPWSYEMSKEQLMSQEERSFQDYLGKIHGAYSSEKLSYFEHNLETWRQLWRVLEMSDIVLLITDIRHPVVNFPPALYEYVTGELGLALVLVLNKVDLAPPALVVAWKHYFHQHYPQLHVVLFTSFPRDPRTPQD

SEQ ID NO: 36900 - protein, 607 aa, Homo sapiens; identical to SEQ ID NO: 36896
  Payload ID: 7316
  Gene Symbol: GNL1
  Gene Name: guanine nucleotide binding protein-like 1
  Uniprot ID: P36915
  ENSP ID: ENSP00000394290

SEQ ID NO: 36901 - protein, 66 aa, Homo sapiens
  Payload ID: 7316
  Gene Symbol: GNL1
  Gene Name: guanine nucleotide binding protein-like 1
  ENSP ID: ENSP00000396129
VVNFPPALYEYVTGELGLALVLVLNKVDLAPPALVVAWKHYFHQHYPQLHVVLFTSFPRDPRTPQD

SEQ ID NO: 36902 - protein, 264 aa, Homo sapiens; identical to SEQ ID NO: 36899
  Payload ID: 7316
  Gene Symbol: GNL1
  Gene Name: guanine nucleotide binding protein-like 1
  ENSP ID: ENSP00000400869

SEQ ID NO: 36903 - protein, 264 aa, Homo sapiens; identical to SEQ ID NO: 36899
  Payload ID: 7316
  Gene Symbol: GNL1
  Gene Name: guanine nucleotide binding protein-like 1
  ENSP ID: ENSP00000400970

SEQ ID NO: 36904 - protein, 264 aa, Homo sapiens; identical to SEQ ID NO: 36899
  Payload ID: 7316
  Gene Symbol: GNL1
  Gene Name: guanine nucleotide binding protein-like 1
  ENSP ID: ENSP00000402631

SEQ ID NO: 36905 - protein, 607 aa, Homo sapiens; identical to SEQ ID NO: 36896
  Payload ID: 7316
  Gene Symbol: GNL1
  Gene Name: guanine nucleotide binding protein-like 1
  Uniprot ID: P36915
  ENSP ID: ENSP00000403576

SEQ ID NO: 36906 - protein, 264 aa, Homo sapiens; identical to SEQ ID NO: 36899
  Payload ID: 7316
  Gene Symbol: GNL1
  Gene Name: guanine nucleotide binding protein-like 1
  ENSP ID: ENSP00000404728

SEQ ID NO: 36907 - protein, 264 aa, Homo sapiens; identical to SEQ ID NO: 36899
  Payload ID: 7316
  Gene Symbol: GNL1
  Gene Name: guanine nucleotide binding protein-like 1
  ENSP ID: ENSP00000407819

SEQ ID NO: 36908 - protein, 607 aa, Homo sapiens; identical to SEQ ID NO: 36896
  Payload ID: 7316
  Gene Symbol: GNL1
  Gene Name: guanine nucleotide binding protein-like 1
  Uniprot ID: P36915
  ENSP ID: ENSP00000409074

SEQ ID NO: 36909 - protein, 607 aa, Homo sapiens; identical to SEQ ID NO: 36896
  Payload ID: 7316
  Gene Symbol: GNL1
  Gene Name: guanine nucleotide binding protein-like 1
  Uniprot ID: P36915
  ENSP ID: ENSP00000409367

SEQ ID NO: 36910 - protein, 264 aa, Homo sapiens; identical to SEQ ID NO: 36899
  Payload ID: 7316
  Gene Symbol: GNL1
  Gene Name: guanine nucleotide binding protein-like 1
  ENSP ID: ENSP00000409984

SEQ ID NO: 36911 - protein, 607 aa, Homo sapiens; identical to SEQ ID NO: 36896
  Payload ID: 7316
  Gene Symbol: GNL1
  Gene Name: guanine nucleotide binding protein-like 1
  Uniprot ID: P36915
  ENSP ID: ENSP00000411162

SEQ ID NO: 36912 - protein, 731 aa, Homo sapiens
  Payload ID: 7317
  Gene Symbol: GNL2
  Gene Name: guanine nucleotide binding protein-like 2 (nucleolar)
  Uniprot ID: Q13823
  ENSP ID: ENSP00000362153
MVKPKYKGRSTINPSKASTNPDRVQGAGGQNMRDRATIRRLNMYRQKERRNSRGKIIKPLQYQSTVASGTVARVEPNIKWFGNTRVIKQSSLQKFQEEMDTVMKDPYKVVMKQSKLPMSLLHDRIRPHNLKVHILDTESFETTFGPKSQRKRPNLFASDMQSLIENAEMSTESYDQGKDRDLVTEDTGVRNEAQEEIYKKGQSKRIWGELYKVIDSSDVVVQVLDARDPMGTRSPHIETYLKKEKPWKHLIFVLNKCDLVPTWATKRWVAVLSQDYPTLAFHASLTNPFGKGAFIQLLRQFGKLHTDKKQISVGFIGYPNVGKSSVINTLRSKKVCNVAPIAGETKVWQYITLMRRIFLIDCPGVVYPSEDSETDIVLKGVVQVEKIKSPEDHIGAVLERAKPEYISKTYKIDSWENAEDFLEKLAFRTGKLLKGGEPDLQTVGKMVLNDWQRGRIPFFVKPPNAEPLVAPQLLPSSSLEVVPEAAQNNPGEEVTETAGEGSESIIKEETEENSHCDANTEMQQILTRVRQNFGKINVVPQFSGDDLVPVEVSDLEEELESFSDEEEEEQEQQRDDAEESSSEPEEENVGNDTKAVIKALDEKIAKYQKFLDKAKAKKFSAVRISKGLSEKIFAKPEEQRKTLEEDVDDRAPSKKGKKRKAQREEEQEHSNKAPRALTSKERRRAVRQQRPKKVGVRYYETHNVKNRNRNKKKTNDSEGQKHKRKKFRQKQ

SEQ ID NO: 36913 - protein, 233 aa, Homo sapiens
  Payload ID: 7317
  Gene Symbol: GNL2
  Gene Name: guanine nucleotide binding protein-like 2 (nucleolar)
  ENSP ID: ENSP00000441288
  MOD_RES (1)..(1): Any amino acid
XDVVVQVLDARDPMGTRSPHIETYLKKEKPWKHLIFVLNKCDLVPTWATKRWVAVLSQDYPTLAFHASLTNPFGKGAFIQLLRQFGKPWHLTFHALLGFPGLLCILCPWSPCSFYVLWLERALPKFKLQIPGQTSAPEGSRGTRLPYQILKASCSLHTDKKQISVGFIGYPNVGKSSVINTLRSKKVCNVAPIAGETKVWQYITLMRRIFLIDCPGVVYPSEDSETDIVLKGV

SEQ ID NO: 36914 - protein, 537 aa, Homo sapiens
  Payload ID: 7318
  Gene Symbol: GNL3
  Gene Name: guanine nucleotide binding protein-like 3 (nucleolar)
  Uniprot ID: Q9BVP2
  ENSP ID: ENSP00000378278
MTCHKRYKIQKKVREHHRKLRKEAKKRGHKKPRKDPGVPNSAPFKEALLREAELRKQRLEELKQQQKLDRQKELEKKRKLETNPDIKPSNVEPMEKEFGLCKTENKAKSGKQNSKKLYCQELKKVIEASDVVLEVLDARDPLGCRCPQVEEAIVQSGQKKLVLILNKSDLVPKENLESWLNYLKKELPTVVFRASTKPKDKGKITKRVKAKKNAAPFRSEVCFGKEGLWKLLGGFQETCSKAIRVGVIGFPNVGKSSIINSLKQEQMCNVGVSMGLTRSMQVVPLDKQITIIDSPSFIVSPLNSSSALALRSPASIEVVKPMEAASAILSQADARQVVLKYTVPGYRNSLEFFTVLAQRRGMHQKGGIPNVEGAAKLLWSEWTGASLAYYCHPPTSWTPPPYFNESIVVDMKSGFNLEELEKNNAQSIRAIKGPHLANSILFQSSGLTNGIIEEKDIHEELPKRKERKQEEREDDKDSDQETVDEEVDENSSGMFAAEETGEALSEETTAGEQSTRSFILDKIIEEDDAYDFSTDYV

SEQ ID NO: 36915 - protein, 549 aa, Homo sapiens
  Payload ID: 7318
  Gene Symbol: GNL3
  Gene Name: guanine nucleotide binding protein-like 3 (nucleolar)
  Uniprot ID: Q9BVP2
  ENSP ID: ENSP00000395772
MKRPKLKKASKRMTCHKRYKIQKKVREHHRKLRKEAKKRGHKKPRKDPGVPNSAPFKEALLREAELRKQRLEELKQQQKLDRQKELEKKRKLETNPDIKPSNVEPMEKEFGLCKTENKAKSGKQNSKKLYCQELKKVIEASDVVLEVLDARDPLGCRCPQVEEAIVQSGQKKLVLILNKSDLVPKENLESWLNYLKKELPTVVFRASTKPKDKGKITKRVKAKKNAAPFRSEVCFGKEGLWKLLGGFQETCSKAIRVGVIGFPNVGKSSIINSLKQEQMCNVGVSMGLTRSMQVVPLDKQITIIDSPSFIVSPLNSSSALALRSPASIEVVKPMEAASAILSQADARQVVLKYTVPGYRNSLEFFTVLAQRRGMHQKGGIPNVEGAAKLLWSEWTGASLAYYCHPPTSWTPPPYFNESIVVDMKSGFNLEELEKNNAQSIRAIKGPHLANSILFQSSGLTNGIIEEKDIHEELPKRKERKQEEREDDKDSDQETVDEEVDENSSGMFAAEETGEALSEETTAGEQSTRSFILDKIIEEDDAYDFSTDYV

SEQ ID NO: 36916 - protein, 134 aa, Homo sapiens
  Payload ID: 7318
  Gene Symbol: GNL3
  Gene Name: guanine nucleotide binding protein-like 3 (nucleolar)
  ENSP ID: ENSP00000419734
MTCHKRYKIQKKVREHHRKLRKEAKKRGHKKPRKDPGVPNSAPFKEALLREAELRKQRLEELKQQQKLDRQKELEKKRKLETNPDIKPSNVEPMEKEFGLCKTENKAKSGKQNSKKLYCQELKKVIEASDVVLE

SEQ ID NO: 36917 - protein, 96 aa, Homo sapiens
  Payload ID: 7318
  Gene Symbol: GNL3
  Gene Name: guanine nucleotide binding protein-like 3 (nucleolar)
  ENSP ID: ENSP00000419895
MTCHKRYKIQKKVREHHRKLRKEAKKRGHKKPRKDPGVPNSAPFKEALLREAELRKQRLEELKQQQKLDRQKELEKKRKLETNPDIKPSNVEPMEK

SEQ ID NO: 36918 - protein, 138 aa, Homo sapiens
  Payload ID: 7318
  Gene Symbol: GNL3
  Gene Name: guanine nucleotide binding protein-like 3 (nucleolar)
  ENSP ID: ENSP00000420345
MKRPKLKKASKRMTCHKRYKIQKKVREHHRKLRKEAKKRGHKKPRKDPGVPNSAPFKEALLREAELRKQRLEELKQQQKLDRQKELEKKRKLETNPDIKPSNVEPMEKEFGLCKTENKAKSGKQNSKKLYCQELKKVS

SEQ ID NO: 36919 - protein, 582 aa, Homo sapiens
  Payload ID: 7319
  Gene Symbol: GNL3L
  Gene Name: guanine nucleotide binding protein-like 3 (nucleolar)-like
  Uniprot ID: Q9NVN8
  ENSP ID: ENSP00000338573
MMKLRHKNKKPGEGSKGHKKISWPYPQPAKQNGKKATSKVPSAPHFVHPNDHANREAELKKKWVEEMREKQQAAREQERQKRRTIESYCQDVLRRQEEFEHKEEVLQELNMFPQLDDEATRKAYYKEFRKVVEYSDVILEVLDARDPLGCRCFQMEEAVLRAQGNKKLVLVLNKIDLVPKEVVEKWLDYLRNELPTVAFKASTQHQVKNLNRCSVPVDQASESLLKSKACFGAENLMRVLGNYCRLGEVRTHIRVGVVGLPNVGKSSLINSLKRSRACSVGAVPGITKFMQEVYLDKFIRLLDAPGIVPGPNSEVGTILRNCVHVQKLADPVTPVETILQRCNLEEISNYYGVSGFQTTEHFLTAVAHRLGKKKKGGLYSQEQAAKAVLADWVSGKISFYIPPPATHTLPTHLSAEIVKEMTEVFDIEDTEQANEDTMECLATGESDELLGDTDPLEMEIKLLHSPMTKIADAIENKTTVYKIGDLTGYCTNPNRHQMGWAKRNVDHRPKSNSMVDVCSVDRRSVLQRIMETDPLQQGQALASALKNKKKMQKRADKIASKLSDSMMSALDLSGNADDGVGD

SEQ ID NO: 36920 - protein, 582 aa, Homo sapiens; identical to SEQ ID NO: 36919
  Payload ID: 7319
  Gene Symbol: GNL3L
  Gene Name: guanine nucleotide binding protein-like 3 (nucleolar)-like
  Uniprot ID: Q9NVN8
  ENSP ID: ENSP00000354091

SEQ ID NO: 36921 - protein, 345 aa, Homo sapiens
  Payload ID: 7320
  Gene Symbol: GMPR
  Gene Name: guanosine monophosphate reductase
  Uniprot ID: P36959
  ENSP ID: ENSP00000259727
MPRIDADLKLDFKDVLLRPKRSSLKSRAEVDLERTFTFRNSKQTYSGIPIIVANMDTVGTFEMAAVMSQHSMFTAIHKHYSLDDWKLFATNHPECLQNVAVSSGSGQNDLEKMTSILEAVPQVKFICLDVANGYSEHFVEFVKLVRAKFPEHTIMAGNVVTGEMVEELILSGADIIKVGVGPGSVCTTRTKTGVGYPQLSAVIECADSAHGLKGHIISDGGCTCPGDVAKAFGAGADFVMLGGMFSGHTECAGEVFERNGRKLKLFYGMSSDTAMNKHAGGVAEYRASEGKTVEVPYKGDVENTILDILGGLRSTCTYVGAAKLKELSRRATFIRVTQQHNTVFS

SEQ ID NO: 36922 - protein, 349 aa, Homo sapiens
  Payload ID: 7321
  Gene Symbol: GMPR2
  Gene Name: guanosine monophosphate reductase 2
  ENSP ID: ENSP00000334409
MPHIDNDVKLDFKDVLLRPKRSTLKSRSEVDLTRSFSFRNSKQTYSGVPIIAANMDTVGTFEMAKVLCKFSLFTAVHKHYSLVQWQEFAGQNPELCFSHSIWLPAQAQALLTLSSWNRSWKLFPRSICLDVANGYSEHFVEFVKDVRKRFPQHTIMAGNVVTGEMVEELILSGADIIKVGIGPGSVCTTRKKTGVGYPQLSAVMECADAAHGLKGHIISDGGCSCPGDVAKAFGAGADFVMLGGMLAGHSESGGELIERDGKKYKLFYGMSSEMAMKKYAGGVAEYRASEGKTVEVPFKGDVEHTIRDILGGIRSTCTYVGAAKLKELSRRTTFIRVTQQVNPIFSEAC

SEQ ID NO: 36923 - protein, 348 aa, Homo sapiens
  Payload ID: 7321
  Gene Symbol: GMPR2
  Gene Name: guanosine monophosphate reductase 2
  Uniprot ID: Q9P2T1
  ENSP ID: ENSP00000347449
MPHIDNDVKLDFKDVLLRPKRSTLKSRSEVDLTRSFSFRNSKQTYSGVPIIAANMDTVGTFEMAKVLCKFSLFTAVHKHYSLVQWQEFAGQNPDCLEHLAASSGTGSSDFEQLEQILEAIPQVKYICLDVANGYSEHFVEFVKDVRKRFPQHTIMAGNVVTGEMVEELILSGADIIKVGIGPGSVCTTRKKTGVGYPQLSAVMECADAAHGLKGHIISDGGCSCPGDVAKAFGAGADFVMLGGMLAGHSESGGELIERDGKKYKLFYGMSSEMAMKKYAGGVAEYRASEGKTVEVPFKGDVEHTIRDILGGIRSTCTYVGAAKLKELSRRTTFIRVTQQVNPIFSEAC

SEQ ID NO: 36924 - protein, 348 aa, Homo sapiens; identical to SEQ ID NO: 36923
  Payload ID: 7321
  Gene Symbol: GMPR2
  Gene Name: guanosine monophosphate reductase 2
  Uniprot ID: Q9P2T1
  ENSP ID: ENSP00000382369

SEQ ID NO: 36925 - protein, 366 aa, Homo sapiens
  Payload ID: 7321
  Gene Symbol: GMPR2
  Gene Name: guanosine monophosphate reductase 2
  Uniprot ID: Q9P2T1
  ENSP ID: ENSP00000392859
MTSCLPALRFIATPRLSAMPHIDNDVKLDFKDVLLRPKRSTLKSRSEVDLTRSFSFRNSKQTYSGVPIIAANMDTVGTFEMAKVLCKFSLFTAVHKHYSLVQWQEFAGQNPDCLEHLAASSGTGSSDFEQLEQILEAIPQVKYICLDVANGYSEHFVEFVKDVRKRFPQHTIMAGNVVTGEMVEELILSGADIIKVGIGPGSVCTTRKKTGVGYPQLSAVMECADAAHGLKGHIISDGGCSCPGDVAKAFGAGADFVMLGGMLAGHSESGGELIERDGKKYKLFYGMSSEMAMKKYAGGVAEYRASEGKTVEVPFKGDVEHTIRDILGGIRSTCTYVGAAKLKELSRRTTFIRVTQQVNPIFSEAC

SEQ ID NO: 36926 - protein, 320 aa, Homo sapiens
  Payload ID: 7321
  Gene Symbol: GMPR2
  Gene Name: guanosine monophosphate reductase 2
  Uniprot ID: Q9P2T1
  ENSP ID: ENSP00000405743
MPHIDNDVKLDFKDVLLRPKRSTLKSRSEVDLTRSFSFRNSKQTYSGVPIIAANMDTVGTFEMAKVLCKHLAASSGTGSSDFEQLEQILEAIPQVKYICLDVANGYSEHFVEFVKDVRKRFPQHTIMAGNVVTGEMVEELILSGADIIKVGIGPGSVCTTRKKTGVGYPQLSAVMECADAAHGLKGHIISDGGCSCPGDVAKAFGAGADFVMLGGMLAGHSESGGELIERDGKKYKLFYGMSSEMAMKKYAGGVAEYRASEGKTVEVPFKGDVEHTIRDILGGIRSTCTYVGAAKLKELSRRTTFIRVTQQVNPIFSEAC

SEQ ID NO: 36927 - protein, 88 aa, Homo sapiens
  Payload ID: 7321
  Gene Symbol: GMPR2
  Gene Name: guanosine monophosphate reductase 2
  ENSP ID: ENSP00000452617
  MOD_RES (1)..(1): Any amino acid
XKYKLFYGMSSEMAMKKYAGGVAEYRASEGKTVEVPFKGDVEHTIRDILGGIRSTCTYVGAAKLKELSRRTTFIRVTQQVNPIFSEAC

SEQ ID NO: 36928 - protein, 70 aa, Homo sapiens
  Payload ID: 7321
  Gene Symbol: GMPR2
  Gene Name: guanosine monophosphate reductase 2
  ENSP ID: ENSP00000452670
MPHIDNDVKLDFKDVLLRPKRSTLKSRSEVDLTRSFSFRNSKQTYSGVPIIAANMDTVGTFEMAKVLCKS

SEQ ID NO: 36929 - protein, 139 aa, Homo sapiens
  Payload ID: 7321
  Gene Symbol: GMPR2
  Gene Name: guanosine monophosphate reductase 2
  ENSP ID: ENSP00000452683
  MOD_RES (1)..(1): Any amino acid
XAGADFVMLGGMLAGHSESGGELIERDGKKYKLFYGMSSEMAMKKYAGGVAEYRASEGKTVEVPFKGDVEHTIRDILGGIRSTCTYVGAAKLKELSRRTTFIRVTQQGSCSNSVLLYLHTQNAQGTHWGGSKEANSLRK

SEQ ID NO: 36930 - protein, 64 aa, Homo sapiens
  Payload ID: 7321
  Gene Symbol: GMPR2
  Gene Name: guanosine monophosphate reductase 2
  ENSP ID: ENSP00000452766
  MOD_RES (1)..(1): Any amino acid
XGVGYPQLSAVMECADAAHGLKGHIISDGGCSCPGDVAKAFEPQRERQWKFLLKEMWNIPSETS

SEQ ID NO: 36931 - protein, 88 aa, Homo sapiens
  Payload ID: 7321
  Gene Symbol: GMPR2
  Gene Name: guanosine monophosphate reductase 2
  ENSP ID: ENSP00000452840
MTSCLPALRFIATPRLSAMPHIDNDVKLDFKDVLLRPKRSTLKSRSEVDLTRSFSFRNSKQTYSGVPIIAANMDTVGTFEMAKVLCKS

SEQ ID NO: 36932 - protein, 57 aa, Homo sapiens
  Payload ID: 7321
  Gene Symbol: GMPR2
  Gene Name: guanosine monophosphate reductase 2
  ENSP ID: ENSP00000453079
MDTVGTFEMAKVLCKFSLFTAVHKHYSLVQWQEFAGQNPDCLEHLAASSGTGSSDFE

SEQ ID NO: 36933 - protein, 169 aa, Homo sapiens
  Payload ID: 7321
  Gene Symbol: GMPR2
  Gene Name: guanosine monophosphate reductase 2
  ENSP ID: ENSP00000453139
FVKDVRKRFPQHTIMAGNVVTGEMVEELILSGADIIKVGIGPGSVCTTRKKTGVGYPQLSAVMECADAAHGLKGHIISDGGCSCPGDVAKAFGAGADFVMLGGMLAGHSESGGELIERDGKKYKLFYGMSSEMAMKKYAGGVAEYRRCGTYHPRHPRRDPLYVYLCGSS

SEQ ID NO: 36934 - protein, 348 aa, Homo sapiens; identical to SEQ ID NO: 36923
  Payload ID: 7321
  Gene Symbol: GMPR2
  Gene Name: guanosine monophosphate reductase 2
  Uniprot ID: Q9P2T1
  ENSP ID: ENSP00000453299

SEQ ID NO: 36935 - protein, 333 aa, Homo sapiens
  Payload ID: 7321
  Gene Symbol: GMPR2
  Gene Name: guanosine monophosphate reductase 2
  ENSP ID: ENSP00000453355
MTSCLPALRFIATPRLSAMPHIDNDVKLDFKDVLLRPKRSTLKSRSEVDLTRSFSFRNSKQTYSGVPIIAANMDTVGTFEMAKVLCKFSLFTAVHKHYSLVQWQEFAGQNPDCLEHLAASSGTGSSDFEQLEQILEAIPQAGNVVTGEMVEELILSGADIIKVGIGPGSVCTTRKKTGVGYPQLSAVMECADAAHGLKGHIISDGGCSCPGDVAKAFGAGADFVMLGGMLAGHSESGGELIERDGKKYKLFYGMSSEMAMKKYAGGVAEYRASEGKTVEVPFKGDVEHTIRDILGGIRSTCTYVGAAKLKELSRRTTFIRVTQQVNPIFSEAC

SEQ ID NO: 36936 - protein, 315 aa, Homo sapiens
  Payload ID: 7321
  Gene Symbol: GMPR2
  Gene Name: guanosine monophosphate reductase 2
  ENSP ID: ENSP00000453537
MPHIDNDVKLDFKDVLLRPKRSTLKSRSEVDLTRSFSFRNSKQTYSGVPIIAANMDTVGTFEMAKVLCKFSLFTAVHKHYSLVQWQEFAGQNPDCLEHLAASSGTGSSDFEQLEQILEAIPQAGNVVTGEMVEELILSGADIIKVGIGPGSVCTTRKKTGVGYPQLSAVMECADAAHGLKGHIISDGGCSCPGDVAKAFGAGADFVMLGGMLAGHSESGGELIERDGKKYKLFYGMSSEMAMKKYAGGVAEYRASEGKTVEVPFKGDVEHTIRDILGGIRSTCTYVGAAKLKELSRRTTFIRVTQQVNPIFSEAC

SEQ ID NO: 36937 - protein, 70 aa, Homo sapiens; identical to SEQ ID NO: 36928
  Payload ID: 7321
  Gene Symbol: GMPR2
  Gene Name: guanosine monophosphate reductase 2
  ENSP ID: ENSP00000453560

SEQ ID NO: 36938 - protein, 75 aa, Homo sapiens
  Payload ID: 7321
  Gene Symbol: GMPR2
  Gene Name: guanosine monophosphate reductase 2
  ENSP ID: ENSP00000453594
MPHIDNDVKLDFKDVLLRPKRSTLKSRSEVDLTRSFSFRNSKQTYSGVPIIAANMDTVGTFEMAKVLFLSLHCCP

SEQ ID NO: 36939 - protein, 131 aa, Homo sapiens
  Payload ID: 7321
  Gene Symbol: GMPR2
  Gene Name: guanosine monophosphate reductase 2
  ENSP ID: ENSP00000453714
MPHIDNDVKLDFKDVLLRPKRSTLKSRSEVDLTRSFSFRNSKQTYSGVPIIAANMDTVGTFEMAKVLCKFSLFTAVHKHYSLVQWQEFAGQNPDCLEHLAASSGTGSSDFEQLEQILEAIPQAGNVVTGEM

SEQ ID NO: 36940 - protein, 151 aa, Homo sapiens
  Payload ID: 7321
  Gene Symbol: GMPR2
  Gene Name: guanosine monophosphate reductase 2
  ENSP ID: ENSP00000453761
MPHIDNDVKLDFKDVLLRPKRSTLKSRSEVDLTRSFSFRNSKQTYSGVPIIAANMDTVGTFEMAKFSLFTAVHKHYSLVQWQEFAGQNPDCLEHLAASSGTGSSDFEQLEQILEAIPQVKYICLDVANGYSEHFVEFVKDVRKRFPQHTIM

SEQ ID NO: 36941 - protein, 93 aa, Homo sapiens
  Payload ID: 7321
  Gene Symbol: GMPR2
  Gene Name: guanosine monophosphate reductase 2
  ENSP ID: ENSP00000453772
  MOD_RES (1)..(1): Any amino acid
XASEGKTVEVPFKGDVEHTIRDILGGIRSTCTYVGAAKLKELSRRTTFIRVTQQVNPIFSEGSCSNSVLLYLHTQNAQGTHWGGSKEANSLRK

SEQ ID NO: 36942 - protein, 69 aa, Homo sapiens
  Payload ID: 7321
  Gene Symbol: GMPR2
  Gene Name: guanosine monophosphate reductase 2
  ENSP ID: ENSP00000453833
  MOD_RES (1)..(1): Any amino acid
XMLGAWLSTEGKTVEVPFKGDVEHTIRDILGGIRSTCTYVGAAKLKELSRRTTFIRVTQQVNPIFSEAC

SEQ ID NO: 36943 - protein, 93 aa, Homo sapiens
  Payload ID: 7321
  Gene Symbol: GMPR2
  Gene Name: guanosine monophosphate reductase 2
  ENSP ID: ENSP00000453895
MTSCLPALRFIATPRLSAMPHIDNDVKLDFKDVLLRPKRSTLKSRSEVDLTRSFSFRNSKQTYSGVPIIAANMDTVGTFEMAKVLFLSLHCCP

SEQ ID NO: 36944 - protein, 239 aa, Homo sapiens
  Payload ID: 7321
  Gene Symbol: GMPR2
  Gene Name: guanosine monophosphate reductase 2
  ENSP ID: ENSP00000454009
MPHIDNDVKLDFKDVLLRPKRSTLKSRSEVDLTRSFSFRNSKQTYSGVPIIAANMDTVGTFEMAKVLCKVPGSFWDVPQMGCVFLIYKLFTLKWKMLLLSVLLPASILVAEKFSLFTAVHKHYSLVQWQEFAGQNPDCLEHLAASSGTGSSDFEQLEQILEAIPQVKYICLDVANGYSEHFVEFVKDVRKRFPQHTIMAGNVVTGEMVEELILSGADIIKVGIGPGSVCTTRKKTGVGY

SEQ ID NO: 36945 - protein, 427 aa, Homo sapiens
  Payload ID: 7321
  Gene Symbol: GMPR2
  Gene Name: guanosine monophosphate reductase 2
  ENSP ID: ENSP00000454038
MTSCLPALRFIATPRLSAMPHIDNDVKLDFKDVLLRPKRSTLKSRSEVDLTRSFSFRNSKQTYSGVPIIAANMDTVGTFEMAKVLCKFSLFTAVHKHYSLVQWQEFAGQNPDCLEHLAASSGTGSSDFEQLEQILEAIPQVKYICLDVANGYSEHFVEFVKDVRKRFPQHTIMAGNVVTGEMVEELILSGADIIKVGIGPGSVCTTRKKTGVGYPQLSAVMECADAAHGLKGHIISDGGCSCPGDVAKAFGAGADFVMLGGMLAGHSESGGELIERDGKKYKLFYGMSSEMAMKKYAGGVAEYRYVWRPRSLVIVWRQNSWLLRGGWYSSQRSMVNRGSMLGSVEKSLGLRNPEGEDNKVFPTLRASEGKTVEVPFKGDVEHTIRDILGGIRSTCTYVGAAKLKELSRRTTFIRVTQQVNPIFSEAC

SEQ ID NO: 36946 - protein, 125 aa, Homo sapiens
  Payload ID: 7321
  Gene Symbol: GMPR2
  Gene Name: guanosine monophosphate reductase 2
  ENSP ID: ENSP00000454138
MAGNVVTGEMVEELILSGADIIKVGIGPGSVCTTRKKTGVGYPQLSAVMECADAAHGLKGHIISDGGCSCPGDVAKAFGAGADFVMLGGMLAGHSESGGELIERDGKKYKLFYGMSSEMAMKKYA

SEQ ID NO: 36947 - protein, 348 aa, Homo sapiens
  Payload ID: 7321
  Gene Symbol: GMPR2
  Gene Name: guanosine monophosphate reductase 2
  ENSP ID: ENSP00000480342
MPHIDNDVKLDFKDVLLRPKRSTLKSRSEVDLTRSFSFRNSKQTYSGVPIIAANMDTVGTFEMAKVLCKFSLFTAVHKHYSLVQWQEFAGQNPDCLESIWLPAQAQALLTLSSWNRSWKLFPRKYICLDVANGYSEHFVEFVKDVRKRFPQHTIMAGNVVTGEMVEELILSGADIIKVGIGPGSVCTTRKKTGVGYPQLSAVMECADAAHGLKGHIISDGGCSCPGDVAKAFGAGADFVMLGGMLAGHSESGGELIERDGKKYKLFYGMSSEMAMKKYAGGVAEYRASEGKTVEVPFKGDVEHTIRDILGGIRSTCTYVGAAKLKELSRRTTFIRVTQQVNPIFSEAC

SEQ ID NO: 36948 - protein, 592 aa, Homo sapiens
  Payload ID: 7322
  Gene Symbol: GBP1
  Gene Name: guanylate binding protein 1, interferon-inducible
  Uniprot ID: P32455
  ENSP ID: ENSP00000359504
MASEIHMTGPMCLIENTNGRLMANPEALKILSAITQPMVVVAIVGLYRTGKSYLMNKLAGKKKGFSLGSTVQSHTKGIWMWCVPHPKKPGHILVLLDTEGLGDVEKGDNQNDSWIFALAVLLSSTFVYNSIGTINQQAMDQLYYVTELTHRIRSKSSPDENENEVEDSADFVSFFPDFVWTLRDFSLDLEADGQPLTPDEYLTYSLKLKKGTSQKDETFNLPRLCIRKFFPKKKCFVFDRPVHRRKLAQLEKLQDEELDPEFVQQVADFCSYIFSNSKTKTLSGGIQVNGPRLESLVLTYVNAISSGDLPCMENAVLALAQIENSAAVQKAIAHYEQQMGQKVQLPTETLQELLDLHRDSEREAIEVFIRSSFKDVDHLFQKELAAQLEKKRDDFCKQNQEASSDRCSALLQVIFSPLEEEVKAGIYSKPGGYRLFVQKLQDLKKKYYEEPRKGIQAEEILQTYLKSKESMTDAILQTDQTLTEKEKEIEVERVKAESAQASAKMLQEMQRKNEQMMEQKERSYQEHLKQLTEKMENDRVQLLKEQERTLALKLQEQEQLLKEGFQKESRIMKNEIQDLQTKMRRRKACTIS

SEQ ID NO: 36949 - protein, 591 aa, Homo sapiens
  Payload ID: 7323
  Gene Symbol: GBP2
  Gene Name: guanylate binding protein 2, interferon-inducible
  Uniprot ID: P32456
  ENSP ID: ENSP00000359497
MAPEINLPGPMSLIDNTKGQLVVNPEALKILSAITQPVVVVAIVGLYRTGKSYLMNKLAGKKNGFSLGSTVKSHTKGIWMWCVPHPKKPEHTLVLLDTEGLGDIEKGDNENDSWIFALAILLSSTFVYNSMGTINQQAMDQLHYVTELTDRIKANSSPGNNSVDDSADFVSFFPAFVWTLRDFTLELEVDGEPITADDYLELSLKLRKGTDKKSKSFNDPRLCIRKFFPKRKCFVFDWPAPKKYLAHLEQLKEEELNPDFIEQVAEFCSYILSHSNVKTLSGGIPVNGPRLESLVLTYVNAISSGDLPCMENAVLALAQIENSAAVEKAIAHYEQQMGQKVQLPTETLQELLDLHRDSEREAIEVFMKNSFKDVDQMFQRKLGAQLEARRDDFCKQNSKASSDCCMALLQDIFGPLEEDVKQGTFSKPGGYRLFTQKLQELKNKYYQVPRKGIQAKEVLKKYLESKEDVADALLQTDQSLSEKEKAIEVERIKAESAEAAKKMLEEIQKKNEEMMEQKEKSYQEHVKQLTEKMERDRAQLMAEQEKTLALKLQEQERLLKEGFENESKRLQKDIWDIQMRSKSLEPICNIL

SEQ ID NO: 36950 - protein, 591 aa, Homo sapiens; identical to SEQ ID NO: 36949
  Payload ID: 7323
  Gene Symbol: GBP2
  Gene Name: guanylate binding protein 2, interferon-inducible
  Uniprot ID: P32456
  ENSP ID: ENSP00000434282

SEQ ID NO: 36951 - protein, 142 aa, Homo sapiens
  Payload ID: 7324
  Gene Symbol: GBP3
  Gene Name: guanylate binding protein 3
  ENSP ID: ENSP00000235878
MAPEIHMTGPMCLIENTNGELVANPEALKILSAITQPVVVVAIVGLYRTGKSYLMNKLAGKNKGFSLGSTVKSHTKGIWMWCVPHPKKPEHTLVLLDTEGLGDVKKGDNQNDSWIFTLAVLLSSTLVYNSMGTINQQAMDQL

SEQ ID NO: 36952 - protein, 595 aa, Homo sapiens
  Payload ID: 7324
  Gene Symbol: GBP3
  Gene Name: guanylate binding protein 3
  Uniprot ID: Q9H0R5
  ENSP ID: ENSP00000359512
MAPEIHMTGPMCLIENTNGELVANPEALKILSAITQPVVVVAIVGLYRTGKSYLMNKLAGKNKGFSLGSTVKSHTKGIWMWCVPHPKKPEHTLVLLDTEGLGDVKKGDNQNDSWIFTLAVLLSSTLVYNSMGTINQQAMDQLYYVTELTHRIRSKSSPDENENEDSADFVSFFPDFVWTLRDFSLDLEADGQPLTPDEYLEYSLKLTQGTSQKDKNFNLPRLCIRKFFPKKKCFVFDLPIHRRKLAQLEKLQDEELDPEFVQQVADFCSYIFSNSKTKTLSGGIKVNGPRLESLVLTYINAISRGDLPCMENAVLALAQIENSAAVQKAIAHYDQQMGQKVQLPAETLQELLDLHRVSEREATEVYMKNSFKDVDHLFQKKLAAQLDKKRDDFCKQNQEASSDRCSALLQVIFSPLEEEVKAGIYSKPGGYCLFIQKLQDLEKKYYEEPRKGIQAEEILQTYLKSKESVTDAILQTDQILTEKEKEIEVECVKAESAQASAKMVEEMQIKYQQMMEEKEKSYQEHVKQLTEKMERERAQLLEEQEKTLTSKLQEQARVLKERCQGESTQLQNEIQKLQKTLKKKTKRYMSHKLKI

SEQ ID NO: 36953 - protein, 137 aa, Homo sapiens
  Payload ID: 7324
  Gene Symbol: GBP3
  Gene Name: guanylate binding protein 3
  ENSP ID: ENSP00000415087
QDEELDPEFVQQVADFCSYIFSNSKTKTLSGGIKAEEILQTYLKSKESVTDAILQTDQILTEKEKEIEVECVKAESAQASAKMVEEMQIKYQQMMEEKEKSYQEHVKQLTEKMERERAQLLEEQEKTLTSKLQVSKC

SEQ ID NO: 36954 - protein, 290 aa, Homo sapiens
  Payload ID: 7324
  Gene Symbol: GBP3
  Gene Name: guanylate binding protein 3
  ENSP ID: ENSP00000437168
MAPEIHMTGPMCLIENTNGELVANPEALKILSAITQPVVVVAIVGLYRTGKSYLMNKLAGKNKGFSLGSTVKSHTKGIWMWCVPHPKKPEHTLVLLDTEGLGDVKKGDNQNDSWIFTLAVLLSSTLVYNSMGTINQQAMDQLYYVTELTHRIRSKSSPDENENEDSADFVSFFPDFVWTLRDFSLDLEADGQPLTPDEYLEYSLKLTQGTSQKDKNFNLPRLCIRKFFPKKKCFVFDLPIHRRKLAQLEKLQDEELDPEFVQQVADFCSYIFSNSKTKTLSGGIKVNGPR

SEQ ID NO: 36955 - protein, 218 aa, Homo sapiens
  Payload ID: 7324
  Gene Symbol: GBP3
  Gene Name: guanylate binding protein 3
  ENSP ID: ENSP00000454978
  MOD_RES (1)..(1): Any amino acid
XHRVSEREATEVYMKNSFKDVDHLFQKKLAAQLDKKRDDFCKQNQEASSDRCSALLQVIFSPLEEEVKAGIYSKPGGYCLFIQKLQDLEKKYYEEPRKGIQAEEILQTYLKSKESVTDAILQTDQILTEKEKEIEVECVKAESAQASAKMVEEMQIKYQQMMEEKEKSYQEHVKQLTEKMERERAQLLEEQEKTLTSKLQVSKCITLWFVFLFSLCSS

SEQ ID NO: 36956 - protein, 96 aa, Homo sapiens
  Payload ID: 7324
  Gene Symbol: GBP3
  Gene Name: guanylate binding protein 3
  ENSP ID: ENSP00000455156
MAPEIHMTGPMCLIENTNGELVANPEALKILSAITQPVVVVAIVGLYRTGKSYLMNKLAGKNKGEWHEQSSAKSLLSPNTVSIHYEDVRRESWHWE

SEQ ID NO: 36957 - protein, 123 aa, Homo sapiens
  Payload ID: 7324
  Gene Symbol: GBP3
  Gene Name: guanylate binding protein 3
  ENSP ID: ENSP00000455317
MWCVPHPKKPEHTLVLLDTEGLGDVKKGDNQNDSWIFTLAVLLSSTLVYNSMGTINQQAMDQLYYVTELTHRIRSKSSPDENENEDSADFVSFFPDFVWTLRDFSLDLEADGQPLTPDEYLEY

SEQ ID NO: 36958 - protein, 91 aa, Homo sapiens
  Payload ID: 7324
  Gene Symbol: GBP3
  Gene Name: guanylate binding protein 3
  ENSP ID: ENSP00000456449
MAPEIHMTGPMCLIENTNGELVANPEALKILSAITQPVVVVAIVGLYRTGKSYLMNKLAGKNKGWSTVARSQLTTVLTSWAQAILSPQPPE

SEQ ID NO: 36959 - protein, 640 aa, Homo sapiens
  Payload ID: 7325
  Gene Symbol: GBP4
  Gene Name: guanylate binding protein 4
  Uniprot ID: Q96PP9
  ENSP ID: ENSP00000359490
MGERTLHAAVPTPGYPESESIMMAPICLVENQEEQLTVNSKALEILDKISQPVVVVAIVGLYRTGKSYLMNRLAGKRNGFPLGSTVQSETKGIWMWCVPHLSKPNHTLVLLDTEGLGDVEKSNPKNDSWIFALAVLLSSSFVYNSVSTINHQALEQLHYVTELAELIRAKSCPRPDEAEDSSEFASFFPDFIWTVRDFTLELKLDGNPITEDEYLENALKLIPGKNPKIQNSNMPRECIRHFFRKRKCFVFDRPTNDKQYLNHMDEVPEENLERHFLMQSDNFCSYIFTHAKTKTLREGIIVTGKRLGTLVVTYVDAINSGAVPCLENAVTALAQLENPAAVQRAADHYSQQMAQQLRLPTDTLQELLDVHAACEREAIAVFMEHSFKDENHEFQKKLVDTIEKKKGDFVLQNEEASAKYCQAELKRLSEHLTESILRGIFSVPGGHNLYLEEKKQVEWDYKLVPRKGVKANEVLQNFLQSQVVVEESILQSDKALTAGEKAIAAERAMKEAAEKEQELLREKQKEQQQMMEAQERSFQEYMAQMEKKLEEERENLLREHERLLKHKLKVQEEMLKEEFQKKSEQLNKEINQLKEKIESTKNEQLRLLKILDMASNIMIVTLPGASKLLGVGTKYLGSRI

SEQ ID NO: 36960 - protein, 586 aa, Homo sapiens
  Payload ID: 7326
  Gene Symbol: GBP5
  Gene Name: guanylate binding protein 5
  Uniprot ID: Q96PP8
  ENSP ID: ENSP00000359488
MALEIHMSDPMCLIENFNEQLKVNQEALEILSAITQPVVVVAIVGLYRTGKSYLMNKLAGKNKGFSVASTVQSHTKGIWIWCVPHPNWPNHTLVLLDTEGLGDVEKADNKNDIQIFALALLLSSTFVYNTVNKIDQGAIDLLHNVTELTDLLKARNSPDLDRVEDPADSASFFPDLVWTLRDFCLGLEIDGQLVTPDEYLENSLRPKQGSDQRVQNFNLPRLCIQKFFPKKKCFIFDLPAHQKKLAQLETLPDDELEPEFVQQVTEFCSYIFSHSMTKTLPGGIMVNGSRLKNLVLTYVNAISSGDLPCIENAVLALAQRENSAAVQKAIAHYDQQMGQKVQLPMETLQELLDLHRTSEREAIEVFMKNSFKDVDQSFQKELETLLDAKQNDICKRNLEASSDYCSALLKDIFGPLEEAVKQGIYSKPGGHNLFIQKTEELKAKYYREPRKGIQAEEVLQKYLKSKESVSHAILQTDQALTETEKKKKEAQVKAEAEKAEAQRLAAIQRQNEQMMQERERLHQEQVRQMEIAKQNWLAEQQKMQEQQMQEQAAQLSTTFQAQNRSLLSELQHAQRTVNNDDPCVLL

SEQ ID NO: 36961 - protein, 483 aa, Homo sapiens
  Payload ID: 7326
  Gene Symbol: GBP5
  Gene Name: guanylate binding protein 5
  ENSP ID: ENSP00000403010
MALEIHMSDPMCLIENFNEQLKVNQEALEILSAITQPVVVVAIVGLYRTGKSYLMNKLAGKNKGFSVASTVQSHTKGIWIWCVPHPNWPNHTLVLLDTEGLGDVEKADNKNDIQIFALALLLSSTFVYNTVNKIDQGAIDLLHNVTELTDLLKARNSPDLDRVEDPADSASFFPDLVWTLRDFCLGLEIDGQLVTPDEYLENSLRPKQGSDQRVQNFNLPRLCIQKFFPKKKCFIFDLPAHQKKLAQLETLPDDELEPEFVQQVTEFCSYIFSHSMTKTLPGGIMVNGSRLKNLVLTYVNAISSGDLPCIENAVLALAQRENSAAVQKAIAHYDQQMGQKVQLPMETLQELLDLHRTSEREAIEVFMKNSFKDVDQSFQKELETLLDAKQNDICKRNLEASSDYCSALLKDIFGPLEEAVKQGIYSKPGGHNLFIQKTEELKAKYYREPRKGIQAEEVLQKYLKSKESVSHAILQTDQALTET

SEQ ID NO: 36962 - protein, 638 aa, Homo sapiens
  Payload ID: 7327
  Gene Symbol: GBP7
  Gene Name: guanylate binding protein 7
  Uniprot ID: Q8N8V2
  ENSP ID: ENSP00000294671
MASEIHMPGPVCLTENTKGHLVVNSEALEILSAITQPVVVVAIVGLYRTGKSYLMNKLAGKNKGFPLGCTVKSETKGIWMWCVPHPSKPNHTLILLDTEGLGDMEKSDPKSDSWIFALAVLLSSSFVYNSMGTINHQALEQLHYVTELTELIRAKSCPRPDEVEDSSEFVSFFPDFIWTVRDFTLELKLDGHPITEDEYLENALKLISGKNPQIQNSNKPREWIRHFFPKQKCFVFDRPINDKKLLLHVEEVREDQLDSNFQMQSENFCSYIFTHAKTKTLREGILVTGNRLGMLVETYLDAINSGATPCLENAMAVLAQCENSAAVQRAANHYSQQMAQQVRFPTDTLQELLDVHAVCEREAIAVFMEYSFKDKSQEFQKKLVDTMEKKKEDFVLQNEEASAKYCQAELKRLSELLTESISRGTFFVPGGHNIYLEAKKKIEQDYTLVPRKGVKADEVLQSFLQSQVVIEESILQSDKALTAGEKAIAAKQAKKEAAEKEQELLRQKQKEQQQMMEAQERSFQENIAQLKKKMERERENYMRELRKMLSHKMKVLEELLTEGFKEIFESLNEEINRLKEQIEAAENEEPSVFSQILDVAGSIFIAALPGAAKLVDLGMKILSSLCNRLRNPGKKIIS

SEQ ID NO: 36963 - protein, 633 aa, Homo sapiens
  Payload ID: 7328
  Gene Symbol: GBP6
  Gene Name: guanylate binding protein family, member 6
  Uniprot ID: Q6ZN66
  ENSP ID: ENSP00000359485
MESGPKMLAPVCLVENNNEQLLVNQQAIQILEKISQPVVVVAIVGLYRTGKSYLMNHLAGQNHGFPLGSTVQSETKGIWMWCVPHPSKPNHTLVLLDTEGLGDVEKGDPKNDSWIFALAVLLCSTFVYNSMSTINHQALEQLHYVTELTELIKAKSSPRPDGVEDSTEFVSFFPDFLWTVRDFTLELKLNGHPITEDEYLENALKLIQGNNPRVQTSNFPRECIRRFFPKRKCFVFDRPTNDKDLLANIEKVSEKQLDPKFQEQTNIFCSYIFTHARTKTLREGITVTGNRLGTLAVTYVEAINSGAVPCLENAVITLAQRENSAAVQRAADYYSQQMAQRVKLPTDTLQELLDMHAACEREAIAIFMEHSFKDENQEFQKKFMETTMNKKGDFLLQNEESSVQYCQAKLNELSKGLMESISAGSFSVPGGHKLYMETKERIEQDYWQVPRKGVKAKEVFQRFLESQMVIEESILQSDKALTDREKAVAVDRAKKEAAEKEQELLKQKLQEQQQQMEAQDKSRKENIAQLKEKLQMEREHLLREQIMMLEHTQKVQNDWLHEGFKKKYEEMNAEISQFKRMIDTTKNDDTPWIARTLDNLADELTAILSAPAKLIGHGVKGVSSLFKKHKLPF

SEQ ID NO: 36964 - protein, 763 aa, Homo sapiens
  Payload ID: 7329
  Gene Symbol: GUCY1A2
  Gene Name: guanylate cyclase 1, soluble, alpha 2
  Uniprot ID: P33402
  ENSP ID: ENSP00000282249
MSRRKISSESFSSLGSDYLETSPEEEGECPLSRLCWNGSRSPPGPLEPSPAAAAAAAAPAPTPAASAAAAAATAGARRVQRRRRVNLDSLGESISRLTAPSPQTIQQTLKRTLQYYEHQVIGYRDAEKNFHNISNRCSYADHSNKEEIEDVSGILQCTANILGLKFEEIQKRFGEEFFNICFHENERVLRAVGGTLQDFFNGFDALLEHIRTSFGKQATLESPSFLCKELPEGTLMLHYFHPHHIVGFAMLGMIKAAGKKIYRLDVEVEQVANEKLCSDVSNPGNCSCLTFLIKECENTNIMKNLPQGTSQVPADLRISINTFCRAFPFHLMFDPSMSVLQLGEGLRKQLRCDTHKVLKFEDCFEIVSPKVNATFERVLLRLSTPFVIRTKPEASGSENKDKVMEVKGQMIHVPESNSILFLGSPCVDKLDELMGRGLHLSDIPIHDATRDVILVGEQAKAQDGLKKRMDKLKATLERTHQALEEEKKKTVDLLYSIFPGDVAQQLWQGQQVQARKFDDVTMLFSDIVGFTAICAQCTPMQVISMLNELYTRFDHQCGFLDIYKVETIGDAYCVAAGLHRKSLCHAKPIALMALKMMELSEEVLTPDGRPIQPQRSELLFSFPVSIQLVPDQHQSETDLGTEKMRIGIHSGSVLAGVVGVRMPRYCLFGNNVTLASKFESGSHPRRINVSPTTYQLLKREESFTFIPRSREELPDNFPKEIPGICYFLEVRTGPKPPKPSLSSSRIKKVSYNIGTMFLRETSL

SEQ ID NO: 36965 - protein, 753 aa, Homo sapiens
  Payload ID: 7329
  Gene Symbol: GUCY1A2
  Gene Name: guanylate cyclase 1, soluble, alpha 2
  Uniprot ID: P33402
  ENSP ID: ENSP00000344874
MSRRKISSESFSSLGSDYLETSPEEEGECPLSRLCWNGSRSPPGPLEPSPAAAAAAAAPAPTPAASAAAAAATAGARRVQRRRRVNLDSLGESISRLTAPSPQTIQQTLKRTLQYYEHQVIGYRDAEKNFHNISNRCSYADHSNKEEIEDVSGILQCTANILGLKFEEIQKRFGEEFFNICFHENERVLRAVGGTLQDFFNGFDALLEHIRTSFGKQATLESPSFLCKELPEGTLMLHYFHPHHIVGFAMLGMIKAAGKKIYRLDVEVEQVANEKLCSDVSNPGNCSCLTFLIKECENTNIMKNLPQGTSQVPADLRISINTFCRAFPFHLMFDPSMSVLQLGEGLRKQLRCDTHKVLKFEDCFEIVSPKVNATFERVLLRLSTPFVIRTKPEASGSENKDKSKHVTEGHLTQLSVAGFNSLEVMEVKGQMIHVPESNSILFLGSPCVDKLDELMGRGLHLSDIPIHDATRDVILVGEQAKAQDGLKKRMDKLKATLERTHQALEEEKKKTVDLLYSIFPGDVAQQLWQGQQVQARKFDDVTMLFSDIVGFTAICAQCTPMQVISMLNELYTRFDHQCGFLDIYKVETIGDAYCVAAGLHRKSLCHAKPIALMALKMMELSEEVLTPDGRPIQMRIGIHSGSVLAGVVGVRMPRYCLFGNNVTLASKFESGSHPRRINVSPTTYQLLKREESFTFIPRSREELPDNFPKEIPGICYFLEVRTGPKPPKPSLSSSRIKKVSYNIGTMFLRETSL

SEQ ID NO: 36966 - protein, 732 aa, Homo sapiens
  Payload ID: 7329
  Gene Symbol: GUCY1A2
  Gene Name: guanylate cyclase 1, soluble, alpha 2
  Uniprot ID: P33402
  ENSP ID: ENSP00000431245
MSRRKISSESFSSLGSDYLETSPEEEGECPLSRLCWNGSRSPPGPLEPSPAAAAAAAAPAPTPAASAAAAAATAGARRVQRRRRVNLDSLGESISRLTAPSPQTIQQTLKRTLQYYEHQVIGYRDAEKNFHNISNRCSYADHSNKEEIEDVSGILQCTANILGLKFEEIQKRFGEEFFNICFHENERVLRAVGGTLQDFFNGFDALLEHIRTSFGKQATLESPSFLCKELPEGTLMLHYFHPHHIVGFAMLGMIKAAGKKIYRLDVEVEQVANEKLCSDVSNPGNCSCLTFLIKECENTNIMKNLPQGTSQVPADLRISINTFCRAFPFHLMFDPSMSVLQLGEGLRKQLRCDTHKVLKFEDCFEIVSPKVNATFERVLLRLSTPFVIRTKPEASGSENKDKVMEVKGQMIHVPESNSILFLGSPCVDKLDELMGRGLHLSDIPIHDATRDVILVGEQAKAQDGLKKRMDKLKATLERTHQALEEEKKKTVDLLYSIFPGDVAQQLWQGQQVQARKFDDVTMLFSDIVGFTAICAQCTPMQVISMLNELYTRFDHQCGFLDIYKVETIGDAYCVAAGLHRKSLCHAKPIALMALKMMELSEEVLTPDGRPIQMRIGIHSGSVLAGVVGVRMPRYCLFGNNVTLASKFESGSHPRRINVSPTTYQLLKREESFTFIPRSREELPDNFPKEIPGICYFLEVRTGPKPPKPSLSSSRIKKVSYNIGTMFLRETSL

SEQ ID NO: 36967 - protein, 690 aa, Homo sapiens
  Payload ID: 7330
  Gene Symbol: GUCY1A3
  Gene Name: guanylate cyclase 1, soluble, alpha 3
  Uniprot ID: Q02108
  ENSP ID: ENSP00000296518
MFCTKLKDLKITGECPFSLLAPGQVPNESSEEAAGSSESCKATVPICQDIPEKNIQESLPQRKTSRSRVYLHTLAESICKLIFPEFERLNVALQRTLAKHKIKESRKSLEREDFEKTIAEQAVAAGVPVEVIKESLGEEVFKICYEEDENILGVVGGTLKDFLNSFSTLLKQSSHCQEAGKRGRLEDASILCLDKEDDFLHVYYFFPKRTTSLILPGIIKAAAHVLYETEVEVSLMPPCFHNDCSEFVNQPYLLYSVHMKSTKPSLSPSKPQSSLVIPTSLFCKTFPFHFMFDKDMTILQFGNGIRRLMNRRDFQGKPNFEEYFEILTPKINQTFSGIMTMLNMQFVVRVRRWDNSVKKSSRVMDLKGQMIYIVESSAILFLGSPCVDRLEDFTGRGLYLSDIPIHNALRDVVLIGEQARAQDGLKKRLGKLKATLEQAHQALEEEKKKTVDLLCSIFPCEVAQQLWQGQVVQAKKFSNVTMLFSDIVGFTAICSQCSPLQVITMLNALYTRFDQQCGELDVYKVETIGDAYCVAGGLHKESDTHAVQIALMALKMMELSDEVMSPHGEPIKMRIGLHSGSVFAGVVGVKMPRYCLFGNNVTLANKFESCSVPRKINVSPTTYRLLKDCPGFVFTPRSREELPPNFPSEIPGICHFLDAYQQGTNSKPCFQKKDVEDGNANFLGKASGID

SEQ ID NO: 36968 - protein, 432 aa, Homo sapiens
  Payload ID: 7330
  Gene Symbol: GUCY1A3
  Gene Name: guanylate cyclase 1, soluble, alpha 3
  ENSP ID: ENSP00000377418
MKSTKPSLSPSKPQSSLVIPTSLFCKTFPFHFMFDKDMTILQFGNGIRRLMNRRDFQGKPNFEEYFEILTPKINQTFSGIMTMLNMQFVVRVRRWDNSVKKSSRVMDLKGQMIYIVESSAILFLGSPCVDRLEDFTGRGLYLSDIPIHNALRDVVLIGEQARAQDGLKKRLGKLKATLEQAHQALEEEKKKTVDLLCSIFPCEVAQQLWQGQVVQAKKFSNVTMLFSDIVGFTAICSQCSPLQVITMLNALYTRFDQQCGELDVYKVETIGDAYCVAGGLHKESDTHAVQIALMALKMMELSDEVMSPHGEPIKMRIGLHSGSVFAGVVGVKMPRYCLFGNNVTLANKFESCSVPRKINVSPTTYRLLKDCPGFVFTPRSREELPPNFPSEIPGICHFLDAYQQGTNSKPCFQKKDVEDGNANFLGKASGID

SEQ ID NO: 36969 - protein, 138 aa, Homo sapiens
  Payload ID: 7330
  Gene Symbol: GUCY1A3
  Gene Name: guanylate cyclase 1, soluble, alpha 3
  ENSP ID: ENSP00000409903
MFCTKLKDLKITGECPFSLLAPGQVPNESSEEAAGSSESCKATVPICQDIPEKNIQESLPQRKTSRSRVYLHTLAESICKLIFPEFERLNVALQRTLAKHKIKESRKSLEREDFEKTIAEQAVAAEQPLPRSRKKGQA

SEQ ID NO: 36970 - protein, 690 aa, Homo sapiens; identical to SEQ ID NO: 36967
  Payload ID: 7330
  Gene Symbol: GUCY1A3
  Gene Name: guanylate cyclase 1, soluble, alpha 3
  Uniprot ID: Q02108
  ENSP ID: ENSP00000412201

SEQ ID NO: 36971 - protein, 690 aa, Homo sapiens; identical to SEQ ID NO: 36967
  Payload ID: 7330
  Gene Symbol: GUCY1A3
  Gene Name: guanylate cyclase 1, soluble, alpha 3
  Uniprot ID: Q02108
  ENSP ID: ENSP00000421493

SEQ ID NO: 36972 - protein, 143 aa, Homo sapiens
  Payload ID: 7330
  Gene Symbol: GUCY1A3
  Gene Name: guanylate cyclase 1, soluble, alpha 3
  ENSP ID: ENSP00000422141
MFCTKLKDLKITGECPFSLLAPGQVPNESSEEAAGSSESCKATVPICQDIPEKNIQESLPQRKTSRSRVYLHTLAESICKLIFPEFERLNVALQRTLAKHKIKESRKSLEREDFEKTIAEQAVAAGGDHWRCLLCSWGITQRE

SEQ ID NO: 36973 - protein, 690 aa, Homo sapiens; identical to SEQ ID NO: 36967
  Payload ID: 7330
  Gene Symbol: GUCY1A3
  Gene Name: guanylate cyclase 1, soluble, alpha 3
  Uniprot ID: Q02108
  ENSP ID: ENSP00000424361

SEQ ID NO: 36974 - protein, 82 aa, Homo sapiens
  Payload ID: 7330
  Gene Symbol: GUCY1A3
  Gene Name: guanylate cyclase 1, soluble, alpha 3
  ENSP ID: ENSP00000424863
MFCTKLKDLKITGECPFSLLAPGQVPNESSEEAAGSSESCKATVPICQDIPEKNIQESLPQRKTSGDHWRCLLCSWGITQRE

SEQ ID NO: 36975 - protein, 690 aa, Homo sapiens; identical to SEQ ID NO: 36967
  Payload ID: 7330
  Gene Symbol: GUCY1A3
  Gene Name: guanylate cyclase 1, soluble, alpha 3
  Uniprot ID: Q02108
  ENSP ID: ENSP00000426040

SEQ ID NO: 36976 - protein, 624 aa, Homo sapiens
  Payload ID: 7330
  Gene Symbol: GUCY1A3
  Gene Name: guanylate cyclase 1, soluble, alpha 3
  Uniprot ID: Q02108
  ENSP ID: ENSP00000426968
MFCTKLKDLKITGECPFSLLAPGQVPNESSEEAAGSSESCKATVPICQDIPEKNIQESLPQRKTSRSRVYLHTLAESICKLIFPEFERLNVALQRTLAKHKIKESRKSLEREDFEKTIAEQAVAAGVPVEVIKESLGEEVFKICYEEDENILGVVGGTLKDFLNSFSTLLKQSSHCQEAGKRGRLEDASILCLDKEDDFLHVYYFFPKRTTSLILPGIIKAAAHVLYETEVEVSLMPPCFHNDCSEFVNQPYLLYSVHMKSTKPSLSPSKPQSSLVIPTSLFCKTFPFHFMFDKDMTILQFGNGIRRLMNRRDFQGKPNFEEYFEILTPKINQTFSGIMTMLNMQFVVRVRRWDNSVKKSSRVMDLKGQMIYIVESSAILFLGSPCVDRLEDFTGRGLYLSDIPIHNALRDVVLIGEQARAQDGLKKRLGKLKATLEQAHQALEEEKKKTVDLLCSIFPCEVAQQLWQGQVVQAKKFSNVTMLFSDIVGFTAICSQCSPLQVITMLNALYTRFDQQCGELDVYKVETIGDAYCVAGGLHKESDTHAVQIALMALKMMELSDEVMSPHGEPIKMRIGLHSGSVFAGVVGVKMPRYCLFGNNVTLANKFESCSVPRKINVSPTTYR

SEQ ID NO: 36977 - protein, 143 aa, Homo sapiens; identical to SEQ ID NO: 36972
  Payload ID: 7330
  Gene Symbol: GUCY1A3
  Gene Name: guanylate cyclase 1, soluble, alpha 3
  ENSP ID: ENSP00000479710

SEQ ID NO: 36978 - protein, 619 aa, Homo sapiens
  Payload ID: 7331
  Gene Symbol: GUCY1B3
  Gene Name: guanylate cyclase 1, soluble, beta 3
  Uniprot ID: Q02153
  ENSP ID: ENSP00000264424
MYGFVNHALELLVIRNYGPEVWEDIKKEAQLDEEGQFLVRIIYDDSKTYDLVAAASKVLNLNAGEILQMFGKMFFVFCQESGYDTILRVLGSNVREFLQNLDALHDHLATIYPGMRAPSFRCTDAEKGKGLILHYYSEREGLQDIVIGIIKTVAQQIHGTEIDMKVIQQRNEECDHTQFLIEEKESKEEDFYEDLDRFEENGTQESRISPYTFCKAFPFHIIFDRDLVVTQCGNAIYRVLPQLQPGNCSLLSVFSLVRPHIDISFHGILSHINTVFVLRSKEGLLDVEKLECEDELTGTEISCLRLKGQMIYLPEADSILFLCSPSVMNLDDLTRRGLYLSDIPLHDATRDLVLLGEQFREEYKLTQELEILTDRLQLTLRALEDEKKKTDTLLYSVLPPSVANELRHKRPVPAKRYDNVTILFSGIVGFNAFCSKHASGEGAMKIVNLLNDLYTRFDTLTDSRKNPFVYKVETVGDKYMTVSGLPEPCIHHARSICHLALDMMEIAGQVQVDGESVQITIGIHTGEVVTGVIGQRMPRYCLFGNTVNLTSRTETTGEKGKINVSEYTYRCLMSPENSDPQFHLEHRGPVSMKGKKEPMQVWFLSRKNTGTEETKQDDD

SEQ ID NO: 36979 - protein, 586 aa, Homo sapiens
  Payload ID: 7331
  Gene Symbol: GUCY1B3
  Gene Name: guanylate cyclase 1, soluble, beta 3
  Uniprot ID: Q02153
  ENSP ID: ENSP00000420842
MYGFVNHALELLVIRNYGPEVWEDIKKEAQLDEEGQFLVRIIYDDSKTYDLVAAASKVLNLNAGEILQMFGKMFFVFCQESGYDTILRVLGSNVREFLQNLDALHDHLATIYPGMRAPSFRCTDAEKGKGLILHYYSEREGLQDIVIGIIKTVAQQIHGTEIDMKVIQQRNEECDHTQFLIEEKESKEEDFYEDLDRFEENGTQESRISPYTFCKAFPFHIIFDRDLVVTQCGNAIYRVLPQLQPGNCSLLSVFSLVRPHIDISFHGILSHINTVFVLRSKEGLLDVEKLECEDELTGTEISCLRLKGQMIYLPEADSILFLCSPSVMNLDDLTRRGLYLSDIPLHDATRDLVLLGEQFREEYKLTQELEILTDRLQLTLRALEDEKKKTDTGIVGFNAFCSKHASGEGAMKIVNLLNDLYTRFDTLTDSRKNPFVYKVETVGDKYMTVSGLPEPCIHHARSICHLALDMMEIAGQVQVDGESVQITIGIHTGEVVTGVIGQRMPRYCLFGNTVNLTSRTETTGEKGKINVSEYTYRCLMSPENSDPQFHLEHRGPVSMKGKKEPMQVWFLSRKNTGTEETKQDDD

SEQ ID NO: 36980 - protein, 594 aa, Homo sapiens
  Payload ID: 7331
  Gene Symbol: GUCY1B3
  Gene Name: guanylate cyclase 1, soluble, beta 3
  ENSP ID: ENSP00000422313
MFGKMFFVFCQESGYDTILRVLGSNVREFLQNLDALHDHLATIYPGMRAPSFRCTDAEKGKGLILHYYSEREGLQDIVIGIIKTVAQQIHGTEIDMKVIQQRNEECDHTQFLIEEKESKEEDFYEDLDRFEENGTQESRISPYTFCKAFPFHIIFDRDLVVTQCGNAIYRVLPQLQPGNCSLLSVFSLVRPHIDISFHGILSHINTVFVLRSKEGLLDVEKLECEDELTGTEISCLRLKGQMIYLPEADSILFLCSPSVMNLDDLTRRGLYLSDIPLHDATRDLVLLGEQFREEYKLTQELEILTDRLQLTLRALEDEKKKTDTGCPARIQAFKVQTTLMLCEKDSRSTKGFPSISYSGFLLIPLNRLLYSVLPPSVANELRHKRPVPAKRYDNVTILFSGIVGFNAFCSKHASGEGAMKIVNLLNDLYTRFDTLTDSRKNPFVYKVETVGDKYMTVSGLPEPCIHHARSICHLALDMMEIAGQVQVDGESVQITIGIHTGEVVTGVIGQRMPRYCLFGNTVNLTSRTETTGEKGKINVSEYTYRCLMSPENSDPQFHLEHRGPVSMKGKKEPMQVWFLSRKNTGTEETKQDDD

SEQ ID NO: 36981 - protein, 551 aa, Homo sapiens
  Payload ID: 7331
  Gene Symbol: GUCY1B3
  Gene Name: guanylate cyclase 1, soluble, beta 3
  ENSP ID: ENSP00000425065
MFGKMFFVFCQESGYDTILRVLGSNVREFLQNLDALHDHLATIYPGMRAPSFRCTDAEKGKGLILHYYSEREGLQDIVIGIIKTVAQQIHGTEIDMKVIQQRNEECDHTQFLIEEKESKEEDFYEDLDRFEENGTQESRISPYTFCKAFPFHIIFDRDLVVTQCGNAIYRVLPQLQPGNCSLLSVFSLVRPHIDISFHGILSHINTVFVLRSKEGLLDVEKLECEDELTGTEISCLRLKGQMIYLPEADSILFLCSPSVMNLDDLTRRGLYLSDIPLHDATRDLVLLGEQFREEYKLTQELEILTDRLQLTLRALEDEKKKTDTLLYSVLPPSVANELRHKRPVPAKRYDNVTILFSGIVGFNAFCSKHASGEGAMKIVNLLNDLYTRFDTLTDSRKNPFVYKVETVGDKYMTVSGLPEPCIHHARSICHLALDMMEIAGQVQVDGESVQITIGIHTGEVVTGVIGQRMPRYCLFGNTVNLTSRTETTGEKGKINVSEYTYRCLMSPENSDPQFHLEHRGPVSMKGKKEPMQVWFLSRKNTGTEETKQDDD

SEQ ID NO: 36982 - protein, 599 aa, Homo sapiens
  Payload ID: 7331
  Gene Symbol: GUCY1B3
  Gene Name: guanylate cyclase 1, soluble, beta 3
  Uniprot ID: Q02153
  ENSP ID: ENSP00000426319
MLMCFIKEAQLDEEGQFLVRIIYDDSKTYDLVAAASKVLNLNAGEILQMFGKMFFVFCQESGYDTILRVLGSNVREFLQNLDALHDHLATIYPGMRAPSFRCTDAEKGKGLILHYYSEREGLQDIVIGIIKTVAQQIHGTEIDMKVIQQRNEECDHTQFLIEEKESKEEDFYEDLDRFEENGTQESRISPYTFCKAFPFHIIFDRDLVVTQCGNAIYRVLPQLQPGNCSLLSVFSLVRPHIDISFHGILSHINTVFVLRSKEGLLDVEKLECEDELTGTEISCLRLKGQMIYLPEADSILFLCSPSVMNLDDLTRRGLYLSDIPLHDATRDLVLLGEQFREEYKLTQELEILTDRLQLTLRALEDEKKKTDTLLYSVLPPSVANELRHKRPVPAKRYDNVTILFSGIVGFNAFCSKHASGEGAMKIVNLLNDLYTRFDTLTDSRKNPFVYKVETVGDKYMTVSGLPEPCIHHARSICHLALDMMEIAGQVQVDGESVQITIGIHTGEVVTGVIGQRMPRYCLFGNTVNLTSRTETTGEKGKINVSEYTYRCLMSPENSDPQFHLEHRGPVSMKGKKEPMQVWFLSRKNTGTEETKQDDD

SEQ ID NO: 36983 - protein, 641 aa, Homo sapiens
  Payload ID: 7331
  Gene Symbol: GUCY1B3
  Gene Name: guanylate cyclase 1, soluble, beta 3
  ENSP ID: ENSP00000426786
MYGFVNHALELLVIRNYGPEVWEDIKKEAQLDEEGQFLVRIIYDDSKTYDLVAAASKVLNLNAGEILQMFGKMFFVFCQESGYDTILRVLGSNVREFLQKNESKHISDLHHCFLGIYLCCNNLDALHDHLATIYPGMRAPSFRCTDAEKGKGLILHYYSEREGLQDIVIGIIKTVAQQIHGTEIDMKVIQQRNEECDHTQFLIEEKESKEEDFYEDLDRFEENGTQESRISPYTFCKAFPFHIIFDRDLVVTQCGNAIYRVLPQLQPGNCSLLSVFSLVRPHIDISFHGILSHINTVFVLRSKEGLLDVEKLECEDELTGTEISCLRLKGQMIYLPEADSILFLCSPSVMNLDDLTRRGLYLSDIPLHDATRDLVLLGEQFREEYKLTQELEILTDRLQLTLRALEDEKKKTDTLLYSVLPPSVANELRHKRPVPAKRYDNVTILFSGIVGFNAFCSKHASGEGAMKIVNLLNDLYTRFDTLTDSRKNPFVYKVETVGDKYMTVSGLPEPCIHHARSICHLALDMMEIAGQVQVDGESVQITIGIHTGEVVTGVIGQRMPRYCLFGNTVNLTSRTETTGEKGKINVSEYTYRCLMSPENSDPQFHLEHRGPVSMKGKKEPMQVWFLSRKNTGTEETKQDDD

SEQ ID NO: 36984 - protein, 551 aa, Homo sapiens; identical to SEQ ID NO: 36981
  Payload ID: 7331
  Gene Symbol: GUCY1B3
  Gene Name: guanylate cyclase 1, soluble, beta 3
  ENSP ID: ENSP00000427226

SEQ ID NO: 36985 - protein, 1073 aa, Homo sapiens
  Payload ID: 7332
  Gene Symbol: GUCY2C
  Gene Name: guanylate cyclase 2C
  Uniprot ID: P25092
  ENSP ID: ENSP00000261170
MKTLLLDLALWSLLFQPGWLSFSSQVSQNCHNGSYEISVLMMGNSAFAEPLKNLEDAVNEGLEIVRGRLQNAGLNVTVNATFMYSDGLIHNSGDCRSSTCEGLDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQILMIAVFTLTGAVVLLLLVALLMLRKYRKDYELRQKKWSHIPPENIFPLETNETNHVSLKIDDDKRRDTIQRLRQCKYDKKRVILKDLKHNDGNFTEKQKIELNKLLQIDYYNLTKFYGTVKLDTMIFGVIEYCERGSLREVLNDTISYPDGTFMDWEFKISVLYDIAKGMSYLHSSKTEVHGRLKSTNCVVDSRMVVKITDFGCNSILPPKKDLWTAPEHLRQANISQKGDVYSYGIIAQEIILRKETFYTLSCRDRNEKIFRVENSNGMKPFRPDLFLETAEEKELEVYLLVKNCWEEDPEKRPDFKKIETTLAKIFGLFHDQKNESYMDTLIRRLQLYSRNLEHLVEERTQLYKAERDRADRLNFMLLPRLVVKSLKEKGFVEPELYEEVTIYFSDIVGFTTICKYSTPMEVVDMLNDIYKSFDHIVDHHDVYKVETIGDAYMVASGLPKRNGNRHAIDIAKMALEILSFMGTFELEHLPGLPIWIRIGVHSGPCAAGVVGIKMPRYCLFGDTVNTASRMESTGLPLRIHVSGSTIAILKRTECQFLYEVRGETYLKGRGNETTYWLTGMKDQKFNLPTPPTVENQQRLQAEFSDMIANSLQKRQAAGIRSQKPRRVASYKKGTLEYLQLNTTDKESTYF

SEQ ID NO: 36986 - protein, 1103 aa, Homo sapiens
  Payload ID: 7333
  Gene Symbol: GUCY2D
  Gene Name: guanylate cyclase 2D, membrane (retina-specific)
  Uniprot ID: Q02846
  ENSP ID: ENSP00000254854
MTACARRAGGLPDPGLCGPAWWAPSLPRLPRALPRLPLLLLLLLLQPPALSAVFTVGVLGPWACDPIFSRARPDLAARLAAARLNRDPGLAGGPRFEVALLPEPCRTPGSLGAVSSALARVSGLVGPVNPAACRPAELLAEEAGIALVPWGCPWTQAEGTTAPAVTPAADALYALLRAFGWARVALVTAPQDLWVEAGRSLSTALRARGLPVASVTSMEPLDLSGAREALRKVRDGPRVTAVIMVMHSVLLGGEEQRYLLEAAEELGLTDGSLVFLPFDTIHYALSPGPEALAALANSSQLRRAHDAVLTLTRHCPSEGSVLDSLRRAQERRELPSDLNLQQVSPLFGTIYDAVFLLARGVAEARAAAGGRWVSGAAVARHIRDAQVPGFCGDLGGDEEPPFVLLDTDAAGDRLFATYMLDPARGSFLSAGTRMHFPRGGSAPGPDPSCWFDPNNICGGGLEPGLVFLGFLLVVGMGLAGAFLAHYVRHRLLHMQMVSGPNKIILTVDDITFLHPHGGTSRKVAQGSRSSLGARSMSDIRSGPSQHLDSPNIGVYEGDRVWLKKFPGDQHIAIRPATKTAFSKLQELRHENVALYLGLFLARGAEGPAALWEGNLAVVSEHCTRGSLQDLLAQREIKLDWMFKSSLLLDLIKGIRYLHHRGVAHGRLKSRNCIVDGRFVLKITDHGHGRLLEAQKVLPEPPRAEDQLWTAPELLRDPALERRGTLAGDVFSLAIIMQEVVCRSAPYAMLELTPEEVVQRVRSPPPLCRPLVSMDQAPVECILLMKQCWAEQPELRPSMDHTFDLFKNINKGRKTNIIDSMLRMLEQYSSNLEDLIRERTEELELEKQKTDRLLTQMLPPSVAEALKTGTPVEPEYFEQVTLYFSDIVGFTTISAMSEPIEVVDLLNDLYTLFDAIIGSHDVYKVETIGDAYMVASGLPQRNGQRHAAEIANMSLDILSAVGTFRMRHMPEVPVRIRIGLHSGPCVAGVVGLTMPRYCLFGDTVNTASRMESTGLPYRIHVNLSTVGILRALDSGYQVELRGRTELKGKGAEDTFWLVGRRGFNKPIPKPPDLQPGSSNHGISLQEIPPERRRKLEKARPGQFS

SEQ ID NO: 36987 - protein, 1108 aa, Homo sapiens
  Payload ID: 7334
  Gene Symbol: GUCY2F
  Gene Name: guanylate cyclase 2F, retinal
  Uniprot ID: P51841
  ENSP ID: ENSP00000218006
MFLGLGRFSRLVLWFAAFRKLLGHHGLASAKFLWCLCLLSVMSLPQQVWTLPYKIGVVGPWACDSLFSKALPEVAARLAIERINRDPSFDLSYSFEYVILNEDCQTSRALSSFISHHQMASGFIGPTNPGYCEAASLLGNSWDKGIFSWACVNYELDNKISYPTFSRTLPSPIRVLVTVMKYFQWAHAGVISSDEDIWVHTANRVASALRSHGLPVGVVLTTGQDSQSMRKALQRIHQADRIRIIIMCMHSALIGGETQMHLLECAHDLKMTDGTYVFVPYDALLYSLPYKHTPYRVLRNNPKLREAYDAVLTITVESQEKTFYQAFTEAAARGEIPEKLEFDQVSPLFGTIYNSIYFIAQAMNNAMKENGQAGAASLVQHSRNMQFHGFNQLMRTDSNGNGISEYVILDTNLKEWELHSTYTVDMEMELLRFGGTPIHFPGGRPPRADAKCWFAEGKICHGGIDPAFAMMVCLTLLIALLSINGFAYFIRRRINKIQLIKGPNRILLTLEDVTFINPHFGSKRGSRASVSFQITSEVQSGRSPRLSFSSGSLTPATYENSNIAIYEGDWVWLKKFSLGDFGDLKSIKSRASDVFEMMKDLRHENINPLLGFFYDSGMFAIVTEFCSRGSLEDILTNQDVKLDWMFKSSLLLDLIKGMKYLHHREFVHGRLKSRNCVVDGRFVLKVTDYGFNDILEMLRLSEEESSMEELLWTAPELLRAPRGSRLGSFAGDVYSFAIIMQEVMVRGTPFCMMDLPAQEIINRLKKPPPVYRPVVPPEHAPPECLQLMKQCWAEAAEQRPTFDEIFNQFKTFNKGKKTNIIDSMLRMLEQYSSNLEDLIRERTEELEIEKQKTEKLLTQMLPPSVAESLKKGCTVEPEGFDLVTLYFSDIVGFTTISAMSEPIEVVDLLNDLYTLFDAIIGSHDVYKVETIGDAYMVASGLPKRNGSRHAAEIANMSLDILSSVGTFKMRHMPEVPVRIRIGLHSGPVVAGVVGLTMPRYCLFGDTVNTASRMESTGLPYRIHVSLSTVTILQNLSEGYEVELRGRTELKGKGTEETFWLIGKKGFMKPLPVPPPVDKDGQVGHGLQPVEIAAFQRRKAERQLVRNKP

SEQ ID NO: 36988 - protein, 201 aa, Homo sapiens
  Payload ID: 7335
  Gene Symbol: GUCA1A
  Gene Name: guanylate cyclase activator 1A (retina)
  Uniprot ID: P43080
  ENSP ID: ENSP00000053469
MGNVMEGKSVEELSSTECHQWYKKFMTECPSGQLTLYEFRQFFGLKNLSPSASQYVEQMFETFDFNKDGYIDFMEYVAALSLVLKGKVEQKLRWYFKLYDVDGNGCIDRDELLTIIQAIRAINPCSDTTMTAEEFTDTVFSKIDVNGDGELSLEEFIEGVQKDQMLLDTLTRSLDLTRIVRRLQNGEQDEEGADEAAEAAG

SEQ ID NO: 36989 - protein, 201 aa, Homo sapiens; identical to SEQ ID NO: 36988
  Payload ID: 7335
  Gene Symbol: GUCA1A
  Gene Name: guanylate cyclase activator 1A (retina)
  Uniprot ID: P43080
  ENSP ID: ENSP00000362049

SEQ ID NO: 36990 - protein, 201 aa, Homo sapiens; identical to SEQ ID NO: 36988
  Payload ID: 7335
  Gene Symbol: GUCA1A
  Gene Name: guanylate cyclase activator 1A (retina)
  Uniprot ID: P43080
  ENSP ID: ENSP00000377784

SEQ ID NO: 36991 - protein, 88 aa, Homo sapiens
  Payload ID: 7335
  Gene Symbol: GUCA1A
  Gene Name: guanylate cyclase activator 1A (retina)
  ENSP ID: ENSP00000388438
MGNVMEGKSVEELSSTECHQWYKKFMTECPSGQLTLYEFRQFFGLKNLSPSASQYVEQMFETFDFNKDGYIDFMEYVAALSLVLKGKV

SEQ ID NO: 36992 - protein, 205 aa, Homo sapiens
  Payload ID: 7335
  Gene Symbol: GUCA1A
  Gene Name: guanylate cyclase activator 1A (retina)
  ENSP ID: ENSP00000437476
MEGKSVEELSSTECHQWYKKFMTECPSGQLTLYEFRQFFGLKNLSPSASQYVEQMFETFDFNKDGYIDFMEYVAALSLVLKGKVEQKLRWYFKLYDVDGNGCIDRDELLTIIQFPHQYQKTAIRAINPCSDTTMTAEEFTDTVFSKIDVNGDGELSLEEFIEGVQKDQMLLDTLTRSLDLTRIVRRLQNGEQDEEGADEAAEAAG

SEQ ID NO: 36993 - protein, 200 aa, Homo sapiens
  Payload ID: 7336
  Gene Symbol: GUCA1B
  Gene Name: guanylate cyclase activator 1B (retina)
  Uniprot ID: Q9UMX6
  ENSP ID: ENSP00000230361
MGQEFSWEEAEAAGEIDVAELQEWYKKFVMECPSGTLFMHEFKRFFKVTDDEEASQYVEGMFRAFDKNGDNTIDFLEYVAALNLVLRGTLEHKLKWTFKIYDKDGNGCIDRLELLNIVEGIYQLKKACRRELQTEQGQLLTPEEVVDRIFLLVDENGDGQLSLNEFVEGARRDKWVMKMLQMDMNPSSWLAQQRRKSAMF

SEQ ID NO: 36994 - protein, 209 aa, Homo sapiens
  Payload ID: 7337
  Gene Symbol: GUCA1C
  Gene Name: guanylate cyclase activator 1C
  Uniprot ID: O95843
  ENSP ID: ENSP00000261047
MGNGKSIAGDQKAVPTQETHVWYRTFMMEYPSGLQTLHEFKTLLGLQGLNQKANKHIDQVYNTFDTNKDGFVDFLEFIAAVNLIMQEKMEQKLKWYFKLYDADGNGSIDKNELLDMFMAVQALNGQQTLSPEEFINLVFHKIDINNDGELTLEEFINGMAKDQDLLEIVYKSFDFSNVLRVICNGKQPDMETDSSKSPDKAGLGKVKMK

SEQ ID NO: 36995 - protein, 196 aa, Homo sapiens
  Payload ID: 7337
  Gene Symbol: GUCA1C
  Gene Name: guanylate cyclase activator 1C
  ENSP ID: ENSP00000377535
MGNGKSIAGDQKAVPTQETHVWYRTFMMEYPSGLQTLHEFKTLLGLQGLNQKANKHIDQVYNTFDTNKDGFVDFLEFIAAVNLIMQEKMEQKLKWYFKLYDADGNGSIDKNELLDMFMAVQALNGQQTLSPEEFINLVFHKIDINNDGNGATLYWITFPTKGIDFRRIYQWHGKRSGSPGDCLQELRLLQCAESNL

SEQ ID NO: 36996 - protein, 161 aa, Homo sapiens
  Payload ID: 7337
  Gene Symbol: GUCA1C
  Gene Name: guanylate cyclase activator 1C
  ENSP ID: ENSP00000417761
MGNGKSIAGDQKAVPTQETHVWYRTFMMEYPSGLQTLHEFKTLLGLQGLNQKANKHIDQVYNTFDTNKDGFVDFLEFIAAVNLIMQEKMEQKLKWYFKLYDADGNGSIDKNELLDMFMAVQALNGQQTLSPEEFINLVFHKIDINNDGNGATLYWITFPTK

SEQ ID NO: 36997 - protein, 115 aa, Homo sapiens
  Payload ID: 7338
  Gene Symbol: GUCA2A
  Gene Name: guanylate cyclase activator 2A (guanylin)
  Uniprot ID: Q02747
  ENSP ID: ENSP00000349493
MNAFLLSALCLLGAWAALAGGVTVQDGNFSFSLESVKKLKDLQEPQEPRVGKLRNFAPIPGEPVVPILCSNPNFPEELKPLCKEPNAQEILQRLEEIAEDPGTCEICAYAACTGC

SEQ ID NO: 36998 - protein, 112 aa, Homo sapiens
  Payload ID: 7339
  Gene Symbol: GUCA2B
  Gene Name: guanylate cyclase activator 2B (uroguanylin)
  Uniprot ID: Q16661
  ENSP ID: ENSP00000361662
MGCRAASGLLPGVAVVLLLLLQSTQSVYIQYQGFRVQLESMKKLSDLEAQWAPSPRLQAQSLLPAVCHHPALPQDLQPVCASQEASSIFKTLRTIANDDCELCVNVACTGCL

SEQ ID NO: 36999 - protein, 197 aa, Homo sapiens
  Payload ID: 7340
  Gene Symbol: GUK1
  Gene Name: guanylate kinase 1
  Uniprot ID: Q16774
  ENSP ID: ENSP00000317659
MSGPRPVVLSGPSGAGKSTLLKRLLQEHSGIFGFSVSHTTRNPRPGEENGKDYYFVTREVMQRDIAAGDFIEHAEFSGNLYGTSKVAVQAVQAMNRICVLDVDLQGVRNIKATDLRPIYISVQPPSLHVLEQRLRQRNTETEESLVKRLAAAQADMESSKEPGLFDVVIINDSLDQAYAELKEALSEEIKKAQRTGA

SEQ ID NO: 37000 - protein, 197 aa, Homo sapiens; identical to SEQ ID NO: 36999
  Payload ID: 7340
  Gene Symbol: GUK1
  Gene Name: guanylate kinase 1
  Uniprot ID: Q16774
  ENSP ID: ENSP00000355677

SEQ ID NO: 37001 - protein, 197 aa, Homo sapiens; identical to SEQ ID NO: 36999
  Payload ID: 7340
  Gene Symbol: GUK1
  Gene Name: guanylate kinase 1
  Uniprot ID: Q16774
  ENSP ID: ENSP00000355679

SEQ ID NO: 37002 - protein, 199 aa, Homo sapiens
  Payload ID: 7340
  Gene Symbol: GUK1
  Gene Name: guanylate kinase 1
  ENSP ID: ENSP00000355682
MSGPRPVVLSGPSGAGKSTLLKRLLQEHSGIFGFSVSRESRALVEGYHEEPEARRGERQREVMQRDIAAGDFIEHAEFSGNLYGTSKVAVQAVQAMNRICVLDVDLQGVRNIKATDLRPIYISVQPPSLHVLEQRLRQRNTETEESLVKRLAAAQADMESSKEPGLFDVVIINDSLDQAYAELKEALSEEIKKAQRTGA

SEQ ID NO: 37003 - protein, 242 aa, Homo sapiens
  Payload ID: 7340
  Gene Symbol: GUK1
  Gene Name: guanylate kinase 1
  ENSP ID: ENSP00000355683
MSGPRPVVLSGPSGAGKSTLLKRLLQEHSGIFGFSVSHTTRNPRPGEENGKDYYFVTREVMQRDIAAGDFIEHAEFSGNLYGTSKVAVQAVQAMNRICVLDVDLQGVRNIKATDLRPIYISVQPPSLHVLRLRQRNTETEESLVKRLAAAQADMESSKEPGLFDVVIINDSLDQAYAELKEALSEVGPSLCLPGQGPRGGLGARPLLSMRPLRKSRKLKGPAPEACCLFSAPRAHTGPGQQH

SEQ ID NO: 37004 - protein, 235 aa, Homo sapiens
  Payload ID: 7340
  Gene Symbol: GUK1
  Gene Name: guanylate kinase 1
  ENSP ID: ENSP00000355684
MLRRPLAGLAAAALGRAPPDGMSGPRPVVLSGPSGAGKSTLLKRLLQEHSGIFGFSVSHTTRNPRPGEENGKDYYFVTREVMQRDIAAGDFIEHAEFSGNLYGTSKVAVQAVQAMNRICVLDVDLQGVRNIKATDLRPIYISVQPPSLHVLEQRLRQRNTETEESLVKRLAAAQADMESSPAGLESCPTAAVRTAAGKEPGLFDVVIINDSLDQAYAELKEALSEEIKKAQRTGA

SEQ ID NO: 37005 - protein, 197 aa, Homo sapiens; identical to SEQ ID NO: 36999
  Payload ID: 7340
  Gene Symbol: GUK1
  Gene Name: guanylate kinase 1
  Uniprot ID: Q16774
  ENSP ID: ENSP00000355687

SEQ ID NO: 37006 - protein, 241 aa, Homo sapiens
  Payload ID: 7340
  Gene Symbol: GUK1
  Gene Name: guanylate kinase 1
  Uniprot ID: Q16774
  ENSP ID: ENSP00000355689
MLRRPLAGLAAAALGRAPPDGMSGPRPVVLSGPSGAGKSTLLKRLLQEHSGIFGFSVSHTTRNPRPGEENGKDYYFVTREVMQRDIAAGDFIEHAEFSGNLYGTSKVAVQAVQAMNRICVLDVDLQGVRNIKATDLRPIYISVQPPSLHVLEQRLRQRNTETEESLVKRLAAAQADMESRNQESSKDRRLRLAVCSRHPGPIQDQGSSIEPPPWQAIRQLCALGQHVEWRRCCPCGWNILG

SEQ ID NO: 37007 - protein, 197 aa, Homo sapiens; identical to SEQ ID NO: 36999
  Payload ID: 7340
  Gene Symbol: GUK1
  Gene Name: guanylate kinase 1
  Uniprot ID: Q16774
  ENSP ID: ENSP00000355691

SEQ ID NO: 37008 - protein, 218 aa, Homo sapiens
  Payload ID: 7340
  Gene Symbol: GUK1
  Gene Name: guanylate kinase 1
  Uniprot ID: Q16774
  ENSP ID: ENSP00000375738
MLRRPLAGLAAAALGRAPPDGMSGPRPVVLSGPSGAGKSTLLKRLLQEHSGIFGFSVSHTTRNPRPGEENGKDYYFVTREVMQRDIAAGDFIEHAEFSGNLYGTSKVAVQAVQAMNRICVLDVDLQGVRNIKATDLRPIYISVQPPSLHVLEQRLRQRNTETEESLVKRLAAAQADMESSKEPGLFDVVIINDSLDQAYAELKEALSEEIKKAQRTGA

SEQ ID NO: 37009 - protein, 217 aa, Homo sapiens
  Payload ID: 7340
  Gene Symbol: GUK1
  Gene Name: guanylate kinase 1
  ENSP ID: ENSP00000401832
MLRRPLAGLAAAALGRAPPDGMSGPRPVVLSGPSGAGKSTLLKRLLQEHSGIFGFSVSHTTRNPRPGEENGKDYYFVTREVMQRDIAAGDFIEHAEFSGNLYGTSKVAVQAVQAMNRICVLDVDLQGVRNIKATDLRPIYISVQPPSLHVLEQRLRQRNTETEESLVKRLAAAQADMESSKEPGLFDVVIINDSLDQAYAELKEALSEEIKKAQRTG

SEQ ID NO: 37010 - protein, 272 aa, Homo sapiens
  Payload ID: 7340
  Gene Symbol: GUK1
  Gene Name: guanylate kinase 1
  ENSP ID: ENSP00000403664
MAGSQKEEIMPPQQGVPFQESGCWGSMGAQSRERSGRDHSGTWICAGGSQETFHLGAPVETTCLAASLLTPRHVGPQACGAERAFGSWEEHPAEEAAPGAQRHLWLQRVPYHEEPEARRGERQREVMQRDIAAGDFIEHAEFSGNLYGTSKVAVQAVQAMNRICVLDVDLQGVRNIKATDLRPIYISVQPPSLHVLEQRLRQRNTETEESLVKRLAAAQADMESRNQESSKDRRLRLAVCSRHPGPIQDQGSSIEPPPWQAIRQLCALGQHV

SEQ ID NO: 37011 - protein, 253 aa, Homo sapiens
  Payload ID: 7340
  Gene Symbol: GUK1
  Gene Name: guanylate kinase 1
  ENSP ID: ENSP00000407604
MAGSQKEEIMPPQQGVPFQESGCWGSMGAQSRERSGRDHSGTWICAGGSQETFHLGAPVETTCLAGMSGPRPVVLSGPSGAGKSTLLKRLLQEHSGIFGFSVSHTTRNPRPGEENGKDYYFVTREVMQRDIAAGDFIEHAEFSGNLYGTSKVAVQAVQAMNRICVLDVDLQGVRNIKATDLRPIYISVQPPSLHVLEQRLRQRNTETEESLVKRLAAAQADMESSKEPGLFDVVIINDSLDQAYAELKEALSE

SEQ ID NO: 37012 - protein, 239 aa, Homo sapiens
  Payload ID: 7341
  Gene Symbol: GUCD1
  Gene Name: guanylyl cyclase domain containing 1
  Uniprot ID: Q96NT3
  ENSP ID: ENSP00000381297
MRTEAEAAGPPLEPGDFVQLPVPVIQQLYHWDCGLACSRMVLRYLGQLDDSEFERALQKLQLTRSIWTIDLAYLMHHFGVRHRFCTQTLGVDKGYKNQSFYRKHFDTEETRVNQLFAQAKACKVLVEKCTVSVKDIQAHLAQGHVAIVLVNSGVLHCDLCSSPVKYCCFTPSGHHCFCRTPDYQGHFIVLRGYNRATGCIFYNNPAYADRMCSTSISNFEEARTSYGTDEDILFVYLDS

SEQ ID NO: 37013 - protein, 295 aa, Homo sapiens
  Payload ID: 7341
  Gene Symbol: GUCD1
  Gene Name: guanylyl cyclase domain containing 1
  Uniprot ID: Q96NT3
  ENSP ID: ENSP00000384121
MTGPGGRRNDPWGRQRAREGAHTSKHPTPRTGWTARRRRGAWALRPGTAGGWAKGQDFPSQFHLLIPAPPGDFVQLPVPVIQQLYHWDCGLACSRMVLRYLGQLDDSEFERALQKLQLTRSIWTIDLAYLMHHFGVRHRFCTQTLGVDKGYKNQSFYRKHFDTEETRVNQLFAQAKACKVLVEKCTVSVKDIQAHLAQGHVAIVLVNSGVLHCDLCSSPVKYCCFTPSGHHCFCRTPDYQGHFIVLRGYNRATGCIFYNNPAYADRMCSTSISNFEEARTSYGTDEDILFVYLDS

SEQ ID NO: 37014 - protein, 137 aa, Homo sapiens
  Payload ID: 7341
  Gene Symbol: GUCD1
  Gene Name: guanylyl cyclase domain containing 1
  ENSP ID: ENSP00000384378
MRTEAEAAGPPLEPGDFVQLPVPVIQQLYHWDCGLACSRMVLRYLGQLDDSEFERALQKLQLTRSIWTIDLAYLMHHFGVRHRFCTQTLGVDKGYKNQSFYRKHFDTEETRVNQLFAQAKACKVLVEKCRNVQHQHQ

SEQ ID NO: 37015 - protein, 127 aa, Homo sapiens
  Payload ID: 7341
  Gene Symbol: GUCD1
  Gene Name: guanylyl cyclase domain containing 1
  ENSP ID: ENSP00000385583
MRTEAEAAGPPLEPGDFVQLPVPVIQQLYHWDCGLACSRMVLRYLGQLDDSEFERALQKLQLTRSIWTIDLAYLMHHFGVRHRFCTQTLGVDKGYKNQSFYRKHFDTEETRVNQLFAQAKACKVLVE

SEQ ID NO: 37016 - protein, 240 aa, Homo sapiens
  Payload ID: 7341
  Gene Symbol: GUCD1
  Gene Name: guanylyl cyclase domain containing 1
  Uniprot ID: Q96NT3
  ENSP ID: ENSP00000386076
MRTEAEAAGPPLEPGDFVQLPVPVIQQLYHWDCGLACSRMVLRYLGQLDDSEFERALQKLQLTRSIWTIDLAYLMHHFGVRHRFCTQTLGVDKGYKNQSFYRKHFDTEETRVNQLFAQAKACKVLVEKCTVSVKDIQAHLAQGHVAIVLVNSGVLHCDLCSSPVKYCCFTPSGHHCFCRTPDYQGHFIVLRGYNRATGCIFYNNPAYADPGMCSTSISNFEEARTSYGTDEDILFVYLDS

SEQ ID NO: 37017 - protein, 136 aa, Homo sapiens
  Payload ID: 7341
  Gene Symbol: GUCD1
  Gene Name: guanylyl cyclase domain containing 1
  ENSP ID: ENSP00000387867
MRTEAEAAGPPLEPGDFVQLPVPVIQQLYHWDCGLACSRMVLRYLGQLDDSEFERALQKLQLTRSIWTIDLAYLMHHFGVRHRFCTQTLGVDKGYKNQSFYRKHFDTEETRVNQLFAQAKACKVLVEKWNVQHQHQ

SEQ ID NO: 37018 - protein, 239 aa, Homo sapiens; identical to SEQ ID NO: 37012
  Payload ID: 7341
  Gene Symbol: GUCD1
  Gene Name: guanylyl cyclase domain containing 1
  Uniprot ID: Q96NT3
  ENSP ID: ENSP00000405985

SEQ ID NO: 37019 - protein, 296 aa, Homo sapiens
  Payload ID: 7341
  Gene Symbol: GUCD1
  Gene Name: guanylyl cyclase domain containing 1
  ENSP ID: ENSP00000479370
MTGPGGRRNDPWGRQRAREGAHTSKHPTPRTGWTARRRRGAWALRPGTAGGWAKGQDFPSQFHLLIPAPPGDFVQLPVPVIQQLYHWDCGLACSRMVLRYLGQLDDSEFERALQKLQLTRSIWTIDLAYLMHHFGVRHRFCTQTLGVDKGYKNQSFYRKHFDTEETRVNQLFAQAKACKVLVEKCTVSVKDIQAHLAQGHVAIVLVNSGVLHCDLCSSPVKYCCFTPSGHHCFCRTPDYQGHFIVLRGYNRATGCIFYNNPAYADPGMCSTSISNFEEARTSYGTDEDILFVYLDS

SEQ ID NO: 37020 - protein, 669 aa, Homo sapiens
  Payload ID: 7342
  Gene Symbol: GUF1
  Gene Name: GUF1 homolog, GTPase
  Uniprot ID: Q8N442
  ENSP ID: ENSP00000281543
MWTLVGRGWGCARALAPRATGAALLVAPGPRSAPTLGAAPESWATDRLYSSAEFKEKLDMSRFPVENIRNFSIVAHVDHGKSTLADRLLELTGTIDKTKNNKQVLDKLQVERERGITVKAQTASLFYNCEGKQYLLNLIDTPGHVDFSYEVSRSLSACQGVLLVVDANEGIQAQTVANFFLAFEAQLSVIPVINKIDLKNADPERVENQIEKVFDIPSDECIKISAKLGTNVESVLQAIIERIPPPKVHRKNPLRALVFDSTFDQYRGVIANVALFDGVVSKGDKIVSAHTQKTYEVNEVGVLNPNEQPTHKLYAGQVGYLIAGMKDVTEAQIGDTLCLHKQPVEPLPGFKSAKPMVFAGMYPLDQSEYNNLKSAIEKLTLNDSSVTVHRDSSLALGAGWRLGFLGLLHMEVFNQRLEQEYNASVILTTPTVPYKAVLSSSKLIKEHREKEITIINPAQFPDKSKVTEYLEPVVLGTIITPDEYTGKIMMLCEARRAVQKNMIFIDQNRVMLKYLFPLNEIVVDFYDSLKSLSSGYASFDYEDAGYQTAELVKMDILLNGNTVEELVTVVHKDKAHSIGKAICERLKDSLPRQLFEIAIQAAIGSKIIARETVKAYRKNVLAKCYGGDITRKMKLLKRQAEGKKKLRKIGNVEVPKDAFIKVLKTQSSK

SEQ ID NO: 37021 - protein, 98 aa, Homo sapiens
  Payload ID: 7342
  Gene Symbol: GUF1
  Gene Name: GUF1 homolog, GTPase
  ENSP ID: ENSP00000422681
MWTLVGRGWGCARALAPRATGAALLVAPGPRSAPTLGAAPESWATDRLYSSAEFKGQLIKQRIISRFLINCKWNEKEESLLKHRQHLSFTIVKESSTF

SEQ ID NO: 37022 - protein, 304 aa, Homo sapiens
  Payload ID: 7343
  Gene Symbol: GULP1
  Gene Name: GULP, engulfment adaptor PTB domain containing 1
  Uniprot ID: Q9UBP9
  ENSP ID: ENSP00000352047
MNRAFSRKKDKTWMHTPEALSKHFIPYNAKFLGSTEVEQPKGTEVVRDAVRKLKFARHIKKSEGQKIPKVELQISIYGVKILEPKTKEVQHNCQLHRISFCADDKTDKRIFTFICKDSESNKHLCYVFDSEKCAEEITLTIGQAFDLAYRKFLESGGKDVETRKQIAGLQKRIQDLETENMELKNKVQDLENQLRITQVSAPPAGSMTPKSPSTDIFDMIPFSPISHQSSMPTRNGTQPPPVPSRSTEIKRDLFGAEPFDPFNCGAADFPPDIQSKLDEMQEGFKMGLTLEGTVFCLDPLDSRC

SEQ ID NO: 37023 - protein, 304 aa, Homo sapiens; identical to SEQ ID NO: 37022
  Payload ID: 7343
  Gene Symbol: GULP1
  Gene Name: GULP, engulfment adaptor PTB domain containing 1
  Uniprot ID: Q9UBP9
  ENSP ID: ENSP00000386289

SEQ ID NO: 37024 - protein, 167 aa, Homo sapiens
  Payload ID: 7343
  Gene Symbol: GULP1
  Gene Name: GULP, engulfment adaptor PTB domain containing 1
  Uniprot ID: Q9UBP9
  ENSP ID: ENSP00000386402
MNRAFSRKKDKTWMHTPEALSKHFIPYNAKFLGSTEVEQPKGTEVVRDAVRKLKFARHIKKSEGQKIPKVELQISIYGVKILEPKTKEVQHNCQLHRISFCADDKTDKRIFTFICKDSESNKHLCYVFDSEKCVSIPDVVGWFVLFYKPGIVLLLALAKYLKMNNFL

SEQ ID NO: 37025 - protein, 304 aa, Homo sapiens; identical to SEQ ID NO: 37022
  Payload ID: 7343
  Gene Symbol: GULP1
  Gene Name: GULP, engulfment adaptor PTB domain containing 1
  Uniprot ID: Q9UBP9
  ENSP ID: ENSP00000386732

SEQ ID NO: 37026 - protein, 68 aa, Homo sapiens
  Payload ID: 7343
  Gene Symbol: GULP1
  Gene Name: GULP, engulfment adaptor PTB domain containing 1
  ENSP ID: ENSP00000386809
MNRAFSRKKDKTWMHTPEALSKHFIPYNAKFLGSTEVEQPKGTEVVRDAVRKLKFARHIKKSEGQKIP

SEQ ID NO: 37027 - protein, 304 aa, Homo sapiens; identical to SEQ ID NO: 37022
  Payload ID: 7343
  Gene Symbol: GULP1
  Gene Name: GULP, engulfment adaptor PTB domain containing 1
  Uniprot ID: Q9UBP9
  ENSP ID: ENSP00000386867

SEQ ID NO: 37028 - protein, 167 aa, Homo sapiens; identical to SEQ ID NO: 37024
  Payload ID: 7343
  Gene Symbol: GULP1
  Gene Name: GULP, engulfment adaptor PTB domain containing 1
  Uniprot ID: Q9UBP9
  ENSP ID: ENSP00000387013

SEQ ID NO: 37029 - protein, 291 aa, Homo sapiens
  Payload ID: 7343
  Gene Symbol: GULP1
  Gene Name: GULP, engulfment adaptor PTB domain containing 1
  Uniprot ID: Q9UBP9
  ENSP ID: ENSP00000387144
MNRAFSRKKDKTWMHTPEALSKHFIPYNAKFLGSTEVEQPKGTEVVRDAVRKLKFARHIKKSEGQKIPKVELQISIYGVKILEPKTKEVQHNCQLHRISFCADDKTDKRIFTFICKDSESNKHLCYVFDSEKCAEEITLTIGQAFDLAYRKFLESGGKDVETRKQIAGLQKRIQDLETENMELKNKVQDLENQLRITQVSAPPAGSMTPKSPSTDIFDMIPFSPISHQSSMPTRNGTQPPPVPSRSTEIKRDLFGAEPFDPFNCGAADFPPDIQSKLDEMQRQRWRGSKWD

SEQ ID NO: 37030 - protein, 201 aa, Homo sapiens
  Payload ID: 7343
  Gene Symbol: GULP1
  Gene Name: GULP, engulfment adaptor PTB domain containing 1
  Uniprot ID: Q9UBP9
  ENSP ID: ENSP00000387171
MNRAFSRKKDKTWMHTPEALSKHFIPYNAKAEEITLTIGQAFDLAYRKFLESGGKDVETRKQIAGLQKRIQDLETENMELKNKVQDLENQLRITQVSAPPAGSMTPKSPSTDIFDMIPFSPISHQSSMPTRNGTQPPPVPSRSTEIKRDLFGAEPFDPFNCGAADFPPDIQSKLDEMQEGFKMGLTLEGTVFCLDPLDSRC

SEQ ID NO: 37031 - protein, 189 aa, Homo sapiens
  Payload ID: 7343
  Gene Symbol: GULP1
  Gene Name: GULP, engulfment adaptor PTB domain containing 1
  ENSP ID: ENSP00000391712
  MOD_RES (1)..(1): Any amino acid
XNQLRITQVSAPPLLHNMSDHEQHVFQRCSSSFWRSNGDSSPCLNISSISVTPINSPDSRLSLGLLIPPPSKCGFPKPVSESSIPRPHAGSMTPKSPSTDIFDMIPFSPISHQSSMPTRNGTQPPPVPSRSTEIKRDLFGAEPFDPFNCGAADFPPDIQSKLDEMQEGFKMGLTLEGTVFCLDPLDSRC

SEQ ID NO: 37032 - protein, 147 aa, Homo sapiens
  Payload ID: 7343
  Gene Symbol: GULP1
  Gene Name: GULP, engulfment adaptor PTB domain containing 1
  ENSP ID: ENSP00000407131
  MOD_RES (1)..(1): Any amino acid
XETENMELKNKVQDLENQLRITQVSAPPAGSMTPKSPSTDIFDMIPFSPISHQSSMPTRNGTQPPPVPSRSTEIKRDLFGAEPFDPFNCGAADFPPDIQSKLDEMQVTILIDWPINDLFHFDMGQRECYVPKLWFPSIIFAIKTRLK

SEQ ID NO: 37033 - protein, 195 aa, Homo sapiens
  Payload ID: 7344
  Gene Symbol: GVQW1
  Gene Name: GVQW motif containing 1
  Uniprot ID: Q8N7I0
  ENSP ID: ENSP00000414891
MPNFLGLHRARSFTVLCFWSTADVLNASGPRRQWHPLASCSSWSRPQSQGSTPGVLCKTGMGREPIPETQCHFANSMCSLHVSVPYFGNSPNISNFFRWSLALSPRQWCDLGSLQPPSPRFKGFSCLSLPSSWDYRRAPSPANFCILVEMGFHHVGQADLELLTSADLPTSASQSAGITGVSHHAWPQTLSLLLY

SEQ ID NO: 37034 - protein, 108 aa, Homo sapiens
  Payload ID: 7345
  Gene Symbol: GVQW2
  Gene Name: GVQW motif containing 2
  ENSP ID: ENSP00000485629
MQYPFRKLLRPSTESCCVAQARVQWCHLGSLQPPLPGFKQFSCHSLPSSWDYRWNLTLSPRLECSGAISAHCNLCLPDLSDSPASTSRVAGTTGAHHHAQEPVVIRKM

SEQ ID NO: 37035 - protein, 522 aa, Homo sapiens
  Payload ID: 7346
  Gene Symbol: GIN1
  Gene Name: gypsy retrotransposon integrase 1
  Uniprot ID: Q9NXP7
  ENSP ID: ENSP00000381970
MVRSGKNGDLHLKQIAYYKRTGEYHSTTLPSERSGIRRAAKKFVFKEKKLFYVGKDRKQNRLVIVSEEEKKKVLRECHENDSGAHHGISRTLTLVESNYYWTSVTNDVKQWVYACQHCQVAKNTVIVAPKQHLLKVENPWSLVTVDLMGPFHTSNRSHVYAIIMTDLFTKWIVILPLCDVSASEVSKAIINIFFLYGPPQKIIMDQRDEFIQQINIELYRLFGIKQIVISHTSGTVNPTESTPNTIKAFLSKHCADHPNNWDDHLSAVSFAFNVTHLEPTKNTPYFQMFSRNPYMPETSDSLHEVDGDNTSMFAKILDAIKEADKIMENKTTSLGQMENNNLDELNKSKIIVKKKPKQLNPFHLKVGHEVLRQRKNWWKDGRFQSEWVGPCVIDYITESGCAVLRDNTGVRLKRPIKMSHLKPYIRESSEQESLYLLQGSVVADHDYIGLPEIPIGAYQANILVEDATIGIVDNELLTSSKDRELLEYRNTKISPLIDDHSSLEKQTFSLLDSSNQVLEYLS

SEQ ID NO: 37036 - protein, 80 aa, Homo sapiens
  Payload ID: 7346
  Gene Symbol: GIN1
  Gene Name: gypsy retrotransposon integrase 1
  Uniprot ID: Q9NXP7
  ENSP ID: ENSP00000422960
MVRSGKNGDLHLKQIAYYKRTGEYHSTTLPSERSGIRRAAKKFVFKGICLSALPSGKKYSYCSTETAPSQGGKSMEFSYC

SEQ ID NO: 37037 - protein, 80 aa, Homo sapiens; identical to SEQ ID NO: 37036
  Payload ID: 7346
  Gene Symbol: GIN1
  Gene Name: gypsy retrotransposon integrase 1
  Uniprot ID: Q9NXP7
  ENSP ID: ENSP00000423031

SEQ ID NO: 37038 - protein, 222 aa, Homo sapiens
  Payload ID: 7346
  Gene Symbol: GIN1
  Gene Name: gypsy retrotransposon integrase 1
  Uniprot ID: Q9NXP7
  ENSP ID: ENSP00000427162
MVRSGKNGDLHLKQIAYYKRTGEYHSTTLPSERSGIRRAAKKFVFKEKKLFYVGKDRKQNRLVIVSEEEKKKVLRECHENDSGAHHGISRTLTLVESNYYWTSVTNDVKQWVYACQHCQVAKNTVIVAPKQHLLKVENPWSLVTVDLMGPFHTSNRSHVYAIIMTDLFTKWIVILPLCDVSASEVSKAIINIFFLYGPPQKIIMDQRDEFIQQKVFISCKVQ

SEQ ID NO: 37039 - protein, 194 aa, Homo sapiens
  Payload ID: 7347
  Gene Symbol: H1F0
  Gene Name: H1 histone family, member 0
  Uniprot ID: P07305
  ENSP ID: ENSP00000344504
MTENSTSAPAAKPKRAKASKKSTDHPKYSDMIVAAIQAEKNRAGSSRQSIQKYIKSHYKVGENADSQIKLSIKRLVTTGVLKQTKGVGASGSFRLAKSDEPKKSVAFKKTKKEIKKVATPKKASKPKKAASKAPTKKPKATPVKKAKKKLAATPKKAKKPKTVKAKPVKASKPKKAKPVKPKAKSSAKRAGKKK

SEQ ID NO: 37040 - protein, 255 aa, Homo sapiens
  Payload ID: 7348
  Gene Symbol: H1FNT
  Gene Name: H1 histone family, member N, testis-specific
  Uniprot ID: Q75WM6
  ENSP ID: ENSP00000334805
MEQALTGEAQSRWPRRGGSGAMAEAPGPSGESRGHSATQLPAEKTVGGPSRGCSSSVLRVSQLVLQAISTHKGLTLAALKKELRNAGYEVRRKSGRHEAPRGQAKATLLRVSGSDAAGYFRVWKVPKPRRKPGRARQEEGTRAPWRTPAAPRSSRRRRQPLRKAARKAREVWRRNARAKAKANARARRTRRARPRAKEPPCARAKEEAGATAADEGRGQAVKEDTTPRSGKDKRRSSKPREEKQEPKKPAQRTIQ

SEQ ID NO: 37041 - protein, 346 aa, Homo sapiens
  Payload ID: 7349
  Gene Symbol: H1FOO
  Gene Name: H1 histone family, member O, oocyte-specific
  Uniprot ID: Q8IZA3
  ENSP ID: ENSP00000319799
MAPGSVTSDISPSSTSTAGSSRSPESEKPGPSHGGVPPGGPSHSSLPVGRRHPPVLRMVLEALQAGEQRRGTSVAAIKLYILHKYPTVDVLRFKYLLKQALATGMRRGLLARPLNSKARGATGSFKLVPKHKKKIQPRKMAPATAPRRAGEAKGKGPKKPSEAKEDPPNVGKVKKAAKRPAKVQKPPPKPGAATEKARKQGGAAKDTRAQSGEARKVPPKPDKAMRAPSSAGGLSRKAKAKGSRSSQGDAEAYRKTKAESKSSKPTASKVKNGAASPTKKKVVAKAKAPKAGQGPNTKAAAPAKGSGSKVVPAHLSRKTEAPKGPRKAGLPIKASSSKVSSQRAEA

SEQ ID NO: 37042 - protein, 207 aa, Homo sapiens
  Payload ID: 7349
  Gene Symbol: H1FOO
  Gene Name: H1 histone family, member O, oocyte-specific
  Uniprot ID: Q8IZA3
  ENSP ID: ENSP00000422964
MAPATAPRRAGEAKGKGPKKPSEAKEDPPNVGKVKKAAKRPAKVQKPPPKPGAATEKARKQGGAAKDTRAQSGEARKVPPKPDKAMRAPSSAGGLSRKAKAKGSRSSQGDAEAYRKTKAESKSSKPTASKVKNGAASPTKKKVVAKAKAPKAGQGPNTKAAAPAKGSGSKVVPAHLSRKTEAPKGPRKAGLPIKASSSKVSSQRAEA

SEQ ID NO: 37043 - protein, 213 aa, Homo sapiens
  Payload ID: 7350
  Gene Symbol: H1FX
  Gene Name: H1 histone family, member X
  Uniprot ID: Q92522
  ENSP ID: ENSP00000329662
MSVELEEALPVTTAEGMAKKVTKAGGSAALSPSKKRKNSKKKNQPGKYSQLVVETIRRLGERNGSSLAKIYTEAKKVPWFDQQNGRTYLKYSIKALVQNDTLLQVKGTGANGSFKLNRKKLEGGGERRGAPAAATAPAPTAHKAKKAAPGAAGSRRADKKPARGQKPEQRSHKKGAGAKKDKGGKAKKTAAAGGKKVKKAAKPSVPKVPKGRK

SEQ ID NO: 37044 - protein, 488 aa, Homo sapiens
  Payload ID: 7351
  Gene Symbol: HLX
  Gene Name: H2.0-like homeobox
  Uniprot ID: Q14774
  ENSP ID: ENSP00000355870
MFAAGLAPFYASNFSLWSAAYCSSAGPGGCSFPLDPAAVKKPSFCIADILHAGVGDLGAAPEGLAGASAAALTAHLGSVHPHASFQAAARSPLRPTPVVAPSEVPAGFPQRLSPLSAAYHHHHPQQQQQQQQPQQQQPPPPPRAGALQPPASGTRVVPNPHHSGSAPAPSSKDLKFGIDRILSAEFDPKVKEGNTLRDLTSLLTGGRPAGVHLSGLQPSAGQFFASLDPINEASAILSPLNSNPRNSVQHQFQDTFPGPYAVLTKDTMPQTYKRKRSWSRAVFSNLQRKGLEKRFEIQKYVTKPDRKQLAAMLGLTDAQVKVWFQNRRMKWRHSKEAQAQKDKDKEAGEKPSGGAPAADGEQDERSPSRSEGEAESESSDSESLDMAPSDTERTEGSERSLHQTTVIKAPVTGALITASSAGSGGSSGGGGNSFSFSSASSLSSSSTSAGCASSLGGGGASELLPATQPTASSAPKSPEPAQGALGCL

SEQ ID NO: 37045 - protein, 151 aa, Homo sapiens
  Payload ID: 7351
  Gene Symbol: HLX
  Gene Name: H2.0-like homeobox
  ENSP ID: ENSP00000408248
MPQTYKRKRSWSRAVFSNLQRKGLEKRFEIQKYVTKPDRKQLAAMLGLTDAQVKVWFQNRRMKWRHSKEAQAQKDKDKEAGEKPSGGAPAADGEQDERSPSRSEGEAESESSDSESLDMAPSDTERTEGSERSLHQTTVIKAPVTGALITA

SEQ ID NO: 37046 - protein, 115 aa, Homo sapiens
  Payload ID: 7352
  Gene Symbol: H2AFB1
  Gene Name: H2A histone family, member B1
  Uniprot ID: P0C5Y9
  ENSP ID: ENSP00000484261
MPRRRRRRGSSGAGGRGRTCSRTVRAELSFSVSQVERSLREGHYAQRLSRTAPVYLAAVIEYLTAKVPELAGNEAQNSGERNITPLLLDMVVHNDRLLSTLFNTTTISQVAPGED

SEQ ID NO: 37047 - protein, 115 aa, Homo sapiens
  Payload ID: 7353
  Gene Symbol: H2AFB2
  Gene Name: H2A histone family, member B2
  Uniprot ID: P0C5Z0
  ENSP ID: ENSP00000346509
MPRRRRRRGSSGAGGRGRTCSRTVRAELSFSVSQVERSLREGHYAQRLSRTAPVYLAAVIEYLTAKVLELAGNEAQNSGERNITPLLLDMVVHNDRLLSTLFNTTTISQVAPGED

SEQ ID NO: 37048 - protein, 115 aa, Homo sapiens; identical to SEQ ID NO: 37047
  Payload ID: 7354
  Gene Symbol: H2AFB3
  Gene Name: H2A histone family, member B3
  Uniprot ID: P0C5Z0
  ENSP ID: ENSP00000482564

SEQ ID NO: 37049 - protein, 129 aa, Homo sapiens
  Payload ID: 7355
  Gene Symbol: H2AFJ
  Gene Name: H2A histone family, member J
  Uniprot ID: Q9BTM1
  ENSP ID: ENSP00000373730
MSGRGKQGGKVRAKAKSRSSRAGLQFPVGRVHRLLRKGNYAERVGAGAPVYLAAVLEYLTAEILELAGNAARDNKKTRIIPRHLQLAIRNDEELNKLLGKVTIAQGGVLPNIQAVLLPKKTESQKTKSK

SEQ ID NO: 37050 - protein, 129 aa, Homo sapiens; identical to SEQ ID NO: 37049
  Payload ID: 7355
  Gene Symbol: H2AFJ
  Gene Name: H2A histone family, member J
  Uniprot ID: Q9BTM1
  ENSP ID: ENSP00000438553

SEQ ID NO: 37051 - protein, 92 aa, Homo sapiens
  Payload ID: 7355
  Gene Symbol: H2AFJ
  Gene Name: H2A histone family, member J
  ENSP ID: ENSP00000440902
GNYAERVGAGAPVYLAAVLEYLTAEILELAGNAARDNKKTRIIPRHLQLAIRNDEELNKLLGKVTIAQGGVLPNIQAVLLPKKTESQKTKSK

SEQ ID NO: 37052 - protein, 114 aa, Homo sapiens
  Payload ID: 7356
  Gene Symbol: H2AFV
  Gene Name: H2A histone family, member V
  Uniprot ID: Q71UI9
  ENSP ID: ENSP00000222690
MAGGKAGKDSGKAKAKAVSRSQRAGLQFPVGRIHRHLKTRTTSHGRVGATAAVYSAAILEYLTAEVLELAGNASKDLKVKRITPRHLQLAIRGDEELDSLIKATIAGGEKRRCS

SEQ ID NO: 37053 - protein, 128 aa, Homo sapiens
  Payload ID: 7356
  Gene Symbol: H2AFV
  Gene Name: H2A histone family, member V
  Uniprot ID: Q71UI9
  ENSP ID: ENSP00000308405
MAGGKAGKDSGKAKAKAVSRSQRAGLQFPVGRIHRHLKTRTTSHGRVGATAAVYSAAILEYLTAEVLELAGNASKDLKVKRITPRHLQLAIRGDEELDSLIKATIAGGGVIPHIHKSLIGKKGQQKTA

SEQ ID NO: 37054 - protein, 102 aa, Homo sapiens
  Payload ID: 7356
  Gene Symbol: H2AFV
  Gene Name: H2A histone family, member V
  Uniprot ID: Q71UI9
  ENSP ID: ENSP00000340708
MFPVGRIHRHLKTRTTSHGRVGATAAVYSAAILEYLTAEVLELAGNASKDLKVKRITPRHLQLAIRGDEELDSLIKATIAGGGVIPHIHKSLIGKKGQQKTA

SEQ ID NO: 37055 - protein, 90 aa, Homo sapiens
  Payload ID: 7356
  Gene Symbol: H2AFV
  Gene Name: H2A histone family, member V
  Uniprot ID: Q71UI9
  ENSP ID: ENSP00000342714
MAGGKAGKDSGKAKAKAVSRSQRAGLQVLELAGNASKDLKVKRITPRHLQLAIRGDEELDSLIKATIAGGGVIPHIHKSLIGKKGQQKTA

SEQ ID NO: 37056 - protein, 66 aa, Homo sapiens
  Payload ID: 7356
  Gene Symbol: H2AFV
  Gene Name: H2A histone family, member V
  Uniprot ID: Q71UI9
  ENSP ID: ENSP00000370516
MAGGKAGKDSGKAKAKAVSRSQRAGLQFPVGRIHRHLKTRTTSHGRVGATAAVYSAAILEYLTAEV

SEQ ID NO: 37057 - protein, 76 aa, Homo sapiens
  Payload ID: 7356
  Gene Symbol: H2AFV
  Gene Name: H2A histone family, member V
  ENSP ID: ENSP00000397115
MAGGKAGKDSGKAKAKAVSRSQRAGLQVLELAGNASKDLKVKRITPRHLQLAIRGDEELDSLIKATIAGGEKRRCS

SEQ ID NO: 37058 - protein, 122 aa, Homo sapiens
  Payload ID: 7356
  Gene Symbol: H2AFV
  Gene Name: H2A histone family, member V
  ENSP ID: ENSP00000406901
MAGGKAGKDSGKAKAKAVSRSQRAGLQFPVGRIHRHLKTRTTSHGRVGATAAVYSAAILEYLTAEVLELAGNASKDLKVKRITPRHLQLAIRGDEELDSLIKATIAGGGMYYYLSLDSYWSF

SEQ ID NO: 37059 - protein, 40 aa, Homo sapiens
  Payload ID: 7356
  Gene Symbol: H2AFV
  Gene Name: H2A histone family, member V
  ENSP ID: ENSP00000430492
MFPVGRIHRHLKTRTTSHGRVGATAAVYSAAILEYLTAEV

SEQ ID NO: 37060 - protein, 143 aa, Homo sapiens
  Payload ID: 7357
  Gene Symbol: H2AFX
  Gene Name: H2A histone family, member X
  Uniprot ID: P16104
  ENSP ID: ENSP00000364310
MSGRGKTGGKARAKAKSRSSRAGLQFPVGRVHRLLRKGHYAERVGAGAPVYLAAVLEYLTAEILELAGNAARDNKKTRIIPRHLQLAIRNDEELNKLLGGVTIAQGGVLPNIQAVLLPKKTSATVGPKAPSGGKKATQASQEY

SEQ ID NO: 37061 - protein, 143 aa, Homo sapiens; identical to SEQ ID NO: 37060
  Payload ID: 7357
  Gene Symbol: H2AFX
  Gene Name: H2A histone family, member X
  Uniprot ID: P16104
  ENSP ID: ENSP00000434024

SEQ ID NO: 37062 - protein, 371 aa, Homo sapiens
  Payload ID: 7358
  Gene Symbol: H2AFY
  Gene Name: H2A histone family, member Y
  Uniprot ID: O75367
  ENSP ID: ENSP00000302572
MSSRGGKKKSTKTSRSAKAGVIFPVGRMLRYIKKGHPKYRIGVGAPVYMAAVLEYLTAEILELAGNAARDNKKGRVTPRHILLAVANDEELNQLLKGVTIASGGVLPNIHPELLAKKRGSKGKLEAIITPPPAKKAKSPSQKKPVSKKAGGKKGARKSKKQGEVSKAASADSTTEGTPADGFTVLSTKSLFLGQKLNLIHSEISNLAGFEVEAIINPTNADIDLKDDLGNTLEKKGGKEFVEAVLELRKKNGPLEVAGAAVSAGHGLPAKFVIHCNSPVWGADKCEELLEKTVKNCLALADDKKLKSIAFPSIGSGRNGFPKQTAAQLILKAISSYFVSTMSSSIKTVYFVLFDSESIGIYVQEMAKLDAN

SEQ ID NO: 37063 - protein, 369 aa, Homo sapiens
  Payload ID: 7358
  Gene Symbol: H2AFY
  Gene Name: H2A histone family, member Y
  Uniprot ID: O75367
  ENSP ID: ENSP00000310169
MSSRGGKKKSTKTSRSAKAGVIFPVGRMLRYIKKGHPKYRIGVGAPVYMAAVLEYLTAEILELAGNAARDNKKGRVTPRHILLAVANDEELNQLLKGVTIASGGVLPNIHPELLAKKRGSKGKLEAIITPPPAKKAKSPSQKKPVSKKAGGKKGARKSKKKQGEVSKAASADSTTEGTPADGFTVLSTKSLFLGQKLQVVQADIASIDSDAVVHPTNTDFYIGGEVGNTLEKKGGKEFVEAVLELRKKNGPLEVAGAAVSAGHGLPAKFVIHCNSPVWGADKCEELLEKTVKNCLALADDKKLKSIAFPSIGSGRNGFPKQTAAQLILKAISSYFVSTMSSSIKTVYFVLFDSESIGIYVQEMAKLDAN

SEQ ID NO: 37064 - protein, 200 aa, Homo sapiens
  Payload ID: 7358
  Gene Symbol: H2AFY
  Gene Name: H2A histone family, member Y
  ENSP ID: ENSP00000415121
MSSRGGKKKSTKTSRSAKAGVIFPVGRMLRYIKKGHPKYRIGVGAPVYMAAVLEYLTGNTLEKKGGKEFVEAVLELRKKNGPLEVAGAAVSAGHGLPAKFVIHCNSPVWGADKCEELLEKTVKNCLALADDKKLKSIAFPSIGSGRNGFPKQTAAQLILKAISSYFVSTMSSSIKTVYFVLFDSESIGIYVQEMAKLDAN

SEQ ID NO: 37065 - protein, 372 aa, Homo sapiens
  Payload ID: 7358
  Gene Symbol: H2AFY
  Gene Name: H2A histone family, member Y
  Uniprot ID: O75367
  ENSP ID: ENSP00000423563
MSSRGGKKKSTKTSRSAKAGVIFPVGRMLRYIKKGHPKYRIGVGAPVYMAAVLEYLTAEILELAGNAARDNKKGRVTPRHILLAVANDEELNQLLKGVTIASGGVLPNIHPELLAKKRGSKGKLEAIITPPPAKKAKSPSQKKPVSKKAGGKKGARKSKKKQGEVSKAASADSTTEGTPADGFTVLSTKSLFLGQKLNLIHSEISNLAGFEVEAIINPTNADIDLKDDLGNTLEKKGGKEFVEAVLELRKKNGPLEVAGAAVSAGHGLPAKFVIHCNSPVWGADKCEELLEKTVKNCLALADDKKLKSIAFPSIGSGRNGFPKQTAAQLILKAISSYFVSTMSSSIKTVYFVLFDSESIGIYVQEMAKLDAN

SEQ ID NO: 37066 - protein, 165 aa, Homo sapiens
  Payload ID: 7358
  Gene Symbol: H2AFY
  Gene Name: H2A histone family, member Y
  ENSP ID: ENSP00000423718
MSSRGGKKKSTKTSRSAKAGVIFPVGRMLRYIKKGHPKYRIGVGAPVYMAAVLEYLTAEILELAGNAARDNKKGRVTPRHILLAVANDEELNQLLKGVTIASGGVLPNIHPELLAKKRGSKGKLEAIITPPPAKKAKSPSQKKPVSKKAGGKKGARKSKNSCTSK

SEQ ID NO: 37067 - protein, 372 aa, Homo sapiens; identical to SEQ ID NO: 37065
  Payload ID: 7358
  Gene Symbol: H2AFY
  Gene Name: H2A histone family, member Y
  Uniprot ID: O75367
  ENSP ID: ENSP00000424971

SEQ ID NO: 37068 - protein, 372 aa, Homo sapiens
  Payload ID: 7359
  Gene Symbol: H2AFY2
  Gene Name: H2A histone family, member Y2
  Uniprot ID: Q9P0M6
  ENSP ID: ENSP00000362352
MSGRSGKKKMSKLSRSARAGVIFPVGRLMRYLKKGTFKYRISVGAPVYMAAVIEYLAAEILELAGNAARDNKKARIAPRHILLAVANDEELNQLLKGVTIASGGVLPRIHPELLAKKRGTKGKSETILSPPPEKRGRKATSGKKGGKKSKAAKPRTSKKSKPKDSDKEGTSNSTSEDGPGDGFTILSSKSLVLGQKLSLTQSDISHIGSMRVEGIVHPTTAEIDLKEDIGKALEKAGGKEFLETVKELRKSQGPLEVAEAAVSQSSGLAAKFVIHCHIPQWGSDKCEEQLEETIKNCLSAAEDKKLKSVAFPPFPSGRNCFPKQTAAQVTLKAISAHFDDSSASSLKNVYFLLFDSESIGIYVQEMAKLDAK

SEQ ID NO: 37069 - protein, 242 aa, Homo sapiens
  Payload ID: 7359
  Gene Symbol: H2AFY2
  Gene Name: H2A histone family, member Y2
  ENSP ID: ENSP00000404584
MSGRSGKKKMSKLSRSARAGVIFPVGRLMRYLKKGTFKYRISVGAPVYMAAVIEYLAAEILELAGNAARDNKKARIAPRHILLAVANDEELNQSKPKDSDKEGTSNSTSEDGPGDGFTILSSKSLVLGQKLSLTQSDISHIGSMRVEGIVHPTTAEIDLKEDIGKALEKAGGKEFLETVKELRKSQGPLEVAEAAVSQSSGLAAKFVIHCHIPQWGSDKCEEQLEETIKNCLSAAEDKKLKS

SEQ ID NO: 37070 - protein, 128 aa, Homo sapiens
  Payload ID: 7360
  Gene Symbol: H2AFZ
  Gene Name: H2A histone family, member Z
  Uniprot ID: P0C0S5
  ENSP ID: ENSP00000296417
MAGGKAGKDSGKAKTKAVSRSQRAGLQFPVGRIHRHLKSRTTSHGRVGATAAVYSAAILEYLTAEVLELAGNASKDLKVKRITPRHLQLAIRGDEELDSLIKATIAGGGVIPHIHKSLIGKKGQQKTV

SEQ ID NO: 37071 - protein, 154 aa, Homo sapiens
  Payload ID: 7361
  Gene Symbol: H2BFM
  Gene Name: H2B histone family, member M
  Uniprot ID: P0C1H6
  ENSP ID: ENSP00000347119
MAAASAMAEASSETTSEEGQSIQEPKEANSTKAQKQKRRGCRGSRRRHANRRGDSFGDSFTPYFPRVLKQVHQGLSLSQEAVSVMDSMIHDILDRIATEAGQLAHYTKRVTITSRDIQMAVRLLLPGKMGKLAEAQGTNAALRTSLCAIWQQRK

SEQ ID NO: 37072 - protein, 52 aa, Homo sapiens
  Payload ID: 7361
  Gene Symbol: H2BFM
  Gene Name: H2B histone family, member M
  ENSP ID: ENSP00000402466
LAHYTKRVTITSRDIQMAVRLLLPGKMGKLAEAQGTNAALRTSLCAIWQQRK

SEQ ID NO: 37073 - protein, 154 aa, Homo sapiens; identical to SEQ ID NO: 37071
  Payload ID: 7361
  Gene Symbol: H2BFM
  Gene Name: H2B histone family, member M
  Uniprot ID: P0C1H6
  ENSP ID: ENSP00000482611

SEQ ID NO: 37074 - protein, 126 aa, Homo sapiens
  Payload ID: 7362
  Gene Symbol: H2BFS
  Gene Name: H2B histone family, member S (pseudogene)
  Uniprot ID: P57053
  ENSP ID: ENSP00000481622
MPEPAKSAPAPKKGSKKAVTKAQKKDGRKRKRSRKESYSVYVYKVLKQVHPDTGISSKAMGIMNSFVNDIFERIAGEASRLPHYNKRSTITSREIQTAVRLLLPGELAKHAVSEGTKAVTKYTSAK

SEQ ID NO: 37075 - protein, 175 aa, Homo sapiens
  Payload ID: 7363
  Gene Symbol: H2BFWT
  Gene Name: H2B histone family, member W, testis-specific
  Uniprot ID: Q7Z2G1
  ENSP ID: ENSP00000354723
MLRTEVPRLPRSTTAIVWSCHLMATASAMAGPSSETTSEEQLITQEPKEANSTTSQKQSKQRKRGRHGPRRCHSNCRGDSFATYFRRVLKQVHQGLSLSREAVSVMDSLVHDILDRIATEAGHLARSTKRQTITAWETRMAVRLLLPGQMGKLAESEGTKAVLRTSLYAIQQQRK

SEQ ID NO: 37076 - protein, 175 aa, Homo sapiens; identical to SEQ ID NO: 37075
  Payload ID: 7363
  Gene Symbol: H2BFWT
  Gene Name: H2B histone family, member W, testis-specific
  Uniprot ID: Q7Z2G1
  ENSP ID: ENSP00000482103

SEQ ID NO: 37077 - protein, 136 aa, Homo sapiens
  Payload ID: 7364
  Gene Symbol: H3F3A
  Gene Name: H3 histone, family 3A
  Uniprot ID: P84243
  ENSP ID: ENSP00000355778
MARTKQTARKSTGGKAPRKQLATKAARKSAPSTGGVKKPHRYRPGTVALREIRRYQKSTELLIRKLPFQRLVREIAQDFKTDLRFQSAAIGALQEASEAYLVGLFEDTNLCAIHAKRVTIMPKDIQLARRIRGERA

SEQ ID NO: 37078 - protein, 123 aa, Homo sapiens
  Payload ID: 7364
  Gene Symbol: H3F3A
  Gene Name: H3 histone, family 3A
  ENSP ID: ENSP00000355779
MARTKQTARKSTGGKAPRKQLATKAARKSAPSTGGVKKPHRYRPGTVALREIRRYQKSTELLIRKLPFQRLVREIAQDFKTDLRFQSAAIGALQVKWWVGRLRVCIPVVYQEQFQIVACAYII

SEQ ID NO: 37079 - protein, 136 aa, Homo sapiens; identical to SEQ ID NO: 37077
  Payload ID: 7364
  Gene Symbol: H3F3A
  Gene Name: H3 histone, family 3A
  Uniprot ID: P84243
  ENSP ID: ENSP00000355780

SEQ ID NO: 37080 - protein, 136 aa, Homo sapiens; identical to SEQ ID NO: 37077
  Payload ID: 7364
  Gene Symbol: H3F3A
  Gene Name: H3 histone, family 3A
  Uniprot ID: P84243
  ENSP ID: ENSP00000355781

SEQ ID NO: 37081 - protein, 136 aa, Homo sapiens; identical to SEQ ID NO: 37077
  Payload ID: 7365
  Gene Symbol: H3F3B
  Gene Name: H3 histone, family 3B (H3.3B)
  Uniprot ID: P84243
  ENSP ID: ENSP00000254810

SEQ ID NO: 37082 - protein, 132 aa, Homo sapiens
  Payload ID: 7365
  Gene Symbol: H3F3B
  Gene Name: H3 histone, family 3B (H3.3B)
  ENSP ID: ENSP00000465403
MARTKQTARKSTGGKAPRKQLATKAARKSAPSTGGVKKPHRYRPGTVALREIRRYQKSTELLIRKLPFQRLVREIAQDFKTDLRFQSAAIGALQEASEAYLVGLFEDTNLCAIHAKRVTIMPKDIQLARRIR

SEQ ID NO: 37083 - protein, 136 aa, Homo sapiens; identical to SEQ ID NO: 37077
  Payload ID: 7365
  Gene Symbol: H3F3B
  Gene Name: H3 histone, family 3B (H3.3B)
  Uniprot ID: P84243
  ENSP ID: ENSP00000465813

SEQ ID NO: 37084 - protein, 136 aa, Homo sapiens; identical to SEQ ID NO: 37077
  Payload ID: 7365
  Gene Symbol: H3F3B
  Gene Name: H3 histone, family 3B (H3.3B)
  Uniprot ID: P84243
  ENSP ID: ENSP00000466020

SEQ ID NO: 37085 - protein, 92 aa, Homo sapiens
  Payload ID: 7365
  Gene Symbol: H3F3B
  Gene Name: H3 histone, family 3B (H3.3B)
  ENSP ID: ENSP00000466663
MARTKQTARKSTGGKAPRKQLATKAARKSAPSTGGVKKPHRYRPGTVALREIRRYQKSTELLIRKLPFQRLVREIAQDFKTDLRFQSAAIGG

SEQ ID NO: 37086 - protein, 113 aa, Homo sapiens
  Payload ID: 7365
  Gene Symbol: H3F3B
  Gene Name: H3 histone, family 3B (H3.3B)
  ENSP ID: ENSP00000467165
MARTKQTARKSTGGKAPRKQLATKAARKSAPSTGGVKKPHRYRPGTVALREIRRYQKSTELLIRKLPFQRRLAKRTWWVCSKIPTCVPSTLRESPSCPKTSSWLAGYGERELK

SEQ ID NO: 37087 - protein, 151 aa, Homo sapiens
  Payload ID: 7365
  Gene Symbol: H3F3B
  Gene Name: H3 histone, family 3B (H3.3B)
  ENSP ID: ENSP00000468484
MARTKQTARKSTGGKAPRKQLATKAARKSAPSTGGVKKPHRYRPGTVALREIRRYQKSTELLIRKLPFQRLVREIAQDFKTDLRFQSAAIGALQVRQRPGAGGGLGGFRSPSGINSAALVLNRRLAKRTWWVCSKIPTCVPSTLRESPSCP

SEQ ID NO: 37088 - protein, 136 aa, Homo sapiens; identical to SEQ ID NO: 37077
  Payload ID: 7365
  Gene Symbol: H3F3B
  Gene Name: H3 histone, family 3B (H3.3B)
  Uniprot ID: P84243
  ENSP ID: ENSP00000468714

SEQ ID NO: 37089 - protein, 135 aa, Homo sapiens
  Payload ID: 7366
  Gene Symbol: H3F3C
  Gene Name: H3 histone, family 3C
  Uniprot ID: Q6NXT2
  ENSP ID: ENSP00000339835
MARTKQTARKSTGGKAPRKQLATKAARKSTPSTCGVKPHRYRPGTVALREIRRYQKSTELLIRKLPFQRLVREIAQDFNTDLRFQSAAVGALQEASEAYLVGLLEDTNLCAIHAKRVTIMPKDIQLARRIRGERA

SEQ ID NO: 37090 - protein, 348 aa, Homo sapiens
  Payload ID: 7367
  Gene Symbol: HMX1
  Gene Name: H6 family homeobox 1
  Uniprot ID: Q9NP08
  ENSP ID: ENSP00000383516
MPDELTEPGRATPARASSFLIENLLAAEAKGAGRATQGDGSREDEEEDDDDPEDEDAEQARRRRLQRRRQLLAGTGPGGEARARALLGPGALGLGPRPPPGPGPPFALGCGGAARWYPRAHGGYGGGLSPDTSDRDSPETGEEMGRAEGAWPRGPGPGAVQREAAELAARGPAAGTEEASELAEVPAAAGETRGGVGVGGGRKKKTRTVFSRSQVFQLESTFDLKRYLSSAERAGLAASLQLTETQVKIWFQNRRNKWKRQLAAELEAASLSPPGAQRLVRVPVLYHESPPAAAAAGPPATLPFPLAPAAPAPPPPLLGFSGALAYPLAAFPAAASVPFLRAQMPGLV

SEQ ID NO: 37091 - protein, 190 aa, Homo sapiens
  Payload ID: 7367
  Gene Symbol: HMX1
  Gene Name: H6 family homeobox 1
  ENSP ID: ENSP00000446997
MPDELTEPGRATPARASSFLIENLLAAEAKGAGRATQGDGSREDEEEDDDDPEDEDAEQARRRRLQRRRQLLAGTGPGGEARARALLGPGALGLGPRPPPGPGPPFALGCGGAARWYPRAHGGYGGGLSPDSTQKITPQPVQCGEGQVTRADKYKVNRSDSGSLWMAEEAAGTGWCSHNTVEPLSAWTPE

SEQ ID NO: 37092 - protein, 373 aa, Homo sapiens
  Payload ID: 7367
  Gene Symbol: HMX1
  Gene Name: H6 family homeobox 1
  ENSP ID: ENSP00000479086
MPDELTEPGRATPARASSFLIENLLAAEAKGAGRDPGRRQPGGRGGGRRRPRRRGRRAGRRRRLQRRRQLLAGTGPGGEARAVAARAGALGLGPRPPPGPGPPFALGCGGAARWYPRAHGGYGGGLSPDTSDRDSPETGEEMGRAEGAWPRGPGRSGAAGGSGAGGAWPGGRHGGGSELAEVPAAAGETRGGVGVGGGRKKKTRTVFSRSQVFQLESTFDLKRYLSSAERAGLAASLQLTETQVKIWFQNRRNKWKRQLAAELEAASLSPPGAQAWSACRCSTTKAPRPQPPLGPRPPCPSRWPARPRRPHRCSASPGPSPTRWPPSRPPPPCPFCGRRCLAWCEPRLPGPLPTTLWTCVDARSAAGAGLRGR

SEQ ID NO: 37093 - protein, 273 aa, Homo sapiens
  Payload ID: 7368
  Gene Symbol: HMX2
  Gene Name: H6 family homeobox 2
  Uniprot ID: A2RU54
  ENSP ID: ENSP00000341108
MGSKEDAGKGCPAAGGVSSFTIQSILGGGPSEAPREPVGWPARKRSLSVSSEEEEPDDGWKAPACFCPDQHGPKEQGPKHHPPIPFPCLGTPKGSGGSGPGGLERTPFLSPSHSDFKEEKERLLPAGSPSPGSERPRDGGAERQAGAAKKKTRTVFSRSQVYQLESTFDMKRYLSSSERACLASSLQLTETQVKTWFQNRRNKWKRQLSAELEAANMAHASAQTLVSMPLVFRDSSLLRVPVPRSLAFPAPLYYPGSNLSALPLYNLYNKLDY

SEQ ID NO: 37094 - protein, 357 aa, Homo sapiens
  Payload ID: 7369
  Gene Symbol: HMX3
  Gene Name: H6 family homeobox 3
  Uniprot ID: A6NHT5
  ENSP ID: ENSP00000350549
MPEPGPDAAGTASAQPQPPPPPPPAPKESPFSIKNLLNGDHHRPPPKPQPPPRTLFAPASAAAAAAAAAAAAAKGALEGAAGFALSQVGDLAFPRFEIPAQRFALPAHYLERSPAWWYPYTLTPAGGHLPRPEASEKALLRDSSPASGTDRDSPEPLLKADPDHKELDSKSPDEIILEESDSEESKKEGEAAPGAAGASVGAAAATPGAEDWKKGAESPEKKPACRKKKTRTVFSRSQVFQLESTFDMKRYLSSSERAGLAASLHLTETQVKIWFQNRRNKWKRQLAAELEAANLSHAAAQRIVRVPILYHENSAAEGAAAAAAGAPVPVSQPLLTFPHPVYYSHPVVSSVPLLRPV

SEQ ID NO: 37095 - protein, 1134 aa, Homo sapiens
  Payload ID: 7370
  Gene Symbol: HR
  Gene Name: hair growth associated
  Uniprot ID: O43593
  ENSP ID: ENSP00000326765
MESTPSFLKGTPTWEKTAPENGIVRQEPGSPPRDGLHHGPLCLGEPAPFWRGVLSTPDSWLPPGFPQGPKDMLPLVEGEGPQNGERKVNWLGSKEGLRWKEAMLTHPLAFCGPACPPRCGPLMPEHSGGHLKSDPVAFRPWHCPFLLETKILERAPFWVPTCLPPYLVSGLPPEHPCDWPLTPHPWVYSGGQPKVPSAFSLGSKGFYYKDPSIPRLAKEPLAAAEPGLFGLNSGGHLQRAGEAERPSLHQRDGEMGAGRQQNPCPLFLGQPDTVPWTSWPACPPGLVHTLGNVWAGPGDGNLGYQLGPPATPRCPSPEPPVTQRGCCSSYPPTKGGGLGPCGKCQEGLEGGASGASEPSEEVNKASGPRACPPSHHTKLKKTWLTRHSEQFECPRGCPEVEERPVARLRALKRAGSPEVQGAMGSPAPKRPPDPFPGTAEQGAGGWQEVRDTSIGNKDVDSGQHDEQKGPQDGQASLQDPGLQDIPCLALPAKLAQCQSCAQAAGEGGGHACHSQQVRRSPLGGELQQEEDTATNSSSEEGPGSGPDSRLSTGLAKHLLSGLGDRLCRLLRREREALAWAQREGQGPAVTEDSPGIPRCCSRCHHGLFNTHWRCPRCSHRLCVACGRVAGTGRAREKAGFQEQSAEECTQEAGHAACSLMLTQFVSSQALAELSTAMHQVWVKFDIRGHCPCQADARVWAPGDAGQQKESTQKTPPTPQPSCNGDTHRTKSIKEETPDSAETPAEDRAGRGPLPCPSLCELLASTAVKLCLGHERIHMAFAPVTPALPSDDRITNILDSIIAQVVERKIQEKALGPGLRAGPGLRKGLGLPLSPVRPRLPPPGALLWLQEPQPCPRRGFHLFQEHWRQGQPVLVSGIQRTLQGNLWGTEALGALGGQVQALSPLGPPQPSSLGSTTFWEGFSWPELRPKSDEGSVLLLHRALGDEDTSRVENLAASLPLPEYCALHGKLNLASYLPPGLALRPLEPQLWAAYGVSPHRGHLGTKNLCVEVADLVSILVHADTPLPAWHRAQKDFLSGLDGEGLWSPGSQVSTVWHVFRAQDAQRIRRFLQMVQGLVSTVSVTQHFLSPETSALSAQLCHQGPSLPPDCHLLYAQMDWAVFQAVKVAVGTLQEAK

SEQ ID NO: 37096 - protein, 1189 aa, Homo sapiens
  Payload ID: 7370
  Gene Symbol: HR
  Gene Name: hair growth associated
  Uniprot ID: O43593
  ENSP ID: ENSP00000370826
MESTPSFLKGTPTWEKTAPENGIVRQEPGSPPRDGLHHGPLCLGEPAPFWRGVLSTPDSWLPPGFPQGPKDMLPLVEGEGPQNGERKVNWLGSKEGLRWKEAMLTHPLAFCGPACPPRCGPLMPEHSGGHLKSDPVAFRPWHCPFLLETKILERAPFWVPTCLPPYLVSGLPPEHPCDWPLTPHPWVYSGGQPKVPSAFSLGSKGFYYKDPSIPRLAKEPLAAAEPGLFGLNSGGHLQRAGEAERPSLHQRDGEMGAGRQQNPCPLFLGQPDTVPWTSWPACPPGLVHTLGNVWAGPGDGNLGYQLGPPATPRCPSPEPPVTQRGCCSSYPPTKGGGLGPCGKCQEGLEGGASGASEPSEEVNKASGPRACPPSHHTKLKKTWLTRHSEQFECPRGCPEVEERPVARLRALKRAGSPEVQGAMGSPAPKRPPDPFPGTAEQGAGGWQEVRDTSIGNKDVDSGQHDEQKGPQDGQASLQDPGLQDIPCLALPAKLAQCQSCAQAAGEGGGHACHSQQVRRSPLGGELQQEEDTATNSSSEEGPGSGPDSRLSTGLAKHLLSGLGDRLCRLLRREREALAWAQREGQGPAVTEDSPGIPRCCSRCHHGLFNTHWRCPRCSHRLCVACGRVAGTGRAREKAGFQEQSAEECTQEAGHAACSLMLTQFVSSQALAELSTAMHQVWVKFDIRGHCPCQADARVWAPGDAGQQKESTQKTPPTPQPSCNGDTHRTKSIKEETPDSAETPAEDRAGRGPLPCPSLCELLASTAVKLCLGHERIHMAFAPVTPALPSDDRITNILDSIIAQVVERKIQEKALGPGLRAGPGLRKGLGLPLSPVRPRLPPPGALLWLQEPQPCPRRGFHLFQEHWRQGQPVLVSGIQRTLQGNLWGTEALGALGGQVQALSPLGPPQPSSLGSTTFWEGFSWPELRPKSDEGSVLLLHRALGDEDTSRVENLAASLPLPEYCALHGKLNLASYLPPGLALRPLEPQLWAAYGVSPHRGHLGTKNLCVEVADLVSILVHADTPLPAWHRAQKDFLSGLDGEGLWSPGSQVSTVWHVFRAQDAQRIRRFLQMVCPAGAGALEPGAPGSCYLDAGLRRRLREEWGVSCWTLLQAPGEAVLVPAGAPHQVQGLVSTVSVTQHFLSPETSALSAQLCHQGPSLPPDCHLLYAQMDWAVFQAVKVAVGTLQEAK

SEQ ID NO: 37097 - protein, 54 aa, Homo sapiens
  Payload ID: 7370
  Gene Symbol: HR
  Gene Name: hair growth associated
  ENSP ID: ENSP00000430413
  MOD_RES (1)..(1): Any amino acid
XTQEAGHAACSLMLTQFVSSQEGINTENAPNSTTFLQWRHPQDQEHQRGDPRFR

SEQ ID NO: 37098 - protein, 259 aa, Homo sapiens
  Payload ID: 7371
  Gene Symbol: HDHD2
  Gene Name: haloacid dehalogenase-like hydrolase domain containing 2
  Uniprot ID: Q9H0R4
  ENSP ID: ENSP00000300605
MAACRALKAVLVDLSGTLHIEDAAVPGAQEALKRLRGASVIIRFVTNTTKESKQDLLERLRKLEFDISEDEIFTSLTAARSLLERKQVRPMLLVDDRALPDFKGIQTSDPNAVVMGLAPEHFHYQILNQAFRLLLDGAPLIAIHKARYYKRKDGLALGPGPFVTALEYATDTKATVVGKPEKTFFLEALRGTGCEPEEAVMIGDDCRDDVGGAQDVGMLGILVKTGKYRASDEEKINPPPYLTCESFPHAVDHILQHLL

SEQ ID NO: 37099 - protein, 122 aa, Homo sapiens
  Payload ID: 7371
  Gene Symbol: HDHD2
  Gene Name: haloacid dehalogenase-like hydrolase domain containing 2
  ENSP ID: ENSP00000465282
MAACRALKAVLVDLSGTLHIEDAAVPGAQEALKRFVTNTTKESKQDLLERLRKLEFDISEDEIFTSLTAARSLLERKQVRPMLLVDDRALPDFKGIQTSDPNAVVMGLAPEHFHYQILNQAF

SEQ ID NO: 37100 - protein, 54 aa, Homo sapiens
  Payload ID: 7371
  Gene Symbol: HDHD2
  Gene Name: haloacid dehalogenase-like hydrolase domain containing 2
  ENSP ID: ENSP00000465829
MAACRALKAVLVDLSGTLHIEDAAVPGAQEALKRQAILQVQLTNMFVTWCFCNH

SEQ ID NO: 37101 - protein, 54 aa, Homo sapiens; identical to SEQ ID NO: 37100
  Payload ID: 7371
  Gene Symbol: HDHD2
  Gene Name: haloacid dehalogenase-like hydrolase domain containing 2
  ENSP ID: ENSP00000466602

SEQ ID NO: 37102 - protein, 146 aa, Homo sapiens
  Payload ID: 7371
  Gene Symbol: HDHD2
  Gene Name: haloacid dehalogenase-like hydrolase domain containing 2
  ENSP ID: ENSP00000466710
MAACRALKAVLVDLSGTLHIEDAAVPGAQEALKRFVTNTTKESKQDLLERLRKLEFDISEDEIFTSLTAARSLLERKQVRPMLLVDDRALPDFKGIQTSDPNAVVMGLAPEHFHYQILNQAFRLLLDGAPLIAIHKARYYKRKDGL

SEQ ID NO: 37103 - protein, 131 aa, Homo sapiens
  Payload ID: 7371
  Gene Symbol: HDHD2
  Gene Name: haloacid dehalogenase-like hydrolase domain containing 2
  ENSP ID: ENSP00000466923
MAACRALKAVLVDLSGTLHIEDAAVPGAQEALKRLRGASVIIRFVTNTTKESKQDLLERLRKLEFDISEDEIFTSLTAARSLLERKQVRPMLLVDDRALPDFKGIQTSDPNAVVMGLAPEHFHYQILNQAF

SEQ ID NO: 37104 - protein, 54 aa, Homo sapiens; identical to SEQ ID NO: 37100
  Payload ID: 7371
  Gene Symbol: HDHD2
  Gene Name: haloacid dehalogenase-like hydrolase domain containing 2
  ENSP ID: ENSP00000467309

SEQ ID NO: 37105 - protein, 132 aa, Homo sapiens
  Payload ID: 7371
  Gene Symbol: HDHD2
  Gene Name: haloacid dehalogenase-like hydrolase domain containing 2
  ENSP ID: ENSP00000467775
MAACRALKAVLVDLSGTLHIEDAAVPGAQEALKRLRGASVIIRFVTNTTKESKQDLLERLRKLEFDISEDEIFTSLTAARSLLERKQVRPMLLVDDRALPDFKGIQTSDPNAVVMGLAPEHFHYQILNQAFR

SEQ ID NO: 37106 - protein, 132 aa, Homo sapiens; identical to SEQ ID NO: 37105
  Payload ID: 7371
  Gene Symbol: HDHD2
  Gene Name: haloacid dehalogenase-like hydrolase domain containing 2
  ENSP ID: ENSP00000467998

SEQ ID NO: 37107 - protein, 204 aa, Homo sapiens
  Payload ID: 7371
  Gene Symbol: HDHD2
  Gene Name: haloacid dehalogenase-like hydrolase domain containing 2
  ENSP ID: ENSP00000468067
MAACRALKAVLVDLSGTLHIEDAAVPGAQEALKRLRGASVIIRFVTNTTKESKQDLLERLRKLEFDISEDEIFTSLTAARSLLERKQVRPMLLVDDRALPDFKGIQTSDPNAVVMGLAPEHFHYQILNQAFRLLLDGAPLIAIHKARYYKRKDGLALGPGPFVTALEYATDTKATVVGKPEKTFFLEALRGTGCEPEEAVMIGD

SEQ ID NO: 37108 - protein, 251 aa, Homo sapiens
  Payload ID: 7372
  Gene Symbol: HDHD3
  Gene Name: haloacid dehalogenase-like hydrolase domain containing 3
  Uniprot ID: Q9BSH5
  ENSP ID: ENSP00000238379
MAHRLQIRLLTWDVKDTLLRLRHPLGEAYATKARAHGLEVEPSALEQGFRQAYRAQSHSFPNYGLSHGLTSRQWWLDVVLQTFHLAGVQDAQAVAPIAEQLYKDFSHPCTWQVLDGAEDTLRECRTRGLRLAVISNFDRRLEGILGGLGLREHFDFVLTSEAAGWPKPDPRIFQEALRLAHMEPVVAAHVGDNYLCDYQGPRAVGMHSFLVVGPQALDPVVRDSVPKEHILPSLAHLLPALDCLEGSTPGL

SEQ ID NO: 37109 - protein, 251 aa, Homo sapiens; identical to SEQ ID NO: 37108
  Payload ID: 7372
  Gene Symbol: HDHD3
  Gene Name: haloacid dehalogenase-like hydrolase domain containing 3
  Uniprot ID: Q9BSH5
  ENSP ID: ENSP00000363295

SEQ ID NO: 37110 - protein, 281 aa, Homo sapiens
  Payload ID: 7373
  Gene Symbol: HP
  Gene Name: haptoglobin
  ENSP ID: ENSP00000228226
MSRISQMTAARSPPRLHMAMWSTRFATSVRTNPVQRILGGHLDAKGSFPWQAKMVSHHNLTTGATLINEQWLLTTAKNLFLNHSENATAKDIAPTLTLYVGKKQLVEIEKVVLHPNYSQVDIGLIKLKQKVSVNERVMPICLPSKDYAEVGRVGYVSGWGRNANFKFTDHLKYVMLPVADQDQCIRHYEGSTVPEKKTPKSPVGVQPILNEHTFCAGMSKYQEDTCYGDAGSAFAVHDLEEDTWYATGILSFDKSCAVAEYGVYVKVTSIQDWVQKTIAEN

SEQ ID NO: 37111 - protein, 406 aa, Homo sapiens
  Payload ID: 7373
  Gene Symbol: HP
  Gene Name: haptoglobin
  Uniprot ID: P00738
  ENSP ID: ENSP00000348170
MSALGAVIALLLWGQLFAVDSGNDVTDIADDGCPKPPEIAHGYVEHSVRYQCKNYYKLRTEGDGVYTLNDKKQWINKAVGDKLPECEADDGCPKPPEIAHGYVEHSVRYQCKNYYKLRTEGDGVYTLNNEKQWINKAVGDKLPECEAVCGKPKNPANPVQRILGGHLDAKGSFPWQAKMVSHHNLTTGATLINEQWLLTTAKNLFLNHSENATAKDIAPTLTLYVGKKQLVEIEKVVLHPNYSQVDIGLIKLKQKVSVNERVMPICLPSKDYAEVGRVGYVSGWGRNANFKFTDHLKYVMLPVADQDQCIRHYEGSTVPEKKTPKSPVGVQPILNEHTFCAGMSKYQEDTCYGDAGSAFAVHDLEEDTWYATGILSFDKSCAVAEYGVYVKVTSIQDWVQKTIAEN

SEQ ID NO: 37112 - protein, 442 aa, Homo sapiens
  Payload ID: 7373
  Gene Symbol: HP
  Gene Name: haptoglobin
  ENSP ID: ENSP00000350406
MSALGAVIALLLWGQLFAVDSGNDVTDIADDGCPKPPEIAHGYVEHSVRYQCKNYYKLRTEGDGVYTLNDKKQWINKAVGDKLPECEADDGCPKPPEIAHGYVEHSVRYQCKNYYKLRTEGDGEAMPCSLPHVNLRVTFTSPADVGKEGMLMMMSPSPRVYTLNNEKQWINKAVGDKLPECEAVCGKPKNPANPVQRILGGHLDAKGSFPWQAKMVSHHNLTTGATLINEQWLLTTAKNLFLNHSENATAKDIAPTLTLYVGKKQLVEIEKVVLHPNYSQVDIGLIKLKQKVSVNERVMPICLPSKDYAEVGRVGYVSGWGRNANFKFTDHLKYVMLPVADQDQCIRHYEGSTVPEKKTPKSPVGVQPILNEHTFCAGMSKYQEDTCYGDAGSAFAVHDLEEDTWYATGILSFDKSCAVAEYGVYVKVTSIQDWVQKTIAEN

SEQ ID NO: 37113 - protein, 347 aa, Homo sapiens
  Payload ID: 7373
  Gene Symbol: HP
  Gene Name: haptoglobin
  Uniprot ID: P00738
  ENSP ID: ENSP00000381199
MSALGAVIALLLWGQLFAVDSGNDVTDIADDGCPKPPEIAHGYVEHSVRYQCKNYYKLRTEGDGVYTLNNEKQWINKAVGDKLPECEAVCGKPKNPANPVQRILGGHLDAKGSFPWQAKMVSHHNLTTGATLINEQWLLTTAKNLFLNHSENATAKDIAPTLTLYVGKKQLVEIEKVVLHPNYSQVDIGLIKLKQKVSVNERVMPICLPSKDYAEVGRVGYVSGWGRNANFKFTDHLKYVMLPVADQDQCIRHYEGSTVPEKKTPKSPVGVQPILNEHTFCAGMSKYQEDTCYGDAGSAFAVHDLEEDTWYATGILSFDKSCAVAEYGVYVKVTSIQDWVQKTIAEN

SEQ ID NO: 37114 - protein, 92 aa, Homo sapiens
  Payload ID: 7373
  Gene Symbol: HP
  Gene Name: haptoglobin
  ENSP ID: ENSP00000454413
MSALGAVIALLLWGQLFAVDSGNDVTDIADDGCPKPPEIAHGYVEHSVRYQCKNYYKLRTEGDGVYTLNNEKQWINKAVGDKLPECEAAHTE

SEQ ID NO: 37115 - protein, 347 aa, Homo sapiens
  Payload ID: 7373
  Gene Symbol: HP
  Gene Name: haptoglobin
  ENSP ID: ENSP00000454966
MSALGAVIALLLWGQLFAVDSGNDVTDIADDGCPKPPEIAHGYVEHSVRYQCKNYYKLRTEGDGVYTLNDKKQWINKAVGDKLPECEAVCGKPKNPANPVQRILGGHLDAKGSFPWQAKMVSHHNLTTGATLINEQWLLTTAKNLFLNHSENATAKDIAPTLTLYVGKKQLVEIEKVVLHPNYSQVDIGLIKLKQKVSVNERVMPICLPSKDYAEVGRVGYVSGWGRNANFKFTDHLKYVMLPVADQDQCIRHYEGSTVPEKKTPKSPVGVQPILNEHTFCAGMSKYQEDTCYGDAGSAFAVHDLEEDTWYATGILSFDKSCAVAEYGVYVKVTSIQDWVQKTIAEN

SEQ ID NO: 37116 - protein, 222 aa, Homo sapiens
  Payload ID: 7373
  Gene Symbol: HP
  Gene Name: haptoglobin
  ENSP ID: ENSP00000456503
MSALGAVIALLLWGQLFAVDSGNDVTDIADDGCPKPPEIAHGYVEHSVRYQCKNYYKLRTEGDGVYTLNNEKQWINKAVGDKLPECEAGATLINEQWLLTTAKNLFLNHSENATAKDIAPTLTLYVGKKQLVEIEKVVLHPNYSQVDIGLIKLKQKVSVNERVMPICLPSKDYAEVGRVGYVSGWGRNANFKFTDHLKYVMLPVADQDQCIRHYEGSTVPEK

SEQ ID NO: 37117 - protein, 347 aa, Homo sapiens; identical to SEQ ID NO: 37113
  Payload ID: 7373
  Gene Symbol: HP
  Gene Name: haptoglobin
  Uniprot ID: P00738
  ENSP ID: ENSP00000457629

SEQ ID NO: 37118 - protein, 149 aa, Homo sapiens
  Payload ID: 7373
  Gene Symbol: HP
  Gene Name: haptoglobin
  ENSP ID: ENSP00000461999
  MOD_RES (1)..(1): Any amino acid
XALGAVIALLLWGQLFAVDSGNDVTDIADDGCPKPPEIAHGYVEHSVRYQCKNYYKLRTEGDGVYTLNDKKQWINKAVGDKLPECEADDGCPKPPEIAHGYVEHSVRYQCKNYYKLRTEGDGVYTLNNEKQWINKAVGDKLPECEAGGC

SEQ ID NO: 37119 - protein, 88 aa, Homo sapiens
  Payload ID: 7373
  Gene Symbol: HP
  Gene Name: haptoglobin
  ENSP ID: ENSP00000462662
MSALGAVIALLLWGQLFAVDSGNDVTDIADDGCPKPPEIAHGYVEHSVRYQCKNYYKLRTEGDGVYTLNNEKQWINKAVGDKLPECEA

SEQ ID NO: 37120 - protein, 365 aa, Homo sapiens
  Payload ID: 7373
  Gene Symbol: HP
  Gene Name: haptoglobin
  ENSP ID: ENSP00000463491
  MOD_RES (1)..(1): Any amino acid
XALGAVIALLLWGQLFAVDSGNDVTDIADDGCPKPPEIAHGYVEHSVRYQCKNYYKLRTEGDGVYTLNDKKQWINKAVGDKLPECEADDGCPKPPEIAHGYVEHSVRYQCKNYYKLRTEGDGVYTLNNEKQWINKAVGDKLPECEAGATLINEQWLLTTAKNLFLNHSENATAKDIAPTLTLYVGKKQLVEIEKVVLHPNYSQVDIGLIKLKQKVSVNERVMPICLPSKDYAEVGRVGYVSGWGRNANFKFTDHLKYVMLPVADQDQCIRHYEGSTVPEKKTPKSPVGVQPILNEHTFCAGMSKYQEDTCYGDAGSAFAVHDLEEDTWYATGILSFDKSCAVAEYGVYVKVTSIQDWVQKTIAEN

SEQ ID NO: 37121 - protein, 91 aa, Homo sapiens
  Payload ID: 7373
  Gene Symbol: HP
  Gene Name: haptoglobin
  ENSP ID: ENSP00000463755
MSALGAVIALLLWGQLFAVDSGNDVTDIADDGCPKPPEIAHGYVEHSVRYQCKNYYKLRTEGDGVYTLNNEKQWINKAVGDKLPECEAGGC

SEQ ID NO: 37122 - protein, 404 aa, Homo sapiens
  Payload ID: 7373
  Gene Symbol: HP
  Gene Name: haptoglobin
  ENSP ID: ENSP00000464070
  MOD_RES (1)..(1): Any amino acid
XALGAVIALLLWGQLFAVDSGNDVTDIADDGCPKPPEIAHGYVEHSVRYQCKNYYKLRTEGDGVYTLNDKKQWINKAVGDKLPECEADDGCPKPPEIAHGYVEHSVRYQCKNYYKLRTEGDVYTLNNEKQWINKAVGDKLPECEAVCGKPKNPANPVQRILGGHLDAKGSFPWQAKMVSHHNLTTGATLINEQWLLTTAKNLFLNHSENATAKDIAPTLTLYVGKKQLVEIEKVVLHPNYSQVDIGLIKLKQKVSVNERVMPICLPSKDYAEVGRVGYVSGWGRNANFKFTDHLKYVMLPVADQDQCIRHYEGSTVPEKKTPKSPVGVQPILNEHTFCAGMSKYQEDTCYGDAGSAFAVHDLEEDTWYATGILSFDKSCAVAEYGVYVKVTSIQDWVQKTIAEN

SEQ ID NO: 37123 - protein, 281 aa, Homo sapiens; identical to SEQ ID NO: 37110
  Payload ID: 7373
  Gene Symbol: HP
  Gene Name: haptoglobin
  ENSP ID: ENSP00000478279

SEQ ID NO: 37124 - protein, 281 aa, Homo sapiens
  Payload ID: 7374
  Gene Symbol: HPR
  Gene Name: haptoglobin-related protein
  ENSP ID: ENSP00000349451
MSRIFQMTASRSPLRLQMAMWSTCFATSVRTNPVQRILGGHLDAKGSFPWQAKMVSHHNLTTGATLINEQWLLTTAKNLFLNHSENATAKDIAPTLTLYVGKKQLVEIEKVVLHPNYHQVDIGLIKLKQKVLVNERVMPICLPSKNYAEVGRVGYVSGWGQSDNFKLTDHLKYVMLPVADQYDCITHYEGSTCPKWKAPKSPVGVQPILNEHTFCVGMSKYQEDTCYGDAGSAFAVHDLEEDTWYAAGILSFDKSCAVAEYGVYVKVTSIQHWVQKTIAEN

SEQ ID NO: 37125 - protein, 348 aa, Homo sapiens
  Payload ID: 7374
  Gene Symbol: HPR
  Gene Name: haptoglobin-related protein
  Uniprot ID: P00739
  ENSP ID: ENSP00000441828
MSDLGAVISLLLWGRQLFALYSGNDVTDISDDRFPKPPEIANGYVEHLFRYQCKNYYRLRTEGDGVYTLNDKKQWINKAVGDKLPECEAVCGKPKNPANPVQRILGGHLDAKGSFPWQAKMVSHHNLTTGATLINEQWLLTTAKNLFLNHSENATAKDIAPTLTLYVGKKQLVEIEKVVLHPNYHQVDIGLIKLKQKVLVNERVMPICLPSKNYAEVGRVGYVSGWGQSDNFKLTDHLKYVMLPVADQYDCITHYEGSTCPKWKAPKSPVGVQPILNEHTFCVGMSKYQEDTCYGDAGSAFAVHDLEEDTWYAAGILSFDKSCAVAEYGVYVKVTSIQHWVQKTIAEN

SEQ ID NO: 37126 - protein, 117 aa, Homo sapiens
  Payload ID: 7374
  Gene Symbol: HPR
  Gene Name: haptoglobin-related protein
  ENSP ID: ENSP00000462916
MSDLGAVISLLLWGRQLFALYSGNDVTDISDDRFPKPPEIANGYVEHLFRYQCKNYYRLRTEGDGVYTLNDKKQWINKAVGDKLPECEAVCGKPKNPANPVQRILGGHLVRGWDPKL

SEQ ID NO: 37127 - protein, 91 aa, Homo sapiens
  Payload ID: 7375
  Gene Symbol: HRK
  Gene Name: harakiri, BCL2 interacting protein
  Uniprot ID: O00198
  ENSP ID: ENSP00000257572
MCPCPLHRGRGPPAVCACSAGRLGLRSSAAQLTAARLKALGDELHQRTMWRRRARSRRAPAPGALPTYWPWLCAAAQVAALAAWLLGRRNL

SEQ ID NO: 37128 - protein, 18 aa, Homo sapiens
  Payload ID: 7375
  Gene Symbol: HRK
  Gene Name: harakiri, BCL2 interacting protein
  ENSP ID: ENSP00000465379
AAAQVAALAAWLLGRRNL

SEQ ID NO: 37129 - protein, 349 aa, Homo sapiens
  Payload ID: 7376
  Gene Symbol: HARBI1
  Gene Name: harbinger transposase derived 1
  Uniprot ID: Q96MB7
  ENSP ID: ENSP00000317743
MAIPITVLDCDLLLYGRGHRTLDRFKLDDVTDEYLMSMYGFPRQFIYYLVELLGANLSRPTQRSRAISPETQVLAALGFYTSGSFQTRMGDAIGISQASMSRCVANVTEALVERASQFIRFPADEASIQALKDEFYGLAGMPGVMGVVDCIHVAIKAPNAEDLSYVNRKGLHSLNCLMVCDIRGTLMTVETNWPGSLQDCAVLQQSSLSSQFEAGMHKDSWLLGDSSFFLRTWLMTPLHIPETPAEYRYNMAHSATHSVIEKTFRTLCSRFRCLDGSKGALQYSPEKSSHIILACCVLHNISLEHGMDVWSSPMTGPMEQPPEEEYEHMESLDLEADRIRQELMLTHFS

SEQ ID NO: 37130 - protein, 75 aa, Homo sapiens
  Payload ID: 7376
  Gene Symbol: HARBI1
  Gene Name: harbinger transposase derived 1
  ENSP ID: ENSP00000431697
MAIPITVLDCDLLLYGRGHRTLDRFKLDDVTDEYLMSMYGFPRQFIYYLVELLGANLSRPTQRSRAISPETQVLA

SEQ ID NO: 37131 - protein, 42 aa, Homo sapiens
  Payload ID: 7376
  Gene Symbol: HARBI1
  Gene Name: harbinger transposase derived 1
  ENSP ID: ENSP00000436232
MAIPITVLDCDLLLYGRGHRTLDRFKLDDVTDEYLMSMYGFP

SEQ ID NO: 37132 - protein, 189 aa, Homo sapiens
  Payload ID: 7377
  Gene Symbol: HRAS
  Gene Name: Harvey rat sarcoma viral oncogene homolog
  Uniprot ID: P01112
  ENSP ID: ENSP00000309845
MTEYKLVVVGAGGVGKSALTIQLIQNHFVDEYDPTIEDSYRKQVVIDGETCLLDILDTAGQEEYSAMRDQYMRTGEGFLCVFAINNTKSFEDIHQYREQIKRVKDSDDVPMVLVGNKCDLAARTVESRQAQDLARSYGIPYIETSAKTRQGVEDAFYTLVREIRQHKLRKLNPPDESGPGCMSCKCVLS

SEQ ID NO: 37133 - protein, 170 aa, Homo sapiens
  Payload ID: 7377
  Gene Symbol: HRAS
  Gene Name: Harvey rat sarcoma viral oncogene homolog
  Uniprot ID: P01112
  ENSP ID: ENSP00000380722
MTEYKLVVVGAGGVGKSALTIQLIQNHFVDEYDPTIEDSYRKQVVIDGETCLLDILDTAGQEEYSAMRDQYMRTGEGFLCVFAINNTKSFEDIHQYREQIKRVKDSDDVPMVLVGNKCDLAARTVESRQAQDLARSYGIPYIETSAKTRQGSRSGSSSSSGTLWDPPGPM

SEQ ID NO: 37134 - protein, 189 aa, Homo sapiens; identical to SEQ ID NO: 37132
  Payload ID: 7377
  Gene Symbol: HRAS
  Gene Name: Harvey rat sarcoma viral oncogene homolog
  Uniprot ID: P01112
  ENSP ID: ENSP00000380723

SEQ ID NO: 37135 - protein, 170 aa, Homo sapiens; identical to SEQ ID NO: 37133
  Payload ID: 7377
  Gene Symbol: HRAS
  Gene Name: Harvey rat sarcoma viral oncogene homolog
  Uniprot ID: P01112
  ENSP ID: ENSP00000388246

SEQ ID NO: 37136 - protein, 189 aa, Homo sapiens; identical to SEQ ID NO: 37132
  Payload ID: 7377
  Gene Symbol: HRAS
  Gene Name: Harvey rat sarcoma viral oncogene homolog
  Uniprot ID: P01112
  ENSP ID: ENSP00000407586

SEQ ID NO: 37137 - protein, 170 aa, Homo sapiens; identical to SEQ ID NO: 37133
  Payload ID: 7377
  Gene Symbol: HRAS
  Gene Name: Harvey rat sarcoma viral oncogene homolog
  Uniprot ID: P01112
  ENSP ID: ENSP00000434023

SEQ ID NO: 37138 - protein, 170 aa, Homo sapiens; identical to SEQ ID NO: 37133
  Payload ID: 7377
  Gene Symbol: HRAS
  Gene Name: Harvey rat sarcoma viral oncogene homolog
  Uniprot ID: P01112
  ENSP ID: ENSP00000480317

SEQ ID NO: 37139 - protein, 189 aa, Homo sapiens; identical to SEQ ID NO: 37132
  Payload ID: 7377
  Gene Symbol: HRAS
  Gene Name: Harvey rat sarcoma viral oncogene homolog
  Uniprot ID: P01112
  ENSP ID: ENSP00000480686

SEQ ID NO: 37140 - protein, 189 aa, Homo sapiens; identical to SEQ ID NO: 37132
  Payload ID: 7377
  Gene Symbol: HRAS
  Gene Name: Harvey rat sarcoma viral oncogene homolog
  Uniprot ID: P01112
  ENSP ID: ENSP00000482366

SEQ ID NO: 37141 - protein, 170 aa, Homo sapiens; identical to SEQ ID NO: 37133
  Payload ID: 7377
  Gene Symbol: HRAS
  Gene Name: Harvey rat sarcoma viral oncogene homolog
  Uniprot ID: P01112
  ENSP ID: ENSP00000488225

SEQ ID NO: 37142 - protein, 170 aa, Homo sapiens; identical to SEQ ID NO: 37133
  Payload ID: 7377
  Gene Symbol: HRAS
  Gene Name: Harvey rat sarcoma viral oncogene homolog
  Uniprot ID: P01112
  ENSP ID: ENSP00000488296

SEQ ID NO: 37143 - protein, 14 aa, Homo sapiens
  Payload ID: 7377
  Gene Symbol: HRAS
  Gene Name: Harvey rat sarcoma viral oncogene homolog
  ENSP ID: ENSP00000488397
MTEYKLVVVGAGGV

SEQ ID NO: 37144 - protein, 189 aa, Homo sapiens; identical to SEQ ID NO: 37132
  Payload ID: 7377
  Gene Symbol: HRAS
  Gene Name: Harvey rat sarcoma viral oncogene homolog
  Uniprot ID: P01112
  ENSP ID: ENSP00000488757

SEQ ID NO: 37145 - protein, 278 aa, Homo sapiens
  Payload ID: 7378
  Gene Symbol: HAUS1
  Gene Name: HAUS augmin-like complex, subunit 1
  Uniprot ID: Q96CS2
  ENSP ID: ENSP00000282058
MEPQEERETQVAAWLKKIFGDHPIPQYEVNPRTTEILHHLSERNRVRDRDVYLVIEDLKQKASEYESEAKYLQDLLMESVNFSPANLSSTGSRYLNALVDSAVALETKDTSLASFIPAVNDLTSDLFRTKSKSEEIKIELEKLEKNLTATLVLEKCLQEDVKKAELHLSTERAKVDNRRQNMDFLKAKSEEFRFGIKAAEEQLSARGMDASLSHQSLVALSEKLARLKQQTIPLKKKLESYLDLMPNPSLAQVKIEEAKRELDSIEAELTRRVDMMEL

SEQ ID NO: 37146 - protein, 80 aa, Homo sapiens
  Payload ID: 7378
  Gene Symbol: HAUS1
  Gene Name: HAUS augmin-like complex, subunit 1
  ENSP ID: ENSP00000465093
MEPQEERETQVAAWLKKIFGDHPIPQYEVNPRTTEILHHLSERNRVRDRDVYLVIEDLKQKASEYESEGEIKSRVLNENK

SEQ ID NO: 37147 - protein, 71 aa, Homo sapiens
  Payload ID: 7378
  Gene Symbol: HAUS1
  Gene Name: HAUS augmin-like complex, subunit 1
  ENSP ID: ENSP00000465492
MEPQEERETQVAAWLKKIFGDHPIPQYEVNPRTTEILHHLSERNRVRDRDVYLVIEDLKQKASEYESEVFF

SEQ ID NO: 37148 - protein, 94 aa, Homo sapiens
  Payload ID: 7378
  Gene Symbol: HAUS1
  Gene Name: HAUS augmin-like complex, subunit 1
  ENSP ID: ENSP00000465622
  MOD_RES (1)..(1): Any amino acid
XEERETQVAAWLKKIFGDHPIPQYEVNPRTTEILHHLSERNRVRDRDVYLVIEDLKQKASEYESEESCSVAQAGVLWCDLSSLQPPPLGFKQFS

SEQ ID NO: 37149 - protein, 94 aa, Homo sapiens
  Payload ID: 7378
  Gene Symbol: HAUS1
  Gene Name: HAUS augmin-like complex, subunit 1
  ENSP ID: ENSP00000466364
MEPQEERETQVAAWLKKIFGDHPIPQYEVNPRTTEILHHLSERNRVRDRDVYLVIEDLKQKASEYESEGMSRKQSCICLQKGPKLIIVVRTWTF

SEQ ID NO: 37150 - protein, 94 aa, Homo sapiens; identical to SEQ ID NO: 37149
  Payload ID: 7378
  Gene Symbol: HAUS1
  Gene Name: HAUS augmin-like complex, subunit 1
  ENSP ID: ENSP00000466715

SEQ ID NO: 37151 - protein, 123 aa, Homo sapiens
  Payload ID: 7378
  Gene Symbol: HAUS1
  Gene Name: HAUS augmin-like complex, subunit 1
  ENSP ID: ENSP00000467975
MEPQEERETQVAAWLKKIFGDHPIPQYEVNPRTTEILHHLSERNRVRDRDVYLVIEDLKQKASEYESEGATFSQRHGCFSVSSVLSSTIRETGKIKATDYTFEEKIGVLFRLNAESVSCSSEN

SEQ ID NO: 37152 - protein, 107 aa, Homo sapiens
  Payload ID: 7378
  Gene Symbol: HAUS1
  Gene Name: HAUS augmin-like complex, subunit 1
  ENSP ID: ENSP00000468575
MEPQEERETQVNPRTTEILHHLSERNRVRDRDVYLVIEDLKQKASEYESEAKYLQDLLMESVNFSPANLSSTGSRYLNALVDSAVALETKDTSLASFIPAVNDLTSD

SEQ ID NO: 37153 - protein, 235 aa, Homo sapiens
  Payload ID: 7379
  Gene Symbol: HAUS2
  Gene Name: HAUS augmin-like complex, subunit 2
  Uniprot ID: Q9NVX0
  ENSP ID: ENSP00000260372
MAAANPWDPASAPNGAGLVLGHFIASGMVNQEMLNMSKKTVSCFVNFTRLQQITNIQAEIYQKNLEIELLKLEKDTADVVHPFFLAQKCHTLQSMNNHLEAVLKEKRSLRQRLLKPMCQENLPIEAVYHRYMVHLLELAVTFIERLETHLETIRNIPHLAANLKKMNQALAKMDILVTETEELAENILKWRKQQNEVSSCIPKILAEESYLYKHDIIMPPLPFTSKVHVQTINAK

SEQ ID NO: 37154 - protein, 93 aa, Homo sapiens
  Payload ID: 7379
  Gene Symbol: HAUS2
  Gene Name: HAUS augmin-like complex, subunit 2
  ENSP ID: ENSP00000390445
MAAANPWDPASAPNGAGLVLGHFIASGMVNQKNLEIELLKLEKDTADVVHPFFLEMKSCYVAQAGLELMASILPFQSPKTLRLQLRSVILCKA

SEQ ID NO: 37155 - protein, 124 aa, Homo sapiens
  Payload ID: 7379
  Gene Symbol: HAUS2
  Gene Name: HAUS augmin-like complex, subunit 2
  ENSP ID: ENSP00000455104
MAAANPWDPASAPNGAGLVLGHFIASGMVNQEMLNMSKKTVSCFVNFTRLQQITNIQAEIYQKNLEIELLKLEKDTADVVHPFFLEMKSCYVAQAGLELMASILPFQSPKTLRLQLRSVILCKA

SEQ ID NO: 37156 - protein, 95 aa, Homo sapiens
  Payload ID: 7379
  Gene Symbol: HAUS2
  Gene Name: HAUS augmin-like complex, subunit 2
  ENSP ID: ENSP00000455118
MAAANPWDPASAPNGAGLVLGHFIASGMVNQEMLNMSKKTVSCFVNFTRLQQITNIQAEIYQKNLEIELLKLEKDTADVVHPFFLDIWYICWSWL

SEQ ID NO: 37157 - protein, 180 aa, Homo sapiens
  Payload ID: 7379
  Gene Symbol: HAUS2
  Gene Name: HAUS augmin-like complex, subunit 2
  ENSP ID: ENSP00000455942
MAAANPWDPASAPNGAGLVLGHFIASGMVNQEMLNMSKKTVSCFVNFTRLQQITNIQAEIYQKNLEIELLKLEKDTADVVHPFFLEMKSCYVAQAGLELMASILPFQSPKTLRLQKCHTLQSMNNHLEAVLKEKRSLRQRLLKPMCQENLPIEAVYHRYMVHLLELAVTFIERLETHLET

SEQ ID NO: 37158 - protein, 71 aa, Homo sapiens
  Payload ID: 7379
  Gene Symbol: HAUS2
  Gene Name: HAUS augmin-like complex, subunit 2
  ENSP ID: ENSP00000456054
MAAANPWDPASAPNGAGLVLGHFIASGMVNQEMLNMSKKTVSCFVNFTRLQQITNIQAEIYQLRSVILCKA

SEQ ID NO: 37159 - protein, 204 aa, Homo sapiens
  Payload ID: 7379
  Gene Symbol: HAUS2
  Gene Name: HAUS augmin-like complex, subunit 2
  Uniprot ID: Q9NVX0
  ENSP ID: ENSP00000456578
MAAANPWDPASAPNGAGLVLGHFIASGMVNQKNLEIELLKLEKDTADVVHPFFLAQKCHTLQSMNNHLEAVLKEKRSLRQRLLKPMCQENLPIEAVYHRYMVHLLELAVTFIERLETHLETIRNIPHLAANLKKMNQALAKMDILVTETEELAENILKWRKQQNEVSSCIPKILAEESYLYKHDIIMPPLPFTSKVHVQTINAK

SEQ ID NO: 37160 - protein, 63 aa, Homo sapiens
  Payload ID: 7379
  Gene Symbol: HAUS2
  Gene Name: HAUS augmin-like complex, subunit 2
  ENSP ID: ENSP00000457169
MAAANPWDPASAPNGAGLVLGHFIASGMVNQEMLNMSKKTVSCFVNFTRLQQITNIQAEIYQR

SEQ ID NO: 37161 - protein, 93 aa, Homo sapiens; identical to SEQ ID NO: 37154
  Payload ID: 7379
  Gene Symbol: HAUS2
  Gene Name: HAUS augmin-like complex, subunit 2
  ENSP ID: ENSP00000475743

SEQ ID NO: 37162 - protein, 55 aa, Homo sapiens
  Payload ID: 7379
  Gene Symbol: HAUS2
  Gene Name: HAUS augmin-like complex, subunit 2
  ENSP ID: ENSP00000475909
DVVHPFFLAQKCHTLQSMNNHLEAVLKEKRSLRQRLLKPMCQENLPIEAVYHRLD

SEQ ID NO: 37163 - protein, 603 aa, Homo sapiens
  Payload ID: 7380
  Gene Symbol: HAUS3
  Gene Name: HAUS augmin-like complex, subunit 3
  Uniprot ID: Q68CZ6
  ENSP ID: ENSP00000243706
MSCGNEFVETLKKIGYPKADNLNGEDFDWLFEGVEDESFLKWFCGNVNEQNVLSERELEAFSILQKSGKPILEGAALDEALKTCKTSDLKTPRLDDKELEKLEDEVQTLLKLKNLKIQRRNKCQLMASVTSHKSLRLNAKEEEATKKLKQSQGILNAMITKISNELQALTDEVTQLMMFFRHSNLGQGTNPLVFLSQFSLEKYLSQEEQSTAALTLYTKKQFFQGIHEVVESSNEDNFQLLDIQTPSICDNQEILEERRLEMARLQLAYICAQHQLIHLKASNSSMKSSIKWAEESLHSLTSKAVDKENLDAKISSLTSEIMKLEKEVTQIKDRSLPAVVRENAQLLNMPVVKGDFDLQIAKQDYYTARQELVLNQLIKQKASFELLQLSYEIELRKHRDIYRQLENLVQELSQSNMMLYKQLEMLTDPSVSQQINPRNTIDTKDYSTHRLYQVLEGENKKKELFLTHGNLEEVAEKLKQNISLVQDQLAVSAQEHSFFLSKRNKDVDMLCDTLYQGGNQLLLSDQELTEQFHKVESQLNKLNHLLTDILADVKTKRKTLANNKLHQMEREFYVYFLKDEDYLKDIVENLETQSKIKAVSLED

SEQ ID NO: 37164 - protein, 603 aa, Homo sapiens; identical to SEQ ID NO: 37163
  Payload ID: 7380
  Gene Symbol: HAUS3
  Gene Name: HAUS augmin-like complex, subunit 3
  Uniprot ID: Q68CZ6
  ENSP ID: ENSP00000392903

SEQ ID NO: 37165 - protein, 33 aa, Homo sapiens
  Payload ID: 7380
  Gene Symbol: HAUS3
  Gene Name: HAUS augmin-like complex, subunit 3
  ENSP ID: ENSP00000423285
MSCGNEFVETLKKIGYPKADNLNGEDFDWLFEG

SEQ ID NO: 37166 - protein, 489 aa, Homo sapiens
  Payload ID: 7380
  Gene Symbol: HAUS3
  Gene Name: HAUS augmin-like complex, subunit 3
  Uniprot ID: Q68CZ6
  ENSP ID: ENSP00000427350
MSCGNEFVETLKKIGYPKADNLNGEDFDWLFEGVEDESFLKWFCGNVNEQNVLSERELEAFSILQKSGKPILEGAALDEALKTCKTSDLKTPRLDDKELEKLEDEVQTLLKLKNLKIQRRNKCQLMASVTSHKSLRLNAKEEEATKKLKQSQGILNAMITKISNELQALTDEVTQLMMFFRHSNLGQGTNPLVFLSQFSLEKYLSQEEQSTAALTLYTKKQFFQGIHEVVESSNEDNFQLLDIQTPSICDNQEILEERRLEMARLQLAYICAQHQLIHLKASNSSMKSSIKWAEESLHSLTSKAVDKENLDAKISSLTSEIMKLEKEVTQIKDRSLPAVVRENAQLLNMPVVKGDFDLQIAKQDYYTARQELVLNQLIKQKASFELLQLSYEIELRKHRDIYRQLENLVQELSQSNMMLYKQLEMLTDPSVSQQINPRNTIDTKDYSTHRLYQVLEGENKKKELFLTHGNLEEVAEAGEWHEPRRRGLQ

SEQ ID NO: 37167 - protein, 10 aa, Homo sapiens
  Payload ID: 7380
  Gene Symbol: HAUS3
  Gene Name: HAUS augmin-like complex, subunit 3
  ENSP ID: ENSP00000427356
MSCGNEFVET

SEQ ID NO: 37168 - protein, 363 aa, Homo sapiens
  Payload ID: 7381
  Gene Symbol: HAUS4
  Gene Name: HAUS augmin-like complex, subunit 4
  Uniprot ID: Q9H6D7
  ENSP ID: ENSP00000206474
MASGDFCSPGEGMEILQQVCSKQLPPCNLSKEDLLQNPYFSKLLLNLSQHVDESGLSLTLAKEQAQAWKEVRLHKTTWLRSEILHRVIQELLVDYYVKIQDTNVTSEDKKFHETLEQRLLVTELMRLLGPSQEREIPPLLGLEKADLLELMPLSEDFVWMRARLQQEVEEQLKKKCFTLLCYYDPNSDADSETVKAAKVWKLAEVLVGEQQQCQDAKSQQKEQMLLLEKKSAAYSQVLLRCLTLLQRLLQEHRLKTQSELDRINAQYLEVKCGAMILKLRMEELKILSDTYTVEKVEVHRLIRDRLEGAIHLQEQDMENSRQVLNSYEVLGEEFDRLVKEYTVLKQATENKRWALQEFSKVYR

SEQ ID NO: 37169 - protein, 318 aa, Homo sapiens
  Payload ID: 7381
  Gene Symbol: HAUS4
  Gene Name: HAUS augmin-like complex, subunit 4
  Uniprot ID: Q9H6D7
  ENSP ID: ENSP00000342776
MASGDFCSPGEGMEILQQVCSKQLPPCNLSKEDLLQNPYFSKLLLNLSQHVDESGLSLTLAKEQAQAWKEVRLHKTTWLRSEILHRVIQELLVDYYVKIQDTNVTSEDKKDFVWMRARLQQEVEEQLKKKCFTLLCYYDPNSDADSETVKAAKVWKLAEVLVGEQQQCQDAKSQQKEQMLLLEKKSAAYSQVLLRCLTLLQRLLQEHRLKTQSELDRINAQYLEVKCGAMILKLRMEELKILSDTYTVEKVEVHRLIRDRLEGAIHLQEQDMENSRQVLNSYEVLGEEFDRLVKEYTVLKQATENKRWALQEFSKVYR

SEQ ID NO: 37170 - protein, 237 aa, Homo sapiens
  Payload ID: 7381
  Gene Symbol: HAUS4
  Gene Name: HAUS augmin-like complex, subunit 4
  Uniprot ID: Q9H6D7
  ENSP ID: ENSP00000343473
MASGDFCSPGEGMEILQQVCSKQLPPCNLSKEDLLQNPYFSKLLLNLSQHVDESGLSLTLAKEQAQAWKEVRLHKTTWLRSEILHRVIQELLVDYYVKIQDTNVTSEDKKVLLRCLTLLQRLLQEHRLKTQSELDRINAQYLEVKCGAMILKLRMEELKILSDTYTVEKVEVHRLIRDRLEGAIHLQEQDMENSRQVLNSYEVLGEEFDRLVKEYTVLKQATENKRWALQEFSKVYR

SEQ ID NO: 37171 - protein, 363 aa, Homo sapiens; identical to SEQ ID NO: 37168
  Payload ID: 7381
  Gene Symbol: HAUS4
  Gene Name: HAUS augmin-like complex, subunit 4
  Uniprot ID: Q9H6D7
  ENSP ID: ENSP00000441026

SEQ ID NO: 37172 - protein, 144 aa, Homo sapiens
  Payload ID: 7381
  Gene Symbol: HAUS4
  Gene Name: HAUS augmin-like complex, subunit 4
  ENSP ID: ENSP00000450542
HRVIQELLVDYYVKIQDTNVTSEDKKFHETLEQRLLVTELMRLLGPSQEREIPPLLGLEKADLLELMPLSEDFVWMRARLQQEVEEQLKKKCFTLLCYYDPNSGASPLPHFAAEASSRTPAEDSIRARPHQCPVPGSQVRCYDP

SEQ ID NO: 37173 - protein, 147 aa, Homo sapiens
  Payload ID: 7381
  Gene Symbol: HAUS4
  Gene Name: HAUS augmin-like complex, subunit 4
  ENSP ID: ENSP00000450612
  MOD_RES (1)..(1): Any amino acid
XCSKQLPPCNLSKEDLLQNPYFSKLLLNLSQHVDESGLSLTLAKEQAQAWKEVRLHKTTWLRSEILHRVIQELLVDYYVKIQDTNVTSEDKKFHETLEQRLLVTELMRLLGPSQEREIPPLLGLEKADLLELMPLSEVGGEILEPNK

SEQ ID NO: 37174 - protein, 17 aa, Homo sapiens
  Payload ID: 7381
  Gene Symbol: HAUS4
  Gene Name: HAUS augmin-like complex, subunit 4
  ENSP ID: ENSP00000450680
MRLLGPSQEREIPPLLG

SEQ ID NO: 37175 - protein, 318 aa, Homo sapiens; identical to SEQ ID NO: 37169
  Payload ID: 7381
  Gene Symbol: HAUS4
  Gene Name: HAUS augmin-like complex, subunit 4
  Uniprot ID: Q9H6D7
  ENSP ID: ENSP00000451018

SEQ ID NO: 37176 - protein, 160 aa, Homo sapiens
  Payload ID: 7381
  Gene Symbol: HAUS4
  Gene Name: HAUS augmin-like complex, subunit 4
  ENSP ID: ENSP00000452058
MASGDFCSPGEGMEILQQVCSKQLPPCNLSKEDLLQNPYFSKLLLNLSQHVDESGLSLTLAKEQAQAWKEVRLHKTTWLRSEILHRVIQELLVDYYVKIQDTNVTSEDKKFHETLEQRLLVTELMRLLGPSQEREIPPLLGLEKADLLELMPLSEDFVWM

SEQ ID NO: 37177 - protein, 279 aa, Homo sapiens
  Payload ID: 7381
  Gene Symbol: HAUS4
  Gene Name: HAUS augmin-like complex, subunit 4
  ENSP ID: ENSP00000452165
MASGDFCSPGEGMEILQQVCSKQLPPCNLSKEDLLQNPYFSKLLLNLSQHVDESGLSLTLAKEQAQAWKEVRLHKTTWLRSEILHRVIQELLVDYYVKIQDTNVTSEDKKFHETLEQRLLVTELMRLLGPSQEREIPPLLGLEKADLLELMPLSEDFVWMRARLQQEVEEQLKKKCFTLLCYYDPNSDADSETVKAAKVWKLAEVLVGEQQQCQDAKSQQKEQMLLLEKKSAAYSQVLLRCLTLLQRLLQEHRLKTQSELDRINAQYLEVKCGAMILKL

SEQ ID NO: 37178 - protein, 318 aa, Homo sapiens; identical to SEQ ID NO: 37169
  Payload ID: 7381
  Gene Symbol: HAUS4
  Gene Name: HAUS augmin-like complex, subunit 4
  Uniprot ID: Q9H6D7
  ENSP ID: ENSP00000452239

SEQ ID NO: 37179 - protein, 239 aa, Homo sapiens
  Payload ID: 7381
  Gene Symbol: HAUS4
  Gene Name: HAUS augmin-like complex, subunit 4
  Uniprot ID: Q9H6D7
  ENSP ID: ENSP00000452260
MRLLGPSQEREIPPLLGLEKADLLELMPLSEDFVWMRARLQQEVEEQLKKKCFTLLCYYDPNSDADSETVKAAKVWKLAEVLVGEQQQCQDAKSQQKEQMLLLEKKSAAYSQVLLRCLTLLQRLLQEHRLKTQSELDRINAQYLEVKCGAMILKLRMEELKILSDTYTVEKVEVHRLIRDRLEGAIHLQEQDMENSRQVLNSYEVLGEEFDRLVKEYTVLKQATENKRWALQEFSKVYR

SEQ ID NO: 37180 - protein, 187 aa, Homo sapiens
  Payload ID: 7381
  Gene Symbol: HAUS4
  Gene Name: HAUS augmin-like complex, subunit 4
  ENSP ID: ENSP00000452261
MASGDFCSPGEGMEILQQVCSKQLPPCNLSKEDLLQNPYFSKLLLNLSQHVDESGLSLTLAKEQAQAWKEVRLHKTTWLRSEILHRVIQELLVDYYVKIQDTNVTSEDKKFHETLEQRLLVTELMRLLGPSQEREIPPLLGLEKADLLELMPLSEDFVWMRARLQQEVEEQLKKKCFTLLCYYDPNS

SEQ ID NO: 37181 - protein, 152 aa, Homo sapiens
  Payload ID: 7381
  Gene Symbol: HAUS4
  Gene Name: HAUS augmin-like complex, subunit 4
  ENSP ID: ENSP00000452595
MASGDFCSPGEGMEILQQVCSKQLPPCNLSKEDLLQNPYFSKLLLNLSQHVDESGLSLTLAKEQAQAWKEVRLHKTTWLRSEILHRVIQELLVDYYVKIQDTNVTSEDKKDFVWMRARLQQEVEEQLKKKCFTLLCYYDPNSGASPLPHFAA

SEQ ID NO: 37182 - protein, 633 aa, Homo sapiens
  Payload ID: 7382
  Gene Symbol: HAUS5
  Gene Name: HAUS augmin-like complex, subunit 5
  Uniprot ID: O94927
  ENSP ID: ENSP00000439056
MELAQEARELGCWAVEEMGVPVAARAPESTLRRLCLGQGADIWAYILQHVHSQRTVKKIRGNLLWYGHQDSPQVRRKLELEAAVTRLRAEIQELDQSLELMERDTEAQDTAMEQARQHTQDTQRRALLLRAQAGAMRRQQHTLRDPMQRLQNQLRRLQDMERKAKVDVTFGSLTSAALGLEPVVLRDVRTACTLRAQFLQNLLLPQAKRGSLPTPHDDHFGTSYQQWLSSVETLLTNHPPGHVLAALEHLAAEREAEIRSLCSGDGLGDTEISRPQAPDQSDSSQTLPSMVHLIQEGWRTVGVLVSQRSTLLKERQVLTQRLQGLVEEVERRVLGSSERQVLILGLRRCCLWTELKALHDQSQELQDAAGHRQLLLRELQAKQQRILHWRQLVEETQEQVRLLIKGNSASKTRLCRSPGEVLALVQRKVVPTFEAVAPQSRELLRCLEEEVRHLPHILLGTLLRHRPGELKPLPTVLPSIHQLHPASPRGSSFIALSHKLGLPPGKASELLLPAAASLRQDLLLLQDQRSLWCWDLLHMKTSLPPGLPTQELLQIQASQEKQQKENLGQALKRLEKLLKQALERIPELQGIVGDWWEQPGQAALSEELCQGLSLPQWRLRWVQAQGALQKLCS

SEQ ID NO: 37183 - protein, 290 aa, Homo sapiens
  Payload ID: 7382
  Gene Symbol: HAUS5
  Gene Name: HAUS augmin-like complex, subunit 5
  Uniprot ID: O94927
  ENSP ID: ENSP00000466661
MELAQEARELGCWAVEEMGVPVAARAPESTLRRLCLGQGADIWAYILQHVHSQRTVKKIRGNLLWYGHQDSPQVRRKLELEAAVTRLRAEIQELDQSLELMERDTEAQDTAMEQARQHTQDTQRRALLLRAQAGAMRRQQHTLRDPMQRLQNQLRRLQDMERKAKVDVTFGSLTSAALGLEPVVLRDVRTACTLRAQFLQNLLLPQAKRGSLPTPHDDHFGTSYQQWLSSVETLLTNHPPGHVLAALEHLAAEREAEIRSLCSGDGLGDTEISRRAGGLWVCWSPSGAPS

SEQ ID NO: 37184 - protein, 168 aa, Homo sapiens
  Payload ID: 7382
  Gene Symbol: HAUS5
  Gene Name: HAUS augmin-like complex, subunit 5
  ENSP ID: ENSP00000467688
PASPRGSSFIALSHKLGLPPGKASELLLPAAASLRQDLLLLQDQRSLWCWDLLHMKTSLPPGLPTQELLQIQASQEKQQKENLGQALKRLEKLLKQALERIPELQGIVGDWTFGRKQRQDSSAVVPTRTCSPLMCCSAAPLSSWTLSFHPAKAPPKTPSSLSFSAKSN

SEQ ID NO: 37185 - protein, 89 aa, Homo sapiens
  Payload ID: 7382
  Gene Symbol: HAUS5
  Gene Name: HAUS augmin-like complex, subunit 5
  ENSP ID: ENSP00000475856
MELAQEARELGCWAVEEMGVPVAARAPESTLRRLCLGQGADIWAYILQHVHSQRTVKKIRGNLLWYGHQDSPQVRSICYKILFHPKNDL

SEQ ID NO: 37186 - protein, 60 aa, Homo sapiens
  Payload ID: 7382
  Gene Symbol: HAUS5
  Gene Name: HAUS augmin-like complex, subunit 5
  ENSP ID: ENSP00000475934
MELAQEARELGCWAVEEMGVPVAARAPESTLRRNEDPTPCVLPQAYAYTLSPQAVSGPGG

SEQ ID NO: 37187 - protein, 802 aa, Homo sapiens
  Payload ID: 7383
  Gene Symbol: HAUS6
  Gene Name: HAUS augmin-like complex, subunit 6
  ENSP ID: ENSP00000369865
MKYIKSNSKNSSHHFVETFNIKPQDLHKCIARCHFARSRFLQILQRQDCVTQKYQENAQLSVKQVRNLRSECIGLENQIKKMEPYDDHSNMEEKIQKVRSLWASVNETLMFLEKEREVVSSVLSLVNQYALDGTNVAINIPRLLLDKIEKQMFQLHIGNVYEAGKLNLLTVIQLLNEVLKVMKYERCQADQARLTVDLHYLEKETKFQKERLSDLKHMRYRIKDDLTTIRHSVVEKQGEWHKKWKEFLGLSPFSLIKGWTPSVDLLPPMSPLSFDPASEEVYAKSILCQYPASLPDAHKQHNQENGCRGDSDTLGALHDLANSPASFLSQSVSSSDRNSVTVLEKDTKMGTPKEKNEAISKKIPEFEVENSPLSDVAKNTESSAFGGSLPAKKSDPFQKEQDHLVEEVARAVLSDSPQLSEGKEIKLEELIDSLGSNPFLTRNQIPRTPENLITEIRSSWRKAIEMEENRTKEPIQMDAEHREVLPESLPVLHNQREFSMADFLLETTVSDFGQSHLTEEKVISDCECVPQKHVLTSHIDEPPTQNQSDLLNKKVICKQDLECLAFTKLSETSRMETFSPAVGNRIDVMGGSEEEFMKILDHLEVSCNKPSTNKTMLWNSFQISSGISSKSFKDNDFGILHETLPEEVGHLSFNSSSSSEANFKLEPNSPMHGGTLLEDVVGGRQTTPESDFNLQALRSRYEALKKSLSKKREESYLSNSQTPERHKPELSPTPQNVQTDDTLNFLDTCDLHTEHIKPSLRTSIGERKRSLSPLIKFSPVEQRLRTTIACSLGELPNLKGKV

SEQ ID NO: 37188 - protein, 955 aa, Homo sapiens
  Payload ID: 7383
  Gene Symbol: HAUS6
  Gene Name: HAUS augmin-like complex, subunit 6
  Uniprot ID: Q7Z4H7
  ENSP ID: ENSP00000369871
MSSASVTAFEKEHLWMYLQALGFEPGPATIACGKIVSHTHLGVNMFDKLNRDAFHIISYFLFQVLDQSLTKEVFKFCWPPFDQKSDTEFRKHCCEWIKRISGECGSSFPQVVGSLFLSPGGPKFIHLMYHFARFVAMKYIKSNSKNSSHHFVETFNIKPQDLHKCIARCHFARSRFLQILQRQDCVTQKYQENAQLSVKQVRNLRSECIGLENQIKKMEPYDDHSNMEEKIQKVRSLWASVNETLMFLEKEREVVSSVLSLVNQYALDGTNVAINIPRLLLDKIEKQMFQLHIGNVYEAGKLNLLTVIQLLNEVLKVMKYERCQADQARLTVDLHYLEKETKFQKERLSDLKHMRYRIKDDLTTIRHSVVEKQGEWHKKWKEFLGLSPFSLIKGWTPSVDLLPPMSPLSFDPASEEVYAKSILCQYPASLPDAHKQHNQENGCRGDSDTLGALHDLANSPASFLSQSVSSSDRNSVTVLEKDTKMGTPKEKNEAISKKIPEFEVENSPLSDVAKNTESSAFGGSLPAKKSDPFQKEQDHLVEEVARAVLSDSPQLSEGKEIKLEELIDSLGSNPFLTRNQIPRTPENLITEIRSSWRKAIEMEENRTKEPIQMDAEHREVLPESLPVLHNQREFSMADFLLETTVSDFGQSHLTEEKVISDCECVPQKHVLTSHIDEPPTQNQSDLLNKKVICKQDLECLAFTKLSETSRMETFSPAVGNRIDVMGGSEEEFMKILDHLEVSCNKPSTNKTMLWNSFQISSGISSKSFKDNDFGILHETLPEEVGHLSFNSSSSSEANFKLEPNSPMHGGTLLEDVVGGRQTTPESDFNLQALRSRYEALKKSLSKKREESYLSNSQTPERHKPELSPTPQNVQTDDTLNFLDTCDLHTEHIKPSLRTSIGERKRSLSPLIKFSPVEQRLRTTIACSLGELPNLKEEDILNKSLDAKEPPSDLTR

SEQ ID NO: 37189 - protein, 183 aa, Homo sapiens
  Payload ID: 7383
  Gene Symbol: HAUS6
  Gene Name: HAUS augmin-like complex, subunit 6
  ENSP ID: ENSP00000409615
MGTPKEKNEAISKKIPEFEVENSPLSDVAKNTESSAFGGSLPAKKSDPFQKEQDHLVEEVARAVLSDSPQLSEGKEIKLEELIDSLGSNPFLTRNQIPRTPENLITEIRSSWRKAIEMEENRTKEPIQMDAEHREVLPESLPVLHNQREFSMADFLLETTVSDFGQSHLTEEKVISDCECVPQ

SEQ ID NO: 37190 - protein, 127 aa, Homo sapiens
  Payload ID: 7384
  Gene Symbol: HAUS7
  Gene Name: HAUS augmin-like complex, subunit 7
  ENSP ID: ENSP00000359229
MAGQDAGCGRGGDDYSEDEGDSSVSRAAVEVFGKLKDLNCPFLEGLYITEPKTIQELLCSPSEYRLEILEWMCTRVWPSLQDRFSSLKGVPTEVKIQEMTKLGHELMLCAPDDQELLKRFIHVTNGL

SEQ ID NO: 37191 - protein, 368 aa, Homo sapiens
  Payload ID: 7384
  Gene Symbol: HAUS7
  Gene Name: HAUS augmin-like complex, subunit 7
  Uniprot ID: Q99871
  ENSP ID: ENSP00000359230
MGGARLGARNMAGQDAGCGRGGDDYSEDEGDSSVSRAAVEVFGKLKDLNCPFLEGLYITEPKTIQELLCSPSEYRLEILEWMCTRVWPSLQDRFSSLKGVPTEVKIQEMTKLGHELMLCAPDDQELLKGCACAQKQLHFMDQLLDTIRSLTIGCSSCSSLMEHFEDTREKNEALLGELFSSPHLQMLLNPECDPWPLDMQPLLNKQSDDWQWASASAKSEEEEKLAELARQLQESAAKLHALRTEYFAQHEQGAAAGAADISTLDQKLRLVTSDFHQLILAFLQVYDDELGECCQRPGPDLHPCGPIIQATHQNLTSYSQLLQVVMAVADTSAKAVETVKKQQGEQICWGGSSSVMSLATKMNELMEK

SEQ ID NO: 37192 - protein, 211 aa, Homo sapiens
  Payload ID: 7384
  Gene Symbol: HAUS7
  Gene Name: HAUS augmin-like complex, subunit 7
  ENSP ID: ENSP00000389431
  MOD_RES (1)..(1): Any amino acid
XKSEEEEKLAELARQLQESAAKLHALRTEYFAQHEQGAAAGAADISTLDQKLRLVTSDFHQLILAFLQVYDDELGECCQRPGPDLHPCGPIIQATHQNLTSYSQIPRGQPKKPALVTMTTVPTCATLPLAQGFRDVHFGFLSERLRAFQPLTGWSCETPRSGMLLQVVMAVADTSAKAVETVKKQQGEQICWGGSSSVMSLATKMNELMEK

SEQ ID NO: 37193 - protein, 127 aa, Homo sapiens; identical to SEQ ID NO: 37190
  Payload ID: 7384
  Gene Symbol: HAUS7
  Gene Name: HAUS augmin-like complex, subunit 7
  ENSP ID: ENSP00000485783

SEQ ID NO: 37194 - protein, 410 aa, Homo sapiens
  Payload ID: 7385
  Gene Symbol: HAUS8
  Gene Name: HAUS augmin-like complex, subunit 8
  Uniprot ID: Q9BT25
  ENSP ID: ENSP00000253669
MADSSGRGAGKPATGPTNSSSAKKKDKRVQGGRVIESRYLQYEKKTTQKAPAGDGSQTRGKMSEGGRKSSLLQKSKADSSGVGKGDLQSTLLEGHGTAPPDLDLSAINDKSIVKKTPQLAKTISKKPESTSFSAPRKKSPDLSEAMEMMESQTLLLTLLSVKMENNLAEFERRAEKNLLIMCKEKEKLQKKAHELKRRLLLSQRKRELADVLDAQIEMLSPFEAVATRFKEQYRTFATALDTTRHELPVRSIHLEGDGQQLLDALQHELVTTQRLLGELDVGDSEENVQVLDLLSELKDVTAKKDLELRRSFAQVLELSAEASKEAALANQEVWEETQGMAPPSRWYFNQDSACRESGGAPKNTPLSEDDNPGASSAPAQATFISPSEDFSSSSQAEVPPSLSRSGRDLS

SEQ ID NO: 37195 - protein, 409 aa, Homo sapiens
  Payload ID: 7385
  Gene Symbol: HAUS8
  Gene Name: HAUS augmin-like complex, subunit 8
  Uniprot ID: Q9BT25
  ENSP ID: ENSP00000395298
MADSSGRGAGKPATGPTNSSSAKKKDKRVQGGRVIESRYLQYEKKTTQKAPAGDGSQTRGKMSEGGRKSSLLQKSKDSSGVGKGDLQSTLLEGHGTAPPDLDLSAINDKSIVKKTPQLAKTISKKPESTSFSAPRKKSPDLSEAMEMMESQTLLLTLLSVKMENNLAEFERRAEKNLLIMCKEKEKLQKKAHELKRRLLLSQRKRELADVLDAQIEMLSPFEAVATRFKEQYRTFATALDTTRHELPVRSIHLEGDGQQLLDALQHELVTTQRLLGELDVGDSEENVQVLDLLSELKDVTAKKDLELRRSFAQVLELSAEASKEAALANQEVWEETQGMAPPSRWYFNQDSACRESGGAPKNTPLSEDDNPGASSAPAQATFISPSEDFSSSSQAEVPPSLSRSGRDLS

SEQ ID NO: 37196 - protein, 349 aa, Homo sapiens
  Payload ID: 7385
  Gene Symbol: HAUS8
  Gene Name: HAUS augmin-like complex, subunit 8
  Uniprot ID: Q9BT25
  ENSP ID: ENSP00000470829
MSEGGRKSSLLQKSKADSSGVGKGDLQSTLLEGHGTAPPDLDLSAINDKSIVKKTPQLAKTISKKPESTSFSAPRKKSPDLSEAMEMMESQTLLLTLLSVKMENNLAEFERRAEKNLLIMCKEKEKLQKKAHELKRRLLLSQRKRELADVLDAQIEMLSPFEAVATRFKEQYRTFATALDTTRHELPVRSIHLEGDGQQLLDALQHELVTTQRLLGELDVGDSEENVQVLDLLSELKDVTAKKDLELRRSFAQVLELSAEASKEAALANQEVWEETQGMAPPSRWYFNQDSACRESGGAPKNTPLSEDDNPGASSAPAQATFISPSEDFSSSSQAEVPPSLSRSGRDLS

SEQ ID NO: 37197 - protein, 39 aa, Homo sapiens
  Payload ID: 7385
  Gene Symbol: HAUS8
  Gene Name: HAUS augmin-like complex, subunit 8
  ENSP ID: ENSP00000471868
MADSSGRGAGKPATGPTNSSSAKKKDKRVQVCPHRWKSD

SEQ ID NO: 37198 - protein, 91 aa, Homo sapiens
  Payload ID: 7385
  Gene Symbol: HAUS8
  Gene Name: HAUS augmin-like complex, subunit 8
  ENSP ID: ENSP00000473111
MADSSGRGAGKPATGPTNSSSAKKKDKRVQGGRVIESRYLQYEKKTTQKQIAVGSERVTCSPRCWKGMAQLHLTWISLLLMTKASSKRRHS

SEQ ID NO: 37199 - protein, 215 aa, Homo sapiens
  Payload ID: 7386
  Gene Symbol: HBS1L
  Gene Name: HBS1-like translational GTPase
  ENSP ID: ENSP00000323566
MARHRNVRGYNYDEDFEDDDLYGQSVEDDYCISPSTAAQFIYSRRDKPSVEPVEEYDYEDLKESSNSVSNHQLSGFDQARLYSCLDHMREVLGDAVPDEILIEAVLKNKFDVQKALSGVLEQDRVQSLKDKNEATVSTGKIAKGVLFSSSEVSADNVQSSYPQSANHLDYSSKPFDFASSVGKYGLSHNSSVPTHCLLHRKKKLDTRKSEKKLES

SEQ ID NO: 37200 - protein, 147 aa, Homo sapiens
  Payload ID: 7386
  Gene Symbol: HBS1L
  Gene Name: HBS1-like translational GTPase
  ENSP ID: ENSP00000356794
MARHRNVRGYNYDEDFEDDDLYGQSVEDDYCISPSTAAQFIYSRRDKPSVEPVEEYDYEDLKESSNSVSNHQLSGFDQARLYSCLDHMREVLGDAVPDEILIEAVLKNKFDVQKALSGVLEQDRVQSLKDKNEATVSTGKIAKGPCC

SEQ ID NO: 37201 - protein, 632 aa, Homo sapiens
  Payload ID: 7386
  Gene Symbol: HBS1L
  Gene Name: HBS1-like translational GTPase
  Uniprot ID: Q9Y450
  ENSP ID: ENSP00000356796
MARHRNVRGYNYDEDFEDDDLYGQSVEDDYCISPSTAAQFIYSRRDKPSVEPVEEYDYEDLKESSNSVSNHQLSGFDQARLYSCLDHMREVLGDAVPDEILIEAVLKNKFDVQKALSGVLEQDRVQSLKDKNEATVSTGKIAKGVLFSSSEVSADNVQSSYPQSANHLDYSSKPFDFASSVGKYGLSHNSSVPTHCLLHRKKKLDTRKSEKKLESCKLTKELSLANLIHDMSRDSCESQPSVRLSSTDSLESLLSKNLDADLLRPHASECISKDDSAFKEIPDLKTIIIKGTTPNNSLYIQNNSLSDFQNIPVQDSLGSSNNPLYLTSSLENMTVDNLNASKETEVGNVSLVEQSAKNHTFKNDNLQFSQCESPSLTELFQEHKENNISQCFTLSDLCNQSSASFTDLSLGSFPLSQLANRCQSSPGISELTGSLSSLAFHKASPTRDLENLSLSELIAETIDVDNSQIKKESFEVSLSEVRSPGIDSNIDLSVLIKNPDFVPKPVVDPSIAPSSRTKVLSSKLGKNSNFAKDNKKNNKGSLTRKPPFSLSWTKALAARPSAFASTLCLRYPLKSCKRRTLDLYKTFLYSRQVQDVKDKEISPLVAITPFDFKSASPDDIVKANQKKAFTRE

SEQ ID NO: 37202 - protein, 642 aa, Homo sapiens
  Payload ID: 7386
  Gene Symbol: HBS1L
  Gene Name: HBS1-like translational GTPase
  Uniprot ID: Q9Y450
  ENSP ID: ENSP00000356800
MARHRNVRGYNYDEDFEDDDLYGQSVEDDYCISPSTARLYSCLDHMREVLGDAVPDEILIEAVLKNKFDVQKALSGVLEQDRVQSLKDKNEATVSTGKIAKGKPVDSQTSRSESEIVPKVAKMTVSGKKQTMGFEVPGVSSEENGHSFHTPQKGPPIEDAIASSDVLETASKSANPPHTIQASEEQSSTPAPVKKSGKLRQQIDVKAELEKRQGGKQLLNLVVIGHVDAGKSTLMGHMLYLLGNINKRTMHKYEQESKKAGKASFAYAWVLDETGEERERGVTMDVGMTKFETTTKVITLMDAPGHKDFIPNMITGAAQADVAVLVVDASRGEFEAGFETGGQTREHGLLVRSLGVTQLAVAVNKMDQVNWQQERFQEITGKLGHFLKQAGFKESDVGFIPTSGLSGENLITRSQSSELTKWYKGLCLLEQIDSFKPPQRSIDKPFRLCVSDVFKDQGSGFCITGKIEAGYIQTGDRLLAMPPNETCTVKGITLHDEPVDWAAAGDHVSLTLVGMDIIKINVGCIFCGPKVPIKACTRFRARILIFNIEIPITKGFPVLLHYQTVSEPAVIKRLISVLNKSTGEVTKKKPKFLTKGQNALVELQTQRPIALELYKDFKELGRFMLRYGGSTIAAGVVTEIKE

SEQ ID NO: 37203 - protein, 684 aa, Homo sapiens
  Payload ID: 7386
  Gene Symbol: HBS1L
  Gene Name: HBS1-like translational GTPase
  Uniprot ID: Q9Y450
  ENSP ID: ENSP00000356811
MARHRNVRGYNYDEDFEDDDLYGQSVEDDYCISPSTAAQFIYSRRDKPSVEPVEEYDYEDLKESSNSVSNHQLSGFDQARLYSCLDHMREVLGDAVPDEILIEAVLKNKFDVQKALSGVLEQDRVQSLKDKNEATVSTGKIAKGKPVDSQTSRSESEIVPKVAKMTVSGKKQTMGFEVPGVSSEENGHSFHTPQKGPPIEDAIASSDVLETASKSANPPHTIQASEEQSSTPAPVKKSGKLRQQIDVKAELEKRQGGKQLLNLVVIGHVDAGKSTLMGHMLYLLGNINKRTMHKYEQESKKAGKASFAYAWVLDETGEERERGVTMDVGMTKFETTTKVITLMDAPGHKDFIPNMITGAAQADVAVLVVDASRGEFEAGFETGGQTREHGLLVRSLGVTQLAVAVNKMDQVNWQQERFQEITGKLGHFLKQAGFKESDVGFIPTSGLSGENLITRSQSSELTKWYKGLCLLEQIDSFKPPQRSIDKPFRLCVSDVFKDQGSGFCITGKIEAGYIQTGDRLLAMPPNETCTVKGITLHDEPVDWAAAGDHVSLTLVGMDIIKINVGCIFCGPKVPIKACTRFRARILIFNIEIPITKGFPVLLHYQTVSEPAVIKRLISVLNKSTGEVTKKKPKFLTKGQNALVELQTQRPIALELYKDFKELGRFMLRYGGSTIAAGVVTEIKE

SEQ ID NO: 37204 - protein, 619 aa, Homo sapiens
  Payload ID: 7386
  Gene Symbol: HBS1L
  Gene Name: HBS1-like translational GTPase
  ENSP ID: ENSP00000389826
MARHRNVRGYNYDEDFEDDDLYGQSVEDDYCISPSTAAQFIYSRRDKPSVEPVEEYDYEDLKESSNSVSNHQLSGFDQGKPVDSQTSRSESEIVPKVAKMTVSGKKQTMGFEVPGVSSEENGHSFHTPQKGPPIEDAIASSDVLETASKSANPPHTIQASEEQSSTPAPVKKSGKLRQQIDVKAELEKRQGGKQLLNLVVIGHVDAGKSTLMGHMLYLLGNINKRTMHKYEQESKKAGKASFAYAWVLDETGEERERGVTMDVGMTKFETTTKVITLMDAPGHKDFIPNMITGAAQADVAVLVVDASRGEFEAGFETGGQTREHGLLVRSLGVTQLAVAVNKMDQVNWQQERFQEITGKLGHFLKQAGFKESDVGFIPTSGLSGENLITRSQSSELTKWYKGLCLLEQIDSFKPPQRSIDKPFRLCVSDVFKDQGSGFCITGKIEAGYIQTGDRLLAMPPNETCTVKGITLHDEPVDWAAAGDHVSLTLVGMDIIKINVGCIFCGPKVPIKACTRFRARILIFNIEIPITKGFPVLLHYQTVSEPAVIKRLISVLNKSTGEVTKKKPKFLTKGQNALVELQTQRPIALELYKDFKELGRFMLRYGGSTIAAGVVTEIKE

SEQ ID NO: 37205 - protein, 142 aa, Homo sapiens
  Payload ID: 7386
  Gene Symbol: HBS1L
  Gene Name: HBS1-like translational GTPase
  ENSP ID: ENSP00000432092
MTVSGKKQTMGFEVPGVSSEENGHSFHTPQKGPPIEDAIASSDVLETASKSANPPHTIQASEEQSSTPAPVKKSGKLRQQIDVKAELEKRQGGKQLLNLVVIGHVDAGKSTLMGHMLYLLGNINKRTMHKYEQESKKAGKAS

SEQ ID NO: 37206 - protein, 167 aa, Homo sapiens
  Payload ID: 7386
  Gene Symbol: HBS1L
  Gene Name: HBS1-like translational GTPase
  ENSP ID: ENSP00000433030
MERPAPWTLWVTTSWWYIWALRSSVTFLPDFEDDDLYGQSVEDDYCISPSTAAQFIYSRRDKPSVEPVEEYDYEDLKESSNSVSNHQLSGFDQARLYSCLDHMREVLGDAVPDEILIEAVLKNKFDVQKALSGVLEQDRVQSLKDKNEATVSTGKIAKGKPVDSQTS

SEQ ID NO: 37207 - protein, 74 aa, Homo sapiens
  Payload ID: 7386
  Gene Symbol: HBS1L
  Gene Name: HBS1-like translational GTPase
  ENSP ID: ENSP00000433161
  MOD_RES (1)..(1): Any amino acid
XEDDDLYGQSVEDDYCISPSTAAQFIYSRRDKPSVEPVEEYDYEDLKESSNSVSNHQLSGFDQAATQLSGHWSC

SEQ ID NO: 37208 - protein, 554 aa, Homo sapiens
  Payload ID: 7386
  Gene Symbol: HBS1L
  Gene Name: HBS1-like translational GTPase
  ENSP ID: ENSP00000434533
QSVEDDYCISPSTGKPVDSQTSRSESEIVPKVAKMTVSGKKQTMGFEVPGVSSEENGHSFHTPQKGPPIEDAIASSDVLETASKSANPPHTIQASEEQSSTPAPVKKSGKLRQQIDVKAELEKRQGGKQLLNLVVIGHVDAGKSTLMGHMLYLLGNINKRTMHKYEQESKKAGKASFAYAWVLDETGEERERGVTMDVGMTKFETTTKVITLMDAPGHKDFIPNMITGAAQADVAVLVVDASRGEFEAGFETGGQTREHGLLVRSLGVTQLAVAVNKMDQVNWQQERFQEITGKLGHFLKQAGFKESDVGFIPTSGLSGENLITRSQSSELTKWYKGLCLLEQIDSFKPPQRSIDKPFRLCVSDVFKDQGSGFCITGKIEAGYIQTGDRLLAMPPNETCTVKGITLHDEPVDWAAAGDHVSLTLVGMDIIKINVGCIFCGPKVPIKACTRFRARILIFNIEIPITKGFPVLLHYQTVSEPAVIKRLISVLNKSTGEVTKKKPKFLTKGQNALVELQTQRPIALELYKDFKELGRFMLRYGGSTIAAGVVTEIKE

SEQ ID NO: 37209 - protein, 141 aa, Homo sapiens
  Payload ID: 7386
  Gene Symbol: HBS1L
  Gene Name: HBS1-like translational GTPase
  ENSP ID: ENSP00000434855
MARHRNVRGYNYDEAAQFIYSRRDKPSVEPVEEYDYEDLKESSNSVSNHQLSGFDQARLYSCLDHMREVLGDAVPDEILIEAVLKNKFDVQKALSGVLEQDRVQSLKDKNEATVSTGKIAKGKPVDSQTSRSESEIVPKVA

SEQ ID NO: 37210 - protein, 118 aa, Homo sapiens
  Payload ID: 7386
  Gene Symbol: HBS1L
  Gene Name: HBS1-like translational GTPase
  ENSP ID: ENSP00000435608
MARHRNVRGYNYDEARLYSCLDHMREVLGDAVPDEILIEAVLKNKFDVQKALSGVLEQDRVQSLKDKNEATVSTGKIAKGKESYFLLLKFQLIMFKVLILSQQIIWIIVANPLILLAQ

SEQ ID NO: 37211 - protein, 520 aa, Homo sapiens
  Payload ID: 7386
  Gene Symbol: HBS1L
  Gene Name: HBS1-like translational GTPase
  ENSP ID: ENSP00000436256
MTVSGKKQTMGFEVPGVSSEENGHSFHTPQKGPPIEDAIASSDVLETASKSANPPHTIQASEEQSSTPAPVKKSGKLRQQIDVKAELEKRQGGKQLLNLVVIGHVDAGKSTLMGHMLYLLGNINKRTMHKYEQESKKAGKASFAYAWVLDETGEERERGVTMDVGMTKFETTTKVITLMDAPGHKDFIPNMITGAAQADVAVLVVDASRGEFEAGFETGGQTREHGLLVRSLGVTQLAVAVNKMDQVNWQQERFQEITGKLGHFLKQAGFKESDVGFIPTSGLSGENLITRSQSSELTKWYKGLCLLEQIDSFKPPQRSIDKPFRLCVSDVFKDQGSGFCITGKIEAGYIQTGDRLLAMPPNETCTVKGITLHDEPVDWAAAGDHVSLTLVGMDIIKINVGCIFCGPKVPIKACTRFRARILIFNIEIPITKGFPVLLHYQTVSEPAVIKRLISVLNKSTGEVTKKKPKFLTKGQNALVELQTQRPIALELYKDFKELGRFMLRYGGSTIAAGVVTEIKE

SEQ ID NO: 37212 - protein, 170 aa, Homo sapiens
  Payload ID: 7386
  Gene Symbol: HBS1L
  Gene Name: HBS1-like translational GTPase
  ENSP ID: ENSP00000436472
  MOD_RES (1)..(1): Any amino acid
XAGFETGGQTREHGLLVRSLGVTQLAVAVNKMDQVNWQQERFQEITGKLGHFLKQAGFKESDVGFIPTSGLSGENLITRSQSSELTKWYKGLCLLEQIDSFKPPQRSIDKPFRLCVSDVFKDQGSGFCITGKIEAGYIQTGDRLLAMPPNETCTVKGIYLQDAFAKQALS

SEQ ID NO: 37213 - protein, 243 aa, Homo sapiens
  Payload ID: 7386
  Gene Symbol: HBS1L
  Gene Name: HBS1-like translational GTPase
  ENSP ID: ENSP00000436620
MTVSGKKQTMGFEVPGVSSEENGHSFHTPQKGPPIEDAIASSDVLETASKSANPPHTIQASEEQSSTPAPVKKSGKLRQQIDVKAELEKRQGGKQLLNLVVIGHVDAGKSTLMGHMLYLLGNINKRTMHKYEQESKKAGKASFAYAWVLDETGEERERGVTMDVGMTKFETTTKVITLMDAPGHKDFIPNMITGAAQADVAVLVVDASRGEFEAGFETGGQTREHGLLVRSLGVTQLAVAVNK

SEQ ID NO: 37214 - protein, 41 aa, Homo sapiens
  Payload ID: 7387
  Gene Symbol: HCK
  Gene Name: HCK proto-oncogene, Src family tyrosine kinase
  ENSP ID: ENSP00000262651
LGGRSSCEDPGCPRDEERAPRGNRCHELQSFQDVPLKMDCI

SEQ ID NO: 37215 - protein, 526 aa, Homo sapiens
  Payload ID: 7387
  Gene Symbol: HCK
  Gene Name: HCK proto-oncogene, Src family tyrosine kinase
  ENSP ID: ENSP00000365012
LGGRSSCEDPGCPRDEERAPRMGCMKSKFLQVGGNTFSKTETSASPHCPVYVPDPTSTIKPGPNSHNSNTPGIREAGSEDIIVVALYDYEAIHHEDLSFQKGDQMVVLEESGEWWKARSLATRKEGYIPSNYVARVDSLETEEWFFKGISRKDAERQLLAPGNMLGSFMIRDSETTKGSYSLSVRDYDPRQGDTVKHYKIRTLDNGGFYISPRSTFSTLQELVDHYKKGNDGLCQKLSVPCMSSKPQKPWEKDAWEIPRESLKLEKKLGAGQFGEVWMATYNKHTKVAVKTMKPGSMSVEAFLAEANVMKTLQHDKLVKLHAVVTKEPIYIITEFMAKGSLLDFLKSDEGSKQPLPKLIDFSAQIAEGMAFIEQRNYIHRDLRAANILVSASLVCKIADFGLARVIEDNEYTAREGAKFPIKWTAPEAINFGSFTIKSDVWSFGILLMEIVTYGRIPYPGMSNPEVIRALERGYRMPRPENCPEELYNIMMRCWKNRPEERPTFEYIQSVLDDFYTATESQYQQQP

SEQ ID NO: 37216 - protein, 525 aa, Homo sapiens
  Payload ID: 7387
  Gene Symbol: HCK
  Gene Name: HCK proto-oncogene, Src family tyrosine kinase
  ENSP ID: ENSP00000365022
LGGRSSCEDPGCPRDEERAPRMGCMKSKFLQVGGNTFSKTETSASPHCPVYVPDPTSTIKPGPNSHNSNTPGIREGSEDIIVVALYDYEAIHHEDLSFQKGDQMVVLEESGEWWKARSLATRKEGYIPSNYVARVDSLETEEWFFKGISRKDAERQLLAPGNMLGSFMIRDSETTKGSYSLSVRDYDPRQGDTVKHYKIRTLDNGGFYISPRSTFSTLQELVDHYKKGNDGLCQKLSVPCMSSKPQKPWEKDAWEIPRESLKLEKKLGAGQFGEVWMATYNKHTKVAVKTMKPGSMSVEAFLAEANVMKTLQHDKLVKLHAVVTKEPIYIITEFMAKGSLLDFLKSDEGSKQPLPKLIDFSAQIAEGMAFIEQRNYIHRDLRAANILVSASLVCKIADFGLARVIEDNEYTAREGAKFPIKWTAPEAINFGSFTIKSDVWSFGILLMEIVTYGRIPYPGMSNPEVIRALERGYRMPRPENCPEELYNIMMRCWKNRPEERPTFEYIQSVLDDFYTATESQYQQQP

SEQ ID NO: 37217 - protein, 61 aa, Homo sapiens
  Payload ID: 7387
  Gene Symbol: HCK
  Gene Name: HCK proto-oncogene, Src family tyrosine kinase
  ENSP ID: ENSP00000420457
LGGRSSCEDPGCPRDEERAPRQTKQNRSSLEVANLSQFPPEEDGVHEVQVPPGRRQYILKN

SEQ ID NO: 37218 - protein, 504 aa, Homo sapiens
  Payload ID: 7387
  Gene Symbol: HCK
  Gene Name: HCK proto-oncogene, Src family tyrosine kinase
  Uniprot ID: P08631
  ENSP ID: ENSP00000427757
MGCMKSKFLQVGGNTFSKTETSASPHCPVYVPDPTSTIKPGPNSHNSNTPGIREGSEDIIVVALYDYEAIHHEDLSFQKGDQMVVLEESGEWWKARSLATRKEGYIPSNYVARVDSLETEEWFFKGISRKDAERQLLAPGNMLGSFMIRDSETTKGSYSLSVRDYDPRQGDTVKHYKIRTLDNGGFYISPRSTFSTLQELVDHYKKGNDGLCQKLSVPCMSSKPQKPWEKDAWEIPRESLKLEKKLGAGQFGEVWMATYNKHTKVAVKTMKPGSMSVEAFLAEANVMKTLQHDKLVKLHAVVTKEPIYIITEFMAKGSLLDFLKSDEGSKQPLPKLIDFSAQIAEGMAFIEQRNYIHRDLRAANILVSASLVCKIADFGLARVIEDNEYTAREGAKFPIKWTAPEAINFGSFTIKSDVWSFGILLMEIVTYGRIPYPGMSNPEVIRALERGYRMPRPENCPEELYNIMMRCWKNRPEERPTFEYIQSVLDDFYTATESQYQQQP

SEQ ID NO: 37219 - protein, 505 aa, Homo sapiens
  Payload ID: 7387
  Gene Symbol: HCK
  Gene Name: HCK proto-oncogene, Src family tyrosine kinase
  Uniprot ID: P08631
  ENSP ID: ENSP00000429848
MGCMKSKFLQVGGNTFSKTETSASPHCPVYVPDPTSTIKPGPNSHNSNTPGIREAGSEDIIVVALYDYEAIHHEDLSFQKGDQMVVLEESGEWWKARSLATRKEGYIPSNYVARVDSLETEEWFFKGISRKDAERQLLAPGNMLGSFMIRDSETTKGSYSLSVRDYDPRQGDTVKHYKIRTLDNGGFYISPRSTFSTLQELVDHYKKGNDGLCQKLSVPCMSSKPQKPWEKDAWEIPRESLKLEKKLGAGQFGEVWMATYNKHTKVAVKTMKPGSMSVEAFLAEANVMKTLQHDKLVKLHAVVTKEPIYIITEFMAKGSLLDFLKSDEGSKQPLPKLIDFSAQIAEGMAFIEQRNYIHRDLRAANILVSASLVCKIADFGLARVIEDNEYTAREGAKFPIKWTAPEAINFGSFTIKSDVWSFGILLMEIVTYGRIPYPGMSNPEVIRALERGYRMPRPENCPEELYNIMMRCWKNRPEERPTFEYIQSVLDDFYTATESQYQQQP

SEQ ID NO: 37220 - protein, 505 aa, Homo sapiens; identical to SEQ ID NO: 37219
  Payload ID: 7387
  Gene Symbol: HCK
  Gene Name: HCK proto-oncogene, Src family tyrosine kinase
  Uniprot ID: P08631
  ENSP ID: ENSP00000441169

SEQ ID NO: 37221 - protein, 526 aa, Homo sapiens; identical to SEQ ID NO: 37215
  Payload ID: 7387
  Gene Symbol: HCK
  Gene Name: HCK proto-oncogene, Src family tyrosine kinase
  ENSP ID: ENSP00000444986

SEQ ID NO: 37222 - protein, 505 aa, Homo sapiens; identical to SEQ ID NO: 37219
  Payload ID: 7387
  Gene Symbol: HCK
  Gene Name: HCK proto-oncogene, Src family tyrosine kinase
  Uniprot ID: P08631
  ENSP ID: ENSP00000486627

SEQ ID NO: 37223 - protein, 279 aa, Homo sapiens
  Payload ID: 7388
  Gene Symbol: HAX1
  Gene Name: HCLS1 associated protein X-1
  Uniprot ID: O00165
  ENSP ID: ENSP00000329002
MSLFDLFRGFFGFPGPRSHRDPFFGGMTRDEDDDEEEEEEGGSWGRGNPRFHSPQHPPEEFGFGFSFSPGGGIRFHDNFGFDDLVRDFNSIFSDMGAWTLPSHPPELPGPESETPGERLREGQTLRDSMLKYPDSHQPRIFGGVLESDARSESPQPAPDWGSQRPFHRFDDVWPMDPHPRTREDNDLDSQVSQEGLGPVLQPQPKSYFKSISVTKITKPDGIVEERRTVVDSEGRTETTVTRHEADSSPRGDPESPRPPALDDAFSILDLFLGRWFRSR

SEQ ID NO: 37224 - protein, 255 aa, Homo sapiens
  Payload ID: 7388
  Gene Symbol: HAX1
  Gene Name: HCLS1 associated protein X-1
  ENSP ID: ENSP00000394920
MSLFDLFRGFFGFPGPRSHRDPFFGGMTRDEDDDEEEEEEGGSWGRGNPRFHSPQHPPEEFGFGFSFSPGGGIRFHDNFGFDDLNFQVLSQRHLVRDYGRDRHFGTQCLSIQIVTSPGSLGGSWRVMQEVNPPNQHQTGAPRGHFIGLMMYGLWTPILEPERTMFLPVHLSPFFLWTLSLLLLHLSALPDLDSQVSQEGLGPVLQPQPKSYFKSISVTKITKPDGIVEERRTVVDSEGRTETTVTRHEADSSPRG

SEQ ID NO: 37225 - protein, 191 aa, Homo sapiens
  Payload ID: 7388
  Gene Symbol: HAX1
  Gene Name: HCLS1 associated protein X-1
  Uniprot ID: O00165
  ENSP ID: ENSP00000403848
MSLFDLFRGFFGFPGPRSHRDPFFGGMTRDEDDDEEEEEEGGSWGRGNPRFHSPQHPPEEFGFGFSFSPGGGIRFHDNFGFDDLNFQVLSQRHLVRDYGRDRHFGTQCLSIQIVTSPGSLGGSWRVMQEVNPPNQHQTGAPRGHFIGLMMYGLWTPILEPERTMILIPRFPRRVLARFYSPSPNPISRASL

SEQ ID NO: 37226 - protein, 231 aa, Homo sapiens
  Payload ID: 7388
  Gene Symbol: HAX1
  Gene Name: HCLS1 associated protein X-1
  Uniprot ID: O00165
  ENSP ID: ENSP00000411448
MSLFDLFRGFFGFPGPRSFSPGGGIRFHDNFGFDDLVRDFNSIFSDMGAWTLPSHPPELPGPESETPGERLREGQTLRDSMLKYPDSHQPRIFGGVLESDARSESPQPAPDWGSQRPFHRFDDVWPMDPHPRTREDNDLDSQVSQEGLGPVLQPQPKSYFKSISVTKITKPDGIVEERRTVVDSEGRTETTVTRHEADSSPRGDPESPRPPALDDAFSILDLFLGRWFRSR

SEQ ID NO: 37227 - protein, 151 aa, Homo sapiens
  Payload ID: 7388
  Gene Symbol: HAX1
  Gene Name: HCLS1 associated protein X-1
  ENSP ID: ENSP00000433951
MLKYPDSHQPRIFGGVLESDARSESPQPAPDWGSQRPFHRFDDVWPMDPHPRTREDNDLDSQVSQEGLGPVLQPQPKSYFKSISVTKITKPDGIVEERRTVVDSEGRTETTVTRHEADSSPRGDPESPRPPALDDAFSILDLFLGRWFRSR

SEQ ID NO: 37228 - protein, 287 aa, Homo sapiens
  Payload ID: 7388
  Gene Symbol: HAX1
  Gene Name: HCLS1 associated protein X-1
  Uniprot ID: O00165
  ENSP ID: ENSP00000435088
MSLFDLFRGFFGFPGPRSHRDPFFGGMTRDEDDDEEEEEEGGSWGRGNPRFHSPQHPPEEFGFGFSFSPGGGIRFHDNFGFDDLVRDFNSIFSDMGAWTLPSHPPANTCHLSAELPGPESETPGERLREGQTLRDSMLKYPDSHQPRIFGGVLESDARSESPQPAPDWGSQRPFHRFDDVWPMDPHPRTREDNDLDSQVSQEGLGPVLQPQPKSYFKSISVTKITKPDGIVEERRTVVDSEGRTETTVTRHEADSSPRGDPESPRPPALDDAFSILDLFLGRWFRSR

SEQ ID NO: 37229 - protein, 392 aa, Homo sapiens
  Payload ID: 7389
  Gene Symbol: HS1BP3
  Gene Name: HCLS1 binding protein 3
  Uniprot ID: Q53T59
  ENSP ID: ENSP00000305193
MQSPAVLVTSRRLQNAHTGLDLTVPQHQEVRGKMMSGHVEYQILVVTRLAAFKSAKHRPEDVVQFLVSKKYSEIEEFYQKLSSRYAAASLPPLPRKVLFVGESDIRERRAVFNEILRCVSKDAELAGSPELLEFLGTRSPGAAGLTSRDSSVLDGTDSQTGNDEEAFDFFEEQDQVAEEGPPVQSLKGEDAEESLEEEEALDPLGIMRSKKPKKHPKVAVKAKPSPRLTIFDEEVDPDEGLFGPGRKLSPQDPSEDVSSVDPLKLFDDPDLGGAIPLGDSLLLPAACESGGPTPSLSHRDASKELFRVEEDLDQILNLGAEPKPKPQLKPKPPVAAKPVIPRKPAVPPKAGPAEAVAGQQKPQEQIQAMDEMDILQYIQDHDTPAQAAPSLF

SEQ ID NO: 37230 - protein, 213 aa, Homo sapiens
  Payload ID: 7389
  Gene Symbol: HS1BP3
  Gene Name: HCLS1 binding protein 3
  ENSP ID: ENSP00000384984
MQSPAVLVTSRRLQNAHTGLDLTVPQHQEVRGKMMSGHVEYQILVVTRLAAFKSAKHRPEDVVQFLVSKKYSEIEEFYQKLSSRYAAASLPPLPRKVLFVGESDIRERRAVFNEILRCVSKDAELAGSPELLEFLGTRSPGAAGLTSRDSSVLDGTDSQTGNDEEAFDFFEEQDQVAEEGPPVQSLKGEDAEESLEEEEALDPLGIMRLVSCC

SEQ ID NO: 37231 - protein, 199 aa, Homo sapiens
  Payload ID: 7389
  Gene Symbol: HS1BP3
  Gene Name: HCLS1 binding protein 3
  ENSP ID: ENSP00000385788
MQSPAVLVTSRRLQNAHTGLDLTVPQHQEVRGKMMSGHVEYQILVVTRLAAFKSAKHRPEDVVQFLVSKKYSEIEEFYQKLSSRYAAASLPPLPRKVLFVGESDIRERRAVFNEILRCVSKDAELAGSPELLEFLGTQGSAPCPSGLPGPELGPAAVPQWEHVHSCLCSLEASARLVRQVASLTSLAGWWAEGGLPLRD

SEQ ID NO: 37232 - protein, 74 aa, Homo sapiens
  Payload ID: 7389
  Gene Symbol: HS1BP3
  Gene Name: HCLS1 binding protein 3
  ENSP ID: ENSP00000387364
  MOD_RES (1)..(1): Any amino acid
XSPQDPSEDVSSVDPLKLFDDPDLGGAIPLGDSLLLPAACESGGPTPSLSHRDASKELFRWDHLVAGKQAQGSH

SEQ ID NO: 37233 - protein, 123 aa, Homo sapiens
  Payload ID: 7389
  Gene Symbol: HS1BP3
  Gene Name: HCLS1 binding protein 3
  ENSP ID: ENSP00000389960
MRSKKPKKHPKVAVKAKPSPRLTIFDEEVDPDEGLFGPGRKLSPQDPSEDVSSVDPLKLFDDPDLGGAIPLGDSLLLPAACESGGPTPSLSHRDASKELFRTLAHKGFQCAQSNCLLTSPRIP

SEQ ID NO: 37234 - protein, 132 aa, Homo sapiens
  Payload ID: 7389
  Gene Symbol: HS1BP3
  Gene Name: HCLS1 binding protein 3
  ENSP ID: ENSP00000392203
PVQSLKGEDAEESLEEEEALDPLGIMRSKKPKKHPKVAVKAKPSPRLTIFDEEVDPDEGLFGPGRKLSPQDPSEDVSSVDPLKLFDDPDLGGAIPLGDSLLLPAACESGGPTPSLSHRDASKELFRQIQKEP

SEQ ID NO: 37235 - protein, 111 aa, Homo sapiens
  Payload ID: 7389
  Gene Symbol: HS1BP3
  Gene Name: HCLS1 binding protein 3
  ENSP ID: ENSP00000397546
  MOD_RES (1)..(1): Any amino acid
XSKKPKKHPKVAVKAKPSPRLTIFDEEVDPDEGLFGPGRKLSPQDPSEDVSSVDPLKLFDDPDLGGAIPLGDSLLLPAACESGGPTPSLSHRDASKELFRYHLSPAALGQL

SEQ ID NO: 37236 - protein, 25 aa, Homo sapiens
  Payload ID: 7389
  Gene Symbol: HS1BP3
  Gene Name: HCLS1 binding protein 3
  ENSP ID: ENSP00000486756
MQSPAVLVTSRSPKSTARLRSFTRN

SEQ ID NO: 37237 - protein, 71 aa, Homo sapiens
  Payload ID: 7390
  Gene Symbol: HDDC2
  Gene Name: HD domain containing 2
  Uniprot ID: Q7Z4H3
  ENSP ID: ENSP00000316242
MASVSSATFSGHGARSLLQFLRLVGQLKRVPRTGWVYRNVQRPESVSDHMYRMAVMAMVIKDDRLNKDRKL

SEQ ID NO: 37238 - protein, 204 aa, Homo sapiens
  Payload ID: 7390
  Gene Symbol: HDDC2
  Gene Name: HD domain containing 2
  Uniprot ID: Q7Z4H3
  ENSP ID: ENSP00000381220
MASVSSATFSGHGARSLLQFLRLVGQLKRVPRTGWVYRNVQRPESVSDHMYRMAVMAMVIKDDRLNKDRCVRLALVHDMAECIVGDIAPADNIPKEEKHRREEEAMKQITQLLPEDLRKELYELWEEYETQSSAEAKFVKQLDQCEMILQASEYEDLEHKPGRLQDFYDSTAGKFNHPEIVQLVSELEAERSTNIAAAASEPHS

SEQ ID NO: 37239 - protein, 71 aa, Homo sapiens; identical to SEQ ID NO: 37237
  Payload ID: 7390
  Gene Symbol: HDDC2
  Gene Name: HD domain containing 2
  Uniprot ID: Q7Z4H3
  ENSP ID: ENSP00000476969

SEQ ID NO: 37240 - protein, 107 aa, Homo sapiens
  Payload ID: 7390
  Gene Symbol: HDDC2
  Gene Name: HD domain containing 2
  ENSP ID: ENSP00000477042
MASVSSATFSGHGARSLLQFLRLVGQLKRVPRTGWVYRNVQRPESVSDHMYRMAVMAMVIKDDRLNKDRCVRLALVHDMAECIVGDIAPADNIPKEEKHRREEKRKT

SEQ ID NO: 37241 - protein, 108 aa, Homo sapiens
  Payload ID: 7390
  Gene Symbol: HDDC2
  Gene Name: HD domain containing 2
  ENSP ID: ENSP00000477277
MASVSSATFSGHGARSLLQFLRLVGQLKRVPRTGWVYRNVQRPESVSDHMYRMAVMAMVIKDDRLNKDRCVRLALVHDMAECIVGDIAPADNIPKEEKHRREEVSVDY

SEQ ID NO: 37242 - protein, 140 aa, Homo sapiens
  Payload ID: 7391
  Gene Symbol: HDDC3
  Gene Name: HD domain containing 3
  Uniprot ID: Q8N4P3
  ENSP ID: ENSP00000330721
MGSEAAQLLEAADFAARKHRQQRRKDPEGTPYINHPIGVARILTHEAGITDIVVLQAALLHDTVEDTDTTLDEVELHFGAQVRRLVEEVTDDKTLPKLERKRLQVEQAPHSSPGAKLVKLADKLYNLRDLNRCTPEVKIQ

SEQ ID NO: 37243 - protein, 179 aa, Homo sapiens
  Payload ID: 7391
  Gene Symbol: HDDC3
  Gene Name: HD domain containing 3
  Uniprot ID: Q8N4P3
  ENSP ID: ENSP00000377814
MGSEAAQLLEAADFAARKHRQQRRKDPEGTPYINHPIGVARILTHEAGITDIVVLQAALLHDTVEDTDTTLDEVELHFGAQVRRLVEEVTDDKTLPKLERKRLQVEQAPHSSPGAKLVKLADKLYNLRDLNRCTPEGWSEHRVQEYFEWAAQVVKGLQGTNRQLEEALKHLFKQRGLTI

SEQ ID NO: 37244 - protein, 152 aa, Homo sapiens
  Payload ID: 7391
  Gene Symbol: HDDC3
  Gene Name: HD domain containing 3
  ENSP ID: ENSP00000452937
SGGRTPRGPPTSTTPSVGASAAERRLRHLGGVARILTHEAGITDIVVLQAALLHDTVEDTDTTLDEVELHFGAQVRRLVEEVTDDKTLPKLERKRLQVEQAPHSSPGAKLVKLADKLYNLRDLNRCTPEGWSEHRVQEYFEWAAQVVKGLQG

SEQ ID NO: 37245 - protein, 143 aa, Homo sapiens
  Payload ID: 7391
  Gene Symbol: HDDC3
  Gene Name: HD domain containing 3
  ENSP ID: ENSP00000454103
MGSEAAQLLEAADFAARKHRQQRRKDPEGTPYINHPIGVARILTHEAGITDIVVLQAALLHDTVEDTDTTLDEVELHFGAQVRRLVEEVTDDKTLPKLERKRLQVEQAPHSSPGAKLVKLADKLYNLRDLNRCTPEGTLSYGL

SEQ ID NO: 37246 - protein, 543 aa, Homo sapiens
  Payload ID: 7392
  Gene Symbol: HECA
  Gene Name: hdc homolog, cell cycle regulator
  Uniprot ID: Q9UBI9
  ENSP ID: ENSP00000356630
MPNPKNSKGGRKNKRANSSGDEQENGAGALAAAGAAGAAAGGALAAAAGCGAAAAGAPGAGGAAGAGGAGTGAANAAAAAGAAAAGDAKNEAPCATPLICSFGRPVDLEKDDYQKVVCNNEHCPCSTWMHLQCFYEWESSILVQFNCIGRARSWNEKQCRQNMWTKKGYDLAFRFCSCRCGQGHLKKDTDWYQVKRMQDEKKKKSGSEKNTGRPPGEAAEEAKKCRPPNKPQKGPSHDLPRRHSMDRQNSQEKAVGAAAYGARSPGGSPGQSPPTGYSILSPAHFSGPRSSRYLGEFLKNAIHLEPHKKAMAGGHVFRNAHFDYSPAGLAVHRGGHFDTPVQFLRRLDLSELLTHIPRHKLNTFHVRMEDDAQVGQGEDLRKFILAALSASHRNVVNCALCHRALPVFEQFPLVDGTLFLSPSRHDEIEYDVPCHLQGRLMHLYAVCVDCLEGVHKIICIKCKSRWDGSWHQLGTMYTYDILAASPCCQARLNCKHCGKPVIDVRIGMQYFSEYSNVQQCPHCGNLDYHFVKPFSSFKVLEAY

SEQ ID NO: 37247 - protein, 215 aa, Homo sapiens
  Payload ID: 7393
  Gene Symbol: HAND1
  Gene Name: heart and neural crest derivatives expressed 1
  Uniprot ID: O96004
  ENSP ID: ENSP00000231121
MNLVGSYAHHHHHHHPHPAHPMLHEPFLFGPASRCHQERPYFQSWLLSPADAAPDFPAGGPPPAAAAAATAYGPDARPGQSPGRLEALGGRLGRRKGSGPKKERRRTESINSAFAELRECIPNVPADTKLSKIKTLRLATSYIAYLMDVLAKDAQSGDPEAFKAELKKADGGRESKRKRELQQHEGFPPALGPVEKRIKGRTGWPQQVWALELNQ

SEQ ID NO: 37248 - protein, 217 aa, Homo sapiens
  Payload ID: 7394
  Gene Symbol: HAND2
  Gene Name: heart and neural crest derivatives expressed 2
  Uniprot ID: P61296
  ENSP ID: ENSP00000352565
MSLVGGFPHHPVVHHEGYPFAAAAAAAAAAAASRCSHEENPYFHGWLIGHPEMSPPDYSMALSYSPEYASGAAGLDHSHYGGVPPGAGPPGLGGPRPVKRRGTANRKERRRTQSINSAFAELRECIPNVPADTKLSKIKTLRLATSYIAYLMDLLAKDDQNGEAEAFKAEIKKTDVKEEKRKKELNEILKSTVSSNDKKTKGRTGWPQHVWALELKQ

SEQ ID NO: 37249 - protein, 92 aa, Homo sapiens
  Payload ID: 7394
  Gene Symbol: HAND2
  Gene Name: heart and neural crest derivatives expressed 2
  ENSP ID: ENSP00000427084
  MOD_RES (1)..(1): Any amino acid
XPNVPADTKLSKIKTLRLATSYIAYLMDLLAKDDQNGEAEAFKAEIKKTDVKEEKRKKELNEILKSTVSSNDKKTKGRTGWPQHVWALELKQ

SEQ ID NO: 37250 - protein, 186 aa, Homo sapiens
  Payload ID: 7394
  Gene Symbol: HAND2
  Gene Name: heart and neural crest derivatives expressed 2
  ENSP ID: ENSP00000477638
MSLVGGFPHHPVVHHEGYPFAAAAAAAAAAAASRCSHEENPYFHGWLIGHPEMSPPDYSMALSYSPEYASGTANRKERRRTQSINSAFAELRECIPNVPADTKLSKIKTLRLATSYIAYLMDLLAKDDQNGEAEAFKAEIKKTDVKEEKRKKELNEILKSTVSSNDKKTKGRTGWPQHVWALELKQ

SEQ ID NO: 37251 - protein, 1381 aa, Homo sapiens
  Payload ID: 7395
  Gene Symbol: HEG1
  Gene Name: heart development protein with EGF-like domains 1
  Uniprot ID: Q9ULI3
  ENSP ID: ENSP00000311502
MASPRASRWPPPLLLLLLPLLLLPPAAPGTRDPPPSPARRALSLAPLAGAGLELQLERRPEREPPPTPPRERRGPATPGPSYRAPEPGAATQRGPSGRAPRGGSADAAWKHWPESNTEAHVENITFYQNQEDFSTVSSKEGVMVQTSGKSHAASDAPENLTLLAETADARGRSGSSSRTNFTILPVGYSLEIATALTSQSGNLASESLHLPSSSSEFDERIAAFQTKSGTASEMGTERAMGLSEEWTVHSQEATTSAWSPSFLPALEMGELTTPSRKRNSSGPDLSWLHFYRTAASSPLLDLSSSSESTEKLNNSTGLQSSSVSQTKTMHVATVFTDGGPRTLRSLTVSLGPVSKTEGFPKDSRIATTSSSVLLSPSAVESRRNSRVTGNPGDEEFIEPSTENEFGLTSLRWQNDSPTFGEHQLASSSEVQNGSPMSQTETVSRSVAPMRGGEITAHWLLTNSTTSADVTGSSASYPEGVNASVLTQFSDSTVQSGGSHTALGDRSYSESSSTSSSESLNSSAPRGERSIAGISYGQVRGTAIEQRTSSDHTDHTYLSSTFTKGERALLSITDNSSSSDIVESSTSYIKISNSSHSEYSSFFHAQTERSNISSYDGEYAQPSTESPVLHTSNLPSYTPTINMPNTSVVLDTDAEFVSDSSSSSSSSSSSSSSGPPLPLPSVSQSHHLFSSILPSTRASVHLLKSTSDASTPWSSSPSPLPVSLTTSTSAPLSVSQTTLPQSSSTPVLPRARETPVTSFQTSTMTSFMTMLHSSQTADLKSQSTPHQEKVITESKSPSLVSLPTESTKAVTTNSPLPPSLTESSTEQTLPATSTNLAQMSPTFTTTILKTSQPLMTTPGTLSSTASLVTGPIAVQTTAGKQLSLTHPEILVPQISTEGGISTERNRVIVDATTGLIPLTSVPTSAKEMTTKLGVTAEYSPASRSLGTSPSPQTTVVSTAEDLAPKSATFAVQSSTQSPTTVSSSASVNSCAVNPCLHNGECVADNTSRGYHCRCPPSWQGDDCSVDVNECLSNPCPSTAMCNNTQGSFICKCPVGYQLEKGICNLVRTFVTEFKLKRTFLNTTVEKHSDLQEVENEITKTLNMCFSALPSYIRSTVHASRESNAVVISLQTTFSLASNVTLFDLADRMQKCVNSCKSSAEVCQLLGSQRRIFRAGSLCKRKSPECDKDTSICTDLDGVALCQCKSGYFQFNKMDHSCRACEDGYRLENETCMSCPFGLGGLNCGNPYQLITVVIAAAGGGLLLILGIALIVTCCRKNKNDISKLIFKSGDFQMSPYAEYPKNPRSQEWGREAIEMHENGSTKNLLQMTDVYYSPTSVRNPELERNGLYPAYTGLPGSRHSCIFPGQYNPSFISDESRRRDYF

SEQ ID NO: 37252 - protein, 63 aa, Homo sapiens
  Payload ID: 7395
  Gene Symbol: HEG1
  Gene Name: heart development protein with EGF-like domains 1
  ENSP ID: ENSP00000417494
RKNKNDISKLIFKSGDFQMSPYAEYPKNPRSQEWGREAIEMHENGSTKNLLQMTDVYYSGAFF

SEQ ID NO: 37253 - protein, 265 aa, Homo sapiens [sequence omitted]

SEQ ID NO: 37254 - protein, 120 aa, Homo sapiens
  Payload ID: 7396
  Gene Symbol: HEATR1
  Gene Name: HEAT repeat containing 1
  ENSP ID: ENSP00000355538
MTSLAQQLQRLALPQSDASLLSRDEVASLLFDPKEAATIDRDTAFAIGCTGLEELLGIDPSFEQFEAPLFSQLAKTLERSVQTKAVNKQLDENISLFLIHLSPYFLLKPAQKCLEWLIHR

SEQ ID NO: 37255 - protein, 2063 aa, Homo sapiens
  Payload ID: 7396
  Gene Symbol: HEATR1
  Gene Name: HEAT repeat containing 1
  ENSP ID: ENSP00000355540
MTSLAQQLQRLALPQSDASLLSRDEVASLLFDPKEAATIDRDTAFAIGCTGLEELLGIDPSFEQFEAPLFSQLAKTLERSVQTKAVNKQLDENISLFLIHLSPYFLLKPAQKCLEWLIHRFHIHLYNQDSLIACVLPYHETRIFVRVIQLLKINNSKHRWFWLLPVKQSGVPLAKGTLITHCYKDLGFMDFICSLVTKSVKVFAEYPGSSAQLRVLLAFYASTIVSALVAAEDVSDNIIAKLFPYIQKGLKSSLPDYRAATYMIICQISVKVTMENTFVNSLASQIIKTLTKIPSLIKDGLSCLIVLLQRQKPESLGKKPFPHLCNVPDLITILHGISETYDVSPLLHYMLPHLVVSIIHHVTGEETEGMDGQIYKRHLEAILTKISLKNNLDHLLASLLFEEYISYSSQEEMDSNKVSLLNEQFLPLIRLLESKYPRTLDVVLEEHLKEIADLKKQELFHQFVSLSTSGGKYQFLADSDTSLMLSLNHPLAPVRILAMNHLKKIMKTSKEGVDESFIKEAVLARLGDDNIDVVLSAISAFEIFKEHFSSEVTISNLLNLFQRAELSKNGEWYEVLKIAADILIKEEILSENDQLSNQVVVCLLPFMVINNDDTESAEMKIAIYLSKSGICSLHPLLRGWEEALENVIKSTKPGKLIGVANQKMIELLADNINLGDPSSMLKMVEDLISVGEEESFNLKQKVTFHVILSVLVSCCSSLKETHFPFAIRVFSLLQKKIKKLESVITAVEIPSEWHIELMLDRGIPVELWAHYVEELNSTQRVAVEDSVFLVFSLKKFIYALKAPKSFPKGDIWWNPEQLKEDSRDYLHLLIGLFEMMLNGADAVHFRVLMKLFIKVHLEDVFQLFKFCSVLWTYGSSLSNPLNCSVKTVLQTQALYVGCAMLSSQKTQCKHQLASISSPVVTSLLINLGSPVKEVRRAAIQCLQALSGVASPFYLIIDHLISKAEEITSDAAYVIQDLATLFEELQREKKLKSHQKLSETLKNLLSCVYSCPSYIAKDLMKVLQGVNGEITKPFFAAISDEKVQQKLLRMLFDLLVNCKNSHCAQTVSSVFKGISVNAEQVRIELEPPDKAKPLGTVQQKRRQKMQQKKSQDLESVQEVGGSYWQRVTLILELLQHKKKLRSPQILVPTLFNLLSRCLEPLPQEQGNMEYTKQLILSCLLNICQKLSPDGGKIPKDILDEEKFNVELIVQCIRLSEMPQTHHHALLLLGTVAGIFPDKVLHNIMSIFTFMGANVMRLDDTYSFQVINKTVKMVIPALIQSDSGDSIEVSRNVEEIVVKIISVFVDALPHVPEHRRLPILVQLVDTLGAEKFLWILLILLFEQYVTKTVLAAAYGEKDAILEADTEFWFSVCCEFSVQHQIQSLMNILQYLLKLPEEKEETIPKAVSFNKSESQEEMLQVFNVETHTSKQLRHFKFLSVSFMSQLLSSNNFLKKVVESGGPEILKGLEERLLETVLGYISAVAQSMERNADKLTVKFWRALLSKAYDLLDKVNALLPTETFIPVIRGLVGNPLPSVRRKALDLLNNKLQQNISWKKTIVTRFLKLVPDLLAIVQRKKKEGEEEQAINRQTALYTLKLLCKNFGAENPDPFVPVLNTAVKLIAPERKEEKNVLGSALLCIAEVTSTLEALAIPQLPSLMPSLLTTMKNTSELVSSEVYLLSALAALQKVVETLPHFISPYLEGILSQVIHLEKITSEMGSASQANIRLTSLKKTLATTLAPRVLLPAIKKTYKQIEKNWKNHMGPFMSILQEHIGVMKKEELTSHQSQLTAFFLEALDFRAQHSENDLEEVGKTENCIIDCLVAMVVKLSEVTFRPLFFKLFDWAKTEDAPKDRLLTFYNLADCIAEKLKGLFTLFAGHLVKPFADTLNQVNISKTDEAFFDSENDPEKCCLLLQFILNCLYKIFLFDTQHFISKERAEALMMPLVDQLENRLGGEEKFQERVTKHLIPCIAQFSVAMADDSLWKPLNYQILLKTRDSSPKVRFAALITVLALAEKLKENYIVLLPESIPFLAELMEDECEEVEHQCQKTIQQLETVLGEPLQSYF

SEQ ID NO: 37256 - protein, 2144 aa, Homo sapiens
  Payload ID: 7396
  Gene Symbol: HEATR1
  Gene Name: HEAT repeat containing 1
  Uniprot ID: Q9H583
  ENSP ID: ENSP00000355541
MTSLAQQLQRLALPQSDASLLSRDEVASLLFDPKEAATIDRDTAFAIGCTGLEELLGIDPSFEQFEAPLFSQLAKTLERSVQTKAVNKQLDENISLFLIHLSPYFLLKPAQKCLEWLIHRFHIHLYNQDSLIACVLPYHETRIFVRVIQLLKINNSKHRWFWLLPVKQSGVPLAKGTLITHCYKDLGFMDFICSLVTKSVKVFAEYPGSSAQLRVLLAFYASTIVSALVAAEDVSDNIIAKLFPYIQKGLKSSLPDYRAATYMIICQISVKVTMENTFVNSLASQIIKTLTKIPSLIKDGLSCLIVLLQRQKPESLGKKPFPHLCNVPDLITILHGISETYDVSPLLHYMLPHLVVSIIHHVTGEETEGMDGQIYKRHLEAILTKISLKNNLDHLLASLLFEEYISYSSQEEMDSNKVSLLNEQFLPLIRLLESKYPRTLDVVLEEHLKEIADLKKQELFHQFVSLSTSGGKYQFLADSDTSLMLSLNHPLAPVRILAMNHLKKIMKTSKEGVDESFIKEAVLARLGDDNIDVVLSAISAFEIFKEHFSSEVTISNLLNLFQRAELSKNGEWYEVLKIAADILIKEEILSENDQLSNQVVVCLLPFMVINNDDTESAEMKIAIYLSKSGICSLHPLLRGWEEALENVIKSTKPGKLIGVANQKMIELLADNINLGDPSSMLKMVEDLISVGEEESFNLKQKVTFHVILSVLVSCCSSLKETHFPFAIRVFSLLQKKIKKLESVITAVEIPSEWHIELMLDRGIPVELWAHYVEELNSTQRVAVEDSVFLVFSLKKFIYALKAPKSFPKGDIWWNPEQLKEDSRDYLHLLIGLFEMMLNGADAVHFRVLMKLFIKVHLEDVFQLFKFCSVLWTYGSSLSNPLNCSVKTVLQTQALYVGCAMLSSQKTQCKHQLASISSPVVTSLLINLGSPVKEVRRAAIQCLQALSGVASPFYLIIDHLISKAEEITSDAAYVIQDLATLFEELQREKKLKSHQKLSETLKNLLSCVYSCPSYIAKDLMKVLQGVNGEMVLSQLLPMAEQLLEKIQKEPTAVLKDEAMVLHLTLGKYNEFSVSLLNEDPKSLDIFIKAVHTTKELYAGMPTIQITALEKITKPFFAAISDEKVQQKLLRMLFDLLVNCKNSHCAQTVSSVFKGISVNAEQVRIELEPPDKAKPLGTVQQKRRQKMQQKKSQDLESVQEVGGSYWQRVTLILELLQHKKKLRSPQILVPTLFNLLSRCLEPLPQEQGNMEYTKQLILSCLLNICQKLSPDGGKIPKDILDEEKFNVELIVQCIRLSEMPQTHHHALLLLGTVAGIFPDKVLHNIMSIFTFMGANVMRLDDTYSFQVINKTVKMVIPALIQSDSGDSIEVSRNVEEIVVKIISVFVDALPHVPEHRRLPILVQLVDTLGAEKFLWILLILLFEQYVTKTVLAAAYGEKDAILEADTEFWFSVCCEFSVQHQIQSLMNILQYLLKLPEEKEETIPKAVSFNKSESQEEMLQVFNVETHTSKQLRHFKFLSVSFMSQLLSSNNFLKKVVESGGPEILKGLEERLLETVLGYISAVAQSMERNADKLTVKFWRALLSKAYDLLDKVNALLPTETFIPVIRGLVGNPLPSVRRKALDLLNNKLQQNISWKKTIVTRFLKLVPDLLAIVQRKKKEGEEEQAINRQTALYTLKLLCKNFGAENPDPFVPVLNTAVKLIAPERKEEKNVLGSALLCIAEVTSTLEALAIPQLPSLMPSLLTTMKNTSELVSSEVYLLSALAALQKVVETLPHFISPYLEGILSQVIHLEKITSEMGSASQANIRLTSLKKTLATTLAPRVLLPAIKKTYKQIEKNWKNHMGPFMSILQEHIGVMKKEELTSHQSQLTAFFLEALDFRAQHSENDLEEVGKTENCIIDCLVAMVVKLSEVTFRPLFFKLFDWAKTEDAPKDRLLTFYNLADCIAEKLKGLFTLFAGHLVKPFADTLNQVNISKTDEAFFDSENDPEKCCLLLQFILNCLYKIFLFDTQHFISKERAEALMMPLVDQLENRLGGEEKFQERVTKHLIPCIAQFSVAMADDSLWKPLNYQILLKTRDSSPKVRFAALITVLALAEKLKENYIVLLPESIPFLAELMEDECEEVEHQCQKTIQQLETVLGEPLQSYF

SEQ ID NO: 37257 - protein, 680 aa, Homo sapiens
  Payload ID: 7397
  Gene Symbol: HEATR3
  Gene Name: HEAT repeat containing 3
  Uniprot ID: Q7Z4Q2
  ENSP ID: ENSP00000299192
MGKSRTKRFKRPQFSPTGDCQAEAAAAANGTGGEEDDGPAAELLEKLQHPSAEVRECACAGLARLVQQRPALPGLARRDAVRRLGPLLLDPSLAVRETAAGALRNLSACGGFEVCDDMVTKDIMTPLVALLKECSAGLDSNEMSLQEKKDQNRNSIENIANETVNVLWNICECSSRAVSIFNKEGCLEIVLKYLSRFPTNVDLAISVAYCLQTVTEDNPELLKSFSATALNMLESALLSPVSSMESLLLKTLVAGTIWNLKDIIPCKSQAEIINALLKILSEVLGMDAGEMVIQMKEAETQRLKTAAEAEEILENTNGDDLIEDDEMEGISHKRRVRRKTFVSDLLPPTDKELRETIALLTAQQTALEIIVNMCCNEDPSDDEWEELSSSDESDAFMENSFSECGGQLFSPLCLSHEVHTALTNYLIPKKIFEKTAFPNSIAVDLCSRNPTWKPLIRKMNTIQCRALFCLQSLVSLLDVEHLGGAAALQTLAQHLSQLLFSQPDFAKHVDFLEAISSALRALLQTMASKNISQCMTPDQLMTLCKAGIHSSNVGVRVNVVSILGITGSVLAKEDGTLETLKNIGCFLLEVTTKDPSLVVAGEALDALFDVFADGKEAERASIQIKLLSALKEFQPVFKMKIRKEGRGNYSTDQLCVLDNVKMNLRRFIAYQETVEKRLTS

SEQ ID NO: 37258 - protein, 1026 aa, Homo sapiens
  Payload ID: 7398
  Gene Symbol: HEATR4
  Gene Name: HEAT repeat containing 4
  Uniprot ID: Q86WZ0
  ENSP ID: ENSP00000335447
MTRTQKGKTFLPHCFYQSLPPRLGWGMILNYSKLKGKEECASVSSVPMVFFSSQYRLHRKSQYLKMAAANLTFSQEVVWQRGLPSIPYSQYSFDHLYNTNDIIHTPQIRKARPQKPVSFKFLGSSSPLTGDTSLAVKTESSANPEKKLKKSKPASTVREAPRPLIHHPCMHPDMLGRPPSLDVNLEEREAWLLPPEKEARAWEATVLEKLNERTARWIQSKRPRRPGASPNKWQSFLRQQYDWSHIRDELTSASDLELLKQLEAEETAEFEDQSVILPPQEKKKPELLLPVYYRLPSYFQQAETVEIMPGNKSTEDIHEKTSLSQPQTQSYFRQVTPRAGKFAYSTDNTFEQEIYFDEVQIIHQIGAKRDQIVLENLNRYNKQLSKVFPETPEKWSAQAIPEASYRPVQGALRWTALPTPAKDMLLQVGEKDVPIKTRRLKKQAKSLQEDVTWELVVLRRMLKEWKTAWALIIEWHHETVENLLQSLGDLHDDVRIKAITTCATAALERPRIATSQRDSDKTIQDLPEVLLPALEAALCDKNAHVRMAAAICQYAIQSHNPLARNIMQTALLKGNSVDSWAAAQCLALEGTATYPVIKRILHQLFTKKNEDTEEQSYILLSYLSEKTTLIHTMLAVELNSCQWKNRIVACQAFSRISGNVCLDMKHKLIQLMWNDWNKEVRRAAAQALGQMSLGKEVHDIIRVKLGQGNSQERVEALYLIGELKLMTAKLLPSFLHCFSDDFTAVRRAACLAAGALQIRDKMVLECLLNLMQRDPYWKIKAFAIRALGQIGQVSPELTDLLLWAIHYEESPGVRLEACRSILALKLQGDRVRDTFLDVLLLENHDAVLKEMYQTMKILNLGNEGNQEMLQEIKNRIKTLSQKDLLTHKILKLEMVMGKVREEAKRVYLKPKGEQGPLTLQTLLQETFQDEMVLPRRPSEVCDTEAVIKPVKPRAPNPWLQSSVPGLTTRSKVRSSLVKDLRTSPEKRIAVGPFRSDYPALYLGKFSERTFFSPIMSSPSGKKGAHL

SEQ ID NO: 37259 - protein, 1026 aa, Homo sapiens; identical to SEQ ID NO: 37258
  Payload ID: 7398
  Gene Symbol: HEATR4
  Gene Name: HEAT repeat containing 4
  Uniprot ID: Q86WZ0
  ENSP ID: ENSP00000450444

SEQ ID NO: 37260 - protein, 39 aa, Homo sapiens
  Payload ID: 7398
  Gene Symbol: HEATR4
  Gene Name: HEAT repeat containing 4
  ENSP ID: ENSP00000451367
MTRTQKGKTFLPHCFYQSLPPRLGWGMILNYSKLKGKEE

SEQ ID NO: 37261 - protein, 191 aa, Homo sapiens
  Payload ID: 7398
  Gene Symbol: HEATR4
  Gene Name: HEAT repeat containing 4
  ENSP ID: ENSP00000452407
MTRTQKGKTFLPHCFYQSLPPRLGWGMILNYSKLKGKEECASVSSVPMVFFSSQYRLHRKSQYLKMAAANLTFSQEVVWQRGLPSIPYSQYSFDHLYNTNDIIHTPQIRKARPQKPVSFKFLGSSSPLTGDTSLAVKTESSANPEKKLKKSKPASTVREAPRPLIHHPCMHPDMLGRPPSLDVNLEEREAW

SEQ ID NO: 37262 - protein, 36 aa, Homo sapiens
  Payload ID: 7398
  Gene Symbol: HEATR4
  Gene Name: HEAT repeat containing 4
  ENSP ID: ENSP00000456792
MTRTQKGKTFLPHCFYQSLPPRLGWGMILNYSKLKG

SEQ ID NO: 37263 - protein, 113 aa, Homo sapiens
  Payload ID: 7399
  Gene Symbol: HEATR5A
  Gene Name: HEAT repeat containing 5A
  Uniprot ID: Q86XA9
  ENSP ID: ENSP00000371903
MELAHSLLLNEEAYNQLGEVQKAEFIFEWLRYLEKLLLATSRNDVREKQKTLVEQLLSLLNSSPGPPTRKLLAKNLAILYSIGDTFSVHEAIDKCNDLIRSKDDSPSYLPTKL

SEQ ID NO: 37264 - protein, 2046 aa, Homo sapiens
  Payload ID: 7399
  Gene Symbol: HEATR5A
  Gene Name: HEAT repeat containing 5A
  ENSP ID: ENSP00000437968
MELAHSLLLNEEAYNQLGEVQKAEFIFEWLRYLEKLLLATSRNDVREKQKTLVEQLLSLLNSSPGPPTRKLLAKNLAILYSIGDTFSVHEAIDKCNDLIRSKDDSPSYLPTKLAAVVCLGSLYKKLGRILGNTFTDTVGNILKAMKSAESQGRYEIMLSLQNILNGLGAAAAPCHRDVYKAARSCLTDRSMAVRCAAAKCLLELQNEAIFMWSTDLDSVATLCFKSFEGSNYDVRISVSKLLGIILAKAVISKHPGTAASRQSIRRVSLEEVLELLGTGFLRGSSGFLRASGDMLKGTSSVSRDVRVGVTQAYVVFVSTLGGAWLEKNFAAFFSHILSLASPSHPKATQTQIDAVCCRRCVSFILRTTIGGLLGEKAQLAAVKDICQAIWKLKKVMDAVMSDGNLETRLGSTDVAASQHMLVCALQELGNLIHNLGTTAAPLLQDSSTGLLDSILSVILHPSISVRLAAAWCLHCIAVALPSYLTPLLDRCLERLTGHKSSPEAVTGFSFAVAALLGAVKHCPLGIPHGKGKIIMTLAEDLLCSAAQNSRLSAQRTQAGWLLISALMTLGPAVVSHHLARVLLLWKCVFPASPKDLETEKSRGDSFTWQVTLEGRAGALCAIKSFVSHCGDLLTEEVTQRLLPPLPCAVDLLTQLSSILKMYGSPLKTPSVVYRQRLYELLILLPPETYEGNLCAILRELAADLTAPDIQVAASTFLLPPLCHQDDLLILSPFLQETDHRFIEEQLLLGNGVACGSLEYDPYSIYEKDVEGDSVPKPLPPALSVISSASKLFGVVCAHVGETQRLLILEQLLDSIKHTKGARQQVVQLHVVSSVSSFLKYVAGSKGCLGPEEMKRFALTLVMGALESPNPLLRCAAAESWARLAQVVDDGAFTAGLAQVSFDKLKSARDVVTRTGHSLALGSLHRYLGGISSSQHLNSCIGILYTLAQDSTSPDVQTWALHSLSLIIDSAGPLYYVHVEPTLSLIIMLLLNVPPTHAEVHQSLGRCLNALITTLGPELQGNSTSISTLRTSCLLGCAVMQDNPDCLVQAQAISCLQQLHMFAPRHVNLSSLVSCLCVNLCSPYLLLRRAVLACLRQLVQREAAEVSEHAVMLAKDSREELTPDANIREVGLEGALLILLDKETDERLCHDIKETLNYMLTSMAVEKLSLWLKLCKDVLAASADFTAVTCVDTMQEEEGDKGDDASVLTTRRDEKSHPFTNPRWATRVFAAECVCRIINQCENANSAHFDIALAQEMKKRDSRNDFLVLHLADLIRMAFMAATDHSDQLRLSGLEMLLVVIRRFATVPEPEFPGHVILEQYQANVGAALRPAFTSETPPDVTAKACQVCSAWIASGVVSDLNDLRRVHQLLVSSLTKIQAGKEALSHLYNESASTMEILAVLKAWAEVYIIAVQRHKNHRQPLKTTTCLEDGIRNGSCSSDGLLDLVYADLGTLSRLWLAALQDFALLTLPSEFASQLPAEGGAFYTAETSENAKLHYYNSWALILHATALWLTSTGFVVADPDEGASNLSRPVTPTSMCQGSSSGATIKSPEDVYTDRFHLILGISVEFLCSLRSDATMESITACLHALQALLDVPWPRSKIGSDQDLGIELLNVLHRVILTRESPSIQLASLEVVRQIICAAQEHVKEKRRSAEVDDGAAEKETLPEFGEGKDTGGLVPGKSLVFATLELCVCILVRQLPELNPKLTGSPGVKATKPQILLEDGSRLVSAALVILSELPAVCSPEGSISILPTILYLTIGVLRETAVKLPGGQLSSTVAASLQALKGILSSPMARAEKSRTAWTDLLRSALTTILDCWDPVDETHQELDEVSLLTAITVFILSTSPEVTTIPCLQKRCIDKFKATLEIKDPVVQIKTYQLLHSIFQYPNPAVSYPYIYSLASCIMEKLQEIDKRKPENTAELEIFQEGIKVLETLVTVAEEHHRAQLVACLLPILISFLLDENSLGSATSIMRNLHDFALQNLMQIGPQYSSVFKSLVASSPALKARLEAAIKGNQESVKVKIPTSKYTKSPGKNSSIQLKTSFL

SEQ ID NO: 37265 - protein, 1599 aa, Homo sapiens
  Payload ID: 7399
  Gene Symbol: HEATR5A
  Gene Name: HEAT repeat containing 5A
  ENSP ID: ENSP00000439979
  MOD_RES (1)..(1): Any amino acid
XGEKAQLAAVKDICQAIWKLKKVMDAVMSDGNLETRLGSTDVAASQHMLVCALQELGNLIHNLGTTAAPLLQDSSTGLLDSILSVILHPSISVRLAAAWCLHCIAVALPSYLTPLLDRCLERLTGHKSSPEAVTGFSFAVAALLGAVKHCPLGIPHGKGKIIMTLAEDLLCSAAQNSRLSAQRTQAGWLLISALMTLGPAVVSHHLARVLLLWKCVFPASPKDLETEKSRGDSFTWQVTLEGRAGALCAIKSFVSHCGDLLTEEVTQRLLPPLPCAVDLLTQLSSILKMYGSPLKTPSVVYRQRLYELLILLPPETYEGNLCAILRELAADLTAPDIQVAASTFLLPPLCHQDDLLILSPFLQETDHRFIEEQLLLGNGVACGSLEYDPYSIYEKDVEGDSVPKPLPPALSVISSASKLFGVVCAHVGETQRLLILEQLLDSIKHTKGARQQVVQLHVVSSVSSFLKYVAGSKGCLGPEEMKRFALTLVMGALESPNPLLRCAAAESWARLAQVVDDGAFTAGLAQVSFDKLKSARDVVTRTGHSLALGSLHRYLGGISSSQHLNSCIGILYTLAQDSTSPDVQTWALHSLSLIIDSAGPLYYVHVEPTLSLIIMLLLNVPPTHAEVHQSLGRCLNALITTLGPELQGNSTSISTLRTSCLLGCAVMQDNPDCLVQAQAISCLQQLHMFAPRHVNLSSLVSCLCVNLCSPYLLLRRAVLACLRQLVQREAAEVSEHAVMLAKDSREELTPDANIREVGLEGALLILLDKETDERLCHDIKETLNYMLTSMAVEKLSLWLKLCKDVLAASADFTAVTCVDTMQEEEGDKGDDASVLTTRRDEKSHPFTNPRWATRVFAAECVCRIINQCENANSAHFDIALAQEMKKRDSRNDFLVLHLADLIRMAFMAATDHSDQLRLSGLEMLLVVIRRFATVPEPEFPGHVILEQYQANVGAALRPAFTSETPPDVTAKACQVCSAWIASGVVSDLNDLRRVHQLLVSSLTKIQAGKEALSHLYNESASTMEILAVLKAWAEVYIIAVQRHKNHRQPLKTTTCLEDGIRNGSCSSDGLLDLVYADLGTLSRLWLAALQDFALLTLPSEFASQLPAEGGAFYTAETSENAKLHYYNSWALILHATALWLTSTGFVVADPDEGASNLSRPVTPTSMCQGSSSGATIKSPEDVYTDRFHLILGISVEFLCSLRSDATMESITACLHALQALLDVPWPRSKIGSDQDLGIELLNVLHRVILTRESPSIQLASLEVVRQIICAAQEHVKEKRRSAEVDDGAAEKETLPEFGEGKDTGGLVPGKSLVFATLELCVCILVRQLPELNPKLTGSPGVKATKPQILLEDGSRLVSAALVILSELPAVCSPEVDETHQELDEVSLLTAITVFILSTSPEVTTIPCLQKRCIDKFKATLEIKDPVVQIKTYQLLHSIFQYPNPAVSYPYIYSLASCIMEKLQEIDKRKPENTAELEIFQEGIKVLETLVTVAEEHHRAQLVACLLPILISFLLDENSLGSATSIMRNLHDFALQNLMQIGPQYSSVFKSLVASSPALKARLEAAIKGNQESVKVKIPTSKYTKSPGKNSSIQLKTSFL

SEQ ID NO: 37266 - protein, 124 aa, Homo sapiens
  Payload ID: 7399
  Gene Symbol: HEATR5A
  Gene Name: HEAT repeat containing 5A
  ENSP ID: ENSP00000446884
  MOD_RES (1)..(1): Any amino acid
XLLLRRAVLACLRQLVQREAAEVSEHAVMLAKDSREELTPDANIREVGLEGALLILLDKETDERLCHDIKETLNYMLTSMAVEKLSLWLKLCKDVLAASAGKYWTLSVKIIKLKFETLHKIVYH

SEQ ID NO: 37267 - protein, 199 aa, Homo sapiens
  Payload ID: 7399
  Gene Symbol: HEATR5A
  Gene Name: HEAT repeat containing 5A
  ENSP ID: ENSP00000447708
  MOD_RES (1)..(1): Any amino acid
XSLIIMLLLNVPPTHAEVHQSLGRCLNALITTLGPELQGNSTSISTLRTSCLLGCAVMQDNPDCLVQAQAISCLQQLHMFAPRHVNLSSLVSCLCEILLDNSVLVNLCSPYLLLRRAVLACLRQLVQREAAEVSEHAVMLAKDSREELTPDANIREVGLEGALLILLDKETDERLCHDIKETLNYMLTSMAVEKLSLWL

SEQ ID NO: 37268 - protein, 87 aa, Homo sapiens
  Payload ID: 7399
  Gene Symbol: HEATR5A
  Gene Name: HEAT repeat containing 5A
  ENSP ID: ENSP00000450262
MELAHSLLLNEEAYNQLGEVQKAEFIFEWLRYLEKLLLATSRNDVREKQKTLVEQLLSLLNSSPGPPTRKLLAKNLAILYSIGDTFS

SEQ ID NO: 37269 - protein, 896 aa, Homo sapiens
  Payload ID: 7399
  Gene Symbol: HEATR5A
  Gene Name: HEAT repeat containing 5A
  ENSP ID: ENSP00000450296
  MOD_RES (1)..(1): Any amino acid
XSHPKATQTQIDAVCCRRCVSFILRTTIGGLLGEKAQLAAVKDICQAIWKLKKVMDVAASQHMLVCALQELGNLIHNLGTTAAPLLQDSSTGLLDSILSVILHPSISVRLAAAWCLHCIAVALPSYLTPLLDRCLERLTGHKSSPEAVTGFSFAVAALLGAVKHCPLGIPHGKGKIIMTLAEDLLCSAAQNSRLSAQRTQAGWLLISALMTLGPAVVSHHLARVLLLWKCVFPASPKDLETEKSRGDSFTWQVTLEGRAGALCAIKSFVSHCGDLLTEEVTQRLLPPLPCAVDLLTQLSSILKMYGSPLKTPSVVYRQRLYELLILLPPETYEGNLCAILRELAADLTAPDIQVAASTFLLPPLCHQDDLLILSPFLQETDHRFIEEQLLLGNGVACGSLEYDPYSIYEKDVEGDSVPKPLPPALSVISSASKLFGVVCAHVGETQRLLILEQLLDSIKHTKGARQQVVQLHVVSSVSSFLKYVAGSKGCLGPEEMKRFALTLVMGALESPNPLLRCAAAESWARLAQVVDDGAFTAGLAQVSFDKLKSARDVVTRTGHSLALGSLHRYLGGISSSQHLNSCIGILYTLAQDSTSPDVQTWALHSLSLIIDSAGPLYYVHVEPTLSLIIMLLLNVPPTHAEVHQSLGRCLNALITTLGPELQGNSTSISTLRTSCLLGCAVMQDNPDCLVQAQAISCLQQLHMFAPRHVNLSSLVSCLCVNLCSPYLLLRRAVLACLRQLVQREAAEVSEHAVMLAKDSREELTPDANIREVGLEGALLILLDKETDERLCHDIKETLNYMLTSMAVEKLSLWLKLCKDVLAASADFTAVTCVDTMQEEEGDKGDDASVLTTRRDEKSHPFTNPRWATRVFAAECVCRIINQCENANSAHFDIALA

SEQ ID NO: 37270 - protein, 2071 aa, Homo sapiens
  Payload ID: 7400
  Gene Symbol: HEATR5B
  Gene Name: HEAT repeat containing 5B
  Uniprot ID: Q9P2D3
  ENSP ID: ENSP00000233099
MELAHSLLLNEEALAQITEAKRPVFIFEWLRFLDKVLVAANKTDVKEKQKKLVEQLTGLISSSPGPPTRKLLAKNLAALYSIGDTFTVFQTLDKCNDIIRNKDDTAAYLPTKLAAVACVGAFYEKMGRMLGSAFPETVNNLLKSLKSAESQGRSEILMSLQKVLSGLGGAAASSHRDIYKNARSLLTDRSMAVRCAVAKCLLELQNEAVFMWTAELENIATLCFKALENSNYGVRVAVSKLLGTVMATALMPKQATVMRQNVKRATFDEVLELMATGFLRGGSGFLKSGGEMLKVGGSVNREVRVGVTQAYVVFVTTLGGQWLERSFATFLSHVLDLVSHPRATQTHVEAVYSRRCVSFILRATVGSLLGEKAQIAAAKEICQAIGKQMKAVEAVVNDTSGENKSGAADIAASQHVMVCALQELGSLVQSLNATASPLIQEASIGLLEIVTSVLLHPSMAARLAAAWCLRCVAVALPFQLTPFLDRCAERLNNLKTSPEAVSGYSFAMAALLGGVHQCPLGIPHAKGKMVVSIAEDLLRTAAQNSRLSLQRTQAGWLLLGALMTLGPSVVRYHLPKMLLLWRNVFPRSLKELEAEKARGDSFTWQVTLEGRAGALCAMRSFVAHCPELLTEDVIRKLMTPIECAMTMMSHIPSVMKAHGAHLKASAAMVRLRLYDILALLPPKTYEGSFNALLRELVAEFTLTDNSANTTTSLLRSLCHYDDSVLLGSWLQETDHKSIEDQLQPNSASGSGALEHDPSSIYLRIPAGEAVPGPLPLGVSVIDASVALFGVVFPHVSYKHRLQMLDHFAECVKQAKGVRQQAVQLNIFTAVLSALKGLAENKSTLGPEEVRKSALTLVMGPLDNPNPILRCAAGEALGRMAQVVGEATFIARMAQYSFDKLKSARDVVSRTGHSLALGCLHRYVGGIGSGQHLKTSVSILLALAQDGTSPEVQTWSLHSLALIVDSSGPMYRGYVEPTLSLVLTLLLTVPPSHTEVHQCLGRCLGAIITTVGPELQGNGATTSTIRSSCLVGCAITQDHSDSLVQAAAISCLQQLHMFAPRHVNLSSLVPSLCVHLCSSHLLLRRAAVACLRQLAQREAAEVCEYAMSLAKNTGDKESSSANVSPFAPGVSSRTDIHCRHQGVNITETGLEGLLFGMLDRETDRKLCSDIHDTLGHMLSSLAVEKLSHWLMLCKDVLAASSDMSTATLLSSGKDEEAEKKDEMDDDTMFTTLGEEDKSKPFVAPRWATRVFAADCLCRIINLCENADQAHFDLALARSAKLRNPTNDLLVLHLSDLIRMAFMAATDHSNQLRMAGLQALEDIIKKFASVPEPEFPGHVILEQYQANVGAALRPAFSQDTPSDIIAKACQVCSTWIGSGVVSDLNDLRRVHNLLVSSLDKVQAGKGSSSQLYRESATTMEKLAVLKAWAEVYVVAMNIKKEAESKPKRAIKNTDDDDDDCGTIDELPPDSLITLVQPELPTLSRLWLAALKDYALLTLPAEFSSQLPPDGGAFYTPETIDTARLHYRNSWAPILHAVALWLNSTGFTCSESTEAAAISGLQKRSTSVNLNQASGAVGSAKSLPEINKDRMHLILGVSIQFLCSPRPEEPIEHVTACLQALHTLLDSPYARVHIAEDQLIGVELLSVLHRLLLTWNPSSVQLLVTGVVQQIVRAAQDYLQEKRNTLNEDDMEKEACTVLGEGGDSGGLIPGKSLVFATMELLMFILVRHMPHLSTKVSDSPSHIATKTRLSEESARLVAATVTILSDLPSLCSPAGCMTILPTILFLIARILKDTAIKSADNQVPPPVSAALQGIKSIVTLSMAKTEAGVQKQWTALIRSTLACILEYSQPEDSVPTPDEVSMLTAIALFLWSASNEIIGVQSLQNGCMNRFKNALNSCDPWVQAKCYQLLLSVFQHSNRALSTPYIHSLAPIVVEKLKAVERNRPASNIELLAVQEGIKVLETLVALGEEQNRVQLLALLVPTLISYLLDENSFASASSASKDLHEFALQNLMHIGPLYPHAFKTVMGAAPELKVRLETAVRASQASKAKAAARQPAPAIHSAPTIKLKTSFF

SEQ ID NO: 37271 - protein, 115 aa, Homo sapiens
  Payload ID: 7400
  Gene Symbol: HEATR5B
  Gene Name: HEAT repeat containing 5B
  ENSP ID: ENSP00000408222
VQAKCYQLLLSVFQHSNRALSTPYIHSLAPIVVEKLKAVERNRPASNIELLAVQEGIKVLETLVALGEEQNILGSQPESTLRSLPPDPILLPPAHNSQAPVIYPPRPPKVLGLQA

SEQ ID NO: 37272 - protein, 1181 aa, Homo sapiens
  Payload ID: 7401
  Gene Symbol: HEATR6
  Gene Name: HEAT repeat containing 6
  Uniprot ID: Q6AI08
  ENSP ID: ENSP00000184956
MAAVQVVGSWPSVQPREAPREAIPERGNGFRLLSARLCALRPDDSSSARTEIHLLFDQLISENYSEGSGVAPEDVSALLVQACRLVPLNQNHLVSKVSQLIHHLLNRLQVIVDEQHLDFLLAYTISAIHQCSSWTHREILQALAALVYCNGSKCQKYLPELLGNTGLLMKLSDLAQSDPEVRRAAVHCMANLCLSVPGQPYLEEPYQNVCFQAFLTILQSPKSSDMDDITFCMLLQNALKGIQSLLNGGRMKLTQTDELGALLAVLKKFMFHGLPGLNIEMPTVLYPTPLPQYDGRTPIKPQQSESSASRPTLNKKKKSKVKPKKIQQGEEEEKESSGEIEAAPVTGTGRVNLHEGNTWCPSSLGVQSLPLDGSGAAEKDGVSSSFSSSSWKRVSSSESDFSDAEGGMQSKMRSYQAKVRQGALVCFLSTIKSIEKKVLYGYWSAFIPDTPELGSPQSVSLMTLTLKDPSPKTRACALQVLSAILEGSKQFLSVAEDTSDHRRAFTPFSVMIACSIRELHRCLLLALVAESSSQTVTQIIKCLANLVSNAPYDRLKLSLLTKVWNQIKPYIRHKDVNVRVSSLTLLGAIVSTHAPLPEVQLLLQQPCSSGLGNSNSATPHLSPPDWWKKAPAGPSLEETSVSSPKGSSEPCWLIRLCISIVVLPKEDSCSGSDAGSAAGSTYEPSPMRLEALQVLTLLARGYFSMTQAYLMELGEVICKCMGEADPSIQLHGAKLLEELGTGLIQQYKPDSTAAPDQRAPVFLVVMFWTMMLNGPLPRALQNSEHPTLQASACDALSSILPEAFSNLPNDRQMLCITVLLGLNDSKNRLVKAATSRALGVYVLFPCLRQDVIFVADAANAILMSLEDKSLNVRAKAAWSLGNLTDTLIVNMETPDPSFQEEFSGLLLLKMLRSAIEASKDKDKVKSNAVRALGNLLHFLQPSHIEKPTFAEIIEESIQALISTVLTEAAMKVRWNACYAMGNVFKNPALPLGTAPWTSQAYNALTSVVTSCKNFKVRIRSAAALSVPGKREQYGSVDQYARIWNALVTALQKSEDTIDFLEFKYCVSLRTQICQALIHLLSLASASDLPCMKETLELSGNMVQSYILQFLKSGAEGDDTGAPHSPQERDQMVRMALKHMGSIQAPTGDTARRAIMGFLEEILAVCFDSSGSQGALPGLTNQ

SEQ ID NO: 37273 - protein, 1069 aa, Homo sapiens
  Payload ID: 7401
  Gene Symbol: HEATR6
  Gene Name: HEAT repeat containing 6
  ENSP ID: ENSP00000464927
MAAVQVVGSWPSVQPREAPREAIPERGNGFRLLSARLCALRPDDSSSARTEIHLLFDQLISENYSEGSGVAPEDVSALLVQACRLVPLNQNHLVSKVSQLIHHLLNRLQVIVDEQHLDFLLAYTISAIHQCSSWTHREILQALAALVYCNGSKCQKYLPELLGNTGLLMKLSDLAQSDPEVRRAAVHCMANLCLSVPGQPYLEEPYQNVCFQAFLTILQSPKSSDMDDITFCMLLQNALKGIQSLLNGGRMKLTQTDELGALLAVLKKFMFHGLPGLNIEMPTVLYPTPLPQYDGRTPIKPQQSESSASRPTLNKKKKSKVKPKKIQQGEEEEKESSGEIEAAPVTGTGRVNLHEGNTWCPSSLGVQSLPLDGSGAAEKDGVSSSFSSSSWKRVSSSESDFSDAEGGMQSKMRSYQAKVRQGALVCFLSTIKSIEKKVLYGYWSAFIPDTPELGSPQSVSLMTLTLKDPSPKTRACALQVLSAILEGSKQFLSVAEDTSDHRRAFTPFSVMIACSIRELHRCLLLALVAESSSQTVTQIIKCLANLVSNAPYDRLKLSLLTKVWNQIKPYIRHKDVNVRVSSLTLLGAIVSTHAPLPEVQLLLQQPCSSGLGNSNSATPHLSPPDWWKKAPAGPSLEETSVSSPKGSSEPCWLIRLCISIVVLPKEDSCSGSDAGSAAGSTYEPSPMRLEAFSNLPNDRQMLCITVLLGLNDSKNRLVKAATSRALGVYVLFPCLRQDVIFVADAANAILMSLEDKSLNVRAKAAWSLGNLTDTLIVNMETPDPSFQEEFSGLLLLKMLRSAIEASKDKDKVKSNAVRALGNLLHFLQPSHIEKPTFAEIIEESIQALISTVLTEAAMKVRWNACYAMGNVFKNPALPLGTAPWTSQAYNALTSVVTSCKNFKVRIRSAAALSVPGKREQYGSVDQYARIWNALVTALQKSEDTIDFLEFKYCVSLRTQICQALIHLLSLASASDLPCMKETLELSGNMVQSYILQFLKSGAEGDDTGAPHSPQERDQMVRMALKHMGSIQAPTGDTARRAIMGFLEEILAVCFDSSGSQGALPGLTNQ

SEQ ID NO: 37274 - protein, 184 aa, Homo sapiens
  Payload ID: 7401
  Gene Symbol: HEATR6
  Gene Name: HEAT repeat containing 6
  ENSP ID: ENSP00000465429
  MOD_RES (1)..(1): Any amino acid
XAAVQVVGSWPSVQPREAPREAIPERGNGFRLLSARLCALRPDDSSSARTEIHLLFDQLISENYSEGSGVAPEDVSALLVQACRLVPLNQNHLVSKVSQLIHHLLNRLQYLPELLGNTGLLMKLSDLAQSDPEVRRAAVHCMANLCLSVPGQPYLEEPYQNVCFQAFLTILQSPKSSDMDDITF

SEQ ID NO: 37275 - protein, 53 aa, Homo sapiens
  Payload ID: 7401
  Gene Symbol: HEATR6
  Gene Name: HEAT repeat containing 6
  ENSP ID: ENSP00000465540
AKAAWSLGNLTDTLIVNMETPDPSFQEEFSGLLLLKMLRSAIEASKDKDKKLP

SEQ ID NO: 37276 - protein, 24 aa, Homo sapiens
  Payload ID: 7401
  Gene Symbol: HEATR6
  Gene Name: HEAT repeat containing 6
  ENSP ID: ENSP00000465595
  MOD_RES (1)..(1): Any amino acid
XHLVSKVSQLIHHLLNRLQLPMSG

SEQ ID NO: 37277 - protein, 114 aa, Homo sapiens
  Payload ID: 7401
  Gene Symbol: HEATR6
  Gene Name: HEAT repeat containing 6
  ENSP ID: ENSP00000465817
MAAVQVVGSWPSVQPREAPREAIPERGNGFRLLSARLCALRPDDSSSARTEIHLLFDQLISENYSEGSGVAPEDVSALLVQACRLVPLNQNHLVSKVSQLIHHLLNRLQLPMSG

SEQ ID NO: 37278 - protein, 120 aa, Homo sapiens
  Payload ID: 7401
  Gene Symbol: HEATR6
  Gene Name: HEAT repeat containing 6
  ENSP ID: ENSP00000465986
LEELGTGLIQQYKPDSTAAPDQRAPVFLVVMFWTMMLNGPLPRALQNSEHPTLQASACDALSSILPEAFSNLPNDRQMLCITVLLGLNDSKNRLVKAATSRALGVYVLFPCLRQTQQMQY

SEQ ID NO: 37279 - protein, 413 aa, Homo sapiens
  Payload ID: 7401
  Gene Symbol: HEATR6
  Gene Name: HEAT repeat containing 6
  ENSP ID: ENSP00000466192
MAAVQVVGSWPSVQPREAPREAIPERGNGFRLLSARLCALRPDDSSSARTEIHLLFDQLISENYSEGSGVAPEDVSALLVQACRLVPLNQNHLVSKVSQLIHHLLNRLQVIVDEQHLDFLLAYTISAIHQCSSWTHREILQALAALVYCNGSKCQKYLPELLGNTGLLMKLSDLAQSDPEVRRAAVHCMANLCLSVPGQPYLEEPYQNVCFQAFLTILQSPKSSDMDDITFCMLLQNALKGIQSLLNGGRMKLTQTDELGALLAVLKKFMFHGLPGLNIEMPTVLYPTPLPQYDGRTPIKPQQSESSASRPTLNKKKKSKVKPKKIQQGEEEEKESSGEIEAAPVTGTGRVNLHEGNTWCPSSLGVQSLPLDGSGAAEKDGVSSSFSSSSWKRVSSSESDFSDAEGGMQSKMR

SEQ ID NO: 37280 - protein, 213 aa, Homo sapiens
  Payload ID: 7401
  Gene Symbol: HEATR6
  Gene Name: HEAT repeat containing 6
  ENSP ID: ENSP00000468810
MAAVQVVGSWPSVQPREAPREAIPERGNGFRLLSARLCALRPDDSSSARTEIHLLFDQLISENYSEGSGVAPEDVSALLVQACRLVPLNQNHLVSKVSQLIHHLLNRLQSFTLLPRLECGAISAHSKLRLPSLHHSSASASQVAGTTGTRHHVIVDEQHLDFLLAYTISAIHQCSSWTHREILQALAALVYCNGSKCQKYLPELLGNTGLLMK

SEQ ID NO: 37281 - protein, 916 aa, Homo sapiens [sequence omitted]

SEQ ID NO: 37282 - protein, 530 aa, Homo sapiens
  Payload ID: 7402
  Gene Symbol: HEATR9
  Gene Name: HEAT repeat containing 9
  Uniprot ID: A2RTY3
  ENSP ID: ENSP00000473760
MAYEKSTDISDVSRSMFLYPWLEYPDKTKELRKAMAPVHLPLSCYQMPKEEFPPSPECWRQHPSKPNSVPYCYFKKPEIYTHWHDLYDQREEREAEKMLRKMRDDCRYIKEELTKSLESPREDEQFYAAQALGCLRISDKFVMEALQQVAQTGPEKVKYEAYRTLAILGCLNKHVIRALIKQLKEKNEGQRMETLTGLRMALNSWAAVSKDKRTQVGDEGKLVPVLQTLIKKSSSEASLEAALCLGFLRPCSNMVQEFLLQCLCQGLKTQRMKALRMLVKVMHVHSAPVIKAILDQLCSSSVLEDRFEATQMLKTIGLEQIQAQGLEELTFNLLRRKTHNEPFLAVRQAVAQTVEELKLKPTMMNLVEAQLMNPDATARQEAVISLGVLGIRSPQVFHLLLDLLDAENHQAVKKSLQETLILCASIDPWIQNKLKNKVLSVYEAPKTNVKAEPTRFQKEPENPEELTIQDFRLAKLNPLFIAKSITKVGQKKTPAFPPCCSKPRKHRPQVIGPWQPRIKKQLRVLAEIAK

SEQ ID NO: 37283 - protein, 570 aa, Homo sapiens
  Payload ID: 7402
  Gene Symbol: HEATR9
  Gene Name: HEAT repeat containing 9
  Uniprot ID: A2RTY3
  ENSP ID: ENSP00000473941
MAYEKSTDISDVSRSMFLYPWLEYPDKTKELRKAMAPVHLPLSCYQMPKEEFPPSPECWRQHPSKPNSVPYCYFKKPEIYTHWHDLYDQREEREAEKMLRKMRDDCRYIKEVHQTHIKMFHLPMSKLTIKSEMRSRPLEPTQDPLKWQRLRELTKSLESPREDEQFYAAQALGCLRISDKFVMEALQQVAQTGPEKVKYEAYRTLAILGCLNKHVIRALIKQLKEKNEGQRMETLTGLRMALNSWAAVSKDKRTQVGDEGKLVPVLQTLIKKSSSEASLEAALCLGFLRPCSNMVQEFLLQCLCQGLKTQRMKALRMLVKVMHVHSAPVIKAILDQLCSSSVLEDRFEATQMLKTIGLEQIQAQGLEELTFNLLRRKTHNEPFLAVRQAVAQTVEELKLKPTMMNLVEAQLMNPDATARQEAVISLGVLGIRSPQVFHLLLDLLDAENHQAVKKSLQETLILCASIDPWIQNKLKNKVLSVYEAPKTNVKAEPTRFQKEPENPEELTIQDFRLAKLNPLFIAKSITKVGQKKTPAFPPCCSKPRKHRPQVIGPWQPRIKKQLRVLAEIAK

SEQ ID NO: 37284 - protein, 140 aa, Homo sapiens
  Payload ID: 7402
  Gene Symbol: HEATR9
  Gene Name: HEAT repeat containing 9
  ENSP ID: ENSP00000474337
MAYEKSTDISDVSRSMFLYPWLEYPDKTKELRKAMAPVHLPLSCYQMPKEEFPPSPECWRQHPSKPNSVPYCYFKKPEIYTHWHDLYDQREEREAEKMLRKMRDDCRYIKEELTKSLESPREDEQFYAAQALGCLRISDK

SEQ ID NO: 37285 - protein, 283 aa, Homo sapiens
  Payload ID: 7402
  Gene Symbol: HEATR9
  Gene Name: HEAT repeat containing 9
  ENSP ID: ENSP00000474391
MAYEKSTDISDVSRSMFLYPWLEYPDKTKELRKAMAPVHLPLSCYQMPKEEFPPSPECWRQHPSKPNSVPYCYFKKPEIYTHWHDLYDQREEREAEKMLRKMRDDCRYIKEVHQTHIKMFHLPMSKLTIKSEMRSRPLEPTQDPLKWQRLRELTKSLESPREDEQFYAAQALGCLRISDKFVMEALQQVAQTGPEKVKYEAYRTLAILGCLNKHVIRALIKQLKEKNEGQRMETLTGLRMALNSWAAVSKDKVIGRTVFNWGQSWTRGLKSGMRASWCLYYRH

SEQ ID NO: 37286 - protein, 340 aa, Homo sapiens
  Payload ID: 7402
  Gene Symbol: HEATR9
  Gene Name: HEAT repeat containing 9
  Uniprot ID: A2RTY3
  ENSP ID: ENSP00000474893
MAPVHLPLSCYQMPKEEFPPSPECWRQHPSKPNSVPYCYFKKPEIYTHWHDLYDQREEREAEKMLRKMRDDCRYIKEELTKSLESPREDEQFYAAQALGCLRISDKFVMEALQQVAQTGPEKVKYEAYRTLAILGCLNKHVIRALIKQLKEKNEGQRMETLTGLRMALNSWAAVSKDKRTQVGDEGKLVPVLQTLIKKSSSEASLEAALCLGFLRPCSNMVQEFLLQCLCQGLKTQRMKALRMLVKVMHVHSAPVIKAILDQLCSSSVLEDRFEATQMLKTIGLEQIQAQGLEELTFNLLRRKTHNEPFLAVRQAVAQTVEELKLKPTMMNLVEANKRRK

SEQ ID NO: 37287 - protein, 380 aa, Homo sapiens
  Payload ID: 7402
  Gene Symbol: HEATR9
  Gene Name: HEAT repeat containing 9
  Uniprot ID: A2RTY3
  ENSP ID: ENSP00000474899
MAPVHLPLSCYQMPKEEFPPSPECWRQHPSKPNSVPYCYFKKPEIYTHWHDLYDQREEREAEKMLRKMRDDCRYIKEVHQTHIKMFHLPMSKLTIKSEMRSRPLEPTQDPLKWQRLRELTKSLESPREDEQFYAAQALGCLRISDKFVMEALQQVAQTGPEKVKYEAYRTLAILGCLNKHVIRALIKQLKEKNEGQRMETLTGLRMALNSWAAVSKDKRTQVGDEGKLVPVLQTLIKKSSSEASLEAALCLGFLRPCSNMVQEFLLQCLCQGLKTQRMKALRMLVKVMHVHSAPVIKAILDQLCSSSVLEDRFEATQMLKTIGLEQIQAQGLEELTFNLLRRKTHNEPFLAVRQAVAQTVEELKLKPTMMNLVEANKRRK

SEQ ID NO: 37288 - protein, 570 aa, Homo sapiens; identical to SEQ ID NO: 37283
  Payload ID: 7402
  Gene Symbol: HEATR9
  Gene Name: HEAT repeat containing 9
  Uniprot ID: A2RTY3
  ENSP ID: ENSP00000479676

SEQ ID NO: 37289 - protein, 380 aa, Homo sapiens; identical to SEQ ID NO: 37287
  Payload ID: 7402
  Gene Symbol: HEATR9
  Gene Name: HEAT repeat containing 9
  Uniprot ID: A2RTY3
  ENSP ID: ENSP00000487778

SEQ ID NO: 37290 - protein, 340 aa, Homo sapiens; identical to SEQ ID NO: 37286
  Payload ID: 7402
  Gene Symbol: HEATR9
  Gene Name: HEAT repeat containing 9
  Uniprot ID: A2RTY3
  ENSP ID: ENSP00000488053

SEQ ID NO: 37291 - protein, 530 aa, Homo sapiens; identical to SEQ ID NO: 37282
  Payload ID: 7402
  Gene Symbol: HEATR9
  Gene Name: HEAT repeat containing 9
  Uniprot ID: A2RTY3
  ENSP ID: ENSP00000488224

SEQ ID NO: 37292 - protein, 283 aa, Homo sapiens; identical to SEQ ID NO: 37285
  Payload ID: 7402
  Gene Symbol: HEATR9
  Gene Name: HEAT repeat containing 9
  ENSP ID: ENSP00000488334

SEQ ID NO: 37293 - protein, 858 aa, Homo sapiens
  Payload ID: 7403
  Gene Symbol: HSPH1
  Gene Name: heat shock 105kDa/110kDa protein 1
  Uniprot ID: Q92598
  ENSP ID: ENSP00000318687
MSVVGLDVGSQSCYIAVARAGGIETIANEFSDRCTPSVISFGSKNRTIGVAAKNQQITHANNTVSNFKRFHGRAFNDPFIQKEKENLSYDLVPLKNGGVGIKVMYMGEEHLFSVEQITAMLLTKLKETAENSLKKPVTDCVISVPSFFTDAERRSVLDAAQIVGLNCLRLMNDMTAVALNYGIYKQDLPSLDEKPRIVVFVDMGHSAFQVSACAFNKGKLKVLGTAFDPFLGGKNFDEKLVEHFCAEFKTKYKLDAKSKIRALLRLYQECEKLKKLMSSNSTDLPLNIECFMNDKDVSGKMNRSQFEELCAELLQKIEVPLYSLLEQTHLKVEDVSAVEIVGGATRIPAVKERIAKFFGKDISTTLNADEAVARGCALQCAILSPAFKVREFSVTDAVPFPISLIWNHDSEDTEGVHEVFSRNHAAPFSKVLTFLRRGPFELEAFYSDPQGVPYPEAKIGRFVVQNVSAQKDGEKSRVKVKVRVNTHGIFTISTASMVEKVPTEENEMSSEADMECLNQRPPENPDTDKNVQQDNSEAGTQPQVQTDAQQTSQSPPSPELTSEENKIPDADKANEKKVDQPPEAKKPKIKVVNVELPIEANLVWQLGKDLLNMYIETEGKMIMQDKLEKERNDAKNAVEEYVYEFRDKLCGPYEKFICEQDHQNFLRLLTETEDWLYEEGEDQAKQAYVDKLEELMKIGTPVKVRFQEAEERPKMFEELGQRLQHYAKIAADFRNKDEKYNHIDESEMKKVEKSVNEVMEWMNNVMNAQAKKSLDQDPVVRAQEIKTKIKELNNTCEPVVTQPKPKIESPKLERTPNGPNIDKKEEDLEDKNNFGAEPPHQNGECYPNEKNSVNMDLD

SEQ ID NO: 37294 - protein, 814 aa, Homo sapiens
  Payload ID: 7403
  Gene Symbol: HSPH1
  Gene Name: heat shock 105kDa/110kDa protein 1
  Uniprot ID: Q92598
  ENSP ID: ENSP00000369768
MSVVGLDVGSQSCYIAVARAGGIETIANEFSDRCTPSVISFGSKNRTIGVAAKNQQITHANNTVSNFKRFHGRAFNDPFIQKEKENLSYDLVPLKNGGVGIKVMYMGEEHLFSVEQITAMLLTKLKETAENSLKKPVTDCVISVPSFFTDAERRSVLDAAQIVGLNCLRLMNDMTAVALNYGIYKQDLPSLDEKPRIVVFVDMGHSAFQVSACAFNKGKLKVLGTAFDPFLGGKNFDEKLVEHFCAEFKTKYKLDAKSKIRALLRLYQECEKLKKLMSSNSTDLPLNIECFMNDKDVSGKMNRSQFEELCAELLQKIEVPLYSLLEQTHLKVEDVSAVEIVGGATRIPAVKERIAKFFGKDISTTLNADEAVARGCALQCAILSPAFKVREFSVTDAVPFPISLIWNHDSEDTEGVHEVFSRNHAAPFSKVLTFLRRGPFELEAFYSDPQGVPYPEAKIGRFVVQNVSAQKDGEKSRVKVKVRVNTHGIFTISTASMVEKVPTEENEMSSEADMECLNQRPPENPDTDANEKKVDQPPEAKKPKIKVVNVELPIEANLVWQLGKDLLNMYIETEGKMIMQDKLEKERNDAKNAVEEYVYEFRDKLCGPYEKFICEQDHQNFLRLLTETEDWLYEEGEDQAKQAYVDKLEELMKIGTPVKVRFQEAEERPKMFEELGQRLQHYAKIAADFRNKDEKYNHIDESEMKKVEKSVNEVMEWMNNVMNAQAKKSLDQDPVVRAQEIKTKIKELNNTCEPVVTQPKPKIESPKLERTPNGPNIDKKEEDLEDKNNFGAEPPHQNGECYPNEKNSVNMDLD

SEQ ID NO: 37295 - protein, 782 aa, Homo sapiens
  Payload ID: 7403
  Gene Symbol: HSPH1
  Gene Name: heat shock 105kDa/110kDa protein 1
  ENSP ID: ENSP00000396090
MATAAVLRGPAAHWVESFQKAREEGSGSGTWRGRWRRRSVISFGSKNRTIGVAAKNQQITHANNTVSNFKRFHGRAFNDPFIQKEKENLSYDLVPLKNGGVGIKVMYMGEEHLFSVEQITAMLLTKLKETAENSLKKPVTDCVISVLGTAFDPFLGGKNFDEKLVEHFCAEFKTKYKLDAKSKIRALLRLYQECEKLKKLMSSNSTDLPLNIECFMNDKDVSGKMNRSQFEELCAELLQKIEVPLYSLLEQTHLKVEDVSAVEIVGGATRIPAVKERIAKFFGKDISTTLNADEAVARGCALQCAILSPAFKVREFSVTDAVPFPISLIWNHDSEDTEGVHEVFSRNHAAPFSKVLTFLRRGPFELEAFYSDPQGVPYPEAKIGRFVVQNVSAQKDGEKSRVKVKVRVNTHGIFTISTASMVEKVPTEENEMSSEADMECLNQRPPENPDTDKNVQQDNSEAGTQPQVQTDAQQTSQSPPSPELTSEENKIPDADKANEKKVDQPPEAKKPKIKVVNVELPIEANLVWQLGKDLLNMYIETEGKMIMQDKLEKERNDAKNAVEEYVYEFRDKLCGPYEKFICEQDHQNFLRLLTETEDWLYEEGEDQAKQAYVDKLEELMKIGTPVKVRFQEAEERPKMFEELGQRLQHYAKIAADFRNKDEKYNHIDESEMKKVEKSVNEVMEWMNNVMNAQAKKSLDQDPVVRAQEIKTKIKELNNTCEPVVTQPKPKIESPKLERTPNGPNIDKKEEDLEDKNNFGAEPPHQNGECYPNEKNSVNMDLD

SEQ ID NO: 37296 - protein, 115 aa, Homo sapiens
  Payload ID: 7403
  Gene Symbol: HSPH1
  Gene Name: heat shock 105kDa/110kDa protein 1
  ENSP ID: ENSP00000408991
DEKYNHIDESEMKKVEKSVNEVMEWMNNVMNAQAKKSLDQDPVVRAQEIKTKIKELNNTCEPVVTQPKPKIESPKLERTPNGPNIDKKEEDLEDKNNFGAEPPHQNDSCGIVNSY

SEQ ID NO: 37297 - protein, 115 aa, Homo sapiens
  Payload ID: 7403
  Gene Symbol: HSPH1
  Gene Name: heat shock 105kDa/110kDa protein 1
  ENSP ID: ENSP00000473512
MSVVGLDVGSQSCYIAVARAGGIETIANEFSDRCTPSVISFGSKNRTIGVAAKNQQITHANNTVSNFKRFHGRAFNDPFIQKEKENLSYDLVPLKNGGVGIKSPPSLQMLRGDLC

SEQ ID NO: 37298 - protein, 860 aa, Homo sapiens
  Payload ID: 7403
  Gene Symbol: HSPH1
  Gene Name: heat shock 105kDa/110kDa protein 1
  Uniprot ID: Q92598
  ENSP ID: ENSP00000487365
MATAAVLRGPAAHWVESFQKAREEGSGSGTWRGRWRRRSVISFGSKNRTIGVAAKNQQITHANNTVSNFKRFHGRAFNDPFIQKEKENLSYDLVPLKNGGVGIKVMYMGEEHLFSVEQITAMLLTKLKETAENSLKKPVTDCVISVPSFFTDAERRSVLDAAQIVGLNCLRLMNDMTAVALNYGIYKQDLPSLDEKPRIVVFVDMGHSAFQVSACAFNKGKLKVLGTAFDPFLGGKNFDEKLVEHFCAEFKTKYKLDAKSKIRALLRLYQECEKLKKLMSSNSTDLPLNIECFMNDKDVSGKMNRSQFEELCAELLQKIEVPLYSLLEQTHLKVEDVSAVEIVGGATRIPAVKERIAKFFGKDISTTLNADEAVARGCALQCAILSPAFKVREFSVTDAVPFPISLIWNHDSEDTEGVHEVFSRNHAAPFSKVLTFLRRGPFELEAFYSDPQGVPYPEAKIGRFVVQNVSAQKDGEKSRVKVKVRVNTHGIFTISTASMVEKVPTEENEMSSEADMECLNQRPPENPDTDKNVQQDNSEAGTQPQVQTDAQQTSQSPPSPELTSEENKIPDADKANEKKVDQPPEAKKPKIKVVNVELPIEANLVWQLGKDLLNMYIETEGKMIMQDKLEKERNDAKNAVEEYVYEFRDKLCGPYEKFICEQDHQNFLRLLTETEDWLYEEGEDQAKQAYVDKLEELMKIGTPVKVRFQEAEERPKMFEELGQRLQHYAKIAADFRNKDEKYNHIDESEMKKVEKSVNEVMEWMNNVMNAQAKKSLDQDPVVRAQEIKTKIKELNNTCEPVVTQPKPKIESPKLERTPNGPNIDKKEEDLEDKNNFGAEPPHQNGECYPNEKNSVNMDLD

SEQ ID NO: 37299 - protein, 102 aa, Homo sapiens
  Payload ID: 7404
  Gene Symbol: HSPE1
  Gene Name: heat shock 10kDa protein 1
  Uniprot ID: P61604
  ENSP ID: ENSP00000233893
MAGQAFRKFLPLFDRVLVERSAAETVTKGGIMLPEKSQGKVLQATVVAVGSGSKGKGGEIQPVSVKVGDKVLLPEYGGTKVVLDDKDYFLFRDGDILGKYVD

SEQ ID NO: 37300 - protein, 101 aa, Homo sapiens
  Payload ID: 7404
  Gene Symbol: HSPE1
  Gene Name: heat shock 10kDa protein 1
  ENSP ID: ENSP00000386447
MAGQAFRKFLPLFDRVLVERSAAETVTKGGIMLPEKSQGKVLQATVVAVGSGSKGKGGEIQPVSVKVGDKVLLPEYGGTKVVLDDKVCKLNNSKKKSDICN

SEQ ID NO: 37301 - protein, 47 aa, Homo sapiens
  Payload ID: 7404
  Gene Symbol: HSPE1
  Gene Name: heat shock 10kDa protein 1
  ENSP ID: ENSP00000387101
MGGEIQPVSVKVGDKVLLPEYGGTKVVLDDKDYFLFRDGDILGKYVD

SEQ ID NO: 37302 - protein, 196 aa, Homo sapiens
  Payload ID: 7405
  Gene Symbol: HSPB8
  Gene Name: heat shock 22kDa protein 8
  Uniprot ID: Q9UJY1
  ENSP ID: ENSP00000281938
MADGQMPFSCHYPSRLRRDPFRDSPLSSRLLDDGFGMDPFPDDLTASWPDWALPRLSSAWPGTLRSGMVPRGPTATARFGVPAEGRTPPPFPGEPWKVCVNVHSFKPEELMVKTKDGYVEVSGKHEEKQQEGGIVSKNFTKKIQLPAEVDPVTVFASLSPEGLLIIEAPQVPPYSTFGESSFNNELPQDSQEVTCT

SEQ ID NO: 37303 - protein, 152 aa, Homo sapiens
  Payload ID: 7405
  Gene Symbol: HSPB8
  Gene Name: heat shock 22kDa protein 8
  ENSP ID: ENSP00000441541
  MOD_RES (1)..(1): Any amino acid
XEPWKVCVNVHSFKPEELMVKTKDGYVEVSGKHEEKQQEGGIVSKNFTKKIQEHNTTGSKLKQTRDEGTSKQADKIVTGVGGCGHLKKYHRGSLYCHLFLIFSDRIYINSFFPFLNSIIFNYIRHFVTGKPENPKTQKKMKIIHIPSFQRRL

SEQ ID NO: 37304 - protein, 205 aa, Homo sapiens
  Payload ID: 7406
  Gene Symbol: HSPB1
  Gene Name: heat shock 27kDa protein 1
  Uniprot ID: P04792
  ENSP ID: ENSP00000248553
MTERRVPFSLLRGPSWDPFRDWYPHSRLFDQAFGLPRLPEEWSQWLGGSSWPGYVRPLPPAAIESPAVAAPAYSRALSRQLSSGVSEIRHTADRWRVSLDVNHFAPDELTVKTKDGVVEITGKHEERQDEHGYISRCFTRKYTLPPGVDPTQVSSSLSPEGTLTVEAPMPKLATQSNEITIPVTFESRAQLGGPEAAKSDETAAK

SEQ ID NO: 37305 - protein, 37 aa, Homo sapiens
  Payload ID: 7406
  Gene Symbol: HSPB1
  Gene Name: heat shock 27kDa protein 1
  ENSP ID: ENSP00000405285
MPKLATQSNEITIPVTFESRAQLGGPEAAKSDETAAK

SEQ ID NO: 37306 - protein, 186 aa, Homo sapiens [sequence omitted]

SEQ ID NO: 37307 - protein, 182 aa, Homo sapiens
  Payload ID: 7407
  Gene Symbol: HSPB2
  Gene Name: heat shock 27kDa protein 2
  Uniprot ID: Q16082
  ENSP ID: ENSP00000302476
MSGRSVPHAHPATAEYEFANPSRLGEQRFGEGLLPEEILTPTLYHGYYVRPRAAPAGEGSRAGASELRLSEGKFQAFLDVSHFTPDEVTVRTVDNLLEVSARHPQRLDRHGFVSREFCRTYVLPADVDPWRVRAALSHDGILNLEAPRGGRHLDTEVNEVYISLLPAPPDPEEEEEAAIVEP

SEQ ID NO: 37308 - protein, 150 aa, Homo sapiens
  Payload ID: 7408
  Gene Symbol: HSPB3
  Gene Name: heat shock 27kDa protein 3
  Uniprot ID: Q12988
  ENSP ID: ENSP00000303394
MAKIILRHLIEIPVRYQEEFEARGLEDCRLDHALYALPGPTIVDLRKTRAAQSPPVDSAAETPPREGKSHFQILLDVVQFLPEDIIIQTFEGWLLIKAQHGTRMDEHGFISRSFTRQYKLPDGVEIKDLSAVLCHDGILVVEVKDPVGTK

SEQ ID NO: 37309 - protein, 170 aa, Homo sapiens
  Payload ID: 7409
  Gene Symbol: HSPB7
  Gene Name: heat shock 27kDa protein family, member 7 (cardiovascular)
  Uniprot ID: Q9UBY9
  ENSP ID: ENSP00000310111
MSHRTSSTFRAERSFHSSSSSSSSSTSSSASRALPAQDPPMEKALSMFSDDFGSFMRPHSEPLAFPARPGGAGNIKTLGDAYEFAVDVRDFSPEDIIVTTSNNHIEVRAEKLAADGTVMNTFAHKCQLPEDVDPTSVTSALREDGSLTIRARRHPHTEHVQQTFRTEIKI

SEQ ID NO: 37310 - protein, 245 aa, Homo sapiens
  Payload ID: 7409
  Gene Symbol: HSPB7
  Gene Name: heat shock 27kDa protein family, member 7 (cardiovascular)
  ENSP ID: ENSP00000364870
MGRQVNPRPRGNCQLDREEGTQQRVTAHRKTMSHCQVLWEDKDSQCWGHLDWVWAHVSRSSQRGLPGGGGIGADLGRKGRIWRGQQRPLTATWAEQRAWPPLRMASTLAQGKDPPMEKALSMFSDDFGSFMRPHSEPLAFPARPGGAGNIKTLGDAYEFAVDVRDFSPEDIIVTTSNNHIEVRAEKLAADGTVMNTFAHKCQLPEDVDPTSVTSALREDGSLTIRARRHPHTEHVQQTFRTEIKI

SEQ ID NO: 37311 - protein, 174 aa, Homo sapiens
  Payload ID: 7409
  Gene Symbol: HSPB7
  Gene Name: heat shock 27kDa protein family, member 7 (cardiovascular)
  ENSP ID: ENSP00000385472
MSHRTSSTFRAERSFHSSSSSSSSSTSSSASRALPAQDPPMEKALSMFSDDFGSFMRPHSEPLAFPAHPTARPGGAGNIKTLGDAYEFAVDVRDFSPEDIIVTTSNNHIEVRAEKLAADGTVMNTFAHKCQLPEDVDPTSVTSALREDGSLTIRARRHPHTEHVQQTFRTEIKI

SEQ ID NO: 37312 - protein, 165 aa, Homo sapiens
  Payload ID: 7409
  Gene Symbol: HSPB7
  Gene Name: heat shock 27kDa protein family, member 7 (cardiovascular)
  ENSP ID: ENSP00000391578
MSHRTSSTFRAERSFHSSSSSSSSSTSSSASRALPAQDPPMEKALSMFSDDFGSFMRPHSEPLAFPARPGGAGNIKTLGDAYEFAVDVRDFSPEDIIVTTSNNHIELAADGTVMNTFAHKCQLPEDVDPTSVTSALREDGSLTIRARRHPHTEHVQQTFRTEIKI

SEQ ID NO: 37313 - protein, 124 aa, Homo sapiens
  Payload ID: 7409
  Gene Symbol: HSPB7
  Gene Name: heat shock 27kDa protein family, member 7 (cardiovascular)
  ENSP ID: ENSP00000417966
MFSDDFGSFMRPHSEPLAFPAAHPTARPGGAGNIKTLGDAYEFAVDVRDFSPEDIIVTTSNNHIELAADGTVMNTFAHKCQLPEDVDPTSVTSALREDGSLTIRARRHPHTEHVQQTFRTEIKI

SEQ ID NO: 37314 - protein, 175 aa, Homo sapiens
  Payload ID: 7409
  Gene Symbol: HSPB7
  Gene Name: heat shock 27kDa protein family, member 7 (cardiovascular)
  Uniprot ID: Q9UBY9
  ENSP ID: ENSP00000419477
MSHRTSSTFRAERSFHSSSSSSSSSTSSSASRALPAQDPPMEKALSMFSDDFGSFMRPHSEPLAFPAAHPTARPGGAGNIKTLGDAYEFAVDVRDFSPEDIIVTTSNNHIEVRAEKLAADGTVMNTFAHKCQLPEDVDPTSVTSALREDGSLTIRARRHPHTEHVQQTFRTEIKI

SEQ ID NO: 37315 - protein, 573 aa, Homo sapiens
  Payload ID: 7410
  Gene Symbol: HSPD1
  Gene Name: heat shock 60kDa protein 1 (chaperonin)
  Uniprot ID: P10809
  ENSP ID: ENSP00000340019
MLRLPTVFRQMRPVSRVLAPHLTRAYAKDVKFGADARALMLQGVDLLADAVAVTMGPKGRTVIIEQSWGSPKVTKDGVTVAKSIDLKDKYKNIGAKLVQDVANNTNEEAGDGTTTATVLARSIAKEGFEKISKGANPVEIRRGVMLAVDAVIAELKKQSKPVTTPEEIAQVATISANGDKEIGNIISDAMKKVGRKGVITVKDGKTLNDELEIIEGMKFDRGYISPYFINTSKGQKCEFQDAYVLLSEKKISSIQSIVPALEIANAHRKPLVIIAEDVDGEALSTLVLNRLKVGLQVVAVKAPGFGDNRKNQLKDMAIATGGAVFGEEGLTLNLEDVQPHDLGKVGEVIVTKDDAMLLKGKGDKAQIEKRIQEIIEQLDVTTSEYEKEKLNERLAKLSDGVAVLKVGGTSDVEVNEKKDRVTDALNATRAAVEEGIVLGGGCALLRCIPALDSLTPANEDQKIGIEIIKRTLKIPAMTIAKNAGVEGSLIVEKIMQSSSEVGYDAMAGDFVNMVEKGIIDPTKVVRTALLDAAGVASLLTTAEVVVTEIPKEEKDPGMGAMGGMGGGMGGGMF

SEQ ID NO: 37316 - protein, 573 aa, Homo sapiens; identical to SEQ ID NO: 37315
  Payload ID: 7410
  Gene Symbol: HSPD1
  Gene Name: heat shock 60kDa protein 1 (chaperonin)
  Uniprot ID: P10809
  ENSP ID: ENSP00000373620

SEQ ID NO: 37317 - protein, 48 aa, Homo sapiens
  Payload ID: 7410
  Gene Symbol: HSPD1
  Gene Name: heat shock 60kDa protein 1 (chaperonin)
  ENSP ID: ENSP00000390404
MLRLPTVFRQMRPVSRVLAPHLTRAYAKDVKFGADARALMLQGKNSDY

SEQ ID NO: 37318 - protein, 234 aa, Homo sapiens [sequence omitted]

SEQ ID NO: 37319 - protein, 94 aa, Homo sapiens
  Payload ID: 7410
  Gene Symbol: HSPD1
  Gene Name: heat shock 60kDa protein 1 (chaperonin)
  ENSP ID: ENSP00000396460
MLRLPTVFRQMRPVSRVLAPHLTRAYAKDVKFGADARALMLQGVDLLADAVAVTMGPKGRTVIIEQSWGSPKVTKDGVTVAKSIDLKDKYKNIG

SEQ ID NO: 37320 - protein, 83 aa, Homo sapiens
  Payload ID: 7410
  Gene Symbol: HSPD1
  Gene Name: heat shock 60kDa protein 1 (chaperonin)
  ENSP ID: ENSP00000402478
MLRLPTVFRQMRPVSRVLAPHLTRAYAKDVKFGADARALMLQGVDLLADAVAVTMGPKGRTVIIEQSWGSPKVTKDGVTVAKS

SEQ ID NO: 37321 - protein, 58 aa, Homo sapiens
  Payload ID: 7410
  Gene Symbol: HSPD1
  Gene Name: heat shock 60kDa protein 1 (chaperonin)
  ENSP ID: ENSP00000412227
MLRLPTVFRQMRPVSRVLAPHLTRAYAKDVKFGADARALMLQGVDLLADAVAVTMGPK

SEQ ID NO: 37322 - protein, 221 aa, Homo sapiens
  Payload ID: 7410
  Gene Symbol: HSPD1
  Gene Name: heat shock 60kDa protein 1 (chaperonin)
  ENSP ID: ENSP00000412717
MLRLPTVFRQMRPVSRVLAPHLTRAYAKDVKFGADARALMLQGVDLLADAVAVTMGPKGRTVIIEQSWGSPKVTKDGVTVAKSIDLKDKYKNIGAKLVQDVANNTNEEAGDGTTTATVLARSIAKEGFEKISKGANPVEIRRGVMLAVDAVIAELKKQSKPVTTPEEIAQVATISANGDKEIGNIISDAMKKVGRKGVITVKDGKTLNDELEIIEGMKFDR

SEQ ID NO: 37323 - protein, 175 aa, Homo sapiens
  Payload ID: 7410
  Gene Symbol: HSPD1
  Gene Name: heat shock 60kDa protein 1 (chaperonin)
  ENSP ID: ENSP00000414446
MKTCWTREQLQGKRQGEVVKGKQGGEYRHPDPARQAGWQETEMLRLPTVFRQMRPVSRVLAPHLTRAYAKDVKFGADARALMLQGVDLLADAVAVTMGPKGRTVIIEQSWGSPKVTKDGVTVAKSIDLKDKYKNIGAKLVQDVANNTNEEAGDGTTTATVLARSIAKEGFEKISK

SEQ ID NO: 37324 - protein, 686 aa, Homo sapiens
  Payload ID: 7411
  Gene Symbol: HSPA12B
  Gene Name: heat shock 70kD protein 12B
  Uniprot ID: Q96MM6
  ENSP ID: ENSP00000254963
MLAVPEMGLQGLYIGSSPERSPVPSPPGSPRTQESCGIAPLTPSQSPKPEVRAPQQASFSVVVAIDFGTTSSGYAFSFASDPEAIHMMRKWEGGDPGVAHQKTPTCLLLTPEGAFHSFGYTARDYYHDLDPEEARDWLYFEKFKMKIHSATDLTLKTQLEAVNGKTMPALEVFAHALRFFREHALQELREQSPSLPEKDTVRWVLTVPAIWKQPAKQFMREAAYLAGLVSRENAEQLLIALEPEAASVYCRKLRLHQLLDLSGRAPGGGRLGERRSIDSSFRQAREQLRRSRHSRTFLVESGVGELWAEMQAGDRYVVADCGGGTVDLTVHQLEQPHGTLKELYKASGGPYGAVGVDLAFEQLLCRIFGEDFIATFKRQRPAAWVDLTIAFEARKRTAGPHRAGALNISLPFSFIDFYRKQRGHNVETALRRSSVNFVKWSSQGMLRMSCEAMNELFQPTVSGIIQHIEALLARPEVQGVKLLFLVGGFAESAVLQHAVQAALGARGLRVVVPHDVGLTILKGAVLFGQAPGVVRVRRSPLTYGVGVLNRFVPGRHPPEKLLVRDGRRWCTDVFERFVAAEQSVALGEEVRRSYCPARPGQRRVLINLYCCAAEDARFITDPGVRKCGALSLELEPADCGQDTAGAPPGRREIRAAMQFGDTEIKVTAVDVSTNRSVRASIDFLSN

SEQ ID NO: 37325 - protein, 600 aa, Homo sapiens
  Payload ID: 7411
  Gene Symbol: HSPA12B
  Gene Name: heat shock 70kD protein 12B
  ENSP ID: ENSP00000382608
MMRKWEGGDPGVAHQKTPTCLLLTPEGAFHSFGYTARDYYHDLDPEEARDWLYFEKFKMKIHSATDLTLKTQLEAVNGKTMPALEVFAHALRFFREHALQELREQSPSLPEKDTVRWVLTVPAIWKQPAKQFMREAAYLAGLVSRENAEQLLIALEPEAASVYCRKLRLHQLLDLSGRAPGGGRLGERRSIDSSFRQAREQLRRSRHSRTFLVESGVGELWAEMQAGDRYVVADCGGGTVDLTVHQLEQPHGTLKELYKASGGPYGAVGVDLAFEQLLCRIFGEDFIATFKRQRPAAWVDLTIAFEARKRTAGPHRAGALNISLPFSFIDFYRKQRGHNVETALRRSSVNFVKWSSQGMLRMSCEAMNELFQPTVSGIIQHIEALLARPEVQGVKLLFLVGGFAESAVLQHAVQAALGARGLRVVVPHDVGLTILKGAVLFGQAPGVVRVRRSPLTYGVGVLNRFVPGRHPPEKLLVRDGRRWCTDVFERFVAAEQSVALGEEVRRSYCPARPGQRRVLINLYCCAAEDARFITDPGVRKCGALSLELEPADCGQDTAGAPPGRREIRAAMQFGDTEIKVTAVDVSTNRSVRASIDFLSN

SEQ ID NO: 37326 - protein, 675 aa, Homo sapiens
  Payload ID: 7412
  Gene Symbol: HSPA12A
  Gene Name: heat shock 70kDa protein 12A
  Uniprot ID: O43301
  ENSP ID: ENSP00000358211
MADKEAGGSDGPRETAPTSAYSSPARSLGDTGITPLSPSHIVNDTDSNVSEQQSFLVVVAVDFGTTSSGYAYSFTKEPECIHVMRRWEGGDPGVSNQKTPTTILLTPERKFHSFGYAARDFYHDLDPNEAKQWLYLEKFKMKLHTTGDLTMDTDLTAANGKKVKALEIFAYALQYFKEQALKELSDQAGSEFENSDVRWVITVPAIWKQPAKQFMRQAAYQAGLASPENSEQLIIALEPEAASIYCRKLRLHQMIELSSKAAVNGYSGSDTVGAGFTQAKEHIRRNRQSRTFLVENVIGEIWSELEEGDKYVVVDSGGGTVDLTVHQIRLPEGHLKELYKATGGPYGSLGVDYEFEKLLYKIFGEDFIEQFKIKRPAAWVDLMIAFESRKRAAAPDRTNPLNITLPFSFIDYYKKFRGHSVEHALRKSNVDFVKWSSQGMLRMSPDAMNALFKPTIDSIIEHLRDLFQKPEVSTVKFLFLVGGFAEAPLLQQAVQAAFGDQCRIIIPQDVGLTILKGAVLFGLDPAVIKVRRSPLTYGVGVLNRYVEGKHPPEKLLVKDGTRWCTDVFDKFISADQSVALGELVKRSYTPAKPSQLVIVINIYSSEHDNVSFITDPGVKKCGTLRLDLTGTSGTAVPARREIQTLMQFGDTEIKATAIDIATSKSVKVGIDFLNY

SEQ ID NO: 37327 - protein, 119 aa, Homo sapiens
  Payload ID: 7412
  Gene Symbol: HSPA12A
  Gene Name: heat shock 70kDa protein 12A
  ENSP ID: ENSP00000466041
ELSDQAGSEFENSDVRWVITVPAIWKQPAKQFMRQAAYQAGLASPENSEQLIIALEPEAASIYCRKLRLHQMIELSSKAAVNGYSGSDTVGAGFTQGTSALSLPLLLSFLPKPWMSLSL

SEQ ID NO: 37328 - protein, 136 aa, Homo sapiens
  Payload ID: 7412
  Gene Symbol: HSPA12A
  Gene Name: heat shock 70kDa protein 12A
  ENSP ID: ENSP00000466927
MLGLNDETAPTSAYSSPARSLGDTGITPLSPSHIVNDTDSNVSEQQSFLVVVAVDFGTTSSGYAYSFTKEPECIHVMRRWEGGDPGVSNQKTPTTILLTPERKFHSFGYAARDFYHDLDPNEAKQWLYLEKFKMKL

SEQ ID NO: 37329 - protein, 509 aa, Homo sapiens
  Payload ID: 7413
  Gene Symbol: HSPA14
  Gene Name: heat shock 70kDa protein 14
  Uniprot ID: Q0VDF9
  ENSP ID: ENSP00000367623
MAAIGVHLGCTSACVAVYKDGRAGVVANDAGDRVTPAVVAYSENEEIVGLAAKQSRIRNISNTVMKVKQILGRSSSDPQAQKYIAESKCLVIEKNGKLRYEIDTGEETKFVNPEDVARLIFSKMKETAHSVLGSDANDVVITVPFDFGEKQKNALGEAARAAGFNVLRLIHEPSAALLAYGIGQDSPTGKSNILVFKLGGTSLSLSVMEVNSGIYRVLSTNTDDNIGGAHFTETLAQYLASEFQRSFKHDVRGNARAMMKLTNSAEVAKHSLSTLGSANCFLDSLYEGQDFDCNVSRARFELLCSPLFNKCIEAIRGLLDQNGFTADDINKVVLCGGSSRIPKLQQLIKDLFPAVELLNSIPPDEVIPIGAAIEAGILIGKENLLVEDSLMIECSARDILVKGVDESGASRFTVLFPSGTPLPARRQHTLQAPGSISSVCLELYESDGKNSAKEETKFAQVVLQDLDKKENGLRDILAVLTMKRDGSLHVTCTDQETGKCEAISIEIAS

SEQ ID NO: 37330 - protein, 143 aa, Homo sapiens
  Payload ID: 7413
  Gene Symbol: HSPA14
  Gene Name: heat shock 70kDa protein 14
  ENSP ID: ENSP00000390513
MAAIGVHLGCTSACVAVYKDGRAGVVANDAGDRVTPAVVAYSENEEIVGLAAKQSRIRNISNTVMKVKQILGRRVLSRDPQLQQLPQPFQRCSCSLSEQPHGQTGCVRGAQPLHQHQPQHSWGSLHTADSSLLFESWFCFWWG

SEQ ID NO: 37331 - protein, 128 aa, Homo sapiens
  Payload ID: 7413
  Gene Symbol: HSPA14
  Gene Name: heat shock 70kDa protein 14
  ENSP ID: ENSP00000404691
  MOD_RES (1)..(1): Any amino acid
XACVAVYKDGRAGVVANDAGDRVTPAVVAYSENEEIVGLAAKQSRIRNISNTVMKVKQILGRSSSDPQAQKYIAESKCLVIEKNGKLRYEIDTGEETKFVNPEDVARLIFSKMKGAYSPWSQSNSEDG

SEQ ID NO: 37332 - protein, 641 aa, Homo sapiens
  Payload ID: 7414
  Gene Symbol: HSPA1A
  Gene Name: heat shock 70kDa protein 1A
  Uniprot ID: P0DMV8
  ENSP ID: ENSP00000364802
MAKAAAIGIDLGTTYSCVGVFQHGKVEIIANDQGNRTTPSYVAFTDTERLIGDAAKNQVALNPQNTVFDAKRLIGRKFGDPVVQSDMKHWPFQVINDGDKPKVQVSYKGETKAFYPEEISSMVLTKMKEIAEAYLGYPVTNAVITVPAYFNDSQRQATKDAGVIAGLNVLRIINEPTAAAIAYGLDRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAILMGDKSENVQDLLLLDVAPLSLGLETAGGVMTALIKRNSTIPTKQTQIFTTYSDNQPGVLIQVYEGERAMTKDNNLLGRFELSGIPPAPRGVPQIEVTFDIDANGILNVTATDKSTGKANKITITNDKGRLSKEEIERMVQEAEKYKAEDEVQRERVSAKNALESYAFNMKSAVEDEGLKGKISEADKKKVLDKCQEVISWLDANTLAEKDEFEHKRKELEQVCNPIISGLYQGAGGPGPGGFGAQGPKGGSGSGPTIEEVD

SEQ ID NO: 37333 - protein, 476 aa, Homo sapiens
  Payload ID: 7414
  Gene Symbol: HSPA1A
  Gene Name: heat shock 70kDa protein 1A
  ENSP ID: ENSP00000372880
MAKAAAIGIDLGTTYSCVGVFQHGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAILMGDKSENVQDLLLLDVAPLSLGLETAGGVMTALIKRNSTIPTKQTQIFTTYSDNQPGVLIQVYEGERAMTKDNNLLGRFELSGIPPAPRGVPQIEVTFDIDANGILNVTATDKSTGKANKITITNDKGRLSKEEIERMVQEAEKYKAEDEVQRERVSAKNALESYAFNMKSAVEDEGLKGKISEADKKKVLDKCQEVISWLDANTLAEKDEFEHKRKELEQVCNPIISGLYQGAGGPGPGGFGAQGPKGGSGSGPTIEEVD

SEQ ID NO: 37334 - protein, 641 aa, Homo sapiens
  Payload ID: 7414
  Gene Symbol: HSPA1A
  Gene Name: heat shock 70kDa protein 1A
  Uniprot ID: P0DMV8
  ENSP ID: ENSP00000382915
MAKAAAIGIDLGTTYSCVGVFQHGKVEIIANDQGNRTTPSYVAFTDTERLIGDAAKNQVALNPQNTVFDAKRLIGRKFGDPVVQSDMKHWPFQVINDGDKPKVQVSYKGDTKAFYPEEISSMVLTKMKEIAEAYLGYPVTNAVITVPAYFNDSQRQATKDAGVIAGLNVLRIINEPTAAAIAYGLDRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAILMGDKSENVQDLLLLDVAPLSLGLETAGGVMTALIKRNSTIPTKQTQIFTTYSDNQPGVLIQVYEGERAMTKDNNLLGRFELSGIPPAPRGVPQIEVTFDIDANGILNVTATDKSTGKANKITITNDKGRLSKEEIERMVQEAEKYKAEDEVQRERVSAKNALESYAFNMKSAVEDEGLKGKISEADKKKVLDKCQEVISWLDANTLAEKDEFEHKRKELEQVCNPIISGLYQGAGGPGPGGFGAQGPKGGSGSGPTIEEVD

SEQ ID NO: 37335 - protein, 476 aa, Homo sapiens; identical to SEQ ID NO: 37333
  Payload ID: 7414
  Gene Symbol: HSPA1A
  Gene Name: heat shock 70kDa protein 1A
  ENSP ID: ENSP00000393259

SEQ ID NO: 37336 - protein, 641 aa, Homo sapiens; identical to SEQ ID NO: 37332
  Payload ID: 7414
  Gene Symbol: HSPA1A
  Gene Name: heat shock 70kDa protein 1A
  Uniprot ID: P0DMV8
  ENSP ID: ENSP00000404524

SEQ ID NO: 37337 - protein, 641 aa, Homo sapiens; identical to SEQ ID NO: 37332
  Payload ID: 7414
  Gene Symbol: HSPA1A
  Gene Name: heat shock 70kDa protein 1A
  Uniprot ID: P0DMV8
  ENSP ID: ENSP00000406359

SEQ ID NO: 37338 - protein, 641 aa, Homo sapiens; identical to SEQ ID NO: 37332
  Payload ID: 7414
  Gene Symbol: HSPA1A
  Gene Name: heat shock 70kDa protein 1A
  Uniprot ID: P0DMV8
  ENSP ID: ENSP00000408907

SEQ ID NO: 37339 - protein, 476 aa, Homo sapiens; identical to SEQ ID NO: 37333
  Payload ID: 7414
  Gene Symbol: HSPA1A
  Gene Name: heat shock 70kDa protein 1A
  ENSP ID: ENSP00000410693

SEQ ID NO: 37340 - protein, 476 aa, Homo sapiens; identical to SEQ ID NO: 37333
  Payload ID: 7414
  Gene Symbol: HSPA1A
  Gene Name: heat shock 70kDa protein 1A
  ENSP ID: ENSP00000415927

SEQ ID NO: 37341 - protein, 476 aa, Homo sapiens; identical to SEQ ID NO: 37333
  Payload ID: 7414
  Gene Symbol: HSPA1A
  Gene Name: heat shock 70kDa protein 1A
  ENSP ID: ENSP00000477378

SEQ ID NO: 37342 - protein, 641 aa, Homo sapiens; identical to SEQ ID NO: 37332
  Payload ID: 7415
  Gene Symbol: HSPA1B
  Gene Name: heat shock 70kDa protein 1B
  Uniprot ID: P0DMV9
  ENSP ID: ENSP00000364801

SEQ ID NO: 37343 - protein, 641 aa, Homo sapiens; identical to SEQ ID NO: 37332
  Payload ID: 7415
  Gene Symbol: HSPA1B
  Gene Name: heat shock 70kDa protein 1B
  Uniprot ID: P0DMV9
  ENSP ID: ENSP00000375391

SEQ ID NO: 37344 - protein, 641 aa, Homo sapiens; identical to SEQ ID NO: 37332
  Payload ID: 7415
  Gene Symbol: HSPA1B
  Gene Name: heat shock 70kDa protein 1B
  Uniprot ID: P0DMV9
  ENSP ID: ENSP00000375399

SEQ ID NO: 37345 - protein, 642 aa, Homo sapiens
  Payload ID: 7415
  Gene Symbol: HSPA1B
  Gene Name: heat shock 70kDa protein 1B
  ENSP ID: ENSP00000387691
GMAKAAAIGIDLGTTYSCVGVFQHGKVEIIANDQGNRTTPSYVAFTDTERLIGDAAKNQVALNPQNTVFDAKRLIGRKFGDPVVQSDMKHWPFQVINDGDKPKVQVSYKGETKAFYPEEISSMVLTKMKEIAEAYLGYPVTNAVITVPAYFNDSQRQATKDAGVIAGLNVLRIINEPTAAAIAYGLDRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAILMGDKSENVQDLLLLDVAPLSLGLETAGGVMTALIKRNSTIPTKQTQIFTTYSDNQPGVLIQVYEGERAMTKDNNLLGRFELSGIPPAPRGVPQIEVTFDIDANGILNVTATDKSTGKANKITITNDKGRLSKEEIERMVQEAEKYKAEDEVQRERVSAKNALESYAFNMKSAVEDEGLKGKISEADKKKVLDKCQEVISWLDANTLAEKDEFEHKRKELEQVCNPIISGLYQGAGGPGPGGFGAQGPKGGSGSGPTIEEVD

SEQ ID NO: 37346 - protein, 641 aa, Homo sapiens; identical to SEQ ID NO: 37332
  Payload ID: 7415
  Gene Symbol: HSPA1B
  Gene Name: heat shock 70kDa protein 1B
  Uniprot ID: P0DMV9
  ENSP ID: ENSP00000393087

SEQ ID NO: 37347 - protein, 642 aa, Homo sapiens; identical to SEQ ID NO: 37345
  Payload ID: 7415
  Gene Symbol: HSPA1B
  Gene Name: heat shock 70kDa protein 1B
  ENSP ID: ENSP00000402651

SEQ ID NO: 37348 - protein, 641 aa, Homo sapiens; identical to SEQ ID NO: 37332
  Payload ID: 7415
  Gene Symbol: HSPA1B
  Gene Name: heat shock 70kDa protein 1B
  Uniprot ID: P0DMV9
  ENSP ID: ENSP00000403530

SEQ ID NO: 37349 - protein, 642 aa, Homo sapiens; identical to SEQ ID NO: 37345
  Payload ID: 7415
  Gene Symbol: HSPA1B
  Gene Name: heat shock 70kDa protein 1B
  ENSP ID: ENSP00000442789

SEQ ID NO: 37350 - protein, 641 aa, Homo sapiens
  Payload ID: 7416
  Gene Symbol: HSPA1L
  Gene Name: heat shock 70kDa protein 1-like
  Uniprot ID: P34931
  ENSP ID: ENSP00000364805
MATAKGIAIGIDLGTTYSCVGVFQHGKVEIIANDQGNRTTPSYVAFTDTERLIGDAAKNQVAMNPQNTVFDAKRLIGRKFNDPVVQADMKLWPFQVINEGGKPKVLVSYKGENKAFYPEEISSMVLTKLKETAEAFLGHPVTNAVITVPAYFNDSQRQATKDAGVIAGLNVLRIINEPTAAAIAYGLDKGGQGERHVLIFDLGGGTFDVSILTIDDGIFEVKATAGDTHLGGEDFDNRLVSHFVEEFKRKHKKDISQNKRAVRRLRTACERAKRTLSSSTQANLEIDSLYEGIDFYTSITRARFEELCADLFRGTLEPVEKALRDAKMDKAKIHDIVLVGGSTRIPKVQRLLQDYFNGRDLNKSINPDEAVAYGAAVQAAILMGDKSEKVQDLLLLDVAPLSLGLETAGGVMTALIKRNSTIPTKQTQIFTTYSDNQPGVLIQVYEGERAMTKDNNLLGRFDLTGIPPAPRGVPQIEVTFDIDANGILNVTATDKSTGKVNKITITNDKGRLSKEEIERMVLDAEKYKAEDEVQREKIAAKNALESYAFNMKSVVSDEGLKGKISESDKNKILDKCNELLSWLEVNQLAEKDEFDHKRKELEQMCNPIITKLYQGGCTGPACGTGYVPGRPATGPTIEEVD

SEQ ID NO: 37351 - protein, 641 aa, Homo sapiens
  Payload ID: 7416
  Gene Symbol: HSPA1L
  Gene Name: heat shock 70kDa protein 1-like
  Uniprot ID: P34931
  ENSP ID: ENSP00000372881
MATAKGIAIGIDLGTTYSCVGVFQHGKVEIIANDQGNRTTPSYVAFTDTERLIGDAAKNQVAMNPQNTVFDAKRLIGRKFNDPVVQADMKLWPFQVINEGGKPKVLVSYKGENKAFYPEEISSMVLTKLKETAEAFLGHPVTNAVITVPAYFNDSQRQATKDAGVIAGLNVLRIINEPTAAAIAYGLDKGGQGERHVLIFDLGGGTFDVSILTIDDGIFEVKATAGDTHLGGEDFDNRLVSHFVEEFKRKHKKDISQNKRAVRRLRTACERAKRTLSSSTQANLEIDSLYEGIDFYTSITRARFEELCADLFRGTLEPVEKALRDAKMDKAKIHDIVLVGGSTRIPKVQRLLQDYFNGRDLNKSINPDEAVAYGAAVQAAILMGDKSEKVQDLLLLDVAPLSLGLETAGGVMTALIKRNSTIPTKQTQIFTTYSDNQPGVLIQVYEGERAMTKDNNLLGRFDLTGIPPAPRGVPQIEVTFDIDANGILNVTAMDKSTGKVNKITITNDKGRLSKEEIERMVLDAEKYKAEDEVQREKIAAKNALESYAFNMKSVVSDEGLKGKISESDKNKILDKCNELLSWLEVNQLAEKDEFDHKRKELEQMCNPIITKLYQGGCTGPACGTGYVPGRPATGPTIEEVD

SEQ ID NO: 37352 - protein, 641 aa, Homo sapiens; identical to SEQ ID NO: 37350
  Payload ID: 7416
  Gene Symbol: HSPA1L
  Gene Name: heat shock 70kDa protein 1-like
  Uniprot ID: P34931
  ENSP ID: ENSP00000396486

SEQ ID NO: 37353 - protein, 641 aa, Homo sapiens; identical to SEQ ID NO: 37351
  Payload ID: 7416
  Gene Symbol: HSPA1L
  Gene Name: heat shock 70kDa protein 1-like
  Uniprot ID: P34931
  ENSP ID: ENSP00000408347

SEQ ID NO: 37354 - protein, 641 aa, Homo sapiens
  Payload ID: 7416
  Gene Symbol: HSPA1L
  Gene Name: heat shock 70kDa protein 1-like
  ENSP ID: ENSP00000409151
MATAKGIAIGIDLGTTYSCVGVFQHGKVEIIANDQGNRTTPSYVAFTDTERLIGDAAKNQVAMNPQNTVFDAKRLIGRKFNDPVVQADMKLWPFQVINEGGKPKVLVSYKGENKAFYPEEISSMVLTKLKETAEAFLGHPVTNAVITVPAYFNDSQRQATKDAGVIAGLNVLRIINEPTAAAIAYGLDKGGQGERHVLIFDLGGGTFDVSILTIDDGIFEVKATAGDTHLGGEDFDNRLVSHFVEEFKRKHKKDISQNKRAVRRLRTACERAKRTLSSSTQANLEIDSLYEGIDFYTSITRARFEELCADLFRGTLEPVEKALRDAKMDKAKIHDIVLVGGSTRIPKVQRLLQDYFNGRDLNKSINPDEAVAYGAAVQAAILMGDKSEKVQDLLLLDVAPLSLGLETAGGVMTALIKRNSTIPTKQTQIFTTYSDNQPGVLIQVYEGERAMTKDNNLLGRFDLTGIPPAPRGVPQIEVTFDIDANGILNVTAMDKSTGKVNKITITNDKGRLSKEEIERMVLDAEKYKAEDEVQREKIAAKNALESYAFNMKSVVSDEGLKGKISESDKNKILDKCNELLSWLEVNQLAEKDEFDHKRKELKQMCNPIITKLYQGGCTGPACGTGYVPGRPATGPTIEEVD

SEQ ID NO: 37355 - protein, 639 aa, Homo sapiens
  Payload ID: 7417
  Gene Symbol: HSPA2
  Gene Name: heat shock 70kDa protein 2
  Uniprot ID: P54652
  ENSP ID: ENSP00000247207
MSARGPAIGIDLGTTYSCVGVFQHGKVEIIANDQGNRTTPSYVAFTDTERLIGDAAKNQVAMNPTNTIFDAKRLIGRKFEDATVQSDMKHWPFRVVSEGGKPKVQVEYKGETKTFFPEEISSMVLTKMKEIAEAYLGGKVHSAVITVPAYFNDSQRQATKDAGTITGLNVLRIINEPTAAAIAYGLDKKGCAGGEKNVLIFDLGGGTFDVSILTIEDGIFEVKSTAGDTHLGGEDFDNRMVSHLAEEFKRKHKKDIGPNKRAVRRLRTACERAKRTLSSSTQASIEIDSLYEGVDFYTSITRARFEELNADLFRGTLEPVEKALRDAKLDKGQIQEIVLVGGSTRIPKIQKLLQDFFNGKELNKSINPDEAVAYGAAVQAAILIGDKSENVQDLLLLDVTPLSLGIETAGGVMTPLIKRNTTIPTKQTQTFTTYSDNQSSVLVQVYEGERAMTKDNNLLGKFDLTGIPPAPRGVPQIEVTFDIDANGILNVTAADKSTGKENKITITNDKGRLSKDDIDRMVQEAERYKSEDEANRDRVAAKNALESYTYNIKQTVEDEKLRGKISEQDKNKILDKCQEVINWLDRNQMAEKDEYEHKQKELERVCNPIISKLYQGGPGGGSGGGGSGASGGPTIEEVD

SEQ ID NO: 37356 - protein, 639 aa, Homo sapiens; identical to SEQ ID NO: 37355
  Payload ID: 7417
  Gene Symbol: HSPA2
  Gene Name: heat shock 70kDa protein 2
  Uniprot ID: P54652
  ENSP ID: ENSP00000378199

SEQ ID NO: 37357 - protein, 840 aa, Homo sapiens
  Payload ID: 7418
  Gene Symbol: HSPA4
  Gene Name: heat shock 70kDa protein 4
  Uniprot ID: P34932
  ENSP ID: ENSP00000302961
MSVVGIDLGFQSCYVAVARAGGIETIANEYSDRCTPACISFGPKNRSIGAAAKSQVISNAKNTVQGFKRFHGRAFSDPFVEAEKSNLAYDIVQLPTGLTGIKVTYMEEERNFTTEQVTAMLLSKLKETAESVLKKPVVDCVVSVPCFYTDAERRSVMDATQIAGLNCLRLMNETTAVALAYGIYKQDLPALEEKPRNVVFVDMGHSAYQVSVCAFNRGKLKVLATAFDTTLGGRKFDEVLVNHFCEEFGKKYKLDIKSKIRALLRLSQECEKLKKLMSANASDLPLSIECFMNDVDVSGTMNRGKFLEMCNDLLARVEPPLRSVLEQTKLKKEDIYAVEIVGGATRIPAVKEKISKFFGKELSTTLNADEAVTRGCALQCAILSPAFKVREFSITDVVPYPISLRWNSPAEEGSSDCEVFSKNHAAPFSKVLTFYRKEPFTLEAYYSSPQDLPYPDPAIAQFSVQKVTPQSDGSSSKVKVKVRVNVHGIFSVSSASLVEVHKSEENEEPMETDQNAKEEEKMQVDQEEPHVEEQQQQTPAENKAESEEMETSQAGSKDKKMDQPPQAKKAKVKTSTVDLPIENQLLWQIDREMLNLYIENEGKMIMQDKLEKERNDAKNAVEEYVYEMRDKLSGEYEKFVSEDDRNSFTLKLEDTENWLYEDGEDQPKQVYVDKLAELKNLGQPIKIRFQESEERPKLFEELGKQIQQYMKIISSFKNKEDQYDHLDAADMTKVEKSTNEAMEWMNNKLNLQNKQSLTMDPVVKSKEIEAKIKELTSTCSPIISKPKPKVEPPKEEQKNAEQNGPVDGQGDNPGPQAAEQGTDTAVPSDSDKKLPEMDID

SEQ ID NO: 37358 - protein, 475 aa, Homo sapiens [sequence omitted]

SEQ ID NO: 37359 - protein, 148 aa, Homo sapiens
  Payload ID: 7418
  Gene Symbol: HSPA4
  Gene Name: heat shock 70kDa protein 4
  Uniprot ID: P34932
  ENSP ID: ENSP00000480688
MSVVGIDLGFQSCYVAVARAGGIETIANEYSDRCTPACISFGPKNRSIGAAAKSQVISNAKNTVQGFKRFHGRAFSDPFVEAEKSNLAYDIVQLPTGLTGIKVTYMEEEQNGPVDGQGDNPGPQAAEQGTDTAVPSDSDKKLPEMDID

SEQ ID NO: 37360 - protein, 699 aa, Homo sapiens [sequence omitted]

SEQ ID NO: 37361 - protein, 839 aa, Homo sapiens
  Payload ID: 7419
  Gene Symbol: HSPA4L
  Gene Name: heat shock 70kDa protein 4-like
  Uniprot ID: O95757
  ENSP ID: ENSP00000296464
MSVVGIDLGFLNCYIAVARSGGIETIANEYSDRCTPACISLGSRTRAIGNAAKSQIVTNVRNTIHGFKKLHGRSFDDPIVQTERIRLPYELQKMPNGSAGVKVRYLEEERPFAIEQVTGMLLAKLKETSENALKKPVADCVISIPSFFTDAERRSVMAAAQVAGLNCLRLMNETTAVALAYGIYKQDLPPLDEKPRNVVFIDMGHSAYQVLVCAFNKGKLKVLATTFDPYLGGRNFDEALVDYFCDEFKTKYKINVKENSRALLRLYQECEKLKKLMSANASDLPLNIECFMNDLDVSSKMNRAQFEQLCASLLARVEPPLKAVMEQANLQREDISSIEIVGGATRIPAVKEQITKFFLKDISTTLNADEAVARGCALQCAILSPAFKVREFSITDLVPYSITLRWKTSFEDGSGECEVFCKNHPAPFSKVITFHKKEPFELEAFYTNLHEVPYPDARIGSFTIQNVFPQSDGDSSKVKVKVRVNIHGIFSVASASVIEKQNLEGDHSDAPMETETSFKNENKDNMDKMQVDQEEGHQKCHAEHTPEEEIDHTGAKTKSAVSDKQDRLNQTLKKGKVKSIDLPIQSSLCRQLGQDLLNSYIENEGKMIMQDKLEKERNDAKNAVEEYVYDFRDRLGTVYEKFITPEDLSKLSAVLEDTENWLYEDGEDQPKQVYVDKLQELKKYGQPIQMKYMEHEERPKALNDLGKKIQLVMKVIEAYRNKDERYDHLDPTEMEKVEKCISDAMSWLNSKMNAQNKLSLTQDPVVKVSEIVAKSKELDNFCNPIIYKPKPKAEVPEDKPKANSEHNGPMDGQSGTETKSDSTKDSSQHTKSSGEMEVD

SEQ ID NO: 37362 - protein, 839 aa, Homo sapiens; identical to SEQ ID NO: 37361
  Payload ID: 7419
  Gene Symbol: HSPA4L
  Gene Name: heat shock 70kDa protein 4-like
  Uniprot ID: O95757
  ENSP ID: ENSP00000422482

SEQ ID NO: 37363 - protein, 813 aa, Homo sapiens
  Payload ID: 7419
  Gene Symbol: HSPA4L
  Gene Name: heat shock 70kDa protein 4-like
  ENSP ID: ENSP00000425645
MKPILLFMERACISLGSRTRAIGNAAKSQIVTNVRNTIHGFKKLHGRSFDDPIVQTERIRLPYELQKMPNGSAGVKVRYLEEERPFAIEQVTGMLLAKLKETSENALKKPVADCVISIPSFFTDAERRSVMAAAQVAGLNCLRLMNETTAVALAYGIYKQDLPPLDEKPRNVVFIDMGHSAYQVLVCAFNKGKLKVLATTFDPYLGGRNFDEALVDYFCDEFKTKYKINVKENSRALLRLYQECEKLKKLMSANASDLPLNIECFMNDLDVSSKMNRAQFEQLCASLLARVEPPLKAVMEQANLQREDISSIEIVGGATRIPAVKEQITKFFLKDISTTLNADEAVARGCALQCAILSPAFKVREFSITDLVPYSITLRWKTSFEDGSGECEVFCKNHPAPFSKVITFHKKEPFELEAFYTNLHEVPYPDARIGSFTIQNVFPQSDGDSSKVKVKVRVNIHGIFSVASASVIEKQNLEGDHSDAPMETETSFKNENKDNMDKMQVDQEEGHQKCHAEHTPEEEIDHTGAKTKSAVSDKQDRLNQTLKKGKVKSIDLPIQSSLCRQLGQDLLNSYIENEGKMIMQDKLEKERNDAKNAVEEYVYDFRDRLGTVYEKFITPEDLSKLSAVLEDTENWLYEDGEDQPKQVYVDKLQELKKYGQPIQMKYMEHEERPKALNDLGKKIQLVMKVIEAYRNKDERYDHLDPTEMEKVEKCISDAMSWLNSKMNAQNKLSLTQDPVVKVSEIVAKSKELDNFCNPIIYKPKPKAEVPEDKPKANSEHNGPMDGQSGTETKSDSTKDSSQHTKSSGEMEVD

SEQ ID NO: 37364 - protein, 531 aa, Homo sapiens
  Payload ID: 7419
  Gene Symbol: HSPA4L
  Gene Name: heat shock 70kDa protein 4-like
  ENSP ID: ENSP00000427305
MSVVGIDLGFLNCYIAVARSGGIETIANEYSDRCTPACISLGSRTRAIGNAAKSQIVTNVRNTIHGFKKLHGRSFDDPIVQTERIRLPYELQKMPNGSAGVKIPSFFTDAERRSVMAAAQVAGLNCLRLMNETTAVALAYGIYKQDLPPLDEKPRNVVFIDMGHSAYQVLVCAFNKGKLKVLATTFDPYLGGRNFDEALVDYFCDEFKTKYKINVKENSRALLRLYQECEKLKKLMSANASDLPLNIECFMNDLDVSSKMNRAQFEQLCASLLARVEPPLKAVMEQANLQREDISSIEIVGGATRIPAVKEQITKFFLKDISTTLNADEAVARGCALQCAILSPAFKVREFSITDLVPYSITLRWKTSFEDGSGECEVFCKNHPAPFSKVITFHKKEPFELEAFYTNLHEVPYPDARIGSFTIQNVFPQSDGDSSKVKVKVRVNIHGIFSVASASVIEKQNLEGDHSDAPMETETSFKNENKDNMDKMQVDQEEGHQKCHAEHTPEEEIDHTGAKTKSAVSDKQDRLNQTL

SEQ ID NO: 37365 - protein, 654 aa, Homo sapiens
  Payload ID: 7420
  Gene Symbol: HSPA5
  Gene Name: heat shock 70kDa protein 5 (glucose-regulated protein, 78kDa)
  Uniprot ID: P11021
  ENSP ID: ENSP00000324173
MKLSLVAAMLLLLSAARAEEEDKKEDVGTVVGIDLGTTYSCVGVFKNGRVEIIANDQGNRITPSYVAFTPEGERLIGDAAKNQLTSNPENTVFDAKRLIGRTWNDPSVQQDIKFLPFKVVEKKTKPYIQVDIGGGQTKTFAPEEISAMVLTKMKETAEAYLGKKVTHAVVTVPAYFNDAQRQATKDAGTIAGLNVMRIINEPTAAAIAYGLDKREGEKNILVFDLGGGTFDVSLLTIDNGVFEVVATNGDTHLGGEDFDQRVMEHFIKLYKKKTGKDVRKDNRAVQKLRREVEKAKRALSSQHQARIEIESFYEGEDFSETLTRAKFEELNMDLFRSTMKPVQKVLEDSDLKKSDIDEIVLVGGSTRIPKIQQLVKEFFNGKEPSRGINPDEAVAYGAAVQAGVLSGDQDTGDLVLLDVCPLTLGIETVGGVMTKLIPRNTVVPTKKSQIFSTASDNQPTVTIKVYEGERPLTKDNHLLGTFDLTGIPPAPRGVPQIEVTFEIDVNGILRVTAEDKGTGNKNKITITNDQNRLTPEEIERMVNDAEKFAEEDKKLKERIDTRNELESYAYSLKNQIGDKEKLGGKLSSEDKETMEKAVEEKIEWLESHQDADIEDFKAKKKELEEIVQPIISKLYGSAGPPPTGEEDTAEKDEL

SEQ ID NO: 37366 - protein, 643 aa, Homo sapiens
  Payload ID: 7421
  Gene Symbol: HSPA6
  Gene Name: heat shock 70kDa protein 6 (HSP70B')
  Uniprot ID: P17066
  ENSP ID: ENSP00000310219
MQAPRELAVGIDLGTTYSCVGVFQQGRVEILANDQGNRTTPSYVAFTDTERLVGDAAKSQAALNPHNTVFDAKRLIGRKFADTTVQSDMKHWPFRVVSEGGKPKVRVCYRGEDKTFYPEEISSMVLSKMKETAEAYLGQPVKHAVITVPAYFNDSQRQATKDAGAIAGLNVLRIINEPTAAAIAYGLDRRGAGERNVLIFDLGGGTFDVSVLSIDAGVFEVKATAGDTHLGGEDFDNRLVNHFMEEFRRKHGKDLSGNKRALRRLRTACERAKRTLSSSTQATLEIDSLFEGVDFYTSITRARFEELCSDLFRSTLEPVEKALRDAKLDKAQIHDVVLVGGSTRIPKVQKLLQDFFNGKELNKSINPDEAVAYGAAVQAAVLMGDKCEKVQDLLLLDVAPLSLGLETAGGVMTTLIQRNATIPTKQTQTFTTYSDNQPGVFIQVYEGERAMTKDNNLLGRFELSGIPPAPRGVPQIEVTFDIDANGILSVTATDRSTGKANKITITNDKGRLSKEEVERMVHEAEQYKAEDEAQRDRVAAKNSLEAHVFHVKGSLQEESLRDKIPEEDRRKMQDKCREVLAWLEHNQLAEKEEYEHQKRELEQICRPIFSRLYGGPGVPGGSSCGTQARQGDPSTGPIIEEVD

SEQ ID NO: 37367 - protein, 646 aa, Homo sapiens
  Payload ID: 7422
  Gene Symbol: HSPA8
  Gene Name: heat shock 70kDa protein 8
  Uniprot ID: P11142
  ENSP ID: ENSP00000227378
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLRIINEPTAAAIAYGLDKKVGAERNVLIFDLGGGTFDVSILTIEDGIFEVKSTAGDTHLGGEDFDNRMVNHFIAEFKRKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGFPGGGAPPSGGASSGPTIEEVD

SEQ ID NO: 37368 - protein, 493 aa, Homo sapiens
  Payload ID: 7422
  Gene Symbol: HSPA8
  Gene Name: heat shock 70kDa protein 8
  Uniprot ID: P11142
  ENSP ID: ENSP00000404372
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLRIINEPTAAAIAYGLDKKVGAERNVLIFDLGGGTFDVSILTIEDGIFEVKSTAGDTHLGGEDFDNRMVNHFIAEFKRKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGMPGGMPGGFPGGGAPPSGGASSGPTIEEVD

SEQ ID NO: 37369 - protein, 183 aa, Homo sapiens
  Payload ID: 7422
  Gene Symbol: HSPA8
  Gene Name: heat shock 70kDa protein 8
  ENSP ID: ENSP00000431641
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLRIINEPTAAAIAY

SEQ ID NO: 37370 - protein, 646 aa, Homo sapiens; identical to SEQ ID NO: 37367
  Payload ID: 7422
  Gene Symbol: HSPA8
  Gene Name: heat shock 70kDa protein 8
  Uniprot ID: P11142
  ENSP ID: ENSP00000432083

SEQ ID NO: 37371 - protein, 312 aa, Homo sapiens
  Payload ID: 7422
  Gene Symbol: HSPA8
  Gene Name: heat shock 70kDa protein 8
  ENSP ID: ENSP00000432884
MNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLRIINEPTAAAIAYGLDKKVGAERNVLIFDLGGGTFDVSILTIEDGIFEVKSTAGDTHLGGEDFDNRMVNHFIAEFKRKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYG

SEQ ID NO: 37372 - protein, 410 aa, Homo sapiens
  Payload ID: 7422
  Gene Symbol: HSPA8
  Gene Name: heat shock 70kDa protein 8
  ENSP ID: ENSP00000433316
MVNHFIAEFKRKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGFPGGGAPPSGGASSGPTIEEVD

SEQ ID NO: 37373 - protein, 627 aa, Homo sapiens
  Payload ID: 7422
  Gene Symbol: HSPA8
  Gene Name: heat shock 70kDa protein 8
  ENSP ID: ENSP00000433584
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKATKDAGTIAGLNVLRIINEPTAAAIAYGLDKKVGAERNVLIFDLGGGTFDVSILTIEDGIFEVKSTAGDTHLGGEDFDNRMVNHFIAEFKRKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGFPGGGAPPSGGASSGPTIEEVD

SEQ ID NO: 37374 - protein, 171 aa, Homo sapiens
  Payload ID: 7422
  Gene Symbol: HSPA8
  Gene Name: heat shock 70kDa protein 8
  ENSP ID: ENSP00000434415
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLR

SEQ ID NO: 37375 - protein, 137 aa, Homo sapiens
  Payload ID: 7422
  Gene Symbol: HSPA8
  Gene Name: heat shock 70kDa protein 8
  ENSP ID: ENSP00000434565
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGK

SEQ ID NO: 37376 - protein, 132 aa, Homo sapiens
  Payload ID: 7422
  Gene Symbol: HSPA8
  Gene Name: heat shock 70kDa protein 8
  ENSP ID: ENSP00000434851
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAE

SEQ ID NO: 37377 - protein, 150 aa, Homo sapiens
  Payload ID: 7422
  Gene Symbol: HSPA8
  Gene Name: heat shock 70kDa protein 8
  ENSP ID: ENSP00000435019
MTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKE

SEQ ID NO: 37378 - protein, 187 aa, Homo sapiens
  Payload ID: 7422
  Gene Symbol: HSPA8
  Gene Name: heat shock 70kDa protein 8
  ENSP ID: ENSP00000435154
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLRIINEPTAAAIAYGLDK

SEQ ID NO: 37379 - protein, 223 aa, Homo sapiens
  Payload ID: 7422
  Gene Symbol: HSPA8
  Gene Name: heat shock 70kDa protein 8
  ENSP ID: ENSP00000435908
MTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGFPGGGAPP

SEQ ID NO: 37380 - protein, 178 aa, Homo sapiens
  Payload ID: 7422
  Gene Symbol: HSPA8
  Gene Name: heat shock 70kDa protein 8
  ENSP ID: ENSP00000436183
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLRIINEPTA

SEQ ID NO: 37381 - protein, 168 aa, Homo sapiens
  Payload ID: 7422
  Gene Symbol: HSPA8
  Gene Name: heat shock 70kDa protein 8
  ENSP ID: ENSP00000436762
MSKGPAVGIDLGTTYSCVGVFQHGKVEIIANDQGNRTTPSYVAFTDTERLIGDAAKNQVAMNPTNTVFETKSFYPEEVSSMVLTKMKEIAEAYLGKTVTNAVVTVPAYFNDSQRQATKDAGTIAGLNVLRIINEPTAAAIAYGLDKKVGAERNVLIFDLGGGTFDVSI

SEQ ID NO: 37382 - protein, 646 aa, Homo sapiens; identical to SEQ ID NO: 37367
  Payload ID: 7422
  Gene Symbol: HSPA8
  Gene Name: heat shock 70kDa protein 8
  Uniprot ID: P11142
  ENSP ID: ENSP00000437125

SEQ ID NO: 37383 - protein, 500 aa, Homo sapiens
  Payload ID: 7422
  Gene Symbol: HSPA8
  Gene Name: heat shock 70kDa protein 8
  ENSP ID: ENSP00000437189
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGFPGGGAPPSGGASSGPTIEEVD

SEQ ID NO: 37384 - protein, 679 aa, Homo sapiens
  Payload ID: 7423
  Gene Symbol: HSPA9
  Gene Name: heat shock 70kDa protein 9 (mortalin)
  Uniprot ID: P38646
  ENSP ID: ENSP00000297185
MISASRAAAARLVGAAASRGPTAARHQDSWNGLSHEAFRLVSRRDYASEAIKGAVVGIDLGTTNSCVAVMEGKQAKVLENAEGARTTPSVVAFTADGERLVGMPAKRQAVTNPNNTFYATKRLIGRRYDDPEVQKDIKNVPFKIVRASNGDAWVEAHGKLYSPSQIGAFVLMKMKETAENYLGHTAKNAVITVPAYFNDSQRQATKDAGQISGLNVLRVINEPTAAALAYGLDKSEDKVIAVYDLGGGTFDISILEIQKGVFEVKSTNGDTFLGGEDFDQALLRHIVKEFKRETGVDLTKDNMALQRVREAAEKAKCELSSSVQTDINLPYLTMDSSGPKHLNMKLTRAQFEGIVTDLIRRTIAPCQKAMQDAEVSKSDIGEVILVGGMTRMPKVQQTVQDLFGRAPSKAVNPDEAVAIGAAIQGGVLAGDVTDVLLLDVTPLSLGIETLGGVFTKLINRNTTIPTKKSQVFSTAADGQTQVEIKVCQGEREMAGDNKLLGQFTLIGIPPAPRGVPQIEVTFDIDANGIVHVSAKDKGTGREQQIVIQSSGGLSKDDIENMVKNAEKYAEEDRRKKERVEAVNMAEGIIHDTETKMEEFKDQLPADECNKLKEEISKMRELLARKDSETGENIRQAASSLQQASLKLFEMAYKKMASEREGSGSSGTGEQKEDQKEEKQ

SEQ ID NO: 37385 - protein, 38 aa, Homo sapiens
  Payload ID: 7423
  Gene Symbol: HSPA9
  Gene Name: heat shock 70kDa protein 9 (mortalin)
  ENSP ID: ENSP00000420944
MISASRAAAARLVGAAASRGPTAARHQIRSNQGSSCWY

SEQ ID NO: 37386 - protein, 100 aa, Homo sapiens
  Payload ID: 7423
  Gene Symbol: HSPA9
  Gene Name: heat shock 70kDa protein 9 (mortalin)
  ENSP ID: ENSP00000421311
  MOD_RES (1)..(1): Any amino acid
XVLLHLSAMISASRAAAARLVGAAASRGPTAARHQDSWNGLSHEAFRLVSRRDYASEAIKGAVVGIDLGTTNSCVAVMEGAGECRRCQNHPFSCGLYSRW

SEQ ID NO: 37387 - protein, 102 aa, Homo sapiens
  Payload ID: 7423
  Gene Symbol: HSPA9
  Gene Name: heat shock 70kDa protein 9 (mortalin)
  ENSP ID: ENSP00000421892
  MOD_RES (1)..(1): Any amino acid
XTQVEIKVCQGEREMAGDNKLLGQFTLIGIPPAPRGVPQIEVTFDIDANGIVHVSAKDKGTGREQQIVIQSSGGLSKDDIENMVKNAEKYAEEDRRKKRFPK

SEQ ID NO: 37388 - protein, 62 aa, Homo sapiens
  Payload ID: 7423
  Gene Symbol: HSPA9
  Gene Name: heat shock 70kDa protein 9 (mortalin)
  ENSP ID: ENSP00000423098
MEGKQAKVLENAEGARTTPSVVAFTADGERLVGMPAKRQAVTNPNNTFYATKRLIGRRYDDP

SEQ ID NO: 37389 - protein, 42 aa, Homo sapiens
  Payload ID: 7423
  Gene Symbol: HSPA9
  Gene Name: heat shock 70kDa protein 9 (mortalin)
  ENSP ID: ENSP00000423759
MISASRAAAARLVGAAASRGPTAARHQDTHWLVTESVFSFLG

SEQ ID NO: 37390 - protein, 95 aa, Homo sapiens
  Payload ID: 7423
  Gene Symbol: HSPA9
  Gene Name: heat shock 70kDa protein 9 (mortalin)
  ENSP ID: ENSP00000425598
MEGKQAKVLENAEGARTTPSVVAFTADGERLVGMPAKRQAVTNPNNTFYATKRLIGRRYDDPEVQKDIKNVPFKIVRASNGDAWVEAHGKLYSPS

SEQ ID NO: 37391 - protein, 163 aa, Homo sapiens
  Payload ID: 7423
  Gene Symbol: HSPA9
  Gene Name: heat shock 70kDa protein 9 (mortalin)
  ENSP ID: ENSP00000429475
  MOD_RES (1)..(1): Any amino acid
XDLTKDNMALQRVREAAEKAKCELSSSVQTDINLPYLTMDSSGPKHLNMKLTRAQFEGIVTDLIRRTIAPCQKAMQDAEVSKSDIGEVILVGGMTRMPKEICKKKKNEPGKKRSWTRWMPHILRNPRGRVQWLTPVIPALWEAKAGGSRGSADCTGSFWQSPK

SEQ ID NO: 37392 - protein, 76 aa, Homo sapiens
  Payload ID: 7424
  Gene Symbol: HSBP1
  Gene Name: heat shock factor binding protein 1
  Uniprot ID: O75506
  ENSP ID: ENSP00000392896
MAETDPKTVQDLTSVVQTLLQQMQDKFQTMSDQIIGRIDDMSSRIDDLEKNIADLMTQAGVEELESENKIPATQKS

SEQ ID NO: 37393 - protein, 66 aa, Homo sapiens
  Payload ID: 7424
  Gene Symbol: HSBP1
  Gene Name: heat shock factor binding protein 1
  ENSP ID: ENSP00000456049
MAETDPKTVQDLTSVVRDGCEGRRPRPSRAAPGQALLDRGAPTAAARGVCRGPVSGSVSGRGSRPP

SEQ ID NO: 37394 - protein, 76 aa, Homo sapiens; identical to SEQ ID NO: 37392
  Payload ID: 7424
  Gene Symbol: HSBP1
  Gene Name: heat shock factor binding protein 1
  Uniprot ID: O75506
  ENSP ID: ENSP00000458007

SEQ ID NO: 37395 - protein, 74 aa, Homo sapiens
  Payload ID: 7425
  Gene Symbol: HSBP1L1
  Gene Name: heat shock factor binding protein 1-like 1
  Uniprot ID: C9JCN9
  ENSP ID: ENSP00000414236
MDVRGPEAPGGRALRDAAENLFQELQEHFQALTATLNLRMEEMGNRIEDLQKNVKDLMVQAGIENSIKEQMLKT

SEQ ID NO: 37396 - protein, 45 aa, Homo sapiens
  Payload ID: 7425
  Gene Symbol: HSBP1L1
  Gene Name: heat shock factor binding protein 1-like 1
  ENSP ID: ENSP00000467108
MDVRGPEAPGGRALRDAAENLFQELQEHFQALTATLNLRNILFYL

SEQ ID NO: 37397 - protein, 471 aa, Homo sapiens
  Payload ID: 7426
  Gene Symbol: HSPA13
  Gene Name: heat shock protein 70kDa family, member 13
  Uniprot ID: P48723
  ENSP ID: ENSP00000285667
MAREMTILGSAVLTLLLAGYLAQQYLPLPTPKVIGIDLGTTYCSVGVFFPGTGKVKVIPDENGHISIPSMVSFTDNDVYVGYESVELADSNPQNTIYDAKRFIGKIFTAEELEAEIGRYPFKVLNKNGMVEFSVTSNETITVSPEYVGSRLLLKLKEMAEAYLGMPVANAVISVPAEFDLKQRNSTIEAANLAGLKILRVINEPTAAAMAYGLHKADVFHVLVIDLGGGTLDVSLLNKQGGMFLTRAMSGNNKLGGQDFNQRLLQYLYKQIYQTYGFVPSRKEEIHRLRQAVEMVKLNLTLHQSAQLSVLLTVEEQDRKEPHSSDTELPKDKLSSADDHRVNSGFGRGLSDKKSGESQVLFETEISRKLFDTLNEDLFQKILVPIQQVLKEGHLEKTEIDEVVLVGGSTRIPRIRQVIQEFFGKDPNTSVDPDLAVVTGVAIQAGIDGGSWPLQVSALEIPNKHLQKTNFN

SEQ ID NO: 37398 - protein, 732 aa, Homo sapiens
  Payload ID: 7427
  Gene Symbol: HSP90AA1
  Gene Name: heat shock protein 90kDa alpha (cytosolic), class A member 1
  Uniprot ID: P07900
  ENSP ID: ENSP00000216281
MPEETQTQDQPMEEEEVETFAFQAEIAQLMSLIINTFYSNKEIFLRELISNSSDALDKIRYESLTDPSKLDSGKELHINLIPNKQDRTLTIVDTGIGMTKADLINNLGTIAKSGTKAFMEALQAGADISMIGQFGVGFYSAYLVAEKVTVITKHNDDEQYAWESSAGGSFTVRTDTGEPMGRGTKVILHLKEDQTEYLEERRIKEIVKKHSQFIGYPITLFVEKERDKEVSDDEAEEKEDKEEEKEKEEKESEDKPEIEDVGSDEEEEKKDGDKKKKKKIKEKYIDQEELNKTKPIWTRNPDDITNEEYGEFYKSLTNDWEDHLAVKHFSVEGQLEFRALLFVPRRAPFDLFENRKKKNNIKLYVRRVFIMDNCEELIPEYLNFIRGVVDSEDLPLNISREMLQQSKILKVIRKNLVKKCLELFTELAEDKENYKKFYEQFSKNIKLGIHEDSQNRKKLSELLRYYTSASGDEMVSLKDYCTRMKENQKHIYYITGETKDQVANSAFVERLRKHGLEVIYMIEPIDEYCVQQLKEFEGKTLVSVTKEGLELPEDEEEKKKQEEKKTKFENLCKIMKDILEKKVEKVVVSNRLVTSPCCIVTSTYGWTANMERIMKAQALRDNSTMGYMAAKKHLEINPDHSIIETLRQKAEADKNDKSVKDLVILLYETALLSSGFSLEDPQTHANRIYRMIKLGLGIDEDDPTADDTSAAVTEEMPPLEGDDDTSRMEEVD

SEQ ID NO: 37399 - protein, 854 aa, Homo sapiens
  Payload ID: 7427
  Gene Symbol: HSP90AA1
  Gene Name: heat shock protein 90kDa alpha (cytosolic), class A member 1
  Uniprot ID: P07900
  ENSP ID: ENSP00000335153
MPPCSGGDGSTPPGPSLRDRDCPAQSAEYPRDRLDPRPGSPSEASSPPFLRSRAPVNWYQEKAQVFLWHLMVSGSTTLLCLWKQPFHVSAFPVTASLAFRQSQGAGQHLYKDLQPFILLRLLMPEETQTQDQPMEEEEVETFAFQAEIAQLMSLIINTFYSNKEIFLRELISNSSDALDKIRYESLTDPSKLDSGKELHINLIPNKQDRTLTIVDTGIGMTKADLINNLGTIAKSGTKAFMEALQAGADISMIGQFGVGFYSAYLVAEKVTVITKHNDDEQYAWESSAGGSFTVRTDTGEPMGRGTKVILHLKEDQTEYLEERRIKEIVKKHSQFIGYPITLFVEKERDKEVSDDEAEEKEDKEEEKEKEEKESEDKPEIEDVGSDEEEEKKDGDKKKKKKIKEKYIDQEELNKTKPIWTRNPDDITNEEYGEFYKSLTNDWEDHLAVKHFSVEGQLEFRALLFVPRRAPFDLFENRKKKNNIKLYVRRVFIMDNCEELIPEYLNFIRGVVDSEDLPLNISREMLQQSKILKVIRKNLVKKCLELFTELAEDKENYKKFYEQFSKNIKLGIHEDSQNRKKLSELLRYYTSASGDEMVSLKDYCTRMKENQKHIYYITGETKDQVANSAFVERLRKHGLEVIYMIEPIDEYCVQQLKEFEGKTLVSVTKEGLELPEDEEEKKKQEEKKTKFENLCKIMKDILEKKVEKVVVSNRLVTSPCCIVTSTYGWTANMERIMKAQALRDNSTMGYMAAKKHLEINPDHSIIETLRQKAEADKNDKSVKDLVILLYETALLSSGFSLEDPQTHANRIYRMIKLGLGIDEDDPTADDTSAAVTEEMPPLEGDDDTSRMEEVD

SEQ ID NO: 37400 - protein, 174 aa, Homo sapiens
  Payload ID: 7427
  Gene Symbol: HSP90AA1
  Gene Name: heat shock protein 90kDa alpha (cytosolic), class A member 1
  ENSP ID: ENSP00000450712
MPEETQTQDQPMEEEEVETFAFQAEIAQLMSLIINTFYSNKEIFLRELISNSSDALDKIRYESLTDPSKLDSGKELHINLIPNKQDRTLTIVDTGIGMTKADLINNLGEPMGRGTKVILHLKEDQTEYLEERRIKEIVKKHSQFIGYPITLFVEKERDKEVSDDEAEEKEDKEE

SEQ ID NO: 37401 - protein, 52 aa, Homo sapiens
  Payload ID: 7427
  Gene Symbol: HSP90AA1
  Gene Name: heat shock protein 90kDa alpha (cytosolic), class A member 1
  ENSP ID: ENSP00000451400
  MOD_RES (1)..(1): Any amino acid
XVETFAFQAEIAQLMSLIINTFYSNKEIFLRELISNSSDVNLWVVEQKLSYT

SEQ ID NO: 37402 - protein, 80 aa, Homo sapiens
  Payload ID: 7427
  Gene Symbol: HSP90AA1
  Gene Name: heat shock protein 90kDa alpha (cytosolic), class A member 1
  ENSP ID: ENSP00000452241
MPPCSGGDGSTPPGPSLRDRDCPAQSAEYPRDRLDPRPGSPSEASSPPFLRRCLRKPRPKTNRWRRRRLRRSPFRQKLPS

SEQ ID NO: 37403 - protein, 100 aa, Homo sapiens
  Payload ID: 7427
  Gene Symbol: HSP90AA1
  Gene Name: heat shock protein 90kDa alpha (cytosolic), class A member 1
  ENSP ID: ENSP00000489370
MPPCSGGDGSTPPGPSLRDRDCPAQSAEYPRDRLDPRPGSPSEASSPPFLRRAPVNWYQEKAQVFLWHLMVSGSTTLLCLWKQPFHVSAFPVTASLAFRQ

SEQ ID NO: 37404 - protein, 724 aa, Homo sapiens
  Payload ID: 7428
  Gene Symbol: HSP90AB1
  Gene Name: heat shock protein 90kDa alpha (cytosolic), class B member 1
  Uniprot ID: P08238
  ENSP ID: ENSP00000325875
MPEEVHHGEEEVETFAFQAEIAQLMSLIINTFYSNKEIFLRELISNASDALDKIRYESLTDPSKLDSGKELKIDIIPNPQERTLTLVDTGIGMTKADLINNLGTIAKSGTKAFMEALQAGADISMIGQFGVGFYSAYLVAEKVVVITKHNDDEQYAWESSAGGSFTVRADHGEPIGRGTKVILHLKEDQTEYLEERRVKEVVKKHSQFIGYPITLYLEKEREKEISDDEAEEEKGEKEEEDKDDEEKPKIEDVGSDEEDDSGKDKKKKTKKIKEKYIDQEELNKTKPIWTRNPDDITQEEYGEFYKSLTNDWEDHLAVKHFSVEGQLEFRALLFIPRRAPFDLFENKKKKNNIKLYVRRVFIMDSCDELIPEYLNFIRGVVDSEDLPLNISREMLQQSKILKVIRKNIVKKCLELFSELAEDKENYKKFYEAFSKNLKLGIHEDSTNRRRLSELLRYHTSQSGDEMTSLSEYVSRMKETQKSIYYITGESKEQVANSAFVERVRKRGFEVVYMTEPIDEYCVQQLKEFDGKSLVSVTKEGLELPEDEEEKKKMEESKAKFENLCKLMKEILDKKVEKVTISNRLVSSPCCIVTSTYGWTANMERIMKAQALRDNSTMGYMMAKKHLEINPDHPIVETLRQKAEADKNDKAVKDLVVLLFETALLSSGFSLEDPQTHSNRIYRMIKLGLGIDEDEVAAEEPNAAVPDEIPPLEGDEDASRMEEVD

SEQ ID NO: 37405 - protein, 724 aa, Homo sapiens; identical to SEQ ID NO: 37404
  Payload ID: 7428
  Gene Symbol: HSP90AB1
  Gene Name: heat shock protein 90kDa alpha (cytosolic), class B member 1
  Uniprot ID: P08238
  ENSP ID: ENSP00000360609

SEQ ID NO: 37406 - protein, 724 aa, Homo sapiens; identical to SEQ ID NO: 37404
  Payload ID: 7428
  Gene Symbol: HSP90AB1
  Gene Name: heat shock protein 90kDa alpha (cytosolic), class B member 1
  Uniprot ID: P08238
  ENSP ID: ENSP00000360709

SEQ ID NO: 37407 - protein, 724 aa, Homo sapiens; identical to SEQ ID NO: 37404
  Payload ID: 7428
  Gene Symbol: HSP90AB1
  Gene Name: heat shock protein 90kDa alpha (cytosolic), class B member 1
  Uniprot ID: P08238
  ENSP ID: ENSP00000481908

SEQ ID NO: 37408 - protein, 803 aa, Homo sapiens
  Payload ID: 7429
  Gene Symbol: HSP90B1
  Gene Name: heat shock protein 90kDa beta (Grp94), member 1
  Uniprot ID: P14625
  ENSP ID: ENSP00000299767
MRALWVLGLCCVLLTFGSVRADDEVDVDGTVEEDLGKSREGSRTDDEVVQREEEAIQLDGLNASQIRELREKSEKFAFQAEVNRMMKLIINSLYKNKEIFLRELISNASDALDKIRLISLTDENALSGNEELTVKIKCDKEKNLLHVTDTGVGMTREELVKNLGTIAKSGTSEFLNKMTEAQEDGQSTSELIGQFGVGFYSAFLVADKVIVTSKHNNDTQHIWESDSNEFSVIADPRGNTLGRGTTITLVLKEEASDYLELDTIKNLVKKYSQFINFPIYVWSSKTETVEEPMEEEEAAKEEKEESDDEAAVEEEEEEKKPKTKKVEKTVWDWELMNDIKPIWQRPSKEVEEDEYKAFYKSFSKESDDPMAYIHFTAEGEVTFKSILFVPTSAPRGLFDEYGSKKSDYIKLYVRRVFITDDFHDMMPKYLNFVKGVVDSDDLPLNVSRETLQQHKLLKVIRKKLVRKTLDMIKKIADDKYNDTFWKEFGTNIKLGVIEDHSNRTRLAKLLRFQSSHHPTDITSLDQYVERMKEKQDKIYFMAGSSRKEAESSPFVERLLKKGYEVIYLTEPVDEYCIQALPEFDGKRFQNVAKEGVKFDESEKTKESREAVEKEFEPLLNWMKDKALKDKIEKAVVSQRLTESPCALVASQYGWSGNMERIMKAQAYQTGKDISTNYYASQKKTFEINPRHPLIRDMLRRIKEDEDDKTVLDLAVVLFETATLRSGYLLPDTKAYGDRIERMLRLSLNIDPDAKVEEEPEEEPEETAEDTTEDTEQDEDEEMDVGTDEEEETAKESTAEKDEL

SEQ ID NO: 37409 - protein, 53 aa, Homo sapiens
  Payload ID: 7429
  Gene Symbol: HSP90B1
  Gene Name: heat shock protein 90kDa beta (Grp94), member 1
  ENSP ID: ENSP00000446266
MRALWVLGLCCVLLTFGSVRADDEVDVDGTVEEDLGKSREGSRTDDEVVQRSR

SEQ ID NO: 37410 - protein, 48 aa, Homo sapiens
  Payload ID: 7429
  Gene Symbol: HSP90B1
  Gene Name: heat shock protein 90kDa beta (Grp94), member 1
  ENSP ID: ENSP00000446748
MMKLIINSLYKNKEIFLRELISNASDALDKIRLISLTDENALSGNEEL

SEQ ID NO: 37411 - protein, 147 aa, Homo sapiens
  Payload ID: 7429
  Gene Symbol: HSP90B1
  Gene Name: heat shock protein 90kDa beta (Grp94), member 1
  ENSP ID: ENSP00000450215
  MOD_RES (1)..(1): Any amino acid
XQYGWSGNMERIMKAQAYQTGKDISTNYYASQKKTFEINPRHPLIRDMLRRIKEDEDDKTVLDLAVVLFETATLRSGYLLPDTKAYGDRIERMLRLSLNIDPDAKVEEEPEEEPEETAEDTTEDTEQDEDEEMDVGTDEEEETAKMS

SEQ ID NO: 37412 - protein, 315 aa, Homo sapiens [sequence omitted]

SEQ ID NO: 37413 - protein, 144 aa, Homo sapiens
  Payload ID: 7430
  Gene Symbol: HSPB11
  Gene Name: heat shock protein family B (small), member 11
  Uniprot ID: Q9Y547
  ENSP ID: ENSP00000194214
MRKIDLCLSSEGSEVILATSSDEKHPPENIIDGNPETFWTTTGMFPQEFIICFHKHVRIERLVIQSYFVQTLKIEKSTSKEPVDFEQWIEKDLVHTEGQLQNEEIVAHDGSATYLRFIIVSAFDHFASVHSVSAEGTVVSNLSS

SEQ ID NO: 37414 - protein, 74 aa, Homo sapiens
  Payload ID: 7430
  Gene Symbol: HSPB11
  Gene Name: heat shock protein family B (small), member 11
  ENSP ID: ENSP00000360427
MRKIDLCLSSEGSEVILATSSDEKHPPENIIDGNPETFWTTTGMFPQEFIICFHKHVRIERLVIQSYFGKQILH

SEQ ID NO: 37415 - protein, 112 aa, Homo sapiens
  Payload ID: 7430
  Gene Symbol: HSPB11
  Gene Name: heat shock protein family B (small), member 11
  ENSP ID: ENSP00000360428
MRKIDLCLSSEGSEVILATSSDEKHPPENIIDGNPETFWTTTGMFPQEFIICFHKHVRIERLVIQSYFVQTLKIEKSTSKEPVDFEQWIEKDLVHTEGQLQNEEIVVSEYTL

SEQ ID NO: 37416 - protein, 214 aa, Homo sapiens
  Payload ID: 7430
  Gene Symbol: HSPB11
  Gene Name: heat shock protein family B (small), member 11
  ENSP ID: ENSP00000360429
MRKIDLCLSSEGSEVILATSSDEKHPPENIIDGNPETFWTTTGMFPQEFIICFHKHVRIERLVIQSYFVQTLKIEKSTSKEPVDFEQWIEKDLVHTEGQLQNEEIVAGVGWRYLGSLQPPSPGFKRFSCLSLPRSWDYRHLPPHPANFFAFLVKMGFCHVGQAGLELQTSGDLPTSASQSAGITGVSHCARPGKANFKWRRVGKAFQKPPWYTR

SEQ ID NO: 37417 - protein, 160 aa, Homo sapiens
  Payload ID: 7431
  Gene Symbol: HSPB6
  Gene Name: heat shock protein, alpha-crystallin-related, B6
  Uniprot ID: O14558
  ENSP ID: ENSP00000004982
MEIPVPVQPSWLRRASAPLPGLSAPGRLFDQRFGEGLLEAELAALCPTTLAPYYLRAPSVALPVAQVPTDPGHFSVLLDVKHFSPEEIAVKVVGEHVEVHARHEERPDEHGFVAREFHRRYRLPPGVDPAAVTSALSPEGVLSIQAAPASAQAPPPAAAK

SEQ ID NO: 37418 - protein, 137 aa, Homo sapiens
  Payload ID: 7431
  Gene Symbol: HSPB6
  Gene Name: heat shock protein, alpha-crystallin-related, B6
  ENSP ID: ENSP00000467169
MEIPVPVQPSWLRRASAPLPGLSAPGRLFDQRFGEGLLEAELAALCPTTLAPYYLRAPSVALPVAQVPTDPGHFSVLLDVKHFSPEEIAVKVVGEHVEVHARHEERPVSRGVGRGWSGYARRRAGGAGPLKPPSPPG

SEQ ID NO: 37419 - protein, 160 aa, Homo sapiens; identical to SEQ ID NO: 37417
  Payload ID: 7431
  Gene Symbol: HSPB6
  Gene Name: heat shock protein, alpha-crystallin-related, B6
  Uniprot ID: O14558
  ENSP ID: ENSP00000468057

SEQ ID NO: 37420 - protein, 159 aa, Homo sapiens
  Payload ID: 7432
  Gene Symbol: HSPB9
  Gene Name: heat shock protein, alpha-crystallin-related, B9
  Uniprot ID: Q9BQS6
  ENSP ID: ENSP00000458018
MQRVGNTFSNESRVASRCPSVGLAERNRVATMPVRLLRDSPAAQEDNDHARDGFQMKLDAHGFAPEELVVQVDGQWLMVTGQQQLDVRDPERVSYRMSQKVHRKMLPSNLSPTAMTCCLTPSGQLWVRGQCVALALPEAQTGPSPRLGSLGSKASNLTR

SEQ ID NO: 37421 - protein, 495 aa, Homo sapiens
  Payload ID: 7433
  Gene Symbol: HSF1
  Gene Name: heat shock transcription factor 1
  ENSP ID: ENSP00000383590
MDLPVGPGAAGPSNVPAFLTKLWTLVSDPDTDALICWSPSGNSFHVFDQGQFAKEVLPKYFKHNNMASFVRQLNMYGFRKVVHIEQGGLVKPERDDTEFQHPCFLRGQEQLLENIKRKVTSVSTLKSEDIKIRQDSVTKLLTDVQLMKGKQECMDSKLLAMKHENEALWREVASLRQKHAQQQKVVNKLIQFLISLVQSNRILGVKRKIPLMLNDSGSAHSMPKYSRQFSLEHVHGSGPYSAPSPAYSSSSLYAPDAVASSGPIISDITELAPASPMASPGGSIDERPLSSSPLVRVKEEPPSPPQSPRVEEASPGRPSSVDTLLSPTALIDSILRESEPAPASVTALTDARGHTDTEGRPPSPPPTSTPEKCLSVACLDNLARTPQMSRVARLFPCPSSSPHGQVQPGNELSDHLDAMDSNLDNLQTMLSSHGFSVDTSALLDIQELLSPQEPPRPPEAENSSPDSAGALHSAAAVPAGPRLRGHREQRPAGAV

SEQ ID NO: 37422 - protein, 529 aa, Homo sapiens
  Payload ID: 7433
  Gene Symbol: HSF1
  Gene Name: heat shock transcription factor 1
  Uniprot ID: Q00613
  ENSP ID: ENSP00000431512
MDLPVGPGAAGPSNVPAFLTKLWTLVSDPDTDALICWSPSGNSFHVFDQGQFAKEVLPKYFKHNNMASFVRQLNMYGFRKVVHIEQGGLVKPERDDTEFQHPCFLRGQEQLLENIKRKVTSVSTLKSEDIKIRQDSVTKLLTDVQLMKGKQECMDSKLLAMKHENEALWREVASLRQKHAQQQKVVNKLIQFLISLVQSNRILGVKRKIPLMLNDSGSAHSMPKYSRQFSLEHVHGSGPYSAPSPAYSSSSLYAPDAVASSGPIISDITELAPASPMASPGGSIDERPLSSSPLVRVKEEPPSPPQSPRVEEASPGRPSSVDTLLSPTALIDSILRESEPAPASVTALTDARGHTDTEGRPPSPPPTSTPEKCLSVACLDKNELSDHLDAMDSNLDNLQTMLSSHGFSVDTSALLDLFSPSVTVPDMSLPDLDSSLASIQELLSPQEPPRPPEAENSSPDSGKQLVHYTAQPLFLLDPGSVDTGSNDLPVLFELGEGSYFSEGDGFAEDPTISLLTGSEPPKAKDPTVS

SEQ ID NO: 37423 - protein, 138 aa, Homo sapiens
  Payload ID: 7433
  Gene Symbol: HSF1
  Gene Name: heat shock transcription factor 1
  ENSP ID: ENSP00000436616
MASFVRQLNMYGFRKVVHIEQGGLVKPERDDTEFQHPCFLRGQEQLLENIKRKVTSVSTLKSEDIKIRQDSVTKLLTDVQLMKGKQECMDSKLLAMKHENEALWREVASLRQKHAQQQKVVNKLIQFLISLVQSNRIL

SEQ ID NO: 37424 - protein, 47 aa, Homo sapiens
  Payload ID: 7433
  Gene Symbol: HSF1
  Gene Name: heat shock transcription factor 1
  ENSP ID: ENSP00000480423
IISDITELAPASPMASPGGSIDESPHGRQGPHGHRGPASLPPAHLHP

SEQ ID NO: 37425 - protein, 64 aa, Homo sapiens
  Payload ID: 7433
  Gene Symbol: HSF1
  Gene Name: heat shock transcription factor 1
  ENSP ID: ENSP00000481007
MDLPVGPGAAGPSNVPAFLTKLWTLVSDPDTDALICWSPLPGSRLVYMVRPCKTGQLRFAEVNQ

SEQ ID NO: 37426 - protein, 91 aa, Homo sapiens
  Payload ID: 7433
  Gene Symbol: HSF1
  Gene Name: heat shock transcription factor 1
  ENSP ID: ENSP00000484174
  MOD_RES (1)..(1): Any amino acid
XFRKVVHIEQGGLVKPERDDTEFQHPCFLRGQEQLLENIKRKVTSVSTLKSEDIKIRQDSVTKLLTDVQLMKGKQECMDSKLLAMKHSFSS

SEQ ID NO: 37427 - protein, 536 aa, Homo sapiens
  Payload ID: 7434
  Gene Symbol: HSF2
  Gene Name: heat shock transcription factor 2
  Uniprot ID: Q03933
  ENSP ID: ENSP00000357440
MKQSSNVPAFLSKLWTLVEETHTNEFITWSQNGQSFLVLDEQRFAKEILPKYFKHNNMASFVRQLNMYGFRKVVHIDSGIVKQERDGPVEFQHPYFKQGQDDLLENIKRKVSSSKPEENKIRQEDLTKIISSAQKVQIKQETIESRLSELKSENESLWKEVSELRAKHAQQQQVIRKIVQFIVTLVQNNQLVSLKRKRPLLLNTNGAQKKNLFQHIVKEPTDNHHHKVPHSRTEGLKPRERISDDIIIYDVTDDNADEENIPVIPETNEDVISDPSNCSQYPDIVIVEDDNEDEYAPVIQSGEQNEPARESLSSGSDGSSPLMSSAVQLNGSSSLTSEDPVTMMDSILNDNINLLGKVELLDYLDSIDCSLEDFQAMLSGRQFSIDPDLLVDLFTSSVQMNPTDYINNTKSENKGLETTKNNVVQPVSEEGRKSKSKPDKQLIQYTAFPLLAFLDGNPASSVEQASTTASSEVLSSVDKPIEVDELLDSSLDPEPTQSKLVRLEPLTEAEASEATLFYLCELAPAPLDSDMPLLDS

SEQ ID NO: 37428 - protein, 518 aa, Homo sapiens
  Payload ID: 7434
  Gene Symbol: HSF2
  Gene Name: heat shock transcription factor 2
  Uniprot ID: Q03933
  ENSP ID: ENSP00000400380
MKQSSNVPAFLSKLWTLVEETHTNEFITWSQNGQSFLVLDEQRFAKEILPKYFKHNNMASFVRQLNMYGFRKVVHIDSGIVKQERDGPVEFQHPYFKQGQDDLLENIKRKVSSSKPEENKIRQEDLTKIISSAQKVQIKQETIESRLSELKSENESLWKEVSELRAKHAQQQQVIRKIVQFIVTLVQNNQLVSLKRKRPLLLNTNGAQKKNLFQHIVKEPTDNHHHKVPHSRTEGLKPRERISDDIIIYDVTDDNADEENIPVIPETNEDVISDPSNCSQYPDIVIVEDDNEDEYAPVIQSGEQNEPARESLSSGSDGSSPLMSSAVQLNGSSSLTSEDPVTMMDSILNDNINLLGKVELLDYLDSIDCSLEDFQAMLSGRQFSIDPDLLVDSENKGLETTKNNVVQPVSEEGRKSKSKPDKQLIQYTAFPLLAFLDGNPASSVEQASTTASSEVLSSVDKPIEVDELLDSSLDPEPTQSKLVRLEPLTEAEASEATLFYLCELAPAPLDSDMPLLDS

SEQ ID NO: 37429 - protein, 214 aa, Homo sapiens
  Payload ID: 7434
  Gene Symbol: HSF2
  Gene Name: heat shock transcription factor 2
  ENSP ID: ENSP00000477405
HSRTEGLKPRERISDDIIIYDVTDDNADEENIPVIPETNEDVISDPSNCSQYPDIVIVEDDNEDEYAPVIQSGEQNEPARESLSSGSDGSSPLMSSAVQLNGSSSLTSEDPVTMMDSILNDNINLLGKVELLDYLDSIDCSLEDFQAMLSGRQFSIDPDLLVDSENKGLETTKNNVVQPVSEEGRKSKSKPDKQLIQYTAFPLLAFLDGNPASS

SEQ ID NO: 37430 - protein, 334 aa, Homo sapiens
  Payload ID: 7435
  Gene Symbol: HSF2BP
  Gene Name: heat shock transcription factor 2 binding protein
  Uniprot ID: O75031
  ENSP ID: ENSP00000291560
MGEAGAAEEACRHMGTKEEFVKVRKKDLERLTTEVMQIRDFLPRILNGEVLESFQKLKIVEKNLERKEQELEQLKMDCEHFKARLETVQADNIREKKEKLALRQQLNEAKQQLLQQAEYCTEMGAAACTLLWGVSSSEEVVKAILGGDKALKFFSITGQTMESFVKSLDGDVQELDSDESQFVFALAGIVTNVAAIACGREFLVNSSRVLLDTILQLLGDLKPGQCTKLKVLMLMSLYNVSINLKGLKYISESPGFIPLLWWLLSDPDAEVCLHVLRLVQSVVLEPEVFSKSASEFRSSLPLQRILAMSKSRNPRLQTAAQELLEDLRTLEHNV

SEQ ID NO: 37431 - protein, 226 aa, Homo sapiens
  Payload ID: 7435
  Gene Symbol: HSF2BP
  Gene Name: heat shock transcription factor 2 binding protein
  ENSP ID: ENSP00000409585
MGEAGAAEEACRHMGTKEEFVKVRKKDLERLTTEVMQIRDFLPRILNGEVLESFQKLKIVEKNLERKEQELEQLKMDCEHFKARLETVQADNIREKKEKLALRQQLNEAKQQLLQQAEYCTEMGAAACTLLWGVSSSEEVVKAILGGVSMDKALKFFSITGQTMESFVKSLDGDVQELDSDESQFVFALAGIVTNVAAIACGREFLVNSSRVLLDTILQLLGDLKP

SEQ ID NO: 37432 - protein, 315 aa, Homo sapiens
  Payload ID: 7436
  Gene Symbol: HSF4
  Gene Name: heat shock transcription factor 4
  ENSP ID: ENSP00000403219
MQEAPAALPTEPGPSPVPAFLGKLWALVGDPGTDHLIRWSPSGTSFLVSDQSRFAKEVLPQYFKHSNMASFVRQLNMYGFRKVVSIEQGGLLRPERDHVEFQHPSFVRGREQLLERVRRKVPALRGDDGRWRPEDLGRLLGEVQALRGVQESTEARLRELRQQNEILWREVVTLRQSHGQQHRVIGKLIQCLFGPLQAGPSNAGGKRKLSLMLDEGSSCPTPAKFNTCPLPGALLQDPYFIQSPLPETNLGLSPHRARGPIISDIPEDSPSPEGTRLSPSSDGRSPPATACGCGAGHPGRERELQPRGAQECPTA

SEQ ID NO: 37433 - protein, 194 aa, Homo sapiens
  Payload ID: 7436
  Gene Symbol: HSF4
  Gene Name: heat shock transcription factor 4
  ENSP ID: ENSP00000427832
MQEAPAALPTEPGPSPVPAFLGKLWALVGDPGTDHLIRWSPSGTSFLVSDQSRFAKEVLPQYFKHSNMASFVRQLNMYGFRKVVSIEQGGLLRPERDHVEFQHPSFVRGREQLLERVRRKVPALRGDDGRWRPEDLGRLLGEAERDLVAGGGDTSAEPRSAAPGHWQADPVSLWATSGGAEQCRRQEKAVPDAG

SEQ ID NO: 37434 - protein, 17 aa, Homo sapiens
  Payload ID: 7436
  Gene Symbol: HSF4
  Gene Name: heat shock transcription factor 4
  ENSP ID: ENSP00000427963
  MOD_RES (1)..(1): Any amino acid
XFSLRPGPASPRDKFGP

SEQ ID NO: 37435 - protein, 223 aa, Homo sapiens
  Payload ID: 7436
  Gene Symbol: HSF4
  Gene Name: heat shock transcription factor 4
  ENSP ID: ENSP00000428077
  MOD_RES (1)..(1): Any amino acid
XTCPLPGALLQDPYFIQSEEKMEASLPPNQTQALQHGLSLLPQTFSLRPGPAPPPLPVAVVQAILEGKGSFSPEGPRNAQQPEPGDPREIPDRGPLGLESGDRSPESLLPPMLLQPPQESVEPAGPLDVLGPSLQGREWTLMDLDMELSLMQPLVPERGEPELAVKGLNSPSPGKDPTLGAPLLLDVQAALGGPALGLPGALTIYSTPESRTASYLGPEASPS

SEQ ID NO: 37436 - protein, 318 aa, Homo sapiens
  Payload ID: 7436
  Gene Symbol: HSF4
  Gene Name: heat shock transcription factor 4
  ENSP ID: ENSP00000428161
MQEAPAALPTEPGPSPVPAFLGKLWALVGDPGTDHLIRWSPSGTSFLVSDQSRFAKEVLPQYFKHSNMASFVRQLNMYGFRKVVSIEQGGLLRPERDHVEFQHPSFVRGREQLLERVRRKVPALRGDDGRWRPEDLGRLLGEVQALRGVQESTEARLRELRQQNEILWREVVTLRQSHGQQHRVIGKLIQCLFGPLQAGPSNAGGKRKLSLMLDEGSSCPTPAKFNTCPLPGALLQDPYFIQSPPRHCLWLWCRPSWKGKGASAPRGPGMPNSLNQGIPGRYLTGGLWAWKAGTGAQRVCCLRCCFSPLKKVWNLQGL

SEQ ID NO: 37437 - protein, 416 aa, Homo sapiens
  Payload ID: 7436
  Gene Symbol: HSF4
  Gene Name: heat shock transcription factor 4
  ENSP ID: ENSP00000428978
MQEAPAALPTEPGPSPVPAFLGKLWALVGDPGTDHLIRWSPSGTSFLVSDQSRFAKEVLPQYFKHSNMASFVRQLNMYGFRKVVSIEQGGLLRPERDHVEFQHPSFVRGREQLLERVRRKVPALRGDDGRWRPEDLGRLLGEVQALRGVQESTEARLRELRQQNEILWREVVTLRQSHGQQHRVIGKLIQCLFGPLQAGPSNAGGKRKLSLMLDEGSSCPTPAKFNTCPLPGALLQDPYFIQSPLPETNLGLSPHRARGPIISDIPEDSPSPEGTRLSPSSDGRRGPLGLESGDRSPESLLPPMLLQPPQESVEPAGPLDVLGPSLQGREWTLMDLDMELSLMQPLVPERGEPELAVKGLNSPSPGKDPTLGAPLLLDVQAALGGPALGLPGALTIYSTPESRTASYLGPEASPSP

SEQ ID NO: 37438 - protein, 63 aa, Homo sapiens
  Payload ID: 7436
  Gene Symbol: HSF4
  Gene Name: heat shock transcription factor 4
  ENSP ID: ENSP00000429486
  MOD_RES (1)..(1): Any amino acid
XMDLDMELSLMQPLVPERGEPELAVKGLNSPSPGPHARGPTPAGCPGGLGRPSPGPAWGFNHL

SEQ ID NO: 37439 - protein, 47 aa, Homo sapiens
  Payload ID: 7436
  Gene Symbol: HSF4
  Gene Name: heat shock transcription factor 4
  ENSP ID: ENSP00000429580
MQEAPAALPTEPGPSPVPAFLGKLWALVGDPGTDHLIRWSPTVFGRW

SEQ ID NO: 37440 - protein, 182 aa, Homo sapiens
  Payload ID: 7436
  Gene Symbol: HSF4
  Gene Name: heat shock transcription factor 4
  ENSP ID: ENSP00000430211
  MOD_RES (1)..(1): Any amino acid
XARLRELRQQNEILWREVVTLRQSHGQQHRVIGKLIQCLFGPLQAGPSNAGGKRKLTPTSSSRLSQRQIWALALTGPGAPSSLTSQKTLHPLRGPGFLPPVMAGAPPPLPVAVVQAILEGKGSFSPEGPRNAQQPEPGDPREIPDRGPLGLESGDRSPESLLPPMLLQPPQESVEPAGPLDV

SEQ ID NO: 37441 - protein, 185 aa, Homo sapiens
  Payload ID: 7436
  Gene Symbol: HSF4
  Gene Name: heat shock transcription factor 4
  ENSP ID: ENSP00000430299
GTSFLVSDQSRFAKEVLPQYFKHSNMASFVRQLNMYGFRKVVSIEQGGLLRPERDHVEFQHPSFVRGREQLLERVRRKVPALRGDDGRWRPEDLGRLLGENEILWREVVTLRQSHGQQHRVIGKLIQCLFGPLQAGPSNAGGKRKLSLMLDEGSSCPTPAKFNTCPLPGALLQDPYFIQSPLPET

SEQ ID NO: 37442 - protein, 315 aa, Homo sapiens; identical to SEQ ID NO: 37432
  Payload ID: 7436
  Gene Symbol: HSF4
  Gene Name: heat shock transcription factor 4
  ENSP ID: ENSP00000430631

SEQ ID NO: 37443 - protein, 77 aa, Homo sapiens
  Payload ID: 7436
  Gene Symbol: HSF4
  Gene Name: heat shock transcription factor 4
  ENSP ID: ENSP00000430724
  MOD_RES (1)..(1): Any amino acid
XRKVPALRGDDGRWRPEDLGRLLGEAERDLVAGGGDTSAEPRSAAPGHWQADPVSLWATSGGAEQCRRQEKAVPDAG

SEQ ID NO: 37444 - protein, 141 aa, Homo sapiens
  Payload ID: 7436
  Gene Symbol: HSF4
  Gene Name: heat shock transcription factor 4
  ENSP ID: ENSP00000430840
  MOD_RES (1)..(1): Any amino acid
XVAVVQAILEGKGSFSPEGPRNAQQPEPGDPREIPDRGPLGLESGDRSPESLLPPMLLQPPQESVEPAGPLDVLGPSLQGREWTLMDLDMELSLMQPLVPERGEPELAVKGLNSPSPALLRAGLPPTWARKPVPPPKTPRL

SEQ ID NO: 37445 - protein, 492 aa, Homo sapiens
  Payload ID: 7436
  Gene Symbol: HSF4
  Gene Name: heat shock transcription factor 4
  Uniprot ID: Q9ULV5
  ENSP ID: ENSP00000430947
MQEAPAALPTEPGPSPVPAFLGKLWALVGDPGTDHLIRWSPSGTSFLVSDQSRFAKEVLPQYFKHSNMASFVRQLNMYGFRKVVSIEQGGLLRPERDHVEFQHPSFVRGREQLLERVRRKVPALRGDDGRWRPEDLGRLLGEVQALRGVQESTEARLRELRQQNEILWREVVTLRQSHGQQHRVIGKLIQCLFGPLQAGPSNAGGKRKLSLMLDEGSSCPTPAKFNTCPLPGALLQDPYFIQSPLPETNLGLSPHRARGPIISDIPEDSPSPEGTRLSPSSDGRREKGLALLKEEPASPGGDGEAGLALAPNECDFCVTAPPPLPVAVVQAILEGKGSFSPEGPRNAQQPEPGDPREIPDRGPLGLESGDRSPESLLPPMLLQPPQESVEPAGPLDVLGPSLQGREWTLMDLDMELSLMQPLVPERGEPELAVKGLNSPSPGKDPTLGAPLLLDVQAALGGPALGLPGALTIYSTPESRTASYLGPEASPSP

SEQ ID NO: 37446 - protein, 462 aa, Homo sapiens
  Payload ID: 7436
  Gene Symbol: HSF4
  Gene Name: heat shock transcription factor 4
  Uniprot ID: Q9ULV5
  ENSP ID: ENSP00000463706
MQEAPAALPTEPGPSPVPAFLGKLWALVGDPGTDHLIRWSPSGTSFLVSDQSRFAKEVLPQYFKHSNMASFVRQLNMYGFRKVVSIEQGGLLRPERDHVEFQHPSFVRGREQLLERVRRKVPALRGDDGRWRPEDLGRLLGEVQALRGVQESTEARLRELRQQNEILWREVVTLRQSHGQQHRVIGKLIQCLFGPLQAGPSNAGGKRKLSLMLDEGSSCPTPAKFNTCPLPGALLQDPYFIQSPSTYSLSQRQIWALALTGPGAPSSLTSQKTLHPLRGPGFLPPVMAGAPPPLPVAVVQAILEGKGSFSPEGPRNAQQPEPGDPREIPDRGPLGLESGDRSPESLLPPMLLQPPQESVEPAGPLDVLGPSLQGREWTLMDLDMELSLMQPLVPERGEPELAVKGLNSPSPGKDPTLGAPLLLDVQAALGGPALGLPGALTIYSTPESRTASYLGPEASPSP

SEQ ID NO: 37447 - protein, 596 aa, Homo sapiens
  Payload ID: 7437
  Gene Symbol: HSF5
  Gene Name: heat shock transcription factor family member 5
  Uniprot ID: Q4G112
  ENSP ID: ENSP00000313243
MEALLSTPINPNNFPAKLWRLVNSPRYRSIRWDGRGEGLLIDQPLFEAELLSPPGPGGGGGTAGAGAEPELFKTTSFTSFIRQLNLYGFRKVVLGGPGGGKPAGNGPLHHFHNPHFRRDQPQLLVHLKRLTSANKAKLAAGLEVPCRPPNRFQRLLITSASAATAPLQHQQPPPPAGPRPEPHGPVAVGQFHRSFRRDSLSPYSCVSTPSHDHSTYPLKGLDRTPVPHRIWQNSLGMHPGQVETSPTFSDKGVPFPVLQRFPTEVTYTLQPSTTSVHVQQGPQTMVSSSQKYSNYTPSAQYSQAYYPTAVLQCCSPTHMDALSSCVTPTASSYAHCNYFQNPSMQSSYPVEFLPSNWPCSTTDENTKTEVNLEAVFQIVDELHSSPKLEMVKVEPVENQCPTSPSYRGQHILANSNNSNPCSASQASQLEPLTPVGSDIMSFVVGTEQAVACSLPQSPEYIYTIHTAQPVENSTIQESAAIQQAHVKLKEHLNHNPSPSSVVFVQEGPPFSTHQVDANIKCQTSSRENILPSEQMGFLISEMGPASKPSEDTGLATPARYREHRSNSQQGKSPDLHLLVDVACKQERFPKEEELKE

SEQ ID NO: 37448 - protein, 475 aa, Homo sapiens
  Payload ID: 7437
  Gene Symbol: HSF5
  Gene Name: heat shock transcription factor family member 5
  Uniprot ID: Q4G112
  ENSP ID: ENSP00000484295
MEALLSTPINPNNFPAKLWRLVNSPRYRSIRWDGRGEGLLIDQPLFEAELLSPPAGPRPEPHGPVAVGQFHRSFRRDSLSPYSCVSTPSHDHSTYPLKGLDRTPVPHRIWQNSLGMHPGQVETSPTFSDKGVPFPVLQRFPTEVTYTLQPSTTSVHVQQGPQTMVSSSQKYSNYTPSAQYSQAYYPTAVLQCCSPTHMDALSSCVTPTASSYAHCNYFQNPSMQSSYPVEFLPSNWPCSTTDENTKTEVNLEAVFQIVDELHSSPKLEMVKVEPVENQCPTSPSYRGQHILANSNNSNPCSASQASQLEPLTPVGSDIMSFVVGTEQAVACSLPQSPEYIYTIHTAQPVENSTIQESAAIQQAHVKLKEHLNHNPSPSSVVFVQEGPPFSTHQVDANIKCQTSSRENILPSEQMGFLISEMGPASKPSEDTGLATPARYREHRSNSQQGKSPDLHLLVDVACKQERFPKEEELKE

SEQ ID NO: 37449 - protein, 423 aa, Homo sapiens
  Payload ID: 7438
  Gene Symbol: HSFX1
  Gene Name: heat shock transcription factor family, X-linked 1
  Uniprot ID: Q9UBD0
  ENSP ID: ENSP00000359444
MEDKRSLSMARCEERNSRGQDHGLERVPFPPQLQSETYLHPADPSPAWDDPGSTGSPNLRLLTEEIAFQPLAEEASFRRPHPDGDVPPQGEDNLLSLPFPQKLWRLVSSNQFSSIWWDDSGACRVINQKLFEKEILKRDVAHKVFATTSIKSFFRQLNLYGFRKRRQCTFRTFTRIFSAKRLVSILNKLEFYCHPYFQRDSPHLLVRMKRRVGVKSAPRHQEEDKPEAAGSCLAPADTEQQDHTSPNENDQVTPQHREPAGPNTQIRSGSAPPATPVMVPDSAVASDNSPVTQPAGEWSEGSQAHVTPVAAVPGPAALPFLYVPGSPTQMNSYGPVVALPTASRSTLAMDTTGLPAPGMLPFCHLWVPVTLVAAGAAQPAASMVMFPHLPALHHHCPHSHRTSQYMPASDGPQAYPDYADQST

SEQ ID NO: 37450 - protein, 423 aa, Homo sapiens; identical to SEQ ID NO: 37449
  Payload ID: 7439
  Gene Symbol: HSFX2
  Gene Name: heat shock transcription factor family, X-linked 2
  Uniprot ID: Q9UBD0
  ENSP ID: ENSP00000469223

SEQ ID NO: 37451 - protein, 401 aa, Homo sapiens
  Payload ID: 7440
  Gene Symbol: HSFY1
  Gene Name: heat shock transcription factor, Y-linked 1
  Uniprot ID: Q96LI6
  ENSP ID: ENSP00000303599
MAHVSSETQDVSPKDELTASEASTRSPLCEHTFPGDSDLRSMIEEHAFQVLSQGSLLESPSYTVCVSEPDKDDDFLSLNFPRKLWKIVESDQFKSISWDENGTCIVINEELFKKEILETKAPYRIFQTDAIKSFVRQLNLYGFSKIQQNFQRSAFLATFLSEEKESSVLSKLKFYYNPNFKRGYPQLLVRVKRRIGVKNASPISTLFNEDFNKKHFRAGANMENHNSALAAEASEESLFSASKNLNMPLTRESSVRQIIANSSVPIRSGFPPPSPSTSVGPSEQIATDQHAILNQLTTIHMHSHSTYMQARGHIVNFITTTTSQYHIISPLQNGYFGLTVEPSAVPTRYPLVSVNEAPYRNMLPAGNPWLQMPTIADRSAAPHSRLALQPSPLDKYHPNYN

SEQ ID NO: 37452 - protein, 203 aa, Homo sapiens
  Payload ID: 7440
  Gene Symbol: HSFY1
  Gene Name: heat shock transcription factor, Y-linked 1
  Uniprot ID: Q96LI6
  ENSP ID: ENSP00000311166
MAHVSSETQDVSPKDELTASEASTRSPLCEHTFPGDSDLRSMIEEHAFQVLSQGSLLESPSYTVCVSEPDKDDDFLSLNFPRKLWKIVESDQFKSISWDENGTCIVINEELFKKEILETKAPYRIFQTDAIKSFVRQLNLYGFSKIQQNFQRSAFLATFLSEEKESSVLSKIRFTKMKLSRSSTYENRYLCCNLHLKDESNYS

SEQ ID NO: 37453 - protein, 214 aa, Homo sapiens
  Payload ID: 7440
  Gene Symbol: HSFY1
  Gene Name: heat shock transcription factor, Y-linked 1
  Uniprot ID: Q96LI6
  ENSP ID: ENSP00000342302
MAHVSSETQDVSPKDELTASEASTRSPLCEHTFPGDSDLRSMIEEHAFQVLSQGSLLESPSYTVCVSEPDKDDDFLSLNFPRKLWKIVESDQFKSISWDENGTCIVINEELFKKEILETKAPYRIFQTDAIKSFVRQLNLYGFSKIQQNFQRSAFLATFLSEEKESSVLSKLHVFVFHHSLFGATFGEHHFQPCPLPSGNKAPISTWSGDSWLL

SEQ ID NO: 37454 - protein, 214 aa, Homo sapiens; identical to SEQ ID NO: 37453
  Payload ID: 7440
  Gene Symbol: HSFY1
  Gene Name: heat shock transcription factor, Y-linked 1
  Uniprot ID: Q96LI6
  ENSP ID: ENSP00000372307

SEQ ID NO: 37455 - protein, 401 aa, Homo sapiens; identical to SEQ ID NO: 37451
  Payload ID: 7441
  Gene Symbol: HSFY2
  Gene Name: heat shock transcription factor, Y-linked 2
  Uniprot ID: Q96LI6
  ENSP ID: ENSP00000306549

SEQ ID NO: 37456 - protein, 203 aa, Homo sapiens; identical to SEQ ID NO: 37452
  Payload ID: 7441
  Gene Symbol: HSFY2
  Gene Name: heat shock transcription factor, Y-linked 2
  Uniprot ID: Q96LI6
  ENSP ID: ENSP00000340971

SEQ ID NO: 37457 - protein, 214 aa, Homo sapiens; identical to SEQ ID NO: 37453
  Payload ID: 7441
  Gene Symbol: HSFY2
  Gene Name: heat shock transcription factor, Y-linked 2
  Uniprot ID: Q96LI6
  ENSP ID: ENSP00000372303

SEQ ID NO: 37458 - protein, 137 aa, Homo sapiens
  Payload ID: 7442
  Gene Symbol: HRSP12
  Gene Name: heat-responsive protein 12
  Uniprot ID: P52758
  ENSP ID: ENSP00000254878
MSSLIRRVISTAKAPGAIGPYSQAVLVDRTIYISGQIGMDPSSGQLVSGGVAEEAKQALKNMGEILKAAGCDFTNVVKTTVLLADINDFNTVNEIYKQYFKSNFPARAAYQVAALPKGSRIEIEAVAIQGPLTTASL

SEQ ID NO: 37459 - protein, 148 aa, Homo sapiens
  Payload ID: 7442
  Gene Symbol: HRSP12
  Gene Name: heat-responsive protein 12
  ENSP ID: ENSP00000428596
  MOD_RES (1)..(1): Any amino acid
XGRLSHVVLDQKGDQHRESPRGHWTLQLSVYCSQAVLVDRTIYISGQIGMDPSSGQLVSGGVAEEAKQALKNMGEILKAAGCDFTNVVKTTVLLADINDFNTVNEIYKQYFKSNFPARAAYQVAALPKGSRIEIEAVAIQGPLTTASL

SEQ ID NO: 37460 - protein, 42 aa, Homo sapiens
  Payload ID: 7442
  Gene Symbol: HRSP12
  Gene Name: heat-responsive protein 12
  ENSP ID: ENSP00000429321
MSSLIRRVISTAKAPGAIGPYRTDRHGPFKWTACVRRGSRRS

SEQ ID NO: 37461 - protein, 127 aa, Homo sapiens
  Payload ID: 7442
  Gene Symbol: HRSP12
  Gene Name: heat-responsive protein 12
  ENSP ID: ENSP00000430482
  MOD_RES (1)..(1): Any amino acid
XSSKKPAGLVLGLLLLKGLQEGRLSHVVLDQKGDQHRESPRGHWTLQALKNMGEILKAAGCDFTNVVKTTVLLADINDFNTVNEIYKQYFKSNFPARAAYQVAALPKGSRIEIEAVAIQGPLTTASL

SEQ ID NO: 37462 - protein, 4834 aa, Homo sapiens
  Payload ID: 7443
  Gene Symbol: HERC2
  Gene Name: HECT and RLD domain containing E3 ubiquitin protein ligase 2
  Uniprot ID: O95714
  ENSP ID: ENSP00000261609
MPSESFCLAAQARLDSKWLKTDIQLAFTRDGLCGLWNEMVKDGEIVYTGTESTQNGELPPRKDDSVEPSGTKKEDLNDKEKKDEEETPAPIYRAKSILDSWVWGKQPDVNELKECLSVLVKEQQALAVQSATTTLSALRLKQRLVILERYFIALNRTVFQENVKVKWKSSGISLPPVDKKSSRPAGKGVEGLARVGSRAALSFAFAFLRRAWRSGEDADLCSELLQESLDALRALPEASLFDESTVSSVWLEVVERATRFLRSVVTGDVHGTPATKGPGSIPLQDQHLALAILLELAVQRGTLSQMLSAILLLLQLWDSGAQETDNERSAQGTSAPLLPLLQRFQSIICRKDAPHSEGDMHLLSGPLSPNESFLRYLTLPQDNELAIDLRQTAVVVMAHLDRLATPCMPPLCSSPTSHKGSLQEVIGWGLIGWKYYANVIGPIQCEGLANLGVTQIACAEKRFLILSRNGRVYTQAYNSDTLAPQLVQGLASRNIVKIAAHSDGHHYLALAATGEVYSWGCGDGGRLGHGDTVPLEEPKVISAFSGKQAGKHVVHIACGSTYSAAITAEGELYTWGRGNYGRLGHGSSEDEAIPMLVAGLKGLKVIDVACGSGDAQTLAVTENGQVWSWGDGDYGKLGRGGSDGCKTPKLIEKLQDLDVVKVRCGSQFSIALTKDGQVYSWGKGDNQRLGHGTEEHVRYPKLLEGLQGKKVIDVAAGSTHCLALTEDSEVHSWGSNDQCQHFDTLRVTKPEPAALPGLDTKHIVGIACGPAQSFAWSSCSEWSIGLRVPFVVDICSMTFEQLDLLLRQVSEGMDGSADWPPPQEKECVAVATLNLLRLQLHAAISHQVDPEFLGLGLGSILLNSLKQTVVTLASSAGVLSTVQSAAQAVLQSGWSVLLPTAEERARALSALLPCAVSGNEVNISPGRRFMIDLLVGSLMADGGLESALHAAITAEIQDIEAKKEAQKEKEIDEQEANASTFHRSRTPLDKDLINTGICESSGKQCLPLVQLIQQLLRNIASQTVARLKDVARRISSCLDFEQHSRERSASLDLLLRFQRLLISKLYPGESIGQTSDISSPELMGVGSLLKKYTALLCTHIGDILPVAASIASTSWRHFAEVAYIVEGDFTGVLLPELVVSIVLLLSKNAGLMQEAGAVPLLGGLLEHLDRFNHLAPGKERDDHEELAWPGIMESFFTGQNCRNNEEVTLIRKADLENHNKDGGFWTVIDGKVYDIKDFQTQSLTGNSILAQFAGEDPVVALEAALQFEDTRESMHAFCVGQYLEPDQEIVTIPDLGSLSSPLIDTERNLGLLLGLHASYLAMSTPLSPVEIECAKWLQSSIFSGGLQTSQIHYSYNEEKDEDHCSSPGGTPASKSRLCSHRRALGDHSQAFLQAIADNNIQDHNVKDFLCQIERYCRQCHLTTPIMFPPEHPVEEVGRLLLCCLLKHEDLGHVALSLVHAGALGIEQVKHRTLPKSVVDVCRVVYQAKCSLIKTHQEQGRSYKEVCAPVIERLRFLFNELRPAVCNDLSIMSKFKLLSSLPRWRRIAQKIIRERRKKRVPKKPESTDDEEKIGNEESDLEEACILPHSPINVDKRPIAIKSPKDKWQPLLSTVTGVHKYKWLKQNVQGLYPQSPLLSTIAEFALKEEPVDVEKMRKCLLKQLERAEVRLEGIDTILKLASKNFLLPSVQYAMFCGWQRLIPEGIDIGEPLTDCLKDVDLIPPFNRMLLEVTFGKLYAWAVQNIRNVLMDASAKFKELGIQPVPLQTITNENPSGPSLGTIPQARFLLVMLSMLTLQHGANNLDLLLNSGMLALTQTALRLIGPSCDNVEEDMNASAQGASATVLEETRKETAPVQLPVSGPELAAMMKIGTRVMRGVDWKWGDQDGPPPGLGRVIGELGEDGWIRVQWDTGSTNSYRMGKEGKYDLKLAELPAAAQPSAEDSDTEDDSEAEQTERNIHPTAMMFTSTINLLQTLCLSAGVHAEIMQSEATKTLCGLLRMLVESGTTDKTSSPNRLVYREQHRSWCTLGFVRSIALTPQVCGALSSPQWITLLMKVVEGHAPFTATSLQRQILAVHLLQAVLPSWDKTERARDMKCLVEKLFDFLGSLLTTCSSDVPLLRESTLRRRRVRPQASLTATHSSTLAEEVVALLRTLHSLTQWNGLINKYINSQLRSITHSFVGRPSEGAQLEDYFPDSENPEVGGLMAVLAVIGGIDGRLRLGGQVMHDEFGEGTVTRITPKGKITVQFSDMRTCRVCPLNQLKPLPAVAFNVNNLPFTEPMLSVWAQLVNLAGSKLEKHKIKKSTKQAFAGQVDLDLLRCQQLKLYILKAGRALLSHQDKLRQILSQPAVQETGTVHTDDGAVVSPDLGDMSPEGPQPPMILLQQLLASATQPSPVKAIFDKQELEAAALAVCQCLAVESTHPSSPGFEDCSSSEATTPVAVQHIRPARVKRRKQSPVPALPIVVQLMEMGFSRRNIEFALKSLTGASGNASSLPGVEALVGWLLDHSDIQVTELSDADTVSDEYSDEEVVEDVDDAAYSMSTGAVVTESQTYKKRADFLSNDDYAVYVRENIQVGMMVRCCRAYEEVCEGDVGKVIKLDRDGLHDLNVQCDWQQKGGTYWVRYIHVELIGYPPPSSSSHIKIGDKVRVKASVTTPKYKWGSVTHQSVGVVKAFSANGKDIIVDFPQQSHWTGLLSEMELVPSIHPGVTCDGCQMFPINGSRFKCRNCDDFDFCETCFKTKKHNTRHTFGRINEPGQSAVFCGRSGKQLKRCHSSQPGMLLDSWSRMVKSLNVSSSVNQASRLIDGSEPCWQSSGSQGKHWIRLEIFPDVLVHRLKMIVDPADSSYMPSLVVVSGGNSLNNLIELKTININPSDTTVPLLNDCTEYHRYIEIAIKQCRSSGIDCKIHGLILLGRIRAEEEDLAAVPFLASDNEEEEDEKGNSGSLIRKKAAGLESAATIRTKVFVWGLNDKDQLGGLKGSKIKVPSFSETLSALNVVQVAGGSKSLFAVTVEGKVYACGEATNGRLGLGISSGTVPIPRQITALSSYVVKKVAVHSGGRHATALTVDGKVFSWGEGDDGKLGHFSRMNCDKPRLIEALKTKRIRDIACGSSHSAALTSSGELYTWGLGEYGRLGHGDNTTQLKPKMVKVLLGHRVIQVACGSRDAQTLALTDEGLVFSWGDGDFGKLGRGGSEGCNIPQNIERLNGQGVCQIECGAQFSLALTKSGVVWTWGKGDYFRLGHGSDVHVRKPQVVEGLRGKKIVHVAVGALHCLAVTDSGQVYAWGDNDHGQQGNGTTTVNRKPTLVQGLEGQKITRVACGSSHSVAWTTVDVATPSVHEPVLFQTARDPLGASYLGVPSDADSSAASNKISGASNSKPNRPSLAKILLSLDGNLAKQQALSHILTALQIMYARDAVVGALMPAAMIAPVECPSFSSAAPSDASAMASPMNGEECMLAVDIEDRLSPNPWQEKREIVSSEDAVTPSAVTPSAPSASARPFIPVTDDLGAASIIAETMTKTKEDVESQNKAAGPEPQALDEFTSLLIADDTRVVVDLLKLSVCSRAGDRGRDVLSAVLSGMGTAYPQVADMLLELCVTELEDVATDSQSGRLSSQPVVVESSHPYTDDTSTSGTVKIPGAEGLRVEFDRQCSTERRHDPLTVMDGVNRIVSVRSGREWSDWSSELRIPGDELKWKFISDGSVNGWGWRFTVYPIMPAAGPKELLSDRCVLSCPSMDLVTCLLDFRLNLASNRSIVPRLAASLAACAQLSALAASHRMWALQRLRKLLTTEFGQSININRLLGENDGETRALSFTGSALAALVKGLPEALQRQFEYEDPIVRGGKQLLHSPFFKVLVALACDLELDTLPCCAETHKWAWFRRYCMASRVAVALDKRTPLPRLFLDEVAKKIRELMADSENMDVLHESHDIFKREQDEQLVQWMNRRPDDWTLSAGGSGTIYGWGHNHRGQLGGIEGAKVKVPTPCEALATLRPVQLIGGEQTLFAVTADGKLYATGYGAGGRLGIGGTESVSTPTLLESIQHVFIKKVAVNSGGKHCLALSSEGEVYSWGEAEDGKLGHGNRSPCDRPRVIESLRGIEVVDVAAGGAHSACVTAAGDLYTWGKGRYGRLGHSDSEDQLKPKLVEALQGHRVVDIACGSGDAQTLCLTDDDTVWSWGDGDYGKLGRGGSDGCKVPMKIDSLTGLGVVKVECGSQFSVALTKSGAVYTWGKGDYHRLGHGSDDHVRRPRQVQGLQGKKVIAIATGSLHCVCCTEDGEVYTWGDNDEGQLGDGTTNAIQRPRLVAALQGKKVNRVACGSAHTLAWSTSKPASAGKLPAQVPMEYNHLQEIPIIALRNRLLLLHHLSELFCPCIPMFDLEGSLDETGLGPSVGFDTLRGILISQGKEAAFRKVVQATMVRDRQHGPVVELNRIQVKRSRSKGGLAGPDGTKSVFGQMCAKMSSFGPDSLLLPHRVWKVKFVGESVDDCGGGYSESIAEICEELQNGLTPLLIVTPNGRDESGANRDCYLLSPAARAPVHSSMFRFLGVLLGIAIRTGSPLSLNLAEPVWKQLAGMSLTIADLSEVDKDFIPGLMYIRDNEATSEEFEAMSLPFTVPSASGQDIQLSSKHTHITLDNRAEYVRLAINYRLHEFDEQVAAVREGMARVVPVPLLSLFTGYELETMVCGSPDIPLHLLKSVATYKGIEPSASLIQWFWEVMESFSNTERSLFLRFVWGRTRLPRTIADFRGRDFVIQVLDKYNPPDHFLPESYTCFFLLKLPRYSCKQVLEEKLKYAIHFCKSIDTDDYARIALTGEPAADDSSDDSDNEDVDSFASDSTQDYLTGH

SEQ ID NO: 37463 - protein, 80 aa, Homo sapiens
  Payload ID: 7443
  Gene Symbol: HERC2
  Gene Name: HECT and RLD domain containing E3 ubiquitin protein ligase 2
  ENSP ID: ENSP00000456237
MPSESFCLAAQARLDSKWLKTDIQLAFTRDGLCGLWNEMVKDGEIVYTGTESTQNGELPPRKVETGFHRVSQDGLELLTS

SEQ ID NO: 37464 - protein, 200 aa, Homo sapiens
  Payload ID: 7443
  Gene Symbol: HERC2
  Gene Name: HECT and RLD domain containing E3 ubiquitin protein ligase 2
  ENSP ID: ENSP00000457745
  MOD_RES (1)..(1): Any amino acid
XRDPLGASYLGVPSDADSSAASNKISGASNSKPNRPSLAKILLSLDGNLAKQQALSHILTALQIMYARDAVVGALMPAAMIAPVECPSFSSAAPSDASAMASPMNGEECMLAVDIEDRLSPNPWQEKREIVSSEDAVTPSAVTPSAPSASARPFIPVTDDLGAASIIAETMTKTKEVADMLLELCVTELEDVATDSQSGR

SEQ ID NO: 37465 - protein, 24 aa, Homo sapiens
  Payload ID: 7443
  Gene Symbol: HERC2
  Gene Name: HECT and RLD domain containing E3 ubiquitin protein ligase 2
  ENSP ID: ENSP00000477508
MPSESFCLAAQARLDSKWLKTDIQ

SEQ ID NO: 37466 - protein, 523 aa, Homo sapiens
  Payload ID: 7443
  Gene Symbol: HERC2
  Gene Name: HECT and RLD domain containing E3 ubiquitin protein ligase 2
  ENSP ID: ENSP00000484177
MVRARVVLPGRSCGRGGGVCRVGRCVCSDTLVLGAAGHITGDMPNGVRQRSRVSTVERPRWQGLPGVHTSRCVTREGPMHGASSSCIRQCRISPTVCFLLRQRPHACLLPPLQVKRSRSKGGLAGPDGTKSVFGQMCAKMSSFGPDSLLLPHRVWKVKFVGESVDDCGGGYSESIAEICEELQNGLTPLLIVTPNGRDESGANRDCYLLSPAARAPVHSSMFRFLGVLLGIAIRTGSPLSLNLAEPVWKQLAGMSLTIADLSEVDKDFIPGLMYIRDNEATSEEFEAMSLPFTVPSASGQDIQLSSKHTHITLDNRAEYVRLAINYRLHEFDEQVAAVREGMARVVPVPLLSLFTGYELETMVCGSPDIPLHLLKSVATYKGIEPSASLIQWFWEVMESFSNTERSLFLRFVWGRTRLPRTIADFRGRDFVIQVLDKYNPPDHFLPESYTCFFLLKLPRYSCKQVLEEKLKYAIHFCKSIDTDDYARIALTGEPAADDSSDDSDNEDVDSFASDSTQDYLTGH

SEQ ID NO: 37467 - protein, 2081 aa, Homo sapiens
  Payload ID: 7443
  Gene Symbol: HERC2
  Gene Name: HECT and RLD domain containing E3 ubiquitin protein ligase 2
  ENSP ID: ENSP00000487606
  MOD_RES (1)..(1): Any amino acid
XQSAVFCGRSGKQLKRCHSSQPGMLLDSWSRMVKSLNVSSSVNQASRLIDGSEPCWQSSGSQGKHWIRLEIFPDVLVHRLKMIVDPADSSYMPSLVVVSGGNSLNNLIELKTININPSDTTVPLLNDCTEYHRYIEIAIKQCRSSGIDCKIHGLILLGRIRAEEEDLAAVPFLASDNEEEEDEKGNSGSLIRKKAAGLESAATIRTKVFVWGLNDKDQLGGLKGSKIKVPSFSETLSALNVVQVAGGSKSLFAVTVEGKVYACGEATNGRLGLGISSGTVPIPRQITALSSYVVKKVAVHSGGRHATALTVDGKVFSWGEGDDGKLGHFSRMNCDKPRLIEALKTKRIRDIACGSSHSAALTSSGELYTWGLGEYGRLGHGDNTTQLKPKMVKVLLGHRVIQVACGSRDAQTLALTDEGLVFSWGDGDFGKLGRGGSEGCNIPQNIERLNGQGVCQIECGAQFSLALTKSGVVWTWGKGDYFRLGHGSDVHVRKPQVVEGLRGKKIVHVAVGALHCLAVTDSGQVYAWGDNDHGQQGNGTTTVNRKPTLVQGLEGQKITRVACGSSHSVAWTTVDVATPSVHEPVLFQTARDPLGASYLGVPSDADSSAASNKISGASNSKPNRPSLAKILLSLDGNLAKQQALSHILTALQIMYARDAVVGALMPAAMIAPVECPSFSSAAPSDASAMASPMNGEECMLAVDIEDRLSPNPWQEKREIVSSEDAVTPSAVTPSAPSASARPFIPVTDDLGAASIIAETMTKTKEDVESQNKAAGPEPQALDEFTSLLIADDTRVVVDLLKLSVCSRAGDRGRDVLSAVLSGMGTAYPQVADMLLELCVTELEDVATDSQSGRLSSQPVVVESSHPYTDDTSTSGTVKIPGAEGLRVEFDRQCSTERRHDPLTVMDGVNRIVSVRSGREWSDWSSELRIPGDELKWKFISDGSVNGWGWRFTVYPIMPAAGPKELLSDRCVLSCPSMDLVTCLLDFRLNLASNRSIVPRLAASLAACAQLSALAASHRMWALQRLRKLLTTEFGQSININRLLGENDGETRALSFTGSALAALVKGLPEALQRQFEYEDPIVRGGKQLLHSPFFKVLVALACDLELDTLPCCAETHKWAWFRRYCMASRVAVALDKRTPLPRLFLDEVAKKIRELMADSENMDVLHESHDIFKREQDEQLVQWMNRRPDDWTLSAGGSGTIYGWGHNHRGQLGGIEGAKVKVPTPCEALATLRPVQLIGGEQTLFAVTADGKLYATGYGAGGRLGIGGTESVSTPTLLESIQHVFIKKVAVNSGGKHCLALSSEGEVYSWGEAEDGKLGHGNRSPCDRPRVIESLRGIEVVDVAAGGAHSACVTAAGDLYTWGKGRYGRLGHSDSEDQLKPKLVEALQGHRVVDIACGSGDAQTLCLTDDDTVWSWGDGDYGKLGRGGSDGCKVPMKIDSLTGLGVVKVECGSQFSVALTKSGAVYTWGKGDYHRLGHGSDDHVRRPRQVQGLQGKKVIAIATGSLHCVCCTEDGEVYTWGDNDEGQLGDGTTNAIQRPRLVAALQGKKVNRVACGSAHTLAWSTSKPASAGKLPAQVPMEYNHLQEIPIIALRNRLLLLHHLSELFCPCIPMFDLEGSLDETGLGPSVGFDTLRGILISQGKEAAFRKVVQATMVRDRQHGPVVELNRIQVKRSRSKGGLAGPDGTKSVFGQMCAKMSSFGPDSLLLPHRVWKVKFVGESVDDCGGGYSESIAEICEELQNGLTPLLIVTPNGRDESGANRDCYLLSPAARAPVHSSMFRFLGVLLGIAIRTGSPLSLNLAEPVWKQLAGMSLTIADLSEVDKDFIPGLMYIRDNEATSEEFEAMSLPFTVPSASGQDIQLSSKHTHITLDNRAEYVRLAINYRLHEFDEQVAAVREGMARVVPVPLLSLFTGYELETMVCGSPDIPLHLLKSVATYKGIEPSASLIQWFWEVMESFSNTERSLFLRFVWGRTRLPRTIADFRGRDFVIQVLDKYNPPDHFLPESYTCFFLLKLPRYSCKQVLEEKLKYAIHFCKSIDTDDYARIALTGEPAADDSSDDSDNEDVDSFASDSTQDYLTGH

SEQ ID NO: 37468 - protein, 959 aa, Homo sapiens
  Payload ID: 7443
  Gene Symbol: HERC2
  Gene Name: HECT and RLD domain containing E3 ubiquitin protein ligase 2
  ENSP ID: ENSP00000488506
MPSESFCLAAQARLDSKWLKTDIQLAFTRDGLCGLWNEMVKDGEIVYTGTESTQNGELPPRKDDSVEPSGTKKEDLNDKEKKDEEETPAPIYRAKSILDSWVWGKQPDVNELKECLSVLVKEQQALAVQSATTTLSALRLKQRLVILERYFIALNRTVFQENVKVKWKSSGISLPPVDKKSSRPAGKGVEGLARVGSRAALSFAFAFLRRAWRSGEDADLCSELLQESLDALRALPEASLFDESTVSSVWLEVVERATRFLRSVVTGDVHGTPATKGPGSIPLQDQHLALAILLELAVQRGTLSQMLSAILLLLQLWDSGAQETDNERSAQGTSAPLLPLLQRFQSIICRKDAPHSEGDMHLLSGPLSPNESFLRYLTLPQDNELAIDLRQTAVVVMAHLDRLATPCMPPLCSSPTSHKGSLQEVIGWGLIGWKYYANVIGPIQCEGLANLGVTQIACAEKRFLILSRNGRVYTQAYNSDTLAPQLVQGLASRNIVKIAAHSDGHHYLALAATGEVYSWGCGDGGRLGHGDTVPLEEPKVISAFSGKQAGKHVVHIACGSTYSAAITAEGELYTWGRGNYGRLGHGSSEDEAIPMLVAGLKGLKVIDVACGSGDAQTLAVTENGQVWSWGDGDYGKLGRGGSDGCKTPKLIEKLQDLDVVKVRCGSQFSIALTKDGQVYSWGKGDNQRLGHGTEEHVRYPKLLEGLQGKKVIDVAAGSTHCLALTEDSEVHSWGSNDQCQHFDTLRVTKPEPAALPGLDTKHIVGIACGPAQSFAWSSCSEWSIGLRVPFVVDICSMTFEQLDLLLRQVSEGMDGSADWPPPQEKECVAVATLNLLRLQLHAAISHQVDPEFLGLGLGSILLNSLKQTVVTLASSAGVLSTVQSAAQAVLQSGWSVLLPTAEERARALSALLPCAVSGNEVNISPGRRFMIDLLVGSLMADGGLESALHAAITAEIQVW

SEQ ID NO: 37469 - protein, 24 aa, Homo sapiens
  Payload ID: 7443
  Gene Symbol: HERC2
  Gene Name: HECT and RLD domain containing E3 ubiquitin protein ligase 2
  ENSP ID: ENSP00000488879
MPSESFCLAAQARLDSKWLKTDIQ

SEQ ID NO: 37470 - protein, 1050 aa, Homo sapiens
  Payload ID: 7444
  Gene Symbol: HERC3
  Gene Name: HECT and RLD domain containing E3 ubiquitin protein ligase 3
  Uniprot ID: Q15034
  ENSP ID: ENSP00000264345
MLCWGYWSLGQPGISTNLQGIVAEPQVCGFISDRSVKEVACGGNHSVFLLEDGEVYTCGLNTKGQLGHEREGNKPEQIGALADQHIIHVACGESHSLALSDRGQLFSWGAGSDGQLGLMTTEDSVAVPRLIQKLNQQTILQVSCGNWHCLALAADGQFFTWGKNSHGQLGLGKEFPSQASPQRVRSLEGIPLAQVAAGGAHSFALSLSGAVFGWGMNNAGQLGLSDEKDRESPCHVKLLRTQKVVYISCGEEHTAVLTKSGGVFTFGAGSCGQLGHDSMNDEVNPRRVLELMGSEVTQIACGRQHTLAFVPSSGLIYAFGCGARGQLGTGHTCNVKCPSPVKGYWAAHSGQLSARADRFKYHIVKQIFSGGDQTFVLCSKYENYSPAVDFRTMNQAHYTSLINDETIAVWRQKLSEHNNANTINGVVQILSSAACWNGSFLEKKIDEHFKTSPKIPGIDLNSTRVLFEKLMNSQHSMILEQILNSFESCLIPQLSSSPPDVEAMRIYLILPEFPLLQDSKYYITLTIPLAMAILRLDTNPSKVLDNWWSQVCPKYFMKLVNLYKGAVLYLLRGRKTFLIPVLFNNYITAALKLLEKLYKVNLKVKHVEYDTFYIPEISNLVDIQEDYLMWFLHQAGMKARPSIIQDTVTLCSYPFIFDAQAKTKMLQTDAELQMQVAVNGANLQNVFMLLTLEPLLARSPFLVLHVRRNNLVGDALRELSIHSDIDLKKPLKVIFDGEEAVDAGGVTKEFFLLLLKELLNPIYGMFTYYQDSNLLWFSDTCFVEHNWFHLIGITCGLAIYNSTVVDLHFPLALYKKLLNVKPGLEDLKELSPTEGRSLQELLDYPGEDVEETFCLNFTICRESYGVIEQKKLIPGGDNVTVCKDNRQEFVDAYVNYVFQISVHEWYTAFSSGFLKVCGGKVLELFQPSELRAMMVGNSNYNWEELEETAIYKGDYSATHPTVKLFWETFHEFPLEKKKKFLLFLTGSDRIPIYGMASLQIVIQSTASGEEYLPVAHTCYNLLDLPKYSSKEILSARLTQALDNYEGFSLA

SEQ ID NO: 37471 - protein, 368 aa, Homo sapiens
  Payload ID: 7444
  Gene Symbol: HERC3
  Gene Name: HECT and RLD domain containing E3 ubiquitin protein ligase 3
  Uniprot ID: Q15034
  ENSP ID: ENSP00000384005
MLCWGYWSLGQPGISTNLQGIVAEPQVCGFISDRSVKEVACGGNHSVFLLEDGEVYTCGLNTKGQLGHEREGNKPEQIGALADQHIIHVACGESHSLALSDRGQLFSWGAGSDGQLGLMTTEDSVAVPRLIQKLNQQTILQVSCGNWHCLALAADGQFFTWGKNSHGQLGLGKEFPSQASPQRVRSLEGIPLAQVAAGGAHSFALSLSGAVFGWGMNNAGQLGLSDEKDRESPCHVKLLRTQKVVYISCGEEHTAVLTKSGGVFTFGAGSCGQLGHDSMNDEVNPRRVLELMGSEVTQIACGRQHTLAFVPSSGLIYAFGCGARGQLGTGHTCNVKCPSPVKGYWAAHSGQLSARAGKNDCLWNLKVF

SEQ ID NO: 37472 - protein, 1050 aa, Homo sapiens; identical to SEQ ID NO: 37470
  Payload ID: 7444
  Gene Symbol: HERC3
  Gene Name: HECT and RLD domain containing E3 ubiquitin protein ligase 3
  Uniprot ID: Q15034
  ENSP ID: ENSP00000385684

SEQ ID NO: 37473 - protein, 128 aa, Homo sapiens
  Payload ID: 7444
  Gene Symbol: HERC3
  Gene Name: HECT and RLD domain containing E3 ubiquitin protein ligase 3
  ENSP ID: ENSP00000389991
MLCWGYWSLGQPGISTNLQGIVAEPQVCGFISDRSVKEVACGGNHSVFLLEDGEVYTCGLNTKGQLGHEREGNKPEQIGALADQHIIHVACGESHSLALSDRGQLFSWGAGSDGQLGLMTTEDSVAVP

SEQ ID NO: 37474 - protein, 131 aa, Homo sapiens
  Payload ID: 7444
  Gene Symbol: HERC3
  Gene Name: HECT and RLD domain containing E3 ubiquitin protein ligase 3
  ENSP ID: ENSP00000405863
MLCWGYWSLGQPGISTNLQGIVAEPQVCGFISDRSVKEVACGGNHSVFLLEDGEVYTCGLNTKGQLGHEREGNKPEQIGALADQHIIHVACGESHSLALSDRGQLFSWGAGSDGQLGLMTTEDSVAVPRLI

SEQ ID NO: 37475 - protein, 227 aa, Homo sapiens
  Payload ID: 7444
  Gene Symbol: HERC3
  Gene Name: HECT and RLD domain containing E3 ubiquitin protein ligase 3
  ENSP ID: ENSP00000406210
MLCWGYWSLGQPGISTNLQGIVAEPQVCGFISDRSVKEVACGGNHSVFLLEDGEVYTCGLNTKGQLGHEREGNKPEQIGALADQHIIHVACGESHSLALSDRGQLFSWGAGSDGQLGLMTTEDSVAVPRLIQKLNQQTILQVSCGNWHCLALAADGQFFTWGKNSHGQLGLGKEFPSQASPQRVRSLEGIPLAQVAAGGAHSFALSLSGAVFGWGMNNAGQLGLSDE

SEQ ID NO: 37476 - protein, 94 aa, Homo sapiens
  Payload ID: 7444
  Gene Symbol: HERC3
  Gene Name: HECT and RLD domain containing E3 ubiquitin protein ligase 3
  ENSP ID: ENSP00000410029
MLCWGYWSLGQPGISTNLQGIVAEPQVCGFISDRSVKEVACGGNHSVFLLEDGEVYTCGLNTKGQLGHEREGNKPEQIGALADQHIIHVACGES

SEQ ID NO: 37477 - protein, 278 aa, Homo sapiens
  Payload ID: 7444
  Gene Symbol: HERC3
  Gene Name: HECT and RLD domain containing E3 ubiquitin protein ligase 3
  ENSP ID: ENSP00000421021
VNLKVKHVEYDTFYIPEISNLVDIQEDYLMWFLHQAGMDTVTLCSYPFIFDAQAKTKMLQTDAELQMQVAVNGANLQNVFMLLTLEPLLARSPFLVLHVRRNNLVGDALRELSIHSDIDLKKPLKVIFDGEEAVDAGGVTKEFFLLLLKELLNPIYGMFTYYQDSNLLWFSDTCFVEHNWFHLIGITCGLAIYNSTVVDLHFPLALYKKLLNVKPGLEDLKELSPTEGRSLQELLDYPGEDVEETFCLNFTICRESYGVIEQKKLIPGGDNVTVCKDN

SEQ ID NO: 37478 - protein, 78 aa, Homo sapiens
  Payload ID: 7444
  Gene Symbol: HERC3
  Gene Name: HECT and RLD domain containing E3 ubiquitin protein ligase 3
  ENSP ID: ENSP00000424786
MLCWGYWSLGQPGISTNLQGIVAEPQVCGFISDRSVKEVACGGNHSVFLLEDGEVYTCGLNTKGQLGHEREGNKPEQI

SEQ ID NO: 37479 - protein, 947 aa, Homo sapiens
  Payload ID: 7445
  Gene Symbol: HERC4
  Gene Name: HECT and RLD domain containing E3 ubiquitin protein ligase 4
  Uniprot ID: Q5GLZ8
  ENSP ID: ENSP00000277817
MCVDSLVRICSGLSYGRIRNIKSLSDIQIVQVACGYYHSLALSKASEVFCWGQNKYGQLGLGTDCKKQTSPQLLKSLLGIPFMQVAAGGAHSFVLTLSGAIFGWGRNKFGQLGLNDENDRYVPNLLKSLRSQKIVYICCGEDHTAALTKEGGVFTFGAGGYGQLGHNSTSHEINPRKVFELMGSIVTEIACGRQHTSAFVPSSGRIYSFGLGGNGQLGTGSTSNRKSPFTVKGNWYPYNGQCLPDIDSEEYFCVKRIFSGGDQSFSHYSSPQNCGPPDDFRCPNPTKQIWTVNEALIQKWLSYPSGRFPVEIANEIDGTFSSSGCLNGSFLAVSNDDHYRTGTRFSGVDMNAARLLFHKLIQPDHPQISQQVAASLEKNLIPKLTSSLPDVEALRFYLTLPECPLMSDSNNFTTIAIPFGTALVNLEKAPLKVLENWWSVLEPPLFLKIVELFKEVVVHLLKLYKIGIPPSERRIFNSFLHTALKVLEILHRVNEKMGQIIQYDKFYIHEVQELIDIRNDYINWVQQQAYGMDVNHGLTELADIPVTICTYPFVFDAQAKTTLLQTDAVLQMQMAIDQAHRQNVSSLFLPVIESVNPCLILVVRRENIVGDAMEVLRKTKNIDYKKPLKVIFVGEDAVDAGGVRKEFFLLIMRELLDPKYGMFRYYEDSRLIWFSDKTFEDSDLFHLIGVICGLAIYNCTIVDLHFPLALYKKLLKKKPSLDDLKELMPDVGRSMQQLLDYPEDDIEETFCLNFTITVENFGATEVKELVLNGADTAVNKQNRQEFVDAYVDYIFNKSVASLFDAFHAGFHKVCGGKVLLLFQPNELQAMVIGNTNYDWKELEKNTEYKGEYWAEHPTIKIFWEVFHELPLEKKKQFLLFLTGSDRIPILGMKSLKLVIQSTGGGEEYLPVSHTCFNLLDLPKYTEKETLRSKLIQAIDHNEGFSLI

SEQ ID NO: 37480 - protein, 1049 aa, Homo sapiens
  Payload ID: 7445
  Gene Symbol: HERC4
  Gene Name: HECT and RLD domain containing E3 ubiquitin protein ligase 4
  Uniprot ID: Q5GLZ8
  ENSP ID: ENSP00000362804
MLCWGNASFGQLGLGGIDEEIVLEPRKSDFFINKRVRDVGCGLRHTVFVLDDGTVYTCGCNDLGQLGHEKSRKKPEQVVALDAQNIVAVSCGEAHTLALNDKGQVYAWGLDSDGQLGLVGSEECIRVPRNIKSLSDIQIVQVACGYYHSLALSKASEVFCWGQNKYGQLGLGTDCKKQTSPQLLKSLLGIPFMQVAAGGAHSFVLTLSGAIFGWGRNKFGQLGLNDENDRYVPNLLKSLRSQKIVYICCGEDHTAALTKEGGVFTFGAGGYGQLGHNSTSHEINPRKVFELMGSIVTEIACGRQHTSAFVPSSGRIYSFGLGGNGQLGTGSTSNRKSPFTVKGNWYPYNGQCLPDIDSEEYFCVKRIFSGGDQSFSHYSSPQNCGPPDDFRCPNPTKQIWTVNEALIQKWLSYPSGRFPVEIANEIDGTFSSSGCLNGSFLAVSNDDHYRTGTRFSGVDMNAARLLFHKLIQPDHPQISQQVAASLEKNLIPKLTSSLPDVEALRFYLTLPECPLMSDSNNFTTIAIPFGTALVNLEKAPLKVLENWWSVLEPPLFLKIVELFKEVVVHLLKLYKIGIPPSERRIFNSFLHTALKVLEILHRVNEKMGQIIQYDKFYIHEVQELIDIRNDYINWVQQQAYGMLADIPVTICTYPFVFDAQAKTTLLQTDAVLQMQMAIDQAHRQNVSSLFLPVIESVNPCLILVVRRENIVGDAMEVLRKTKNIDYKKPLKVIFVGEDAVDAGGVRKEFFLLIMRELLDPKYGMFRYYEDSRLIWFSDKTFEDSDLFHLIGVICGLAIYNCTIVDLHFPLALYKKLLKKKPSLDDLKELMPDVGRSMQQLLDYPEDDIEETFCLNFTITVENFGATEVKELVLNGADTAVNKQNRQEFVDAYVDYIFNKSVASLFDAFHAGFHKVCGGKVLLLFQPNELQAMVIGNTNYDWKELEKNTEYKGEYWAEHPTIKIFWEVFHELPLEKKKQFLLFLTGSDRIPILGMKSLKLVIQSTGGGEEYLPVSHTCFNLLDLPKYTEKETLRSKLIQAIDHNEGFSLI

SEQ ID NO: 37481 - protein, 1057 aa, Homo sapiens
  Payload ID: 7445
  Gene Symbol: HERC4
  Gene Name: HECT and RLD domain containing E3 ubiquitin protein ligase 4
  Uniprot ID: Q5GLZ8
  ENSP ID: ENSP00000378624
MLCWGNASFGQLGLGGIDEEIVLEPRKSDFFINKRVRDVGCGLRHTVFVLDDGTVYTCGCNDLGQLGHEKSRKKPEQVVALDAQNIVAVSCGEAHTLALNDKGQVYAWGLDSDGQLGLVGSEECIRVPRNIKSLSDIQIVQVACGYYHSLALSKASEVFCWGQNKYGQLGLGTDCKKQTSPQLLKSLLGIPFMQVAAGGAHSFVLTLSGAIFGWGRNKFGQLGLNDENDRYVPNLLKSLRSQKIVYICCGEDHTAALTKEGGVFTFGAGGYGQLGHNSTSHEINPRKVFELMGSIVTEIACGRQHTSAFVPSSGRIYSFGLGGNGQLGTGSTSNRKSPFTVKGNWYPYNGQCLPDIDSEEYFCVKRIFSGGDQSFSHYSSPQNCGPPDDFRCPNPTKQIWTVNEALIQKWLSYPSGRFPVEIANEIDGTFSSSGCLNGSFLAVSNDDHYRTGTRFSGVDMNAARLLFHKLIQPDHPQISQQVAASLEKNLIPKLTSSLPDVEALRFYLTLPECPLMSDSNNFTTIAIPFGTALVNLEKAPLKVLENWWSVLEPPLFLKIVELFKEVVVHLLKLYKIGIPPSERRIFNSFLHTALKVLEILHRVNEKMGQIIQYDKFYIHEVQELIDIRNDYINWVQQQAYGMDVNHGLTELADIPVTICTYPFVFDAQAKTTLLQTDAVLQMQMAIDQAHRQNVSSLFLPVIESVNPCLILVVRRENIVGDAMEVLRKTKNIDYKKPLKVIFVGEDAVDAGGVRKEFFLLIMRELLDPKYGMFRYYEDSRLIWFSDKTFEDSDLFHLIGVICGLAIYNCTIVDLHFPLALYKKLLKKKPSLDDLKELMPDVGRSMQQLLDYPEDDIEETFCLNFTITVENFGATEVKELVLNGADTAVNKQNRQEFVDAYVDYIFNKSVASLFDAFHAGFHKVCGGKVLLLFQPNELQAMVIGNTNYDWKELEKNTEYKGEYWAEHPTIKIFWEVFHELPLEKKKQFLLFLTGSDRIPILGMKSLKLVIQSTGGGEEYLPVSHTCFNLLDLPKYTEKETLRSKLIQAIDHNEGFSLI

SEQ ID NO: 37482 - protein, 399 aa, Homo sapiens
  Payload ID: 7445
  Gene Symbol: HERC4
  Gene Name: HECT and RLD domain containing E3 ubiquitin protein ligase 4
  ENSP ID: ENSP00000406171
  MOD_RES (1)..(1): Any amino acid
XGNASFGQLGLGGIDEEIVLEPRKSDFFINKRVRDVGCGLRHTVFVLDDGTVYTCGCNDLGQLGHEKSRKKPEQVVALDAQNIVAVSCGEAHTLALNDKGQVYAWGLDSDGQLGLVGSEECIRVPRNIKSLSDIQIVQVACGYYHSLALSKASEVFCWGQNKYGQLGLGTDCKKQTSPQLLKSLLGIPFMQVAAGGAHSFVLTLSGAIFGWGRNKFGQLGLNDENDRYVPNLLKSLRSQKIVYICCGEDHTAALTKEGGVFTFGAGGYGQLGHNSTSHEINPRKVFELMGSIVTEIACGRQHTSAFVPSSGRIYSFGLGGNGQLGTGSTSNRKSPFTVKGNWYPYNGQCLPDIEARSCHVVQAGLELLGSSDPPTLASQSAGITVNEHQCLLPPQKRTQ

SEQ ID NO: 37483 - protein, 979 aa, Homo sapiens
  Payload ID: 7445
  Gene Symbol: HERC4
  Gene Name: HECT and RLD domain containing E3 ubiquitin protein ligase 4
  Uniprot ID: Q5GLZ8
  ENSP ID: ENSP00000416504
MLCWGNASFGQLGLGGIDEEIVLEPRKSDFFINKRVRDVGCGLRHTVFVLDDGTVYTCGCNDLGQLGHEKSRKKPEQVVALDAQNIVAVSCGEAHTLALNDKGQVYAWGLDSDGQLGLVGSEECIRVPRNIKSLSDIQIVQVACGYYHSLALSKASEVFCWGQNKYGQLGLGTDCKKQTSPQLLKSLLGIPFMQVAAGGAHSFVLTLSGAIFGWGRNKFGQLGLNDENDRYVPNLLKSLRSQKIVYICCGEDHTAALTKEGGVFTFGAGGYGQLGHNSTSHEINPRKVFELMGSIVTEIACGRQHTSAFVPSSGRIYSFGLGGNGQLGTGSTSNRKSPFTVKGNWYPYNGQCLPDIDSEEYFCVKRIFSGGDQSFSHYSSPQNCGPPDDFRCPNPTKQIWTVNEALIQKWLSYPSGRFPVEIANEIDGTFSSSGCLNGSFLAVSNDDHYRTGTRFSGVDMNAARLLFHKLIQPDHPQISQQVAASLEKNLIPKLTSSLPDVEALRFYLTLPECPLMSDSNNFTTIAIPFGTALVNLEKAPLKVLENWWSVLEPPLFLKIVELFKEVVVHLLKLYKIGIPPSERRIFNSFLHTALKVLEILHRVNEKMGQIIQYDKFYIHEVQELIDIRNDYINWVQQQAYGMDVNHGLTELADIPVTICTYPFVFDAQAKTTLLQTDAVLQMQMAIDQAHRQNVSSLFLPVIESVNPCLILVVRRENIVGDAMEVLRKTKNIDYKKPLKVIFVGEDAVDAGGVRKEFFLLIMRELLDPKYGMFRYYEDSRLIWFSDKITVENFGATEVKELVLNGADTAVNKQNRQEFVDAYVDYIFNKSVASLFDAFHAGFHKVCGGKVLLLFQPNELQAMVIGNTNYDWKELEKNTEYKGEYWAEHPTIKIFWEVFHELPLEKKKQFLLFLTGSDRIPILGMKSLKLVIQSTGGGEEYLPVSHTCFNLLDLPKYTEKETLRSKLIQAIDHNEGFSLI

SEQ ID NO: 37484 - protein, 110 aa, Homo sapiens
  Payload ID: 7445
  Gene Symbol: HERC4
  Gene Name: HECT and RLD domain containing E3 ubiquitin protein ligase 4
  Uniprot ID: Q5GLZ8
  ENSP ID: ENSP00000422383
MLCWGNASFGQLGLGGIDEEIVLEPRKSDFFINKRVRDVGCGLRHTVFVLDDGTVYTCGCNDLGQLGHEKSRKKPEFRSCFPGRSAMAPSRLTATSASQVQAILLPQPPE

SEQ ID NO: 37485 - protein, 117 aa, Homo sapiens
  Payload ID: 7445
  Gene Symbol: HERC4
  Gene Name: HECT and RLD domain containing E3 ubiquitin protein ligase 4
  Uniprot ID: Q5GLZ8
  ENSP ID: ENSP00000423671
MLCWGNASFGQLGLGGIDEEIVLEPRKSDFFINKRVRDVGCGLRHTVFVLDDGTVYTCGCNDLGQLGHEKSRKKPEILKVCQISRLYRLLVVTIIHLHFLKQVKSSVGDRINMANWV

SEQ ID NO: 37486 - protein, 29 aa, Homo sapiens
  Payload ID: 7445
  Gene Symbol: HERC4
  Gene Name: HECT and RLD domain containing E3 ubiquitin protein ligase 4
  ENSP ID: ENSP00000426563
MLCWGNASFGQLGLGGIDEEIVLEPRKSD

SEQ ID NO: 37487 - protein, 240 aa, Homo sapiens
  Payload ID: 7445
  Gene Symbol: HERC4
  Gene Name: HECT and RLD domain containing E3 ubiquitin protein ligase 4
  ENSP ID: ENSP00000427191
MLCWGNASFGQLGLGGIDEEIVLEPRKSDFFINKRVRDVGCGLRHTVFVLDDGTVYTCGCNDLGQLGHEKSRKKPEQVVALDAQNIVAVSCGEAHTLALNDKGQVYAWGLDSDGQLGLVGSEECIRVPSCFPKIMCVDSLVRICSGLSYGRIRNIKSLSDIQIVQVACGYYHSLALSKASEVFCWGQNKYGQLGLGTDCKKQTSPQLLKSLLGIPFMQVAAGGAHSFVLTLSGAIFGWGR

SEQ ID NO: 37488 - protein, 1024 aa, Homo sapiens
  Payload ID: 7446
  Gene Symbol: HERC5
  Gene Name: HECT and RLD domain containing E3 ubiquitin protein ligase 5
  Uniprot ID: Q9UII4
  ENSP ID: ENSP00000264350
MERRSRRKSRRNGRSTAGKAAATQPAKSPGAQLWLFPSAAGLHRALLRRVEVTRQLCCSPGRLAVLERGGAGVQVHQLLAGSGGARTPKCIKLGKNMKIHSVDQGAEHMLILSSDGKPFEYDNYSMKHLRFESILQEKKIIQITCGDYHSLALSKGGELFAWGQNLHGQLGVGRKFPSTTTPQIVEHLAGVPLAQISAGEAHSMALSMSGNIYSWGKNECGQLGLGHTESKDDPSLIEGLDNQKVEFVACGGSHSALLTQDGLLFTFGAGKHGQLGHNSTQNELRPCLVAELVGYRVTQIACGRWHTLAYVSDLGKVFSFGSGKDGQLGNGGTRDQLMPLPVKVSSSEELKLESHTSEKELIMIAGGNQSILLWIKKENSYVNLKRTIPTLNEGTVKRWIADVETKRWQSTKREIQEIFSSPACLTGSFLRKRRTTEMMPVYLDLNKARNIFKELTQKDWITNMITTCLKDNLLKRLPFHSPPQEALEIFFLLPECPMMHISNNWESLVVPFAKVVCKMSDQSSLVLEEYWATLQESTFSKLVQMFKTAVICQLDYWDESAEENGNVQALLEMLKKLHRVNQVKCQLPESIFQVDELLHRLNFFVEVCRRYLWKMTVDASENVQCCVIFSHFPFIFNNLSKIKLLHTDTLLKIESKKHKAYLRSAAIEEERESEFALRPTFDLTVRRNHLIEDVLNQLSQFENEDLRKELWVSFSGEIGYDLGGVKKEFFYCLFAEMIQPEYGMFMYPEGASCMWFPVKPKFEKKRYFFFGVLCGLSLFNCNVANLPFPLALFKKLLDQMPSLEDLKELSPDLGKNLQTLLDDEGDNFEEVFYIHFNVHWDRNDTNLIPNGSSITVNQTNKRDYVSKYINYIFNDSVKAVYEEFRRGFYKMCDEDIIKLFHPEELKDVIVGNTDYDWKTFEKNARYEPGYNSSHPTIVMFWKAFHKLTLEEKKKFLVFLTGTDRLQMKDLNNMKITFCCPESWNERDPIRALTCFSVLFLPKYSTMETVEEALQEAINNNRGFG

SEQ ID NO: 37489 - protein, 662 aa, Homo sapiens
  Payload ID: 7446
  Gene Symbol: HERC5
  Gene Name: HECT and RLD domain containing E3 ubiquitin protein ligase 5
  ENSP ID: ENSP00000424129
MIAGGNQSILLWIKKENSYVNLKRTIPTLNEGTVKRWIADVETKRWQSTKREIQEIFSSPACLTGSFLRKRRTTEMMPVYLDLNKARNIFKELTQKDWITNMITTCLKDNLLKRLPFHSPPQEALEIFFLLPECPMMHISNNWESLVVPFAKVVCKMSDQSSLVLEEYWATLQESTFSKLVQMFKTAVICQLDYWDESAEENGNVQALLEMLKKLHRVNQVKCQLPESIFQVDELLHRLNFFVEVCRRYLWKMTVDASENVQCCVIFSHFPFIFNNLSKIKLLHTDTLLKIESKKHKAYLRSAAIEEERESEFALRPTFDLTVRRNHLIEDVLNQLSQFENEDLRKELWVSFSGEIGYDLGGVKKEFFYCLFAEMIQPEYGMFMYPEGASCMWFPVKPKFEKKRYFFFGVLCGLSLFNCNVANLPFPLALFKKLLDQMPSLEDLKELSPDLGKNLQTLLDDEGDNFEEVFYIHFNVHWDRNDTNLIPNGSSITVNQTNKRDYVSKYINYIFNDSVKAVYEEFRRGFYKMCDEDIIKLFHPEELKDVIVGNTDYDWKTFEKNARYEPGYNSSHPTIVMFWKAFHKLTLEEKKKFLVFLTGTDRLQMKDLNNMKITFCCPESWNERDPIRALTCFSVLFLPKYSTMETVEEALQEAINNNRGFG

SEQ ID NO: 37490 - protein, 4861 aa, Homo sapiens
  Payload ID: 7447
  Gene Symbol: HERC1
  Gene Name: HECT and RLD domain containing E3 ubiquitin protein ligase family member 1
  Uniprot ID: Q15751
  ENSP ID: ENSP00000390158
MATMIPPVKLKWLEHLNSSWITEDSESIATREGVAVLYSKLVSNKEVVPLPQQVLCLKGPQLPDFERESLSSDEQDHYLDALLSSQLALAKMVCSDSPFAGALRKRLLVLQRVFYALSNKYHDKGKVKQQQHSPESSSGSADVHSVSERPRSSTDALIEMGVRTGLSLLFALLRQSWMMPVSGPGLSLCNDVIHTAIEVVSSLPPLSLANESKIPPMGLDCLSQVTTFLKGVTIPNSGADTLGRRLASELLLGLAAQRGSLRYLLEWIEMALGASAVVHTMEKGKLLSSQEGMISFDCFMTILMQMRRSLGSSADRSQWREPTRTSDGLCSLYEAALCLFEEVCRMASDYSRTCASPDSIQTGDAPIVSETCEVYVWGSNSSHQLVEGTQEKILQPKLAPSFSDAQTIEAGQYCTFVISTDGSVRACGKGSYGRLGLGDSNNQSTLKKLTFEPHRSIKKVSSSKGSDGHTLAFTTEGEVFSWGDGDYGKLGHGNSSTQKYPKLIQGPLQGKVVVCVSAGYRHSAAVTEDGELYTWGEGDFGRLGHGDSNSRNIPTLVKDISNVGEVSCGSSHTIALSKDGRTVWSFGGGDNGKLGHGDTNRVYKPKVIEALQGMFIRKVCAGSQSSLALTSTGQVYAWGCGACLGCGSSEATALRPKLIEELAATRIVDVSIGDSHCLALSHDNEVYAWGNNSMGQCGQGNSTGPITKPKKVSGLDGIAIQQISAGTSHSLAWTALPRDRQVVAWHRPYCVDLEESTFSHLRSFLERYCDKINSEIPPLPFPSSREHHSFLKLCLKLLSNHLALALAGGVATSILGRQAGPLRNLLFRLMDSTVPDEIQEVVIETLSVGATMLLPPLRERMELLHSLLPQGPDRWESLSKGQRMQLDIILTSLQDHTHVASLLGYSSPSDAADLSSVCTGYGNLSDQPYGTQSCHPDTHLAEILMKTLLRNLGFYTDQAFGELEKNSDKFLLGTSSSENSQPAHLHELLCSLQKQLLAFCHINNISENSSSVALLHKHLQLLLPHATDIYSRSANLLKESPWNGSVGEKLRDVIYVSAAGSMLCQIVNSLLLLPVSVARPLLSYLLDLLPPLDCLNRLLPAADLLEDQELQWPLHGGPELIDPAGLPLPQPAQSWVWLVDLERTIALLIGRCLGGMLQGSPVSPEEQDTAYWMKTPLFSDGVEMDTPQLDKCMSCLLEVALSGNEEQKPFDYKLRPEIAVYVDLALGCSKEPARSLWISMQDYAVSKDWDSATLSNESLLDTVSRFVLAALLKHTNLLSQACGESRYQPGKHLSEVYRCVYKVRSRLLACKNLELIQTRSSSRDRWISENQDSADVDPQEHSFTRTIDEEAEMEEQAERDREEGHPEPEDEEEEREHEVMTAGKIFQCFLSAREVARSRDRDRMNSGAGSGARADDPPPQSQQERRVSTDLPEGQDVYTAACNSVIHRCALLILGVSPVIDELQKRREEGQLQQPSTSASEGGGLMTRSESLTAESRLVHTSPNYRLIKSRSESDLSQPESDEEGYALSGRRNVDLDLAASHRKRGPMHSQLESLSDSWARLKHSRDWLCNSSYSFESDFDLTKSLGVHTLIENVVSFVSGDVGNAPGFKEPEESMSTSPQASIIAMEQQQLRAELRLEALHQILVLLSGMEEKGSISLAGSRLSSGFQSSTLLTSVRLQFLAGCFGLGTVGHTGGKGESGRLHHYQDGIRAAKRNIQIEIQVAVHKIYQQLSATLERALQANKHHIEAQQRLLLVTVFALSVHYQPVDVSLAISTGLLNVLSQLCGTDTMLGQPLQLLPKTGVSQLSTALKVASTRLLQILAITTGTYADKLSPKVVQSLLDLLCSQLKNLLSQTGVLHMASFGEGEQEDGEEEEKKVDSSGETEKKDFRAALRKQHAAELHLGDFLVFLRRVVSSKAIQSKMASPKWTEVLLNIASQKCSSGIPLVGNLRTRLLALHVLEAVLPACESGVEDDQMAQIVERLFSLLSDCMWETPIAQAKHAIQIKEKEQEIKLQKQGELEEEDENLPIQEVSFDPEKAQCCLVENGQILTHGSGGKGYGLASTGVTSGCYQWKFYIVKENRGNEGTCVGVSRWPVHDFNHRTTSDMWLYRAYSGNLYHNGEQTLTLSSFTQGDFITCVLDMEARTISFGKNGEEPKLAFEDVDAAELYPCVMFYSSNPGEKVKICDMQMRGTPRDLLPGDPICSPVAAVLAEATIQLIRILHRTDRWTYCINKKMMERLHKIKICIKESGQKLKKSRSVQSREENEMREEKESKEEEKGKHTRHGLADLSELQLRTLCIEVWPVLAVIGGVDAGLRVGGRCVHKQTGRHATLLGVVKEGSTSAKVQWDEAEITISFPTFWSPSDTPLYNLEPCEPLPFDVARFRGLTASVLLDLTYLTGVHEDMGKQSTKRHEKKHRHESEEKGDVEQKPESESALDMRTGLTSDDVKSQSTTSSKSENEIASFSLDPTLPSVESQHQITEGKRKNHEHMSKNHDVAQSEIRAVQLSYLYLGAMKSLSALLGCSKYAELLLIPKVLAENGHNSDCASSPVVHEDVEMRAALQFLMRHMVKRAVMRSPIKRALGLADLERAQAMIYKLVVHGLLEDQFGGKIKQEIDQQAEESDPAQQAQTPVTTSPSASSTTSFMSSSLEDTTTATTPVTDTETVPASESPGVMPLSLLRQMFSSYPTTTVLPTRRAQTPPISSLPTSPSDEVGRRQSLTSPDSQSARPANRTALSDPSSRLSTSPPPPAIAVPLLEMGFSLRQIAKAMEATGARGEADAQNITVLAMWMIEHPGHEDEEEPQSGSTADSRPGAAVLGSGGKSNDPCYLQSPGDIPSADAAEMEEGFSESPDNLDHTENAASGSGPSARGRSAVTRRHKFDLAARTLLARAAGLYRSVQAHRNQSRREGISLQQDPGALYDFNLDEELEIDLDDEAMEAMFGQDLTSDNDILGMWIPEVLDWPTWHVCESEDREEVVVCELCECSVVSFNQHMKRNHPGCGRSANRQGYRSNGSYVDGWFGGECGSGNPYYLLCGTCREKYLAMKTKSKSTSSERYKGQAPDLIGKQDSVYEEDWDMLDVDEDEKLTGEEEFELLAGPLGLNDRRIVPEPVQFPDSDPLGASVAMVTATNSMEETLMQIGCHGSVEKSSSGRITLGEQAAALANPHDRVVALRRVTAAAQVLLARTMVMRALSLLSVSGSSCSLAAGLESLGLTDIRTLVRLMCLAAAGRAGLSTSPSAMASTSERSRGGHSKANKPISCLAYLSTAVGCLASNAPSAAKLLVQLCTQNLISAATGVNLTTVDDSIQRKFLPSFLRGIAEENKLVTSPNFVVTQALVALLADKGAKLRPNYDKSEVEKKGPLELANALAACCLSSRLSSQHRQWAAQQLVRTLAAHDRDNQTTLQTLADMGGDLRKCSFIKLEAHQNRVMTCVWCNKKGLLATSGNDGTIRVWNVTKKQYSLQQTCVFNRLEGDAEESLGSPSDPSFSPVSWSISGKYLAGALEKMVNIWQVNGGKGLVDIQPHWVSALAWPEEGPATAWSGESPELLLVGRMDGSLGLIEVVDVSTMHRRELEHCYRKDVSVTCIAWFSEDRPFAVGYFDGKLLLGTKEPLEKGGIVLIDAHKDTLISMKWDPTGHILMTCAKEDSVKLWGSISGCWCCLHSLCHPSIVNGIAWCRLPGKGSKLQLLMATGCQSGLVCVWRIPQDTTQTNVTSAEGWWEQESNCQDGYRKSSGAKCVYQLRGHITPVRTVAFSSDGLALVSGGLGGLMNIWSLRDGSVLQTVVIGSGAIQTTVWIPEVGVAACSNRSKDVLVVNCTAEWAAANHVLATCRTALKQQGVLGLNMAPCMRAFLERLPMMLQEQYAYEKPHVVCGDQLVHSPYMQCLASLAVGLHLDQLLCNPPVPPHHQNCLPDPASWNPNEWAWLECFSTTIKAAEALTNGAQFPESFTVPDLEPVPEDELVFLMDNSKWINGMDEQIMSWATSRPEDWHLGGKCDVYLWGAGRHGQLAEAGRNVMVPAAAPSFSQAQQVICGQNCTFVIQANGTVLACGEGSYGRLGQGNSDDLHVLTVISALQGFVVTQLVTSCGSDGHSMALTESGEVFSWGDGDYGKLGHGNSDRQRRPRQIEALQGEEVVQMSCGFKHSAVVTSDGKLFTFGNGDYGRLGLGNTSNKKLPERVTALEGYQIGQVACGLNHTLAVSADGSMVWAFGDGDYGKLGLGNSTAKSSPQKIDVLCGIGIKKVACGTQFSVALTKDGHVYTFGQDRLIGLPEGRARNHNRPQQIPVLAGVIIEDVAVGAEHTLALASNGDVYAWGSNSEGQLGLGHTNHVREPTLVTGLQGKNVRQISAGRCHSAAWTAPPVPPRAPGVSVPLQLGLPDTVPPQYGALREVSIHTVRARLRLLYHFSDLMYSSWRLLNLSPNNQNSTSHYNAGTWGIVQGQLRPLLAPRVYTLPMVRSIGKTMVQGKNYGPQITVKRISTRGRKCKPIFVQIARQVVKLNASDLRLPSRAWKVKLVGEGADDAGGVFDDTITEMCQELETGIVDLLIPSPNATAEVGYNRDRFLFNPSACLDEHLMQFKFLGILMGVAIRTKKPLDLHLAPLVWKQLCCVPLTLEDLEEVDLLYVQTLNSILHIEDSGITEESFHEMIPLDSFVGQSADGKMVPIIPGGNSIPLTFSNRKEYVERAIEYRLHEMDRQVAAVREGMSWIVPVPLLSLLTAKQLEQMVCGMPEISVEVLKKVVRYREVDEQHQLVQWFWHTLEEFSNEERVLFMRFVSGRSRLPANTADISQRFQIMKVDRPYDSLPTSQTCFFQLRLPPYSSQLVMAERLRYAINNCRSIDMDNYMLSRNVDNAEGSDTDY

SEQ ID NO: 37491 - protein, 165 aa, Homo sapiens
  Payload ID: 7447
  Gene Symbol: HERC1
  Gene Name: HECT and RLD domain containing E3 ubiquitin protein ligase family member 1
  ENSP ID: ENSP00000452654
  MOD_RES (1)..(1): Any amino acid
XGGVDAGLRVGGRCVHKQTGRHATLLGVVKEGSTSAKVQWDEAEITISDTPLYNLEPCEPLPFDVARFRGLTASVLLDLTYLTGVHEDMGKQSTKRHEKKHRHESEEKGDVEQKPESESALDMRTGLTSDDVKSQSTTSSKSENEIASFSLDPTLPSVESQHQIT

SEQ ID NO: 37492 - protein, 26 aa, Homo sapiens
  Payload ID: 7447
  Gene Symbol: HERC1
  Gene Name: HECT and RLD domain containing E3 ubiquitin protein ligase family member 1
  ENSP ID: ENSP00000452671
NSDDLHVLTVISALQDFKGHLHQSSL

SEQ ID NO: 37493 - protein, 145 aa, Homo sapiens
  Payload ID: 7447
  Gene Symbol: HERC1
  Gene Name: HECT and RLD domain containing E3 ubiquitin protein ligase family member 1
  ENSP ID: ENSP00000452969
MATMIPPVKLKWLEHLNSSWITEDSESIATREGVAVLYSKLVSNKEVVPLPQQVLCLKGPQLPDFERESLSSDEQDHYLDALLSSQLALAKMVCSDSPFAGALRKRLLVLQRVFYALSNKYHDKGKVKQQQHSPESSSGSADVHS

SEQ ID NO: 37494 - protein, 20 aa, Homo sapiens
  Payload ID: 7447
  Gene Symbol: HERC1
  Gene Name: HECT and RLD domain containing E3 ubiquitin protein ligase family member 1
  ENSP ID: ENSP00000453010
MATMIPPVKLKWLEHLNSSW

SEQ ID NO: 37495 - protein, 153 aa, Homo sapiens
  Payload ID: 7447
  Gene Symbol: HERC1
  Gene Name: HECT and RLD domain containing E3 ubiquitin protein ligase family member 1
  ENSP ID: ENSP00000453086
MATMIPPVKLKWLEHLNSSWITEDSESIATREGVAVLYSKLVSNKEVVPLPQQVLCLKGPQLPDFERESLSSDEQDHYLDALLSSQLALAKMVCSDSPFAGALRKRLLVLQRVFYALSNKYHDKGKVKQQQHSPESSSGSADVHSVSERPRSS

SEQ ID NO: 37496 - protein, 152 aa, Homo sapiens
  Payload ID: 7447
  Gene Symbol: HERC1
  Gene Name: HECT and RLD domain containing E3 ubiquitin protein ligase family member 1
  ENSP ID: ENSP00000453196
  MOD_RES (1)..(1): Any amino acid
XDVAVGAEHTLALASNGDVYAWGSNSEGQLGLGHTNHVREPTLVTGLQGKNVRQISAGRCHSAAWTAPPVPPRAPGVSVPLQLGLPDTVPPQYGALREVSIHTVRARLRLLYHFSDLMYSSWRLLNLSPNNQVTDWRGKQPGTDWLEQHIPL

SEQ ID NO: 37497 - protein, 47 aa, Homo sapiens
  Payload ID: 7447
  Gene Symbol: HERC1
  Gene Name: HECT and RLD domain containing E3 ubiquitin protein ligase family member 1
  ENSP ID: ENSP00000453603
  MOD_RES (1)..(1): Any amino acid
XNSTAKSSPQKIDVLCGIGIKKVACGTQFSVALTKDGHVYTFGQGGE

SEQ ID NO: 37498 - protein, 691 aa, Homo sapiens
  Payload ID: 7447
  Gene Symbol: HERC1
  Gene Name: HECT and RLD domain containing E3 ubiquitin protein ligase family member 1
  ENSP ID: ENSP00000453937
MATMIPPVKLKWLEHLNSSWITEDSESIATREGVAVLYSKLVSNKEVVPLPQQVLCLKGPQLPDFERESLSSDEQDHYLDALLSSQLALAKMVCSDSPFAGALRKRLLVLQRVFYALSNKYHDKGKVKQQQHSPESSSGSADVHSVSERPRSSTDALIEMGVRTGLSLLFALLRQSWMMPVSGPGLSLCNDVIHTAIEVVSSLPPLSLANESKIPPMGLDCLSQVTTFLKGVTIPNSGADTLGRRLASELLLGLAAQRGSLRYLLEWIEMALGASAVVHTMEKGKLLSSQEGMISFDCFMTILMQMRRSLISENQDSADVDPQEHSFTRTIDEEAEMEEQAERDREEGHPEPEDEEEEREHEVMTAGKIFQCFLSAREVARSRDRDRMNSGAGSGARADDPPPQSQQERRVSTDLPEGQDVYTAACNSVIHRCALLILGVSPVIDELQKRREEGQLQQPSTSASEGGGLMTRSESLTAESRLVHTSPNYRLIKSRSESDLSQPESDEEGYALSGRRNVDLDLAASHRKRGPMHSQLESLSDSWARLKHSRDWLCNSSYSFESDFDLTKSLGVHTLIENVVSFVSGDVGNAPGFKEPEESMSTSPQASIIAMEQQQLRAELRLEALHQILVLLSGMEEKGSISLAGSRLSSGFQSSTLLTSVRLQFLAGCFGLGTVGHTGGKGESGRLHHYQ

SEQ ID NO: 37499 - protein, 1022 aa, Homo sapiens
  Payload ID: 7448
  Gene Symbol: HERC6
  Gene Name: HECT and RLD domain containing E3 ubiquitin protein ligase family member 6
  Uniprot ID: Q8IVU3
  ENSP ID: ENSP00000264346
MYFCWGADSRELQRRRTAGSPGAELLQAASGERHSLLLLTNHRVLSCGDNSRGQLGRRGAQRGELPEPIQALETLIVDLVSCGKEHSLAVCHKGRVFAWGAGSEGQLGIGEFKEISFTPKKIMTLNDIKIIQVSCGHYHSLALSKDSQVFSWGKNSHGQLGLGKEFPSQASPQRVRSLEGIPLAQVAAGGAHSFALSLCGTSFGWGSNSAGQLALSGRNVPVQSNKPLSVGALKNLGVVYISCGDAHTAVLTQDGKVFTFGDNRSGQLGYSPTPEKRGPQLVERIDGLVSQIDCGSYHTLAYVHTTGQVVSFGHGPSDTSKPTHPEALTENFDISCLISAEDFVDVQVKHIFAGTYANFVTTHQDTSSTRAPGKTLPEISRISQSMAEKWIAVKRRSTEHEMAKSEIRMIFSSPACLTASFLKKRGTGETTSIDVDLEMARDTFKKLTKKEWISSMITTCLEDDLLRALPCHSPHQEALSVFLLLPECPVMHDSKNWKNLVVPFAKAVCEMSKQSLQVLKKCWAFLQESSLNPLIQMLKAAIISQLLHQTKTEQDHCNVKALLGMMKELHKVNKANCRLPENTFNINELSNLLNFYIDRGRQLFRDNHLIPAETPSPVIFSDFPFIFNSLSKIKLLQADSHIKMQMSEKKAYMLMHETILQKKDEFPPSPRFILRVRRSRLVKDALRQLSQAEATDFCKVLVVEFINEICPESGGVSSEFFHCMFEEMTKPEYGMFMYPEMGSCMWFPAKPKPEKKRYFLFGMLCGLSLFNLNVANLPFPLALYKKLLDQKPSLEDLKELSPRLGKSLQEVLDDAADDIGDALCIRFSIHWDQNDVDLIPNGISIPVDQTNKRDYVSKYIDYIFNVSVKAVYEEFQRGFYRVCEKEILRHFYPEELMTAIIGNTDYDWKQFEQNSKYEQGYQKSHPTIQLFWKAFHKLTLDEKKKFLFFLTGRDRLHARGIQKMEIVFRCPETFSERDHPTSITCHNILSLPKYSTMERMEEALQVAINNNRGFVSPMLTQS

SEQ ID NO: 37500 - protein, 322 aa, Homo sapiens
  Payload ID: 7448
  Gene Symbol: HERC6
  Gene Name: HECT and RLD domain containing E3 ubiquitin protein ligase family member 6
  ENSP ID: ENSP00000273960
MYFCWGADSRELQRRRTAGSPGAELLQAASGERHSLLLLTNHRVLSCGDNSRGQLGRRGAQRGELPEPIQALETLIVDLVSCGKEHSLAVCHKGRVFAWGAGSEGQLGIGEFKEISFTPKKIMTLNDIKIIQVSCGHYHSLALSKDSQVFSWGKNSHGQLGLGKEFPSQASPQRVRSLEGIPLAQVAAGGAHSFALSLCGTSFGWGSNSAGQLALSGRNVPVQSNKPLSVGALKNLGVVYISCGDAHTAVLTQDGKVFTFGDNRSGQLGYSPTPEKRGPQLVERIDGLVSQIDCGRLRGCSSQTHFCWNICQLCDNSSVKLE

SEQ ID NO: 37501 - protein, 986 aa, Homo sapiens
  Payload ID: 7448
  Gene Symbol: HERC6
  Gene Name: HECT and RLD domain containing E3 ubiquitin protein ligase family member 6
  Uniprot ID: Q8IVU3
  ENSP ID: ENSP00000369617
MYFCWGADSRELQRRRTAGSPGAELLQAASGERHSLLLLTNHRVLSCGDNSRGQLGRRGAQRGELPEPIQALETLIVDLVSCGKEHSLAVCHKGRVFAWGAGSEGQLGIGEFKEISFTPKKIMTLNDIKIIQVSCGHYHSLALSKDSQVFSWGKNSHGQLGLGKEFPSQASPQRVRSLEGIPLAQVAAGGAHSFALSLCGTSFGWGSNSAGQLALSGRNVPVQSNKPLSVGALKNLGVVYISCGDAHTAVLTQDGKVFTFGDNRSGQLGYSPTPEKRGPQLVERIDGLVSQIDCGSYHTLAYVHTTGQVVSFGHGPSDTSKPTHPEALTENFDISCLISAEDFVDVQVKHIFAGTYANFVTTHQDTSSTRAPGKTLPEISRISQSMAEKWIAVKRRSTEHEMAKSEIRMIFSSPACLTASFLKKRGTGETTSIDVDLEMARDTFKKLTKKEWISSMITTCLEDDLLRALPCHSPHQEALSVFLLLPECPVMHDSKNWKNLVVPFAKAVCEMSKQSLQVLKKCWAFLQESSLNPLIQMLKAAIISQLLHQTKTEQDHCNVKALLGMMKELHKVNKANCRLPENTFNINELSNLLNFYIDRGRQLFRDNHLMSEKKAYMLMHETILQKKDEFPPSPRFILRVRRSRLVKDALRQLSQAEATDFCKVLVVEFINEICPESGGVSSEFFHCMFEEMTKPEYGMFMYPEMGSCMWFPAKPKPEKKRYFLFGMLCGLSLFNLNVANLPFPLALYKKLLDQKPSLEDLKELSPRLGKSLQEVLDDAADDIGDALCIRFSIHWDQNDVDLIPNGISIPVDQTNKRDYVSKYIDYIFNVSVKAVYEEFQRGFYRVCEKEILRHFYPEELMTAIIGNTDYDWKQFEQNSKYEQGYQKSHPTIQLFWKAFHKLTLDEKKKFLFFLTGRDRLHARGIQKMEIVFRCPETFSERDHPTSITCHNILSLPKYSTMERMEEALQVAINNNRGFVSPMLTQS

SEQ ID NO: 37502 - protein, 186 aa, Homo sapiens
  Payload ID: 7448
  Gene Symbol: HERC6
  Gene Name: HECT and RLD domain containing E3 ubiquitin protein ligase family member 6
  ENSP ID: ENSP00000425060
  MOD_RES (1)..(1): Any amino acid
XDNSRGQLGRRGAQRGELPVVVGGCFVLFPKEPIQALETLIVDLVSCGKEHSLAVCHKGRVFAWGAGSEGQLGIGEFKEISFTPKKIMTLNDIKIIQVSCGHYHSLALSKDSQVFSWGKNSHGQLGLGKEFPSQASPQRVRSLEGIPLAQVAAGGAHSFALSLCGTSFGWGSNSAGQLALSGRNVP

SEQ ID NO: 37503 - protein, 73 aa, Homo sapiens
  Payload ID: 7448
  Gene Symbol: HERC6
  Gene Name: HECT and RLD domain containing E3 ubiquitin protein ligase family member 6
  ENSP ID: ENSP00000425504
MYFCWGADSRELQRRRTAGSPGAELLQAASGERHSLLLLTNHRVLSCGDNSRGQLGRRGAQRGELPGIGNPNC

SEQ ID NO: 37504 - protein, 909 aa, Homo sapiens
  Payload ID: 7449
  Gene Symbol: HACE1
  Gene Name: HECT domain and ankyrin repeat containing E3 ubiquitin protein ligase 1
  Uniprot ID: Q8IYU2
  ENSP ID: ENSP00000262903
MERAMEQLNRLTRSLRRARTVELPEDNETAVYTLMPMVMADQHRSVSELLSNSKFDVNYAFGRVKRSLLHIAANCGSVECLVLLLKKGANPNYQDISGCTPLHLAARNGQKKCMSKLLEYSADVNICNNEGLTAIHWLAVNGRTELLHDLVQHVSDVDVEDAMGQTALHVACQNGHKTTVQCLLDSGADINRPNVSGATPLYFACSHGQRDTAQILLLRGAKYLPDKNGVTPLDLCVQGGYGETCEVLIQYHPRLFQTIIQMTQNEDLRENMLRQVLEHLSQQSESQYLKILTSLAEVATTNGHKLLSLSSNYDAQMKSLLRIVRMFCHVFRIGPSSPSNGIDMGYNGNKTPRSQVFKPLELLWHSLDEWLVLIATELMKNKRDSTEITSILLKQKGQDQDAASIPPFEPPGPGSYENLSTGTRESKPDALAGRQEASADCQDVISMTANRLSAVIQAFYMCCSCQMPPGMTSPRFIEFVCKHDEVLKCFVNRNPKIIFDHFHFLLECPELMSRFMHIIKAQPFKDRCEWFYEHLHSGQPDSDMVHRPVNENDILLVHRDSIFRSSCEVVSKANCAKLKQGIAVRFHGEEGMGQGVVREWFDILSNEIVNPDYALFTQSADGTTFQPNSNSYVNPDHLNYFRFAGQILGLALNHRQLVNIYFTRSFYKHILGIPVNYQDVASIDPEYAKNLQWILDNDISDLGLELTFSVETDVFGAMEEVPLKPGGGSILVTQNNKAEYVQLVTELRMTRAIQPQINAFLQGFHMFIPPSLIQLFDEYELELLLSGMPEIDVSDWIKNTEYTSGYEREDPVIQWFWEVVEDITQEERVLLLQFVTGSSRVPHGGFANIMGGSGLQNFTIAAVPYTPNLLPTSSTCINMLKLPEYPSKEILKDRLLVALHCGSYGYTMA

SEQ ID NO: 37505 - protein, 694 aa, Homo sapiens
  Payload ID: 7449
  Gene Symbol: HACE1
  Gene Name: HECT domain and ankyrin repeat containing E3 ubiquitin protein ligase 1
  Uniprot ID: Q8IYU2
  ENSP ID: ENSP00000358121
MERAMEQLNRLTRSLRRARTVELPEDNETAVYTLMPMVMADQHRSVSELLSNSKFDVNYAFGRVKRSLLHIAANCGSVECLVLLLKKGANPNYQDISGCTPLHLAARNGQKKCMSKLLEYSADVNICNNEGLTAIHWLAVNGRTELLHDLVQHVSDVDVEDAMGQTALHVACQNGHKTTVQCLLDSGADINRPNVSGATPLYFACSHGQRDTAQILLLRGAKYLPDKNGVTPLDLCVQGGYGETCEVLIQYHPRLFQTIIQMTQNEDLRENMLRQVLEHLSQQSESQYLKILTSLAEVATTNGHKLLSLSSNYDAQMKSLLRIVRMFCHVFRIGPSSPSNGIDMGYNGNKTPRSQVFKPLELLWHSLDEWLVLIATELMKNKRDSTEITSILLKQKGQDQDAASIPPFEPPGPGSYENLSTGTRESKPDALAGRQEASADCQDVISMTANRLSAVIQAFYMCCSCQMPPGMTSPRFIEFVCKHDEVLKCFVNRNPKIIFDHFHFLLECPELMSRFMHIIKAQAEYVQLVTELRMTRAIQPQINAFLQGFHMFIPPSLIQLFDEYELELLLSGMPEIDVSDWIKNTEYTSGYEREDPVIQWFWEVVEDITQEERVLLLQFVTGSSRVPHGGFANIMGGSGLQNFTIAAVPYTPNLLPTSSTCINMLKLPEYPSKEILKDRLLVALHCGSYGYTMA

SEQ ID NO: 37506 - protein, 178 aa, Homo sapiens
  Payload ID: 7449
  Gene Symbol: HACE1
  Gene Name: HECT domain and ankyrin repeat containing E3 ubiquitin protein ligase 1
  ENSP ID: ENSP00000392425
MERAMEQLNRLTRSLRRARTVELPEDNETAVYTLMPMVMADQHRSVSELLSNSKFDVNYAFGRVKRSLLHIAANCGSVECLVLLLKKGANPNYQDISGCTPLHLAARNGQKKCMSKLLEYSADVNICNNEGLTAIHWLAVNGRTELLHDLVQHVSDVDVEDAMGQTALHVACQNGHKT

SEQ ID NO: 37507 - protein, 138 aa, Homo sapiens
  Payload ID: 7449
  Gene Symbol: HACE1
  Gene Name: HECT domain and ankyrin repeat containing E3 ubiquitin protein ligase 1
  ENSP ID: ENSP00000427901
MPMVMADQHRSVSELLSNSKFDVNYAFGRVKRSLLHIAANCGSVECLVLLLKKGANPNYQDISGCTPLHLAARNGQKKCMSKLLEYSADVNICNNEGLTAIHWLAVNGRTELLHDLVQHVSDVDVEDAMGQTALHVAC

SEQ ID NO: 37508 - protein, 300 aa, Homo sapiens
  Payload ID: 7449
  Gene Symbol: HACE1
  Gene Name: HECT domain and ankyrin repeat containing E3 ubiquitin protein ligase 1
  ENSP ID: ENSP00000428110
  MOD_RES (1)..(1): Any amino acid
XCEVVSKANCAKLKQGIAVRFHGEEGMGQGVVREWFDILSNEIVNPDYALFTQSADGTTFQPNSNSYVNPDHLNYFRFAGQILGLALNHRQLVNIYFTRSFYKHILGIPVNYQDVASIDPEYAKNLQWILDNDISDLGLELTFSVETDVFGAMEEVPLKPGGGSILVTQNNKELLLSGMPEIDVSDWIKNTEYTSGYEREDPVIQWFWEVVEDITQEERVLLLQFVTGSSRVPHGGFANIMGGSGLQNFTIAAVPYTPNLLPTSSTCINMLKLPEYPSKEILKDRLLVALHCGSYGYTMA

SEQ ID NO: 37509 - protein, 329 aa, Homo sapiens
  Payload ID: 7449
  Gene Symbol: HACE1
  Gene Name: HECT domain and ankyrin repeat containing E3 ubiquitin protein ligase 1
  ENSP ID: ENSP00000429520
  MOD_RES (1)..(1): Any amino acid
XIKAQPFKDRCEWFYEHLHSGQPDSDMVHRPVNENDILLVHRDSIFRSSCEVVSKANCAKLKQGIAVRFHGEEGMGQGVVREWFDILSNEIVNPDYALFTQSADGTTFQPNSNSYVNPDHLNYFRFAGQILGLALNHRQLVNIYFTRSFYKHILGIPVNYQDVASIDPEYAKNLQWILDNDISDLGLELTFSVETDVFGAMEEVPLKPGGGSILVTQNNKELLLSGMPEIDVSDWIKNTEYTSGYEREDPVIQFVTGSSRVPHGGFANIMGGSGLQNFTIAAVPYTPNLLPTSSTCINMLKLPEYPSKEILKDRLLVALHCGSYGYTMA

SEQ ID NO: 37510 - protein, 207 aa, Homo sapiens
  Payload ID: 7449
  Gene Symbol: HACE1
  Gene Name: HECT domain and ankyrin repeat containing E3 ubiquitin protein ligase 1
  ENSP ID: ENSP00000429765
MERAMEQLNRLTRSLRRARTVELPEDNETAVYTLMPMVMADQHRSVSELLSNSKFDVNYAFGRVKRSLLHIAANCGSVECLVLLLKKGANPNYQDISGCTPLHLAARNGQKKCMSKLLEYSADVNICNNEGLTATVQCLLDSGADINRPNVSGATPLYFACSHGQRDTAQILLLRGAKYLPDKNGVTPLDLCVQGGYGETCEVLIQY

SEQ ID NO: 37511 - protein, 44 aa, Homo sapiens
  Payload ID: 7449
  Gene Symbol: HACE1
  Gene Name: HECT domain and ankyrin repeat containing E3 ubiquitin protein ligase 1
  ENSP ID: ENSP00000430669
  MOD_RES (1)..(1): Any amino acid
XSLRRARTVELPEELRGGPGPRTPLARRSHPGRDEVSLCSPGWS

SEQ ID NO: 37512 - protein, 175 aa, Homo sapiens
  Payload ID: 7449
  Gene Symbol: HACE1
  Gene Name: HECT domain and ankyrin repeat containing E3 ubiquitin protein ligase 1
  ENSP ID: ENSP00000430898
  MOD_RES (1)..(1): Any amino acid
XQDAASIPPFEPPGPGSYENLSTGTRESKPDALAGRQEASADCQDVISMTANRLSAVIQAFYMCCSCQMPPGMTSPRFIEFVCKHDEVLKCFVNRNPKIIFDHFHFLLECPELMSRFMHIIKAQPFKDRCEWFYEHLHSGQPDSDMVHRPVNENDILLVHRGVAVKLCQKQIVQS

SEQ ID NO: 37513 - protein, 2610 aa, Homo sapiens
  Payload ID: 7450
  Gene Symbol: HECTD1
  Gene Name: HECT domain containing E3 ubiquitin protein ligase 1
  Uniprot ID: Q9ULT8
  ENSP ID: ENSP00000382269
MADVDPDTLLEWLQMGQGDERDMQLIALEQLCMLLLMSDNVDRCFETCPPRTFLPALCKIFLDESAPDNVLEVTARAITYYLDVSAECTRRIVGVDGAIKALCNRLVVVELNNRTSRDLAEQCVKVLELICTRESGAVFEAGGLNCVLTFIRDSGHLVHKDTLHSAMAVVSRLCGKMEPQDSSLEICVESLSSLLKHEDHQVSDGALRCFASLADRFTRRGVDPAPLAKHGLTEELLSRMAAAGGTVSGPSSACKPGRSTTGAPSTTADSKLSNQVSTIVSLLSTLCRGSPVVTHDLLRSELPDSIESALQGDERCVLDTMRLVDLLLVLLFEGRKALPKSSAGSTGRIPGLRRLDSSGERSHRQLIDCIRSKDTDALIDAIDTGAFEVNFMDDVGQTLLNWASAFGTQEMVEFLCERGADVNRGQRSSSLHYAACFGRPQVAKTLLRHGANPDLRDEDGKTPLDKARERGHSEVVAILQSPGDWMCPVNKGDDKKKKDTNKDEEECNEPKGDPEMAPIYLKRLLPVFAQTFQQTMLPSIRKASLALIRKMIHFCSEALLKEVCDSDVGHNLPTILVEITATVLDQEDDDDGHLLALQIIRDLVDKGGDIFLDQLARLGVISKVSTLAGPSSDDENEEESKPEKEDEPQEDAKELQQGKPYHWRDWSIIRGRDCLYIWSDAAALELSNGSNGWFRFILDGKLATMYSSGSPEGGSDSSESRSEFLEKLQRARGQVKPSTSSQPILSAPGPTKLTVGNWSLTCLKEGEIAIHNSDGQQATILKEDLPGFVFESNRGTKHSFTAETSLGSEFVTGWTGKRGRKLKSKLEKTKQKVRTMARDLYDDHFKAVESMPRGVVVTLRNIATQLESSWELHTNRQCIESENTWRDLMKTALENLIVLLKDENTISPYEMCSSGLVQALLTVLNNSMDLDMKQDCSQLVERINVFKTAFSENEDDESRPAVALIRKLIAVLESIERLPLHLYDTPGSTYNLQILTRRLRFRLERAPGETALIDRTGRMLKMEPLATVESLEQYLLKMVAKQWYDFDRSSFVFVRKLREGQNFIFRHQHDFDENGIIYWIGTNAKTAYEWVNPAAYGLVVVTSSEGRNLPYGRLEDILSRDNSALNCHSNDDKNAWFAIDLGLWVIPSAYTLRHARGYGRSALRNWVFQVSKDGQNWTSLYTHVDDCSLNEPGSTATWPLDPPKDEKQGWRHVRIKQMGKNASGQTHYLSLSGFELYGTVNGVCEDQLGKAAKEAEANLRRQRRLVRSQVLKYMVPGARVIRGLDWKWRDQDGSPQGEGTVTGELHNGWIDVTWDAGGSNSYRMGAEGKFDLKLAPGYDPDTVASPKPVSSTVSGTTQSWSSLVKNNCPDKTSAAAGSSSRKGSSSSVCSVASSSDISLGSTKTERRSEIVMEHSIVSGADVHEPIVVLSSAENVPQTEVGSSSSASTSTLTAETGSENAERKLGPDSSVRTPGESSAISMGIVSVSSPDVSSVSELTNKEAASQRPLSSSASNRLSVSSLLAAGAPMSSSASVPNLSSRETSSLESFVRRVANIARTNATNNMNLSRSSSDNNTNTLGRNVMSTATSPLMGAQSFPNLTTPGTTSTVTMSTSSVTSSSNVATATTVLSVGQSLSNTLTTSLTSTSSESDTGQEAEYSLYDFLDSCRASTLLAELDDDEDLPEPDEEDDENEDDNQEDQEYEEVMILRRPSLQRRAGSRSDVTHHAVTSQLPQVPAGAGSRPIGEQEEEEYETKGGRRRTWDDDYVLKRQFSALVPAFDPRPGRTNVQQTTDLEIPPPGTPHSELLEEVECTPSPRLALTLKVTGLGTTREVELPLTNFRSTIFYYVQKLLQLSCNGNVKSDKLRRIWEPTYTIMYREMKDSDKEKENGKMGCWSIEHVEQYLGTDELPKNDLITYLQKNADAAFLRHWKLTGTNKSIRKNRNCSQLIAAYKDFCEHGTKSGLNQGAISTLQSSDILNLTKEQPQAKAGNGQNSCGVEDVLQLLRILYIVASDPYSRISQEDGDEQPQFTFPPDEFTSKKITTKILQQIEEPLALASGALPDWCEQLTSKCPFLIPFETRQLYFTCTAFGASRAIVWLQNRREATVERTRTTSSVRRDDPGEFRVGRLKHERVKVPRGESLMEWAENVMQIHADRKSVLEVEFLGEEGTGLGPTLEFYALVAAEFQRTDLGAWLCDDNFPDDESRHVDLGGGLKPPGYYVQRSCGLFTAPFPQDSDELERITKLFHFLGIFLAKCIQDNRLVDLPISKPFFKLMCMGDIKSNMSKLIYESRGDRDLHCTESQSEASTEEGHDSLSVGSFEEDSKSEFILDPPKPKPPAWFNGILTWEDFELVNPHRARFLKEIKDLAIKRRQILSNKGLSEDEKNTKLQELVLKNPSGSGPPLSIEDLGLNFQFCPSSRIYGFTAVDLKPSGEDEMITMDNAEEYVDLMFDFCMHTGIQKQMEAFRDGFNKVFPMEKLSSFSHEEVQMILCGNQSPSWAAEDIINYTEPKLGYTRDSPGFLRFVRVLCGMSSDERKAFLQFTTGCSTLPPGGLANLHPRLTVVRKVDATDASYPSVNTCVHYLKLPEYSSEEIMRERLLAATMEKGFHLN

SEQ ID NO: 37514 - protein, 2610 aa, Homo sapiens; identical to SEQ ID NO: 37513
  Payload ID: 7450
  Gene Symbol: HECTD1
  Gene Name: HECT domain containing E3 ubiquitin protein ligase 1
  Uniprot ID: Q9ULT8
  ENSP ID: ENSP00000450697

SEQ ID NO: 37515 - protein, 122 aa, Homo sapiens
  Payload ID: 7450
  Gene Symbol: HECTD1
  Gene Name: HECT domain containing E3 ubiquitin protein ligase 1
  ENSP ID: ENSP00000450920
  MOD_RES (1)..(1): Any amino acid
XTNATNNMNLSRSSSDNNTNTLGRNVMSTATSPLMGAQSFPNLTTPGTTSTVTMSTSSVTSSSNVATATTVLSVGQSLSNTLTTSLTSTSSESDTGQEAEYSLYVFMKNSLSASSFMQDNVI

SEQ ID NO: 37516 - protein, 976 aa, Homo sapiens
  Payload ID: 7450
  Gene Symbol: HECTD1
  Gene Name: HECT domain containing E3 ubiquitin protein ligase 1
  ENSP ID: ENSP00000451260
  MOD_RES (1)..(1): Any amino acid
XLSNTLTTSLTSTSSESDTGQEAEYSLYDFLDSCRASTLLAELDDDEDLPEPDEEDDENEDDNQEDQEYEEILRRPSLQRRAGSRSDVTHHAVTSQLPQVPAGAGSRPIGEQEEEEYETKGGRRRTWDDDYVLKRQFSALVPAFDPRPGRTNVQQTTDLEIPPPGTPHSELLEEVECTPSPRLALTLKVTGLGTTREVELPLTNFRSTIFYYVQKLLQLSCNGNVKSDKLRRIWEPTYTIMYREMKDSDKEKENGKMGCWSIEHVEQYLGTDELPKNDLITYLQKNADAAFLRHWKLTGTNKSIRKNRNCSQLIAAYKDFCEHGTKSGLNQGAISTLQSSDILNLTKEQPQAKAGNGQNSCGVEDVLQLLRILYIVASDPYSRISQEDGDEQPQFTFPPDEFTSKKITTKILQQIEEPLALASGALPDWCEQLTSKCPFLIPFETRQLYFTCTAFGASRAIVWLQNRREATVERTRTTSSVRRDDPGEFRVGRLKHERVKVPRGESLMEWAENVMQIHADRKSVLEVEFLGEEGTGLGPTLEFYALVAAEFQRTDLGAWLCDDNFPDDESRHVDLGGGLKPPGYYVQRSCGLFTAPFPQDSDELERITKLFHFLGIFLAKCIQDNRLVDLPISKPFFKLMCMGDIKSNMSKLIYESRGDRDLHCTESQSEASTEEGHDSLSVGSFEEDSKSEFILDPPKPKPPAWFNGILTWEDFELVNPHRARFLKEIKDLAIKRRQILSNKGLSEDEKNTKLQELVLKNPSGSGPPLSIEDLGLNFQFCPSSRIYGFTAVDLKPSGEDEMITMDNAEEYVDLMFDFCMHTGIQKQMEAFRDGFNKVFPMEKLSSFSHEEVQMILCGNQSPSWAAEDIINYTEPKLGYTRDSPGFLRFVRVLCGMSSDERKAFLQFTTGCSTLPPGGLANLHPRLTVVRKVDATDASYPSVNTCVHYLKLPEYSSEEIMRERLLAATMEKGFHLN

SEQ ID NO: 37517 - protein, 1465 aa, Homo sapiens
  Payload ID: 7450
  Gene Symbol: HECTD1
  Gene Name: HECT domain containing E3 ubiquitin protein ligase 1
  ENSP ID: ENSP00000451860
VFAQTFQQTMLPSIRKASLALIRKMIHFCSEALLKEVCDSDVGHNLPTILVEITATVLDQEDDDDGHLLALQIIRDLVDKGGDIFLDQLARLGVISKVSTLAGPSSDDENEEESKPEKEDEPQEDAKELQQGKPYHWRDWSIIRGRDCLYIWSDAAALELSNGSNGWFRFILDGKLATMYSSGSPEGGSDSSESRSEFLEKLQRARGQVKPSTSSQPILSAPGPTKLTVGNWSLTCLKEGEIAIHNSDGQQATILKEDLPGFVFESNRGTKHSFTAETSLGSEFVTGWTGKRGRKLKSKLEKTKQKVRTMARDLYDDHFKAVESMPRGVVVTLRNIATQLESSWELHTNRQCIESENTWRDLMKTALENLIVLLKDENTISPYEMCSSGLVQALLTVLNNSMDLDMKQDCSQLVERINVFKTAFSENEDDESRPAVALIRKLIAVLESIERLPLHLYDTPGSTYNLQILTRRLRFRLERAPGETALIDRTGRMLKMEPLATVESLEQYLLKMVAKQWYDFDRSSFVFVRKLREGQNFIFRHQHDFDENGIIYWIGTNAKTAYEWVNPAAYGLVVVTSSEGRNLPYGRLEDILSRDNSALNCHSNDDKNAWFAIDLGLWVIPSAYTLRHARGYGRSALRNWVFQVSKDGQNWTSLYTHVDDCSLNEPGSTATWPLDPPKDEKQGWRHVRIKQMGKNASGQTHYLSLSGFELYGTVNGVCEDQLGKAAKEAEANLRRQRRLVRSQVLKYMVPGARVIRGLDWKWRDQDGSPQGEGTVTGELHNGTTQSWSSLVKNNCPDKTSAAAGSSSRKGSSSSVCSVASSSDISLGSTKTERRSEIVMEHSIVSGADVHEPIVVLSSAENVPQTEVGSSSSASTSTLTAETGSENAERKLGPDSSVRTPGESSAISMGIVSVSSPDVSSVSELTNKEAASQRPLSSSASNRLSVSSLLAAGAPMSSSASVPNLSSRETSSLESFVRRVANIARTNATNNMNLSRSSSDNNTNTLGRNVMSTATSPLMGAQSFPNLTTPGTTSTVTMSTSSVTSSSNVATATTVLSVGQSLSNTLTTSLTSTSSESDTGQEAEYSLYDFLDSCRASTLLAELDDDEDLPEPDEEDDENEDDNQEDQEYEEVMILRRPSLQRRAGSRSDVTHHAVTSQLPQVPAGAGSRPIGEQEEEEYETKGGRRRTWDDDYVLKRQFSALVPAFDPRPGRTNVQQTTDLEIPPPGTPHSELLEEVECTPSPRLALTLKVTGLGTTREVELPLTNFRSTIFYYVQKLLQLSCNGNVKSDKLRRIWEPTYTIMYREMKDSDKEKENGKMGCWSIEHVEQYLGTDELPKNDLITYLQKNADAAFLRHWKLTGTNKSIRKNRNCSQLIAAYKDFCEHGTKSGLNQGAISTLQSSDILNLTKEQPQAKAGNGQNSCGVEDVLQLLRILYIVASDPYSRISQEDGDEQPQFTFPPDEFTS

SEQ ID NO: 37518 - protein, 926 aa, Homo sapiens
  Payload ID: 7450
  Gene Symbol: HECTD1
  Gene Name: HECT domain containing E3 ubiquitin protein ligase 1
  ENSP ID: ENSP00000452015
MADVDPDTLLEWLQMGQGDERDMQLIALEQLCMLLLMSDNVDRCFETCPPRTFLPALCKIFLDESAPDNVLEVTARAITYYLDVSAECTRRIVGVDGAIKALCNRLVVVELNNRTSRDLAEQCVKVLELICTRESGAVFEAGGLNCVLTFIRDSGHLVHKDTLHSAMAVVSRLCGKMEPQDSSLEICVESLSSLLKHEDHQVSDGALRCFASLADRFTRRGVDPAPLAKHGLTEELLSRMAAAGGTVSGPSSACKPGRSTTGAPSTTADSKLSNQVSTIVSLLSTLCRGSPVVTHDLLRSELPDSIESALQGDERCVLDTMRLVDLLLVLLFEGRKALPKSSAGSTGRIPGLRRLDSSGERSHRQLIDCIRSKDTDALIDAIDTGAFEVNFMDDVGQTLLNWASAFGTQEMVEFLCERGADVNRGQRSSSLHYAACFGRPQVAKTLLRHGANPDLRDEDGKTPLDKARERGHSEVVAILQSPGDWMCPVNKGDDKKKKDTNKDEEECNEPKGDPEMAPIYLKRLLPVFAQTFQQTMLPSIRKASLALIRKMIHFCSEALLKEVCDSDVGHNLPTILVEITATVLDQEDDDDGHLLALQIIRDLVDKGGDIFLDQLARLGVISKVSTLAGPSSDDENEEESKPEKEDEPQEDAKELQQGKPYHWRDWSIIRGRDCLYIWSDAAALELSNGSNGWFRFILDGKLATMYSSGSPEGGSDSSESRSEFLEKLQRARGQVKPSTSSQPILSAPGPTKLTVGNWSLTCLKEGEIAIHNSDGQQATILKEDLPGFVFESNRGTKHSFTAETSLGSEFVTGWTGKRGRKLKSKLEKTKQKVRTMARDLYDDHFKAVESMPRGVVVTLRNIATQLESSWELHTNRQCIESENTWRDLMKTALENLIVLLKDENTISPYEMCSSGLVQALLTVLNN

SEQ ID NO: 37519 - protein, 185 aa, Homo sapiens
  Payload ID: 7450
  Gene Symbol: HECTD1
  Gene Name: HECT domain containing E3 ubiquitin protein ligase 1
  ENSP ID: ENSP00000452233
  MOD_RES (1)..(1): Any amino acid
XSKDGQNWTSLYTHVDDCSLNEPGSTATWPLDPPKDEKQGWRHVRIKQMGKNASGQTHYLSLSGFELYGTVNGVCEDQLGKAAKEAEANLRRQRRLVRSQVLKYMVPGARVIRGLDWKWRDQDGSPQGEGTVTGELHNASPLMGAQSFPNLTTPGTTSTVTMSTSSVTSSSNVATATTVLSVGQS

SEQ ID NO: 37520 - protein, 212 aa, Homo sapiens
  Payload ID: 7450
  Gene Symbol: HECTD1
  Gene Name: HECT domain containing E3 ubiquitin protein ligase 1
  ENSP ID: ENSP00000479695
  MOD_RES (1)..(1): Any amino acid
XDSSLEICVESLSSLLKHEDHQVSDGALRCFASLADRFTRRGVDPAPLAKHGLTEELLSRMAAAGGTVSGPSSACKPGRSTTGAPSTTADSKLSNQVSTIVSLLSTLCRGSPVVTHDLLRSELPDSIESALQGDERCVLDTMRLVDLLLVLLFEGRKALPKSSAGSTGRIPGLRRLDSSGERSHRQLIDCIRSKDTDALIDAIDTGGQKIFF

SEQ ID NO: 37521 - protein, 2614 aa, Homo sapiens [sequence omitted]

SEQ ID NO: 37522 - protein, 776 aa, Homo sapiens
  Payload ID: 7451
  Gene Symbol: HECTD2
  Gene Name: HECT domain containing E3 ubiquitin protein ligase 2
  Uniprot ID: Q5U5R9
  ENSP ID: ENSP00000298068
MSEAVRVPSPATPLVVAAPAPEERKGKESEREKLPPIVSAGAGATAGLDRGAKGQISTFSSFISAVSPKKEAAENRSSPAHLVFPNIKNVREPPPICLDVRQKQRTSMDASSSEMKAPVLPEPILPIQPKTVKDFQEDVEKVKSSGDWKAVHDFYLTTFDSFPELNAAFKKDATASFNTIEDSGINAKFVNAVYDTLLNTPQDVQKTVLKGIINSLLREWKGPRTKDDLRAYFILLQNPQFNNTSTYVIYAHLLRQIATLVEADHHFLVHWFKKLSQKRFKQLVERLLQFISLRLFPAKPEEFPPITKCSWWIPSAAKVLALLNTANNLVHPPLIPYTDFYNSTLDHIDLMEEYHTWQNFGNSHRFSFCQYPFVISVAAKKIIIQRDSEQQMINIARQSLVDKVSRRQRPDMNILFLNMKVRRTHLVSDSLDELTRKRADLKKKLKVTFVGEAGLDMGGLTKEWFLLLIRQIFHPDYGMFTYHKDSHCHWFSSFKCDNYSEFRLVGILMGLAVYNSITLDIRFPPCCYKKLLSPPIIPSDQNIPVGICNVTVDDLCQIMPELAHGLSELLSHEGNVEEDFYSTFQVFQEEFGIIKSYNLKPGGDKISVTNQNRKEYVQLYTDFLLNKSIYKQFAAFYYGFHSVCASNALMLLRPEEVEILVCGSPDLDMHALQRSTQYDGYAKTDLTIKYFWDVVLGFPLDLQKKLLHFTTGSDRVPVGGMADLNFKISKNETSTNCLPVAHTCFNQLCLPPYKSKKDLKQKLIIGISNSEGFGLE

SEQ ID NO: 37523 - protein, 426 aa, Homo sapiens
  Payload ID: 7451
  Gene Symbol: HECTD2
  Gene Name: HECT domain containing E3 ubiquitin protein ligase 2
  ENSP ID: ENSP00000360731
MEEYHTWQNFGNSHRFSFCQYPFVISVAAKKIIIQRDSEQQMINIARQSLVDKVSRRQRPDMNILFLNMKVRRTHLVSDSLDELTRKRADLKKKLKVTFVGEAGLDMGGLTKEWFLLLIRQIFHPDYGMFTYHKDSHCHWFSSFKCDNYSEFRLVGILMGLAVYNSITLDIRFPPCCYKKLLSPPIIPSDQNIPVGICNVTVDDLCQIMPELAHGLSELLSHEGNVEEDFYSTFQVFQEEFGIIKSYNLKPGGDKISVTNQNRKEYVQLYTDFLLNKSIYKQFAAFYYGFHSVCASNALMLLRPEEVEILVCGSPDLDMHALQRSTQYDGYAKTDLTIKYFWDVVLGFPLDLQKKLLHFTTGSDRVPVGGMADLNFKISKNETSTNCLPVAHTCFNQLCLPPYKSKKDLKQKLIIGISNSEGFGLE

SEQ ID NO: 37524 - protein, 207 aa, Homo sapiens
  Payload ID: 7451
  Gene Symbol: HECTD2
  Gene Name: HECT domain containing E3 ubiquitin protein ligase 2
  Uniprot ID: Q5U5R9
  ENSP ID: ENSP00000360746
MSEAVRVPSPATPLVVAAPAPEERKGKESEREKLPPIVSAGAGATAGLDRGAKGQISTFSSFISAVSPKKEAAENRSSPAHLVFPNIKNVREPPPICLDVRQKQRTSMDASSSEMKAPVLPEPILPIQPKTVKDFQEDVEKVKSSGDWKAVHDFYLTTFDSFPELNAAFKKDATASFNTIEDSGINAKFVNAVYDTLLNTVSIMTCK

SEQ ID NO: 37525 - protein, 780 aa, Homo sapiens
  Payload ID: 7451
  Gene Symbol: HECTD2
  Gene Name: HECT domain containing E3 ubiquitin protein ligase 2
  ENSP ID: ENSP00000401023
MSEAVRVPSPATPLVVAAPAPEERKGKESEREKLPPIVSAGAGATAGLDRGAKGQISTFSSFISAVSPKKEAAENRSSPAHLVFPNIKNVREPPPICLDVRQKQRTSMDASSSEMKAPVLPEPILPIQPKTVKDFQEDVEKVKSSGDWKAVHDFYLTTFDSFPELNAAFKKDATASFNTIEDSGINAKFVNAVYDTLLNTPQDVQKTVLKGIINSLLREWKGPRTKDDLRAYFILLQNPQFNNTSTYVIYAHLLRQIATLVEADHHFLVHWFKKQYSRLSQKRFKQLVERLLQFISLRLFPAKPEEFPPITKCSWWIPSAAKVLALLNTANNLVHPPLIPYTDFYNSTLDHIDLMEEYHTWQNFGNSHRFSFCQYPFVISVAAKKIIIQRDSEQQMINIARQSLVDKVSRRQRPDMNILFLNMKVRRTHLVSDSLDELTRKRADLKKKLKVTFVGEAGLDMGGLTKEWFLLLIRQIFHPDYGMFTYHKDSHCHWFSSFKCDNYSEFRLVGILMGLAVYNSITLDIRFPPCCYKKLLSPPIIPSDQNIPVGICNVTVDDLCQIMPELAHGLSELLSHEGNVEEDFYSTFQVFQEEFGIIKSYNLKPGGDKISVTNQNRKEYVQLYTDFLLNKSIYKQFAAFYYGFHSVCASNALMLLRPEEVEILVCGSPDLDMHALQRSTQYDGYAKTDLTIKYFWDVVLGFPLDLQKKLLHFTTGSDRVPVGGMADLNFKISKNETSTNCLPVAHTCFNQLCLPPYKSKKDLKQKLIIGISNSEGFGLE

SEQ ID NO: 37526 - protein, 23 aa, Homo sapiens
  Payload ID: 7451
  Gene Symbol: HECTD2
  Gene Name: HECT domain containing E3 ubiquitin protein ligase 2
  ENSP ID: ENSP00000487686
MDASSSEMKAPVLPEPILPIQPK

SEQ ID NO: 37527 - protein, 471 aa, Homo sapiens
  Payload ID: 7452
  Gene Symbol: HECTD3
  Gene Name: HECT domain containing E3 ubiquitin protein ligase 3
  Uniprot ID: Q5T447
  ENSP ID: ENSP00000361241
MLGSWGCYRYAKLFSCSLSTHARFIKILDSVLHHLVPAWDHTLGTFSEIKQVKQFLLLSRQRPGLVAQCLRDSESSKPSFMPRLYINRRLAMEHRACPSRDPACKNAVFTQVYEGLKPSDKYEKPLDYRWPMRYDQWWECKFIAEGIIDQGGGFRDSLADMSEELCPSSADTPVPLPFFVRTANQGNGTGEARDMYVPNPSCRDFAKYEWIGQLMGAALRGKEFLVLALPGFVWKQLSGEEVSWSKDFPAVDSVLVKLLEVMEGMDKETFEFKFGKELTFTTVLSDQQVVELIPGGAGIVVGYGDRSRFIQLVQKARLEESKEQVAAMQAGLLKVVPQAVLDLLTWQELEKKVCGDPEVTVDALRKLTRFEDFEPSDSRVQYFWEALNNFTNEDRSRFLRFVTGRSRLPARIYIYPDKLGYETTDALPESSTCSSTLFLPHYASAKVCEEKLRYAAYNCVAIDTDMSPWEE

SEQ ID NO: 37528 - protein, 861 aa, Homo sapiens
  Payload ID: 7452
  Gene Symbol: HECTD3
  Gene Name: HECT domain containing E3 ubiquitin protein ligase 3
  Uniprot ID: Q5T447
  ENSP ID: ENSP00000361245
MAGPGPGAVLESPRQLLGRVRFLAEAARSLRAGRPLPAALAFVPREVLYKLYKDPAGPSRVLLPVWEAEGLGLRVGAAGPAPGTGSGPLRAARDSIELRRGACVRTTGEELCNGHGLWVKLTKEQLAEHLGDCGLQEGWLLVCRPAEGGARLVPIDTPNHLQRQQQLFGVDYRPVLRWEQVVDLTYSHRLGSRPQPAEAYAEAVQRLLYVPPTWTYECDEDLIHFLYDHLGKEDENLGSVKQYVESIDVSSYTEEFNVSCLTDSNADTYWESDGSQCQHWVRLTMKKGTIVKKLLLTVDTTDDNFMPKRVVVYGGEGDNLKKLSDVSIDETLIGDVCVLEDMTVHLPIIEIRIVECRDDGIDVRLRGVKIKSSRQRELGLNADLFQPTSLVRYPRLEGTDPEVLYRRAVLLQRFIKILDSVLHHLVPAWDHTLGTFSEIKQVKQFLLLSRQRPGLVAQCLRDSESSKPSFMPRLYINRRLAMEHRACPSRDPACKNAVFTQVYEGLKPSDKYEKPLDYRWPMRYDQWWECKFIAEGIIDQGGGFRDSLADMSEELCPSSADTPVPLPFFVRTANQGNGTGEARDMYVPNPSCRDFAKYEWIGQLMGAALRGKEFLVLALPGFVWKQLSGEEVSWSKDFPAVDSVLVKLLEVMEGMDKETFEFKFGKELTFTTVLSDQQVVELIPGGAGIVVGYGDRSRFIQLVQKARLEESKEQVAAMQAGLLKVVPQAVLDLLTWQELEKKVCGDPEVTVDALRKLTRFEDFEPSDSRVQYFWEALNNFTNEDRSRFLRFVTGRSRLPARIYIYPDKLGYETTDALPESSTCSSTLFLPHYASAKVCEEKLRYAAYNCVAIDTDMSPWEE

SEQ ID NO: 37529 - protein, 4416 aa, Homo sapiens
  Payload ID: 7453
  Gene Symbol: HECTD4
  Gene Name: HECT domain containing E3 ubiquitin protein ligase 4
  ENSP ID: ENSP00000366783
MGSSAAAAAAAAAAADSAQWLSVKEETIFLHDGLIRVTDLAELPSEILGAPEAADTDLEILTFETKNPSELAERLRSVCGNQSNAYARLLEYRLNALRGLWNAQRQLALEEQHERESSGDEETLALLKRQGLLQQPEQAPFTSRMGLLLVFPLIQSQSRTDPSLCNITAEVLLNCLRDCQPLSLTKEPADCLNGIETLLCSWLEETSDTGRHIPHKQKENAAAALVALACARGSLKTFVHTVHLLQKQTDLGSLPVADVLYRLLLLEGGPGSPSCLLGGKHIVSWGYEDMLPAPDSNTGSSSENKDADLGRCLTADGLYLYTTNSVGRGVSKLGSGLHGTLRGFVYCRNEELEPGWVAFGSGSLLHRPVSFDNKPHSLFQVIDQNTLQVCQVVPMPANHLPIGSTMSTVHLSSDGTYFYWIWSPASLNEKTPKGHSVFMDIFELVVENGVFVANPLQERTILMRKEGESAKSINEMLLSRLSRYRASPSATLAALTGSTISNTLKEDQAANTSCGLPLKMLRKTPIYTCGTYLVMLVPPPGGSGSSATRSLFGGTSGLSSLKILASSLVYNISDGQFTSRADLIDAAGSSLGRGALVPGLGACYDTVNNMLWTCSNDYIDQWCNPGNQAFHYVCQRLGVSHIITEPKEEAITTNEVINQLLHHVGAMCIHQLNLLATNPNLPITSVLGKQHPIEAHHLSSICDIMEKAMVNGDTCIIRCILVVFQVVFKFFFSPQTERNRDIIRRSGLLLWQLLMAPKDQICPEIQKEVCLAISSGLNILYPGETEINNLLKLVLTEGERNSGLSQLRDVILTNLAEQLQNNRFGSDEDDHYRLNDELLHYILKIVVRESCILITKCQTVSKDDFQKLLSTVPAASSCLRYLMAVQNHLLSNTILIKPDENDDSDSSLQGETLKELKVSILALATQILTGCDEVLEMLQQVTTALINSDIADREQRLKGLEQVTKATMLGHLLPVLLTSLMHPNLQTLIMADALMPQLVQLVLYTSQTALLLKTQCPVFAEVGCSPCGAPDQKCRLFPDERMLEEKEEPGFLTGLKIPAPWAAGKTVETVHPVRDNYKFKETVHIPGARCLYLRFDSRCSSQYDYDKLVIYAGPNTNSRKVAEYGGNTLGYGSRSVLGTGWPKDLVKVEGDTVTFSFEMRSGREHNTPDKAMWGFACTVRAQESSEDVSGGLPFLVDLALGLSVLACSMLRILYNGPEITKEEEACQELLRSKLLQRCQWQVEANGVISPALTPSPSPLPLTIEEDREFTYPSDVLVPPVGNYFDLPRIRLPPGIMIKLREISGRARPQFRPSIKEVIQPDVMEEMVVSCVIKHLNLVDALQSLINFQYQEEHAEEYDLLCKIMGETFKKLNAMERQLQSVAELEQKWQSEVDDAMQGKLENNMPFFYDYHFNENKMKELELLCSMKEVSFDGNDLENMVLSLREKFLQEVNSLIQKPSHPLAKTKTLVKSLMNRAELLLHVTIAAQSGLTRSISGTPAETPACKSASETKVISHAVRQPVFLRSMSAPSDLEMIGNEDLEFTRANQRRRHVTSHRSSSFTLLQSLAIEDSRDKPTYSVLLGQLFAFIGTNPDQAVSSSSFLLAAQTRWRRGNTRKQALVHMRELLTAAVRVGGVTHLVGPVTMVLQGGPRIEELTCGGMVEQVQEAFGETMTSVVSLCARYPIACANSIGLLCTIPYTRSEEKCLVRSGLVQLMDRLCSLSNQTESSSSEKQTKKQKVATMAWAAFQVLANRCVEWEKEEGGSTEAVHSGLARQVSSLLTNHLARATECCGNQAAGNDALQDVLSLLNDLSRSHIGKAILSQPACVSKLLSLLLDQRPSPKLVLIILQLCRAALPLMSVEDCGNVELPPWSYSVPSLNSEQEDPSDPASKIASLLLAKLADYVVPGCQTVLSPTASEPDTTLTKTSPKNSLKGDKDPGEESEAVDGKLSIFIHKREDQSSHEVLQPLLSSSEGRPFRLGTGANMEKVVKMDRDMTKGGCCEVITEEAAAALRKATKWAQSGLIVSIGPPVESINPETVSGLSTGDKKKTAQTSICRERNSELARTDPVRPFISGHVANSMAAEVIALLHSLLMAPESNAAQIWTTTAEKVLSRALMYIPQLGKYAESILENGSSSGRKLAKLQRIARQAVAALCALGGFKETIKIGSEVQVLGRGISGSIGVVASINEQEGIATVRFPPIDCRKTSQASDTLTIPLSRLCVPRSEALPLHKLSITEKVVQAVQSMLLPQEGSLSIHTSLPATGDGSAPVMAVVRLLAEIRTRACLVMAQLLEDSLFCEEFIQQCPAAVEVLNLVAQECSAGERLAVVEVQCERLRMLYRDCARPPPPPLQADRRQPKEITWSPSRVFPPVRACMFSSHLTSVTFLADPSAGGGLPRGTFIYATSPLPVQAPSFYWEIEIVSYGDTDDDTGPIVSFGFTTEAEKRDGAWTNPVGTCLFHNNGRAVHYNGSSLLQWKSVRLDVTLSPGDVAGIGWERTEGTPPPPGQPAKGRVYFTYCGQRLSPYLEDVSGGMWPVVHIQKKNTKTRANFGSRPFAYAEGQAHRNAADLCTDLAEEISANFEALPFAMASDSDNDAGTSIASDPGTHGPPCRIAAVATAQQQYDSDTSCHYKVELSYENFITSGPDPHPPPIADDESDDDDDDDIPQEDHYALLVKAWETKVFPTIRRRFRNEAERKSGLDQIKGALQLGMVDIARQTVEFLYEENGGIPRDLYLPTIEDIKDEANKFTIDKVRKGLTVVTRSPDSNNVASSAVGTALPKFAIRGMLKTFGLHGVVLDVDSVNELVQVETYLRSEGVLVRYWYPIDMLERPPAGYRRTATNGLVTLDNTNLQIHRELLRCEAALARLYCRMALLNIFAPKLPHLFTRLFHIPAIRDITLEHLQLLSNQLLAPPLPDGTISSSSILLAQSLQHCIHSQNCSATDLFYQGNSQTVREWLNVAITRTLHQGEESLLELTKQICSFLQTAPEQFPSEEFPISESKVNMDVNFPGAAFVVVSCKESQSGFRKDSSLYKAPWARVLVYGLGHKVKRNGQLNLIEAACYPRDASPANTGLAPPPTADQYPSVVLSTDRVHIKLGVSPPPGAVLVLHSLPLEFPLAMAFAEQLLSWKSEDSEGKSEDEPDTIPTSVLLQVVELLGNFLWTTDMAACVKELVFHLLAELLRTVHTLEQRRHPAGLSSSIALQLNPCLAMLMALQSELHKLYDEETQNWVSGGACGGSGGAAAGDQGRFSTYFHALMEGCLAVAEVTLPTNMSVTASGVTSATAPNLSDSSSSSSSSPGQTPQSPSLLSKRKKVKMKREKASSSGKRQSSRTVDSDPTVLSIGGSKPEDMLWFHRALTLLIILRHLTRKDPQGLGVTSDAIADACQALVGPTAHSRLLVISGIPTHLDEGVVRGAIRKACNAHGGVFKDEIYIPLQEEDTKKPKDKAEGGDGKVEPEKTLAFPGTDSMEVSTSSSLTPAMSISASASTSQASICSSQGISQTVSDLSVDPLPAGLELPIPPGLLEPHAVSSQESLDISLCSTGSLGSLGSLGEPLDNAETASVSDMGSMYTVTSLDNQPLAARPIKGFAVVEIRSRAKIEKIRASLFNNNDLIGLSSLDGEDELMEMSTEEILTVSVVNQSLFDTQGSPGLEDYFNDKSIKGEKLVPGAREVLTEIFKSCAHSEQTLSLTPAKPIRVSDIYLSKEQINSQTPGNLLHLFFTNVRPPKKVLEDQLTQILRKYGVPKPKFDKSKYSKAGKEQHPVKVVSTKRPITKPPAKDKAVLNSVSRTALSEKKPTVKPKSPEKSKPDEKDPEKSPTKKQEVPEEKYLTLEGFHKFVIDRARQDIRSVWRAILSCGYDLHFERCACIDVRHAQKASRKWTLEMDVALVQYINQLCRHLAITPARLHPHEVYLDPADAADPRVACLLNVPIESLRLRFALLQSLNTTLETFFLPLVELRQTPMYTHSIAALLKEAKGLIFYDTKVTVMNRVLNATVQRTADHAAPEITLDPLEIVGGEIRASENSYFCQAARQLASVPSSQLCVKLASGGDPTYAFNIRFTGEEVHGTSGSFRHFLWQVCKELQSSSLSLLLLCPSSAVNKNKGKYILTPSPITYGEEQLLHFLGQLLGIAIRADVPLPLDLLPSFWKTLVGEPLDPEQDLQEADILTYNYVKKFESINDETELEALCAEIASQHLATESPDSPNKPCCRFTYLTMTGEEVELCSRGRHILVAWENKDIYAAAIRSLRLRELQNVECVTAVRAGLGSIIPLQLLTMLSPLEMELRTCGLPYINLEFLKAHTMYQVGLMETDQHIEFFWGALEMFTQEELCKFIKFACNQERIPFTCPCKDGGPDTAHVPPYPMKIAPPDGTAGSPDSRYIRVETCMFMIKLPQYSSLEIMLEKLRCAIHYREDPLSG

SEQ ID NO: 37530 - protein, 109 aa, Homo sapiens
  Payload ID: 7453
  Gene Symbol: HECTD4
  Gene Name: HECT domain containing E3 ubiquitin protein ligase 4
  ENSP ID: ENSP00000448061
AAADSAQWLSVKEETIFLHDGLIRVTDLAELPSEILGAPEAADTDLEILTFETKNPSELAERLRSVCGNQSNAYARLLEYRLNALRGLWNAQRQLALEEQHERESSGGI

SEQ ID NO: 37531 - protein, 4284 aa, Homo sapiens
  Payload ID: 7453
  Gene Symbol: HECTD4
  Gene Name: HECT domain containing E3 ubiquitin protein ligase 4
  ENSP ID: ENSP00000449784
MGLLLVFPLIQSQSRTDPSLCNITAEVLLNCLRDCQPLSLTKEPADCLNGIETLLCSWLEETSDTGRHIPHKQKENAAAALVALACARGSLKTFVHTVHLLQKQTDLGSLPVADVLYRLLLLEGGPGSPSCLLGGKHIVSWGYEDMLPAPDSNTGSSSENKDADLGRCLTADGLYLYTTNSVGRGVSKLGSGLHGTLRGFVYCRNEELEPGWVAFGSGSLLHRPVSFDNKPHSLFQVIDQNTLQVCQVVPMPANHLPIGSTMSTVHLSSDGTYFYWIWSPASLNEKTPKGHSVFMDIFELVVENGVFVANPLQERTILMRKEGESAKSINEMLLSRLSRYRASPSATLAALTGSTISNTLKEDQAANTSCGLPLKMLRKTPIYTCGTYLVMLVPPPGGSGSSATRSLFGGTSGLSSLKILASSLVYNISDGQFTSRADLIDAAGSSLGRGALVPGLGACYDTVNNMLWTCSNDYIDQWCNPGNQAFHYVCQRLGVSHIITEPKEEAITTNEVINQLLHHVGAMCIHQLNLLATNPNLPITSVLGKQHPIEAHHLSSICDIMEKAMVNGDTCIIRCILVVFQVVFKFFFSPQTERNRDIIRRSGLLLWQLLMAPKDQICPEIQKEVCLAISSGLNILYPGETEINNLLKLVLTEGERNSGLSQLRDVILTNLAEQLQNNRFGSDEDDHYRLNDELLHYILKIVVRESCILITKCQTVSKDDFQKLLSTVPAASSCLRYLMAVQNHLLSNTILIKPDENDDSDSSLQGETLKVQELKVSILALATQILTGCDEVLEMLQQVTTALINSDIADREQRLKGLEQVTKATMLGHLLPVLLTSLMHPNLQTLIMADALMPQLVQLVLYTSQTALLLKTQCPVFAEVGCSPCGAPDQKCRLFPDERMLEEKEEPGFLTGLKIPAPWAAGKTVETVHPVRDNYKFKETVHIPGARCLYLRFDSRCSSQYDYDKLVIYAGPNTNSRKVAEYGGNTLGYGSRSVLGTGWPKDLVKCISPPSLNFKVEGDTVTFSFEMRSGREHNTPDKAMWGFACTVRAQESSEDVSGGLPFLVDLALGLSVLACSMLRILYNGPEITKEEEACQELLRSKLLQRCQWQVEANGVISPALTPSPSPLPLTIEEDREFTYPSDVLVPPVGNYFDLPRIRLPPGIMIKLREISGRARPQFRPSIKEVIQPDVMEEMVVSCVIKHLNLVDALQSLINFQYQEEHAEEYDLLCKIMGETFKKLNAMERQLQSVAELEQKWQSEVDDAMQGKLENNMPFFYDYHFNENKMKELELLCSMKEVSFDGNDLENMVLSLREKFLQEVNSLIQKPSHPLAKTKTLVKSLMNRAELLLHVTIAAQSGLTRSISGTPAETPACKSASETKVISHAVRQPVFLRSMSAPSDLEMIGNEDLEFTRANQRRRHVTSHRSSSFTLLQSLAIEDSRDKPTYSVLLGQLFAFIGTNPDQAVSSSSFLLAAQTRWRRGNTRKQALVHMRELLTAAVRVGGVTHLVGPVTMVLQGGPRIEELTCGGMVEQVQEAFGETMTSVVSLCARYPIACANSIGLLCTIPYTRSEEKCLVRSGLVQLMDRLCSLSNQTESSSSEKQTKKQKVATMAWAAFQVLANRCVEWEKEEGGSTEAVHSGLARQVSSLLTNHLARATECCGNQAAGNDALQDVLSLLNDLSRSHIGKAILSQPACVSKLLSLLLDQRPSPKLVLIILQLCRAALPLMSVEDCGNVELPPWSYSVPSLNSEQEDPSDPASKIASLLLAKLADYVVPGCQTVLSPTASEPDTTLTKTSPKNSLKGDKDPGEESEAVDGKLSIFIHKREDQSSHEVLQPLLSSSEGRPFRLGTGANMEKVVKMDRDMTKGGCCEVITEEAAAALRKATKWAQSGLIVSIGPPVESINPETVSGLSTGDKKKTAQTSICRERNSELARTDPVRPFISGHVANSMAAEVIALLHSLLMAPESNAAQIWTTTAEKVLSRALMYIPQLGKYAESILENGSSSGRKLAKLQRIARQAVAALCALGGFKETIKIGSEVQVLGRGISGSIGVVASINEQEGIATVRFPPIDCRKTSQASDTLTIPLSRLCVPRSEALPLHKLSITEKVVQAVQSMLLPQEGSLSIHTSLPATGDGSAPVMAVVRLLAEIRTRACLVMAQLLEDSLFCEEFIQQCPAAVEVLNLVAQECSAGERLAVVEVQCERLRMLYRDCARPPPPPLQADRRQPKEITWSPSRVFPPVRACMFSSHLTSVTFLADPSAGGGLPRGTFIYATSPLPVQAPSFYWEIEIVSYGDTDDDTGPIVSFGFTTEAEKRDGAWTNPVGTCLFHNNGRAVHYNGSSLLQWKSVRLDVTLSPGDVAGIGWERTEGTPPPPGQPAKGRVYFTYCGQRLSPYLEDVSGGMWPVVHIQKKNTKTRANFGSRPFAYAEGQAHRNAADLCTDLAEEISANFEALPFAMASDSDNDAGTSIASDPGTHGPPCRIAAVATAQQQYDSDTSCHYKVELSYENFITSGPDPHPPPIADDESDDDDDDDIPQEDHYALLVKAWETKVFPTIRRRFRNEAERKSGLDQIKGALQLGMVDIARQTVEFLYEENGGIPRDLYLPTIEDIKDEANKFTIDKVRKGLTVVTRSPDSNNVASSAVGTALPKFAIRGMLKTFGLHGVVLDVDSVNELVQVETYLRSEGVLVRYWYPIDMLERPPAGYRRTATNGLVTLDNTNLQIHRELLRCEAALARLYCRMALLNIFAPKLPHLFTRLFHIPAIRDITLEHLQLLSNQLLAPPLPDGTISSSSILLAQSLQHCIHSQNCSATDLFYQGNSQTVREWLNVAITRTLHQGEESLLELTKQICSFLQTAPEQFPSEEFPISESKVNMDVNFPGAAFVVVSCKESQSGFRKDSSLYKAPWARVLVYGLGHKVKRNGQLNLIEAACYPRDASPANTGLAPPPTADQYPSVVLSTDRVHIKLGVSPPPGAVLVLHSLPLEFPLAMAFAEQLLSWKSEDSEGKSEDEPDTIPTSVLLQVVELLGNFLWTTDMAACVKELVFHLLAELLRTVHTLEQRRHPAGLSSSIALQLNPCLAMLMALQSELHKLYDEETQNWVSGGACGGSGGAAAGDQGRFSTYFHALMEGCLAVAEVTLPTNMSVTASGVTSATAPNLSDSSSSSSSSPGQTPQSPSLLSKRKKVKMKREKASSSGKRQSSRTVDSDPTVLSIGGSKPEDMLWFHRALTLLIILRHLTRKDPQGLGVTSDAIADACQALVGPTAHSRLLVISGIPTHLDEGVVRGAIRKACNAHGGVFKDEIYIPLQEEDTKKPKDKAEGGDGKVEPEKTLAFPGTDSMEVSTSSSLTPAMSISASASTSQASICSSQGISQTVSDLSVDPLPAGLELPIPPGLLEPHAVSSQESLDISLCSTGSLGSLGSLGEPLDNAETASVSDMGSMYTVTSLDNQPLAARPIKGFAVVEIRSRAKIEKIRASLFNNNDLIGLSSLDGEDELMEMSTEEILTVSVVNQSLFDTQGSPGLEDYFNDKSIKGEKLVPGAREVLTEIFKSCAHSEQTLSLTPAKPIRVSDIYLSKEQINSQTPGNLLHLFFTNVRPPKKVLEDQLTQILRKYGVPKPKFDKSKYSKAGKEQHPVKVVSTKRPITKPPAKDKAVLNSVSRTALSEKKPTVKPKSPEKSKPDEKDPEKSPTKKQEVPEEKYLTLEGFHKFVIDRARQDIRSVWRAILSCGYDLHFERCACIDVRHAQKASRKWTLEMDVALVQYINQLCRHLAITPARLHPHEVYLDPADAADPRVACLLNVPIESLRLRFALLQSLNTTLETFFLPLVELRQTPMYTHSIAALLKEAKGLIFYDTKVTVMNRVLNATVQRTADHAAPEITLDPLEIVGGEIRASENSYFCQAARQLASVPSSQLCVKLASGGDPTYAFNIRFTGEEVHGTSGSFRHFLWQVCKELQSSSLSLLLLCPSSAVNKNKGKYILTPSPITYGEEQLLHFLGQLLGIAIRADVPLPLDLLPSFWKTLVGEPLDPEQDLQEADILTYNYVKKFESINDETELEALCAEIASQHLATESPDSPNKPCCRFTYLTMTGEEVELCSRGRHILVAWENKDIYAAAIRSLRLRELQNVECVTAVRAGLGSIIPLQLLTMLSPLEMELRTCGLPYINLEFLKAHTMYQVGLMETDQHIEFFWGALEMFTQEELCKFIKFACNQERIPFTCPCKDGGPDTAHVPPYPMKIAPPDGTAGSPDSRYIRVETCMFMIKLPQYSSLEIMLEKLRCAIHYREDPLSG

SEQ ID NO: 37532 - protein, 262 aa, Homo sapiens
  Payload ID: 7453
  Gene Symbol: HECTD4
  Gene Name: HECT domain containing E3 ubiquitin protein ligase 4
  ENSP ID: ENSP00000477079
  MOD_RES (1)..(1): Any amino acid
XRTALSEKKPTVKPKSPEKSKPDEKDPEKSPTKKQEVPEEKYLTLEGFHKFVIDRARQDIRSVWRAILSCGYDLHFERCACIDVRHAQKASRKWTLEMDVALVQYINQLCRHLAITPARLHPHEVYLDPADAADPRVACLLMIGLPVLPVSQASQPPGRDLSLTAPAPSDVPIESLRLRFALLQSLNTTLETFFLPLVELRQTPMYTHSIAALLKEAKGQCLHLPWPCRKREVTCKTPGPESTGSVLGQPRQEDATPPQPFM

SEQ ID NO: 37533 - protein, 1606 aa, Homo sapiens
  Payload ID: 7454
  Gene Symbol: HECW1
  Gene Name: HECT, C2 and WW domain containing E3 ubiquitin protein ligase 1
  Uniprot ID: Q76N89
  ENSP ID: ENSP00000379228
MLLHLCSVKNLYQNRFLGLAAMASPSRNSQSRRRCKEPLRYSYNPDQFHNMDLRGGPHDGVTIPRSTSDTDLVTSDSRSTLMVSSSYYSIGHSQDLVIHWDIKEEVDAGDWIGMYLIDEVLSENFLDYKNRGVNGSHRGQIIWKIDASSYFVEPETKICFKYYHGVSGALRATTPSVTVKNSAAPIFKSIGADETVQGQGSRRLISFSLSDFQAMGLKKGMFFNPDPYLKISIQPGKHSIFPALPHHGQERRSKIIGNTVNPIWQAEQFSFVSLPTDVLEIEVKDKFAKSRPIIKRFLGKLSMPVQRLLERHAIGDRVVSYTLGRRLPTDHVSGQLQFRFEITSSIHPDDEEISLSTEPESAQIQDSPMNNLMESGSGEPRSEAPESSESWKPEQLGEGSVPDGPGNQSIELSRPAEEAAVITEAGDQGMVSVGPEGAGELLAQVQKDIQPAPSAEELAEQLDLGEEASALLLEDGEAPASTKEEPLEEEATTQSRAGREEEEKEQEEEGDVSTLEQGEGRLQLRASVKRKSRPCSLPVSELETVIASACGDPETPRTHYIRIHTLLHSMPSAQGGSAAEEEDGAEEESTLKDSSEKDGLSEVDTVAADPSALEEDREEPEGATPGTAHPGHSGGHFPSLANGAAQDGDTHPSTGSESDSSPRQGGDHSCEGCDASCCSPSCYSSSCYSTSCYSSSCYSASCYSPSCYNGNRFASHTRFSSVDSAKISESTVFSSQDDEEEENSAFESVPDSMQSPELDPESTNGAGPWQDELAAPSGHVERSPEGLESPVAGPSNRREGECPILHNSQPVSQLPSLRPEHHHYPTIDEPLPPNWEARIDSHGRVFYVDHVNRTTTWQRPTAAATPDGMRRSGSIQQMEQLNRRYQNIQRTIATERSEEDSGSQSCEQAPAGGGGGGGSDSEAESSQSSLDLRREGSLSPVNSQKITLLLQSPAVKFITNPEFFTVLHANYSAYRVFTSSTCLKHMILKVRRDARNFERYQHNRDLVNFINMFADTRLELPRGWEIKTDQQGKSFFVDHNSRATTFIDPRIPLQNGRLPNHLTHRQHLQRLRSYSAGEASEVSRNRGASLLARPGHSLVAAIRSQHQHESLPLAYNDKIVAFLRQPNIFEMLQERQPSLARNHTLREKIHYIRTEGNHGLEKLSCDADLVILLSLFEEEIMSYVPLQAAFHPGYSFSPRCSPCSSPQNSPGLQRASARAPSPYRRDFEAKLRNFYRKLEAKGFGQGPGKIKLIIRRDHLLEGTFNQVMAYSRKELQRNKLYVTFVGEEGLDYSGPSREFFFLLSQELFNPYYGLFEYSANDTYTVQISPMSAFVENHLEWFRFSGRILGLALIHQYLLDAFFTRPFYKALLRLPCDLSDLEYLDEEFHQSLQWMKDNNITDILDLTFTVNEEVFGQVTERELKSGGANTQVTEKNKKEYIERMVKWRVERGVVQQTEALVRGFYEVVDSRLVSVFDARELELVIAGTAEIDLNDWRNNTEYRGGYHDGHLVIRWFWAAVERFNNEQRLRLLQFVTGTSSVPYEGFAALRGSNGLRRFCIEKWGKITSLPRAHTCFNRLDLPPYPSYSMLYEKLLTAVEETSTFGLE

SEQ ID NO: 37534 - protein, 1572 aa, Homo sapiens
  Payload ID: 7454
  Gene Symbol: HECW1
  Gene Name: HECT, C2 and WW domain containing E3 ubiquitin protein ligase 1
  Uniprot ID: Q76N89
  ENSP ID: ENSP00000407774
MLLHLCSVKNLYQNRFLGLAAMASPSRNSQSRRRCKEPLRYSYNPDQFHNMDLRGGPHDGVTIPRSTSDTDLVTSDSRSTLMVSSSYYSIGHSQDLVIHWDIKEEVDAGDWIGMYLIDEVLSENFLDYKNRGVNGSHRGQIIWKIDASSYFVEPETKICFKYYHGVSGALRATTPSVTVKNSAAPIFKSIGADETVQGQGSRRLISFSLSDFQAMGLKKGMFFNPDPYLKISIQPGKHSIFPALPHHGQERRSKIIGNTVNPIWQAEQFSFVSLPTDVLEIEVKDKFAKSRPIIKRFLGKLSMPVQRLLERHAIGDRVVSYTLGRRLPTDHVSGQLQFRFEITSSIHPDDEEISLSTEPESAQIQDSPMNNLMESGSGEPRSEAPESSESWKPEQLGEGSVPDGPGNQSIELSRPAEEAAVITEAGDQGMVSVGPEGAGELLAQVQKDIQPAPSAEELAEQLDLGEEASALLLEDGEAPASTKEEPLEEEATTQSRAGREEEEKEQEEEGDVSTLEQGEGRLQLRASVKRKSRPCSLPVSELETVIASACGDPETPRTHYIRIHTLLHSMPSAQGGSAAEEEDGAEEESTLKDSSEKDGLSEVDTVAADPSALEEDREEPEGATPGTAHPGHSGGHFPSLANGAAQDGDTHPSTGSESDSSPRQGGDHSCEGCDASCCSPSCYSSSCYSTSCYSSSCYSASCYSPSCYNGNRFASHTRFSSVDSAKISESTVFSSQDDEEEENSAFESVPDSMQSPELDPESTNGAGPWQDELAAPSGHVERSPEGLESPVAGPSNRREDWEARIDSHGRVFYVDHVNRTTTWQRPTAAATPDGMRRSGSIQQMEQLNRRYQNIQRTIATERSEEDSGSQSCEQAPAGGGGGGGSDSEAESSQSSLDLRREGSLSPVNSQKITLLLQSPAVKFITNPEFFTVLHANYSAYRVFTSSTCLKHMILKVRRDARNFERYQHNRDLVNFINMFADTRLELPRGWEIKTDQQGKSFFVDHNSRATTFIDPRIPLQNGRLPNHLTHRQHLQRLRSYSAGEASEVSRNRGASLLARPGHSLVAAIRSQHQHESLPLAYNDKIVAFLRQPNIFEMLQERQPSLARNHTLREKIHYIRTEGNHGLEKLSCDADLVILLSLFEEEIMSYVPLQAAFHPGYSFSPRCSPCSSPQNSPGLQRASARAPSPYRRDFEAKLRNFYRKLEAKGFGQGPGKIKLIIRRDHLLEGTFNQVMAYSRKELQRNKLYVTFVGEEGLDYSGPSREFFFLLSQELFNPYYGLFEYSANDTYTVQISPMSAFVENHLEWFRFSGRILGLALIHQYLLDAFFTRPFYKALLRLPCDLSDLEYLDEEFHQSLQWMKDNNITDILDLTFTVNEEVFGQVTERELKSGGANTQVTEKNKKEYIERMVKWRVERGVVQQTEALVRGFYEVVDSRLVSVFDARELELVIAGTAEIDLNDWRNNTEYRGGYHDGHLVIRWFWAAVERFNNEQRLRLLQFVTGTSSVPYEGFAALRGSNGLRRFCIEKWGKITSLPRAHTCFNRLDLPPYPSYSMLYEKLLTAVEETSTFGLE

SEQ ID NO: 37535 - protein, 138 aa, Homo sapiens
  Payload ID: 7454
  Gene Symbol: HECW1
  Gene Name: HECT, C2 and WW domain containing E3 ubiquitin protein ligase 1
  ENSP ID: ENSP00000413336
  MOD_RES (1)..(1): Any amino acid
XPRIPLQNGRLPNHLTHRQHLQRLRSYSAGEARVQWCDLGSLQPPPPRFKQFSCLSLSSSWDYRFRFSGRILGLALIHQYLLDAFFTRPFYKALLRLPCDLSDLEYLDEEFHQSLQWMKDNNITDILDLTFTVNEEVF

SEQ ID NO: 37536 - protein, 1572 aa, Homo sapiens
  Payload ID: 7455
  Gene Symbol: HECW2
  Gene Name: HECT, C2 and WW domain containing E3 ubiquitin protein ligase 2
  Uniprot ID: Q9P2P5
  ENSP ID: ENSP00000260983
MASSAREHLLFVRRRNPQMRYTLSPENLQSLAAQSSMPENMTLQRANSDTDLVTSESRSSLTASMYEYTLGQAQNLIIFWDIKEEVDPSDWIGLYHIDENSPANFWDSKNRGVTGTQKGQIVWRIEPGPYFMEPEIKICFKYYHGISGALRATTPCITVKNPAVMMGAEGMEGGASGNLHSRKLVSFTLSDLRAVGLKKGMFFNPDPYLKMSIQPGKKSSFPTCAHHGQERRSTIISNTTNPIWHREKYSFFALLTDVLEIEIKDKFAKSRPIIKRFLGKLTIPVQRLLERQAIGDQMLSYNLGRRLPADHVSGYLQFKVEVTSSVHEDASPEAVGTILGVNSVNGDLGSPSDDEDMPGSHHDSQVCSNGPVSEDSAADGTPKHSFRTSSTLEIDTEELTSTSSRTSPPRGRQDSLNDYLDAIEHNGHSRPGTATCSERSMGASPKLRSSFPTDTRLNAMLHIDSDEEDHEFQQDLGYPSSLEEEGGLIMFSRASRADDGSLTSQTKLEDNPVENEEASTHEAASFEDKPENLPELAESSLPAGPAPEEGEGGPEPQPSADQGSAELCGSQEVDQPTSGADTGTSDASGGSRRAVSETESLDQGSEPSQVSSETEPSDPARTESVSEASTRPEGESDLECADSSCNESVTTQLSSVDTRCSSLESARFPETPAFSSQEEEDGACAAEPTSSGPAEGSQESVCTAGSLPVVQVPSGEDEGPGAESATVPDQEELGEVWQRRGSLEGAAAAAESPPQEEGSAGEAQGTCEGATAQEEGATGGSQANGHQPLRSLPSVRQDVSRYQRVDEALPPNWEARIDSHGRIFYVDHVNRTTTWQRPTAPPAPQVLQRSNSIQQMEQLNRRYQSIRRTMTNERPEENTNAIDGAGEEADFHQASADFRRENILPHSTSRSRITLLLQSPPVKFLISPEFFTVLHSNPSAYRMFTNNTCLKHMITKVRRDTHHFERYQHNRDLVGFLNMFANKQLELPRGWEMKHDHQGKAFFVDHNSRTTTFIDPRLPLQSSRPTSALVHRQHLTRQRSHSAGEVGEDSRHAGPPVLPRPSSTFNTVSRPQYQDMVPVAYNDKIVAFLRQPNIFEILQERQPDLTRNHSLREKIQFIRTEGTPGLVRLSSDADLVMLLSLFEEEIMSYVPPHALLHPSYCQSPRGSPVSSPQNSPGTQRANARAPAPYKRDFEAKLRNFYRKLETKGYGQGPGKLKLIIRRDHLLEDAFNQIMGYSRKDLQRNKLYVTFVGEEGLDYSGPSREFFFLVSRELFNPYYGLFEYSANDTYTVQISPMSAFVDNHHEWFRFSGRILGLALIHQYLLDAFFTRPFYKALLRILCDLSDLEYLDEEFHQSLQWMKDNDIHDILDLTFTVNEEVFGQITERELKPGGANIPVTEKNKKEYIERMVKWRIERGVVQQTESLVRGFYEVVDARLVSVFDARELELVIAGTAEIDLSDWRNNTEYRGGYHDNHIVIRWFWAAVERFNNEQRLRLLQFVTGTSSIPYEGFASLRGSNGPRRFCVEKWGKITALPRAHTCFNRLDLPPYPSFSMLYEKLLTAVEETSTFGLE

SEQ ID NO: 37537 - protein, 1216 aa, Homo sapiens
  Payload ID: 7455
  Gene Symbol: HECW2
  Gene Name: HECT, C2 and WW domain containing E3 ubiquitin protein ligase 2
  Uniprot ID: Q9P2P5
  ENSP ID: ENSP00000386775
MPGSHHDSQVCSNGPVSEDSAADGTPKHSFRTSSTLEIDTEELTSTSSRTSPPRGRQDSLNDYLDAIEHNGHSRPGTATCSERSMGASPKLRSSFPTDTRLNAMLHIDSDEEDHEFQQDLGYPSSLEEEGGLIMFSRASRADDGSLTSQTKLEDNPVENEEASTHEAASFEDKPENLPELAESSLPAGPAPEEGEGGPEPQPSADQGSAELCGSQEVDQPTSGADTGTSDASGGSRRAVSETESLDQGSEPSQVSSETEPSDPARTESVSEASTRPEGESDLECADSSCNESVTTQLSSVDTRCSSLESARFPETPAFSSQEEEDGACAAEPTSSGPAEGSQESVCTAGSLPVVQVPSGEDEGPGAESATVPDQEELGEVWQRRGSLEGAAAAAESPPQEEGSAGEAQGTCEGATAQEEGATGGSQANGHQPLRSLPSVRQDVSRYQRVDEALPPNWEARIDSHGRIFYVDHVNRTTTWQRPTAPPAPQVLQRSNSIQQMEQLNRRYQSIRRTMTNERPEENTNAIDGAGEEADFHQASADFRRENILPHSTSRSRITLLLQSPPVKFLISPEFFTVLHSNPSAYRMFTNNTCLKHMITKVRRDTHHFERYQHNRDLVGFLNMFANKQLELPRGWEMKHDHQGKAFFVDHNSRTTTFIDPRLPLQSSRPTSALVHRQHLTRQRSHSAGEVGEDSRHAGPPVLPRPSSTFNTVSRPQYQDMVPVAYNDKIVAFLRQPNIFEILQERQPDLTRNHSLREKIQFIRTEGTPGLVRLSSDADLVMLLSLFEEEIMSYVPPHALLHPSYCQSPRGSPVSSPQNSPGTQRANARAPAPYKRDFEAKLRNFYRKLETKGYGQGPGKLKLIIRRDHLLEDAFNQIMGYSRKDLQRNKLYVTFVGEEGLDYSGPSREFFFLVSRELFNPYYGLFEYSANDTYTVQISPMSAFVDNHHEWFRFSGRILGLALIHQYLLDAFFTRPFYKALLRILCDLSDLEYLDEEFHQSLQWMKDNDIHDILDLTFTVNEEVFGQITERELKPGGANIPVTEKNKKEYIERMVKWRIERGVVQQTESLVRGFYEVVDARLVSVFDARELELVIAGTAEIDLSDWRNNTEYRGGYHDNHIVIRWFWAAVERFNNEQRLRLLQFVTGTSSIPYEGFASLRGSNGPRRFCVEKWGKITALPRAHTCFNRLDLPPYPSFSMLYEKLLTAVEETSTFGLE

SEQ ID NO: 37538 - protein, 118 aa, Homo sapiens
  Payload ID: 7455
  Gene Symbol: HECW2
  Gene Name: HECT, C2 and WW domain containing E3 ubiquitin protein ligase 2
  ENSP ID: ENSP00000395770
MASSAREHLLFVRRRNPQMRYTLSPENLQSLAAQSSMPENMTLQRANSDTDLVTSESRSSLTASMYEYTLGQAQNLIIFWDIKEEVDPSDWIGLYHIDENSPANFWDSKNRGVTGTQK

SEQ ID NO: 37539 - protein, 133 aa, Homo sapiens
  Payload ID: 7455
  Gene Symbol: HECW2
  Gene Name: HECT, C2 and WW domain containing E3 ubiquitin protein ligase 2
  ENSP ID: ENSP00000409918
MASSAREHLLFVRRRNPQMRYTLSPENLQSLAAQSSMPENMTLQRANSDTDLVTSESRSSLTASMYEYTLGQAQNLIIFWDIKEEVDPSDWIGLYHIDENSPANFWDSKNRGVTGTQKGQIVWRIEPGPYFME

SEQ ID NO: 37540 - protein, 4374 aa, Homo sapiens
  Payload ID: 7456
  Gene Symbol: HUWE1
  Gene Name: HECT, UBA and WWE domain containing 1, E3 ubiquitin protein ligase
  Uniprot ID: Q7Z6Z7
  ENSP ID: ENSP00000262854
MKVDRTKLKKTPTEAPADCRALIDKLKVCNDEQLLLELQQIKTWNIGKCELYHWVDLLDRFDGILADAGQTVENMSWMLVCDRPEREQLKMLLLAVLNFTALLIEYSFSRHLYSSIEHLTTLLASSDMQVVLAVLNLLYVFSKRSNYITRLGSDKRTPLLTRLQHLAESWGGKENGFGLAECCRDLHMMKYPPSATTLHFEFYADPGAEVKIEKRTTSNTLHYIHIEQLDKISESPSEIMESLTKMYSIPKDKQMLLFTHIRLAHGFSNHRKRLQAVQARLHAISILVYSNALQESANSILYNGLIEELVDVLQITDKQLMEIKAASLRTLTSIVHLERTPKLSSIIDCTGTASYHGFLPVLVRNCIQAMIDPSMDPYPHQFATALFSFLYHLASYDAGGEALVSCGMMEALLKVIKFLGDEQDQITFVTRAVRVVDLITNLDMAAFQSHSGLSIFIYRLEHEVDLCRKECPFVIKPKIQRPNTTQEGEEMETDMDGVQCIPQRAALLKSMLNFLKKAIQDPAFSDGIRHVMDGSLPTSLKHIISNAEYYGPSLFLLATEVVTVFVFQEPSLLSSLQDNGLTDVMLHALLIKDVPATREVLGSLPNVFSALCLNARGLQSFVQCQPFERLFKVLLSPDYLPAMRRRRSSDPLGDTASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAGTLSSIPTALTRWTEECKVLDAESMHDCVSVVKVSIVNHLEFLRDEELEERREKRRKQLAEEETKITDKGKEDKENRDQSAQCTASKSNDSTEQNLSDGTPMPDSYPTTPSSTDAATSESKETLGTLQSSQQQPTLPTPPALGEVPQELQSPAGEGGSSTQLLMPVEPEELGPTRPSGEAETTQMELSPAPTITSLSPERAEDSDALTAVSSQLEGSPMDTSSLASCTLEEAVGDTSAAGSSEQPRAGSSTPGDAPPAVAEVQGRSDGSGESAQPPEDSSPPASSESSSTRDSAVAISGADSRGILEEPLPSTSSEEEDPLAGISLPEGVDPSFLAALPDDIRREVLQNQLGIRPPTRTAPSTNSSAPAVVGNPGVTEVSPEFLAALPPAIQEEVLAQQRAEQQRRELAQNASSDTPMDPVTFIQTLPSDLRRSVLEDMEDSVLAVMPPDIAAEAQALRREQEARQRQLMHERLFGHSSTSALSAILRSPAFTSRLSGNRGVQYTRLAVQRGGTFQMGGSSSHNRPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAASTTPTPPTAPTPVTSAPALVAATAISTIVVAASTTVTTPTTATTTVSISPTTKGSKSPAKVSDGGSSSTDFKMVSSGLTENQLQLSVEVLTSHSCSEEGLEDAANVLLQLSRGDSGTRDTVLKLLLNGARHLGYTLCKQIGTLLAELREYNLEQQRRAQCETLSPDGLPEEQPQTTKLKGKMQSRFDMAENVVIVASQKRPLGGRELQLPSMSMLTSKTSTQKFFLRVLQVIIQLRDDTRRANKKAKQTGRLGSSGLGSASSIQAAVRQLEAEADAIIQMVREGQRARRQQQAATSESSQSEASVRREESPMDVDQPSPSAQDTQSIASDGTPQGEKEKEERPPELPLLSEQLSLDELWDMLGECLKELEESHDQHAVLVLQPAVEAFFLVHATERESKPPVRDTRESQLAHIKDEPPPLSPAPLTPATPSSLDPFFSREPSSMHISSSLPPDTQKFLRFAETHRTVLNQILRQSTTHLADGPFAVLVDYIRVLDFDVKRKYFRQELERLDEGLRKEDMAVHVRRDHVFEDSYRELHRKSPEEMKNRLYIVFEGEEGQDAGGLLREWYMIISREMFNPMYALFRTSPGDRVTYTINPSSHCNPNHLSYFKFVGRIVAKAVYDNRLLECYFTRSFYKHILGKSVRYTDMESEDYHFYQGLVYLLENDVSTLGYDLTFSTEVQEFGVCEVRDLKPNGANILVTEENKKEYVHLVCQMRMTGAIRKQLAAFLEGFYEIIPKRLISIFTEQELELLISGLPTIDIDDLKSNTEYHKYQSNSIQIQWFWRALRSFDQADRAKFLQFVTGTSKVPLQGFAALEGMNGIQKFQIHRDDRSTDRLPSAHTCFNQLDLPAYESFEKLRHMLLLAIQECSEGFGLA

SEQ ID NO: 37541 - protein, 4374 aa, Homo sapiens; identical to SEQ ID NO: 37540
  Payload ID: 7456
  Gene Symbol: HUWE1
  Gene Name: HECT, UBA and WWE domain containing 1, E3 ubiquitin protein ligase
  Uniprot ID: Q7Z6Z7
  ENSP ID: ENSP00000340648

SEQ ID NO: 37542 - protein, 1197 aa, Homo sapiens
  Payload ID: 7456
  Gene Symbol: HUWE1
  Gene Name: HECT, UBA and WWE domain containing 1, E3 ubiquitin protein ligase
  ENSP ID: ENSP00000403236
  MOD_RES (1)..(1): Any amino acid
XPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAASTTPTPPTAPTPVTSAPALVAATAISTIVVAASTTVTTPTTATTTVSISPTTKGSKSPAKVSDGGSSSTDFKMVSSGLTENQLQLSVEVLTSHSCSEEGLEDAANVLLQLSRGDSGTRDTVLKLLLNGARHLGYTLCKQIGTLLAELREYNLEQQRRAQCETLSPDGLPEEQPQTTKLKGKMQSRFDMAENVVIVASQKRPLGGRELQLPSMSMLTSKTSTQKFFLRVLQVIIQLRDDTRRANKKAKQTGRLGSSGLGSASSIQAAVRQLEAEADAIIQMSESSQSEASVRREESPMDVDQPSPSAQDTQSIASDGTPQGEKEKEERPPELPLLSEQLSLDELWDMLGECLKELEESHDQHAVLVLQPAVEAFFLVHATERESKPPVRDTRESQLAHIKDEPPPLSPAPLTPATPSSLDPFFSREPSSMHISSSLPPDTQKFLRFAETHRTVLNQILRQSTTHLADGPFAVLVDYIRVLDFDVKRKYFRQELERLDEGLRKEDMAVHVRRDHVFEDSYRELHRKSPEEMKNRLYIVFEGEEGQDAGGLLREWYMIISREMFNPMYALFRTSPGDRVTYTINPSSHCNPNHLSYFKFVGRIVAKAVYDNRLLECYFTRSFYKHILGKSVRYTDMESEDYHFYQGLVYLLENDVSTLGYDLTFSTEVQEFGVCEVRDLKPNGANILVTEENKKEYVHLVCQMRMTGAIRKQLAAFLEGFYEIIPKRLISIFTEQELELLISGLPTIDIDDLKSNTEYHKYQSNSIQIQWFWRALRSFDQADRAKFLQFVTGTSKVPLQGFAALEGMNGIQKFQIHRDDRSTDRLPSAHTCFNQLDLPAYESFEKLRHMLLLAIQECSEGFGLA

SEQ ID NO: 37543 - protein, 92 aa, Homo sapiens
  Payload ID: 7456
  Gene Symbol: HUWE1
  Gene Name: HECT, UBA and WWE domain containing 1, E3 ubiquitin protein ligase
  ENSP ID: ENSP00000413651
MKVDRTKLKKTPTEAPADCRALIDKLKVCNDEQLLLELQQIKTWNIGKCELYHWVDLLDRFDGILADAGQTVENMSWMLVCDRPEREQLKML

SEQ ID NO: 37544 - protein, 4365 aa, Homo sapiens
  Payload ID: 7456
  Gene Symbol: HUWE1
  Gene Name: HECT, UBA and WWE domain containing 1, E3 ubiquitin protein ligase
  Uniprot ID: Q7Z6Z7
  ENSP ID: ENSP00000479451
MKVDRTKLKKTPTEAPADCRALIDKLKVCNDEQLLLELQQIKTWNIGKCELYHWVDLLDRFDGILADAGQTVENMSWMLVCDRPEREQLKMLLLAVLNFTALLIEYSFSRHLYSSIEHLTTLLASSDMQVVLAVLNLLYVFSKRSNYITRLGSDKRTPLLTRLQHLAESWGGKENGFGLAECCRDLHMMKYPPSATTLHFEFYADPGAEVKIEKRTTSNTLHYIHIEQLDKISESPSEIMESLTKMYSIPKDKQMLLFTHIRLAHGFSNHRKRLQAVQARLHAISILVYSNALQESANSILYNGLIEELVDVLQITDKQLMEIKAASLRTLTSIVHLERTPKLSSIIDCTGTASYHGFLPVLVRNCIQAMIDPSMDPYPHQFATALFSFLYHLASYDAGGEALVSCGMMEALLKVIKFLGDEQDQITFVTRAVRVVDLITNLDMAAFQSHSGLSIFIYRLEHEVDLCRKECPFVIKPKIQRPNTTQEGEEMETDMDGVQCIPQRAALLKSMLNFLKKAIQDPAFSDGIRHVMDGSLPTSLKHIISNAEYYGPSLFLLATEVVTVFVFQEPSLLSSLQDNGLTDVMLHALLIKDVPATREVLGSLPNVFSALCLNARGLQSFVQCQPFERLFKVLLSPDYLPAMRRRRSSDPLGDTASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKADGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAGTLSSIPTALTRWTEECKVLDAESMHDCVSVVKVSIVNHLEFLRDEELEERREKRRKQLAEEETKITDKGKEDKENRDQSAQCTASKSNDSTEQNLSDGTPMPDSYPTTPSSTDAATSESKETLGTLQSSQQQPTLPTPPALGEVPQELQSPAGEGGSSTQLLMPVEPEELGPTRPSGEAETTQMELSPAPTITSLSPERAEDSDALTAVSSQLEGSPMDTSSLASCTLEEAVGDTSAAGSSEQPRAGSSTPGDAPPAVAEVQGRSDGSGESAQPPEDSSPPASSESSSTRDSAVAISGADSRGILEEPLPSTSSEEEDPLAGISLPEGVDPSFLAALPDDIRREVLQNQLGIRPPTRTAPSTNSSAPAVVGNPGVTEVSPEFLAALPPAIQEEVLAQQRAEQQRRELAQNASSDTPMDPVTFIQTLPSDLRRSVLEDMEDSVLAVMPPDIAAEAQALRREQEARQRQLMHERLFGHSSTSALSAILRSPAFTSRLSGNRGVQYTRLAVQRGGTFQMGGSSSHNRPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAASTTPTPPTAPTPVTSAPALVAATAISTIVVAASTTVTTPTTATTTVSISPTTKGSKSPAKVSDGGSSSTDFKMVSSGLTENQLQLSVEVLTSHSCSEEGLEDAANVLLQLSRGDSGTRDTVLKLLLNGARHLGYTLCKQIGTLLAELREYNLEQQRRAQCETLSPDGLPEEQPQTTKLKGKMQSRFDMAENVVIVASQKRPLGGRELQLPSMSMLTSKTSTQKFFLRVLQVIIQLRDDTRRANKKAKQTGRLGSSGLGSASSIQAAVRQLEAEADAIIQMVREGQRARRQQQAATSESSQSEASVRREESPMDVDQPSPSAQDTQSIASDGTPQGEKEKEERPPELPLLSEQLSLDELWDMLGECLKELEESHDQHAVLVLQPAVEAFFLVHATERESKPPVRDTRESQLAHIKDEPPPLSPAPLTPATPSSLDPFFSREPSSMHISSSLPPDTQKFLRFAETHRTVLNQILRQSTTHLADGPFAVLVDYIRVLDFDVKRKYFRQELERLDEGLRKEDMAVHVRRDHVFEDSYRELHRKSPEEMKNRLYIVFEGEEGQDAGGLLREWYMIISREMFNPMYALFRTSPGDRVTYTINPSSHCNPNHLSYFKFVGRIVAKAVYDNRLLECYFTRSFYKHILGKSVRYTDMESEDYHFYQGLVYLLENDVSTLGYDLTFSTEVQEFGVCEVRDLKPNGANILVTEENKKEYVHLVCQMRMTGAIRKQLAAFLEGFYEIIPKRLISIFTEQELELLISGLPTIDIDDLKSNTEYHKYQSNSIQIQWFWRALRSFDQADRAKFLQFVTGTSKVPLQGFAALEGMNGIQKFQIHRDDRSTDRLPSAHTCFNQLDLPAYESFEKLRHMLLLAIQECSEGFGLA

SEQ ID NO: 37545 - protein, 191 aa, Homo sapiens
  Payload ID: 7456
  Gene Symbol: HUWE1
  Gene Name: HECT, UBA and WWE domain containing 1, E3 ubiquitin protein ligase
  ENSP ID: ENSP00000483891
  MOD_RES (1)..(1): Any amino acid
XTPTPPTAPTPVTSAPALVAATAISTIVVAASTTVTTPTTATTTVSISPTTKGSKSPAKVSDGGSSSTDFKMVSSGLTENQLQLSVEVLTSHSCSEEGLEDAANVLLQLSRGDSGTRDTVLKLLLNGARHLGYTLCKQIGTLLAELREYNLEQQRRAQCETLSPDGLPEEQPQTTKLKGKMQSRFLRFRLS

SEQ ID NO: 37546 - protein, 230 aa, Homo sapiens
  Payload ID: 7456
  Gene Symbol: HUWE1
  Gene Name: HECT, UBA and WWE domain containing 1, E3 ubiquitin protein ligase
  ENSP ID: ENSP00000484417
  MOD_RES (1)..(1): Any amino acid
XVSCGMMEALLKVIKFLGDEQDQITFVTRAVRVVDLITNLDMAAFQSHSGLSIFIYRLEHEVDLCRKECPFVIKPKIQRPNTTQEGEEMETDMDVADVAMESSPGSSISMEHRLDVELRASGSSSSTNISSGPSPGPSPGPGTGPGPGPGPGPGPGPGPGPGPGPGPGPGPGPGPRPGVQCIPQRAALLKSMLNFLKKAIQDPAFSDGIRHVMDGSLPTSLKHIISNAEY

SEQ ID NO: 37547 - protein, 493 aa, Homo sapiens
  Payload ID: 7457
  Gene Symbol: HHAT
  Gene Name: hedgehog acyltransferase
  Uniprot ID: Q5VTY9
  ENSP ID: ENSP00000261458
MLPRWELALYLLASLGFHFYSFYEVYKVSREHEEELDQEFELETDTLFGGLKKDATDFEWSFWMEWGKQWLVWLLLGHMVVSQMATLLARKHRPWILMLYGMWACWCVLGTPGVAMVLLHTTISFCVAQFRSQLLTWLCSLLLLSTLRLQGVEEVKRRWYKTENEYYLLQFTLTVRCLYYTSFSLELCWQQLPAASTSYSFPWMLAYVFYYPVLHNGPILSFSEFIKQMQQQEHDSLKASLCVLALGLGRLLCWWWLAELMAHLMYMHAIYSSIPLLETVSCWTLGGLALAQVLFFYVKYLVLFGVPALLMRLDGLTPPALPRCVSTMFSFTGMWRYFDVGLHNFLIRYVYIPVGGSQHGLLGTLFSTAMTFAFVSYWHGGYDYLWCWAALNWLGVTVENGVRRLVETPCIQDSLARYFSPQARRRFHAALASCSTSMLILSNLVFLGGNEVGKTYWNRIFIQGWPWVTLSVLGFLYCYSHVGIAWAQTYATD

SEQ ID NO: 37548 - protein, 183 aa, Homo sapiens
  Payload ID: 7457
  Gene Symbol: HHAT
  Gene Name: hedgehog acyltransferase
  ENSP ID: ENSP00000355976
MRLDGLTPPALPRCVSTMFSFTGMWRYFDVGLHNFLIRYVYIPVGGSQHGLLGTLFSTAMTFAFVSYWHGGYDYLWCWAALNWLGVTVENGVRRLVETPCIQDSLARYFSPQARRRFHAALASCSTSMLILSNLVFLGGNEVGKTYWNRIFIQGWPWVTLSVLGFLYCYSHVGIAWAQTYATD

SEQ ID NO: 37549 - protein, 493 aa, Homo sapiens; identical to SEQ ID NO: 37547
  Payload ID: 7457
  Gene Symbol: HHAT
  Gene Name: hedgehog acyltransferase
  Uniprot ID: Q5VTY9
  ENSP ID: ENSP00000355977

SEQ ID NO: 37550 - protein, 207 aa, Homo sapiens
  Payload ID: 7457
  Gene Symbol: HHAT
  Gene Name: hedgehog acyltransferase
  ENSP ID: ENSP00000413399
MEWGKQWLVWLLLGHMVVSQMATLLARKRRWYKTENEYYLLQFTLTVRCLYYTSFSLELCWQQLPAASTSYSFPWMLAYVFYYPVLHNGPILSFSEFIKQMQQQEHDSLKASLCVLALGLGRLLCWWWLAELMAHLMYMHAIYSSIPLLETVSCWTLGGLALAQVLFFYVKYLVLFGVPALLMRLDGLTPPALPRCVSTMFSFTGMW

SEQ ID NO: 37551 - protein, 493 aa, Homo sapiens; identical to SEQ ID NO: 37547
  Payload ID: 7457
  Gene Symbol: HHAT
  Gene Name: hedgehog acyltransferase
  Uniprot ID: Q5VTY9
  ENSP ID: ENSP00000416845

SEQ ID NO: 37552 - protein, 494 aa, Homo sapiens
  Payload ID: 7457
  Gene Symbol: HHAT
  Gene Name: hedgehog acyltransferase
  Uniprot ID: Q5VTY9
  ENSP ID: ENSP00000438468
MSLGLGSAERGVLGTRGARERCRRRRPGQPGEHEEELDQEFELETDTLFGGLKKDATDFEWSFWMEWGKQWLVWLLLGHMVVSQMATLLARKHRPWILMLYGMWACWCVLGTPGVAMVLLHTTISFCVAQFRSQLLTWLCSLLLLSTLRLQGVEEVKRRWYKTENEYYLLQFTLTVRCLYYTSFSLELCWQQLPAASTSYSFPWMLAYVFYYPVLHNGPILSFSEFIKQMQQQEHDSLKASLCVLALGLGRLLCWWWLAELMAHLMYMHAIYSSIPLLETVSCWTLGGLALAQVLFFYVKYLVLFGVPALLMRLDGLTPPALPRCVSTMFSFTGMWRYFDVGLHNFLIRYVYIPVGGSQHGLLGTLFSTAMTFAFVSYWHGGYDYLWCWAALNWLGVTVENGVRRLVETPCIQDSLARYFSPQARRRFHAALASCSTSMLILSNLVFLGGNEVGKTYWNRIFIQGWPWVTLSVLGFLYCYSHVGIAWAQTYATD

SEQ ID NO: 37553 - protein, 82 aa, Homo sapiens
  Payload ID: 7457
  Gene Symbol: HHAT
  Gene Name: hedgehog acyltransferase
  ENSP ID: ENSP00000439229
MTFAFVSYWHGGYDYLWCWAALNWLGVTVENGVRRLVETPCIQDSLVSRILAAVLGDSGTRQIRFIRDGAIRFPAPTMGPFY

SEQ ID NO: 37554 - protein, 428 aa, Homo sapiens
  Payload ID: 7457
  Gene Symbol: HHAT
  Gene Name: hedgehog acyltransferase
  Uniprot ID: Q5VTY9
  ENSP ID: ENSP00000442625
MLPRWELALYLLASLGFHFYSFYEVYKVSREHEEELDQEFELETDTLFGGLKKDATDFEWSFWMEWGKQWLVWLLLGHMVVSQMATLLARKRRWYKTENEYYLLQFTLTVRCLYYTSFSLELCWQQLPAASTSYSFPWMLAYVFYYPVLHNGPILSFSEFIKQMQQQEHDSLKASLCVLALGLGRLLCWWWLAELMAHLMYMHAIYSSIPLLETVSCWTLGGLALAQVLFFYVKYLVLFGVPALLMRLDGLTPPALPRCVSTMFSFTGMWRYFDVGLHNFLIRYVYIPVGGSQHGLLGTLFSTAMTFAFVSYWHGGYDYLWCWAALNWLGVTVENGVRRLVETPCIQDSLARYFSPQARRRFHAALASCSTSMLILSNLVFLGGNEVGKTYWNRIFIQGWPWVTLSVLGFLYCYSHVGIAWAQTYATD

SEQ ID NO: 37555 - protein, 356 aa, Homo sapiens
  Payload ID: 7457
  Gene Symbol: HHAT
  Gene Name: hedgehog acyltransferase
  Uniprot ID: Q5VTY9
  ENSP ID: ENSP00000444995
MLPRWELALYLLASLGFHFYSFYEVYKVSREHEEELDQEFELETDTLFGGLKKDATDFEWSFWMEWGKQWLVWLLLGHMVVSQMATLLARKMQQQEHDSLKASLCVLALGLGRLLCWWWLAELMAHLMYMHAIYSSIPLLETVSCWTLGGLALAQVLFFYVKYLVLFGVPALLMRLDGLTPPALPRCVSTMFSFTGMWRYFDVGLHNFLIRYVYIPVGGSQHGLLGTLFSTAMTFAFVSYWHGGYDYLWCWAALNWLGVTVENGVRRLVETPCIQDSLARYFSPQARRRFHAALASCSTSMLILSNLVFLGGNEVGKTYWNRIFIQGWPWVTLSVLGFLYCYSHVGIAWAQTYATD

SEQ ID NO: 37556 - protein, 504 aa, Homo sapiens
  Payload ID: 7458
  Gene Symbol: HHATL
  Gene Name: hedgehog acyltransferase-like
  Uniprot ID: Q9HCP6
  ENSP ID: ENSP00000310621
MGIKTALPAAELGLYSLVLSGALAYAGRGLLEASQDGAHRKAFRESVRPGWEYIGRKMDVADFEWVMWFTSFRNVIIFALSGHVLFAKLCTMVAPKLRSWMYAVYGALAVMGTMGPWYLLLLLGHCVGLYVASLLGQPWLCLGLGLASLASFKMDPLISWQSGFVTGTFDLQEVLFHGGSSFTVLRCTSFALESCAHPDRHYSLADLLKYNFYLPFFFFGPIMTFDRFHAQVSQVEPVRREGELWHIRAQAGLSVVAIMAVDIFFHFFYILTIPSDLKFANRLPDSALAGLAYSNLVYDWVKAAVLFGVVNTVACLDHLDPPQPPKCITALYVFAETHFDRGINDWLCKYVYNHIGGEHSAVIPELAATVATFAITTLWLGPCDIVYLWSFLNCFGLNFELWMQKLAEWGPLARIEASLSVQMSRRVRALFGAMNFWAIIMYNLVSLNSLKFTELVARRLLLTGFPQTTLSILFVTYCGVQLVKERERTLALEEEQKQDKEKPE

SEQ ID NO: 37557 - protein, 231 aa, Homo sapiens
  Payload ID: 7458
  Gene Symbol: HHATL
  Gene Name: hedgehog acyltransferase-like
  ENSP ID: ENSP00000395779
MGIKTALPAAELGLYSLVLSGALAYAGRGLLEASQDGAHRKAFRESVRPGWEYIGRKMDVADFEWVMWFTSFRNVIIFALSGHVLFAKLCTMVAPKLRSWMYAVYGALAVMGTMGPWYLLLLLGHCVGLYVASLLGQPWLCLGLGLASLASFKMDPLISWQSGFVTGTFDLQEVLFHGGSSFTVLRCTSFALESCAHPDRHYSLADLLKYNFYLPFFFFGPIMTFDRFHAQ

SEQ ID NO: 37558 - protein, 124 aa, Homo sapiens
  Payload ID: 7458
  Gene Symbol: HHATL
  Gene Name: hedgehog acyltransferase-like
  ENSP ID: ENSP00000401568
  MOD_RES (1)..(1): Any amino acid
XVLFGVVNTVACLDHLDPPQPPKCITALYVFAETHFDRGINDWLCKVRALFGAMNFWAIIMYNLVSLNSLKFTELVARRLLLTGFPQTTLSILFVTYCGVQLVKERERTLALEEEQKQDKEKPE

SEQ ID NO: 37559 - protein, 261 aa, Homo sapiens
  Payload ID: 7458
  Gene Symbol: HHATL
  Gene Name: hedgehog acyltransferase-like
  ENSP ID: ENSP00000403787
MGIKTALPAAELGLYSLVLSGALAYAGRGLLEASQDGAHRKAFRESVRPGWEYIGRKMDVADFEWVMWFTSFRNVIIFALSGHVLFAKLCTMVAPKSGFVTGTFDLQEVLFHGGSSFTVLRCTSFALESCAHPDRHYSLADLLKYNFYLPFFFFGPIMTFDRFHAQVSQVEPVRREGELWHIRAQAGLSVVAIMAVDIFFHFFYILTIPSDLKFANRLPDSALAGLAYSNLVYDWVKAAVLFGVVNTVACLDHLDPPQPPK

SEQ ID NO: 37560 - protein, 504 aa, Homo sapiens; identical to SEQ ID NO: 37556
  Payload ID: 7458
  Gene Symbol: HHATL
  Gene Name: hedgehog acyltransferase-like
  Uniprot ID: Q9HCP6
  ENSP ID: ENSP00000405423

SEQ ID NO: 37561 - protein, 117 aa, Homo sapiens
  Payload ID: 7458
  Gene Symbol: HHATL
  Gene Name: hedgehog acyltransferase-like
  ENSP ID: ENSP00000408999
MGIKTALPAAELGLYSLVLSGALAYAGRGLLEASQDGAHRKAFRESVRPGWEYIGRKMDVADFEWVMWFTSFRNVIIFALSGHVLFAKLCTMVAPKLRSWMYAVYGALAVMGTMGPW

SEQ ID NO: 37562 - protein, 116 aa, Homo sapiens
  Payload ID: 7458
  Gene Symbol: HHATL
  Gene Name: hedgehog acyltransferase-like
  ENSP ID: ENSP00000413810
MGIKTALPAAELGLYSLVLSGALAYAGRGLLEASQDGAHRKAFRESVRPGWEYIGRKMDVADFEWVMWFTSFRNVIIFALSGHVLFAKLCTMVAPKSGFVTGTFDLQEVLFHGGSS

SEQ ID NO: 37563 - protein, 203 aa, Homo sapiens
  Payload ID: 7458
  Gene Symbol: HHATL
  Gene Name: hedgehog acyltransferase-like
  ENSP ID: ENSP00000415351
MGIKTALPAAELGLYSLVLSGALAYAGRGLLEASQDGAHRKAFRESVRPGWEYIGRKMDVADFEWVMWFTSFRNVIIFALSGHVLFAKLCTMVAPKLRSWMYAVYGALAVMGTMGPWYLLLLLGHCVGLYVASLLGQPWLCLGLGLASLASFKMDPLISWQSGFVTGTFDLQEVLFHGGSSFTVLRCTSFALESCAHPDRHYS

SEQ ID NO: 37564 - protein, 700 aa, Homo sapiens
  Payload ID: 7459
  Gene Symbol: HHIP
  Gene Name: hedgehog interacting protein
  Uniprot ID: Q96QV1
  ENSP ID: ENSP00000296575
MLKMLSFKLLLLAVALGFFEGDAKFGERNEGSGARRRRCLNGNPPKRLKRRDRRMMSQLELLSGGEMLCGGFYPRLSCCLRSDSPGLGRLENKIFSVTNNTECGKLLEEIKCALCSPHSQSLFHSPEREVLERDLVLPLLCKDYCKEFFYTCRGHIPGFLQTTADEFCFYYARKDGGLCFPDFPRKQVRGPASNYLDQMEEYDKVEEISRKHKHNCFCIQEVVSGLRQPVGALHSGDGSQRLFILEKEGYVKILTPEGEIFKEPYLDIHKLVQSGIKGGDERGLLSLAFHPNYKKNGKLYVSYTTNQERWAIGPHDHILRVVEYTVSRKNPHQVDLRTARVFLEVAELHRKHLGGQLLFGPDGFLYIILGDGMITLDDMEEMDGLSDFTGSVLRLDVDTDMCNVPYSIPRSNPHFNSTNQPPEVFAHGLHDPGRCAVDRHPTDININLTILCSDSNGKNRSSARILQIIKGKDYESEPSLLEFKPFSNGPLVGGFVYRGCQSERLYGSYVFGDRNGNFLTLQQSPVTKQWQEKPLCLGTSGSCRGYFSGHILGFGEDELGEVYILSSSKSMTQTHNGKLYKIVDPKRPLMPEECRATVQPAQTLTSECSRLCRNGYCTPTGKCCCSPGWEGDFCRTAKCEPACRHGGVCVRPNKCLCKKGYLGPQCEQVDRNIRRVTRAGILDQIIDMTSYLLDLTSYIV

SEQ ID NO: 37565 - protein, 320 aa, Homo sapiens
  Payload ID: 7459
  Gene Symbol: HHIP
  Gene Name: hedgehog interacting protein
  Uniprot ID: Q96QV1
  ENSP ID: ENSP00000408587
MLKMLSFKLLLLAVALGFFEGDAKFGERNEGSGARRRRCLNGNPPKRLKRRDRRMMSQLELLSGGEMLCGGFYPRLSCCLRSDSPGLGRLENKIFSVTNNTECGKLLEEIKCALCSPHSQSLFHSPEREVLERDLVLPLLCKDYCKEFFYTCRGHIPGFLQTTADEFCFYYARKDGGLCFPDFPRKQVRGPASNYLDQMEEYDKVEEISRKHKHNCFCIQEVVSGLRQPVGALHSGDGSQRLFILEKEGYVKILTPEGEIFKEPYLDIHKLVQSGIKVGFLNFIYFCAGYVNFILVLPSSLKVFLCNKRKNLAGENKGAT

SEQ ID NO: 37566 - protein, 1087 aa, Homo sapiens
  Payload ID: 7460
  Gene Symbol: HELB
  Gene Name: helicase (DNA) B
  Uniprot ID: Q8NG08
  ENSP ID: ENSP00000247815
MARSSPYLRQLQGPLLPPRDLVEEDDDYLNDDVEEDEESVFIDAEELCSGGVKAGSLPGCLRVSICDENTQETCKVFGRFPITGAWWRVKVQVKPVVGSRSYQYQVQGFPSYFLQSDMSPPNQKHICALFLKECEVSSDDVNKFLTWVKEVSNYKNLNFENLRETLRTFHKETGRKDQKQPTQNGQEELFLDNEMSLPLENTIPFRNVMTALQFPKIMEFLPVLLPRHFKWIIGSGSKEMLKEIEEILGTHPWKLGFSKITYREWKLLRCEASWIAFCQCESLLQLMTDLEKNALIMYSRLKQICREDGHTYVEVNDLTLTLSNHMSFHAASESLKFLKDIGVVTYEKSCVFPYDLYHAERAIAFSICDLMKKPPWHLCVDVEKVLASIHTTKPENSSDDALNESKPDEVRLENPVDVVDTQDNGDHIWTNGENEINAEISEVQLDQDQVEVPLDRDQVAALEMICSNPVTVISGKGGCGKTTIVSRLFKHIEQLEEREVKKACEDFEQDQNASEEWITFTEQSQLEADKAIEVLLTAPTGKAAGLLRQKTGLHAYTLCQVNYSFYSWTQTMMTTNKPWKFSSVRVLVVDEGSLVSVGIFKSVLNLLCEHSKLSKLIILGDIRQLPSIEPGNLLKDLFETLKSRNCAIELKTNHRAESQLIVDNATRISRRQFPKFDAELNISDNPTLPISIQDKTFIFVRLPEEDASSQSSKTNHHSCLYSAVKTLLQENNLQNAKTSQFIAFRRQDCDLINDCCCKHYTGHLTKDHQSRLVFGIGDKICCTRNAYLSDLLPENISGSQQNNDLDASSEDFSGTLPDFAKNKRDFESNVRLCNGEIFFITNDVTDVTFGKRRSLTINNMAGLEVTVDFKKLMKYCRIKHAWARTIHTFQGSEEQTVVYVVGKAGRQHWQHVYTAVTRGRCRVYVIAEESQLRNAIMKNSFPRKTRLKHFLQSKLSSSGAPPADFPSPRKSSGDSGGPSTPSASPLPVVTDHAMTNDVTWSEASSPDERTLTFAERWQLSSPDGVDTDDDLPKSRASKRTCGVNDDESPSKIFMVGESPQVSSRLQNLRLNNLIPRQLFKPTDNQET

SEQ ID NO: 37567 - protein, 574 aa, Homo sapiens
  Payload ID: 7460
  Gene Symbol: HELB
  Gene Name: helicase (DNA) B
  Uniprot ID: Q8NG08
  ENSP ID: ENSP00000396955
MARSSPYLRQLQGPLLPPRDLVEEDDDYLNDDVEEDEESVFIDAEELCSGGVKAGSLPGCLRVSICDENTQETCKVFGRFPITGAWWRVKVQVKPVVGSRSYQYQVQGFPSYFLQSDMSPPNQKHICALFLKECEVSSDDVNKFLTWVKEVSNYKNLNFENLRETLRTFHKETGRKDQKQPTQNGQEELFLDNEMSLPLENTIPFRNVMTALQFPKIMEFLPVLLPRHFKWIIGSGSKEMLKEIEEILGTHPWKLGFSKITYREWKLLRCEASWIAFCQCESLLQLMTDLEKNALIMYSRLKQICREDGHTYVEVNDLTLTLSNHMSFHAASESLKFLKDIGVVTYEKSCVFPYDLYHAERAIAFSICDLMKKPPWHLCVDVEKVLASIHTTKPENSSDDALNESKPDEVRLENPVDVVDTQDNGDHIWTNGENEINAEISEVQLDQDQVEVPLDRDQVAALEMICSNPVTVISGKGGCGKTTIVSRLFKHIEQLEEREVKKACEDFEQDQNASEEWITFTEQSQLEADKAIEVLLTAPTGKAAGLLRQKTGLHAYTLCQVTLDSYPVLNLVTC

SEQ ID NO: 37568 - protein, 846 aa, Homo sapiens
  Payload ID: 7460
  Gene Symbol: HELB
  Gene Name: helicase (DNA) B
  ENSP ID: ENSP00000439617
MARSSPYLRQLQGPLLPPRDLVEEDDDYLNDDVEEDEESVFIDAEELCSGGVKAGSLPGCLRVSICDENTQETCKVFGRFPITGAWWRVKVQVKPVVGSRSYQYQVQGFPSYFLQSDMSPPNQKHICALFLKECEVSSDDVNKFLTWVKEVSNYKNLNFENLRETLRTFHKETGRKDQKQPTQNGQEELFLDNEMSLPLENTIPFRNVMTALQFPKIMEFLPVLLPRHFKWIIGSGSKEMLKEIEEILGTHPWKLGFSKITYREWKLLRCEASWIAFCQCESLLQLMTDLEKNALIMYSRLKQICREDGHTYVEVNDLTLTLSNHMSFHAASESLKFLKDIGVVTYEKSCVFPYDLYHAERAIAFSICDLMKKPPWHLCVDVEKVLASIHTTKPENSSDDALNESKPDEVRLENPVDVVDTQDNGDHIWTNGENEINAEISEVQLDQDQVEVPLDRDQVAALEMICSNPVTVISGKGGCGKTTIVSRLFKHIEQLEEREVKKACEDFEQDQNASEEWITFTEQSQLEADKAIEVLLTAPTGKAAGLLRQKTGLHAYTLCQVNYSFYSWTQTMMTTNKPWKFSSVRVLVVDEGSLVSVGIFKSVLNLLCEHSKLSKLIILGDIRQLPSIEPGNLLKDLFETLKSRNCAIELKTNHRAESQLIVDNATRISRRQFPKFDAELNISDNPTLPISIQDKTFIFVRLPEEDASSQSSKTNHHSCLYSAVKTLLQENNLQNAKTSQFIAFRRQDCDLINDCCCKHYTGHLTKDHQSRLVFGIGDKICCTRNAYLSDLLPENISGSQQNNDLDASSEDFSGTLPDFAKNKRDFESNVRLCNGEIFFITNIEYL

SEQ ID NO: 37569 - protein, 1087 aa, Homo sapiens; identical to SEQ ID NO: 37566
  Payload ID: 7460
  Gene Symbol: HELB
  Gene Name: helicase (DNA) B
  Uniprot ID: Q8NG08
  ENSP ID: ENSP00000443287

SEQ ID NO: 37570 - protein, 1942 aa, Homo sapiens
  Payload ID: 7461
  Gene Symbol: HELZ
  Gene Name: helicase with zinc finger
  Uniprot ID: P42694
  ENSP ID: ENSP00000351524
MEDRRAEKSCEQACESLKRQDYEMALKHCTEALLSLGQYSMADFTGPCPLEIERIKIESLLYRIASFLQLKNYVQADEDCRHVLGEGLAKGEDAFRAVLCCMQLKGKLQPVSTILAKSLTGESLNGMVTKDLTRLKTLLSETETATSNALSGYHVEDLDEGSCNGWHFRPPPRGITSSEEYTLCKRFLEQGICRYGAQCTSAHSQEELAEWQKRYASRLIKLKQQNENKQLSGSYMETLIEKWMNSLSPEKVLSECIEGVKVEHNPDLSVTVSTKKSHQTWTFALTCKPARMLYRVALLYDAHRPHFSIIAISAGDSTTQVSQEVPENCQEWIGGKMAQNGLDHYVYKVGIAFNTEIFGTFRQTIVFDFGLEPVLMQRVMIDAASTEDLEYLMHAKQQLVTTAKRWDSSSKTIIDFEPNETTDLEKSLLIRYQIPLSADQLFTQSVLDKSLTKSNYQSRLHDLLYIEEIAQYKEISKFNLKVQLQILASFMLTGVSGGAKYAQNGQLFGRFKLTETLSEDTLAGRLVMTKVNAVYLLPVPKQKLVQTQGTKEKVYEATIEEKTKEYIFLRLSRECCEELNLRPDCDTQVELQFQLNRLPLCEMHYALDRIKDNGVLFPDISMTPTIPWSPNRQWDEQLDPRLNAKQKEAVLAITTPLAIQLPPVLIIGPYGTGKTFTLAQAVKHILQQQETRILICTHSNSAADLYIKDYLHPYVEAGNPQARPLRVYFRNRWVKTVHPVVHQYCLISSAHSTFQMPQKEDILKHRVVVVTLNTSQYLCQLDLEPGFFTHILLDEAAQAMECETIMPLALATQNTRIVLAGDHMQLSPFVYSEFARERNLHVSLLDRLYEHYPAEFPCRILLCENYRSHEAIINYTSELFYEGKLMASGKQPAHKDFYPLTFFTARGEDVQEKNSTAFYNNAEVFEVVERVEELRRKWPVAWGKLDDGSIGVVTPYADQVFRIRAELRKKRLSDVNVERVLNVQGKQFRVLFLSTVRTRHTCKHKQTPIKKKEQLLEDSTEDLDYGFLSNYKLLNTAITRAQSLVAVVGDPIALCSIGRCRKFWERFIALCHENSSLHGITFEQIKAQLEALELKKTYVLNPLAPEFIPRALRLQHSGSTNKQQQSPPKGKSLHHTQNDHFQNDGIVQPNPSVLIGNPIRAYTPPPPLGPHPNLGKSPSPVQRIDPHTGTSILYVPAVYGGNVVMSVPLPVPWTGYQGRFAVDPRIITHQAAMAYNMNLLQTHGRGSPIPYGLGHHPPVTIGQPQNQHQEKDQHEQNRNGKSDTNNSGPEINKIRTPEKKPTEPKQVDLESNPQNRSPESRPSVVYPSTKFPRKDNLNPRHINLPLPAPHAQYAIPNRHFHPLPQLPRPPFPIPQQHTLLNQQQNNLPEQPNQIPPQPNQVVQQQSQLNQQPQQPPPQLSPAYQAGPNNAFFNSAVAHRPQSPPAEAVIPEQQPPPMLQEGHSPLRAIAQPGPILPSHLNSFIDENPSGLPIGEALDRIHGSVALETLRQQQARFQQWSEHHAFLSQGSAPYPHHHHPHLQHLPQPPLGLHQPPVRADWKLTSSAEDEVETTYSRFQDLIRELSHRDQSETRELAEMPPPQSRLLQYRQVQSRSPPAVPSPPSSTDHSSHFSNFNDNSRDIEVASNPAFPQRLPPQIFNSPFSLPSEHLAPPPLKYLAPDGAWTFANLQQNHLMGPGFPYGLPPLPHRPPQNPFVQIQNHQHAIGQEPFHPLSSRTVSSSSLPSLEEYEPRGPGRPLYQRRISSSSVQPCSEEVSTPQDSLAQCKELQDHSNQSSFNFSSPESWVNTTSSTPYQNIPCNGSSRTAQPRELIAPPKTVKPPEDQLKSENLEVSSSFNYSVLQHLGQFPPLMPNKQIAESANSSSPQSSAGGKPAMSYASALRAPPKPRPPPEQAKKSSDPLSLFQELSLGSSSGSNGFYSYFK

SEQ ID NO: 37571 - protein, 567 aa, Homo sapiens
  Payload ID: 7461
  Gene Symbol: HELZ
  Gene Name: helicase with zinc finger
  ENSP ID: ENSP00000411144
MEDRRAEKSCEQACESLKRQDYEMALKHCTEALLSLGQYSMADFTGPCPLEIERIKIESLLYRIASFLQLKNYVQADEDCRHVLGEGLAKGEDAFRAVLCCMQLKGKLQPVSTILAKSLTGESLNGMVTKDLTRLKTLLSETETATSNALSGYHVEDLDEGSCNGWHFRPPPRGITSSEEYTLCKRFLEQGICRYGAQCTSAHSQEELAEWQKRYASRLIKLKQQNENKQLSGSYMETLIEKWMNSLSPEKVLSECIEGVKVEHNPDLSVTVSTKKSHQTWTFALTCKPARMLYRVALLYDAHRPHFSIIAISAGDSTTQVSQEVPENCQEWIGGKMAQNGLDHYVYKVGIAFNTEIFGTFRQTIVFDFGLEPVLMQRVMIDAASTEDLEYLMHAKQQLVTTAKRWDSSSKTIIDFEPNETTDLEKSLLIRYQIPLSADQLFTQSVLDKSLTKSNYQSRLHDLLYIEEIAQYKEISKFNLKVQLQILASFMLTGVSGGAKYAQNGQLFGRFKLTETLSEDTLAGRLVMTKVNAVYLLPVPKQKLVQTQGTKEKVYEATIEEKTKEYI

SEQ ID NO: 37572 - protein, 65 aa, Homo sapiens
  Payload ID: 7461
  Gene Symbol: HELZ
  Gene Name: helicase with zinc finger
  ENSP ID: ENSP00000462320
MEDRRAEKSCEQACESLKRQDYEMALKHCTEALLSLGQYSMADFTGPCPLEIERIKIESLLYRIA

SEQ ID NO: 37573 - protein, 103 aa, Homo sapiens
  Payload ID: 7461
  Gene Symbol: HELZ
  Gene Name: helicase with zinc finger
  ENSP ID: ENSP00000462763
MEDRRAEKSCEQACESLKRQDYEMALKHCTEALLSLGQYSMADFTGPCPLEIERIKIESLLYRIASFLQLKNYVQADEDCRHVLGEGLAKGEDAFRAVLCCMQ

SEQ ID NO: 37574 - protein, 1163 aa, Homo sapiens
  Payload ID: 7461
  Gene Symbol: HELZ
  Gene Name: helicase with zinc finger
  Uniprot ID: P42694
  ENSP ID: ENSP00000463727
MEDRRAEKSCEQACESLKRQDYEMALKHCTEALLSLGQYSMADFTGPCPLEIERIKIESLLYRIASFLQLKNYVQADEDCRHVLGEGLAKGEDAFRAVLCCMQLKGKLQPVSTILAKSLTGESLNGMVTKDLTRLKTLLSETETATSNALSGYHVEDLDEGSCNGWHFRPPPRGITSSEEYTLCKRFLEQGICRYGAQCTSAHSQEELAEWQKRYASRLIKLKQQNENKQLSGSYMETLIEKWMNSLSPEKVLSECIEGVKVEHNPDLSVTVSTKKSHQTWTFALTCKPARMLYRVALLYDAHRPHFSIIAISAGDSTTQVSQEVPENCQEWIGGKMAQNGLDHYVYKVGIAFNTEIFGTFRQTIVFDFGLEPVLMQRVMIDAASTEDLEYLMHAKQQLVTTAKRWDSSSKTIIDFEPNETTDLEKSLLIRYQIPLSADQLFTQSVLDKSLTKSNYQSRLHDLLYIEEIAQYKEISKFNLKVQLQILASFMLTGVSGGAKYAQNGQLFGRFKLTETLSEDTLAGRLVMTKVNAVYLLPVPKQKLVQTQGTKEKVYEATIEEKTKEYIFLRLSRECCEELNLRPDCDTQVELQFQLNRLPLCEMHYALDRIKDNGVLFPDISMTPTIPWSPNRQWDEQLDPRLNAKQKEAVLAITTPLAIQLPPVLIIGPYGTGKTFTLAQAVKHILQQQETSRILICTHSNSAADLYIKDYLHPYVEAGNPQARPLRVYFRNRWVKTVHPVVHQYCLISSAHSTFQMPQKEDILKHRVVVVTLNTSQYLCQLDLEPGFFTHILLDEAAQAMECETIMPLALATQNTRIVLAGDHMQLSPFVYSEFARERNLHVSLLDRLYEHYPAEFPCRILLCENYRSHEAIINYTSELFYEGKLMASGKQPAHKDFYPLTFFTARGEDVQEKNSTAFYNNAEVFEVVERVEELRRKWPVAWGKLDDGSIGVVTPYADQVFRIRAELRKKRLSDVNVERVLNVQGKQFRVLFLSTVRTRHTCKHKQTPIKKKEQLLEDSTEDLDYGFLSNYKLLNTAITRAQSLVAVVGDPIALCSIGRCRKFWERFIALCHENSSLHGITFEQIKAQLEALELKKTYVLNPLAPEFIPRALRLQHSGSTNKQQQSPPKVKPLLMKLKRLKGENFAEVPKVYWDASYFKCWN

SEQ ID NO: 37575 - protein, 193 aa, Homo sapiens
  Payload ID: 7461
  Gene Symbol: HELZ
  Gene Name: helicase with zinc finger
  ENSP ID: ENSP00000464354
  MOD_RES (1)..(1): Any amino acid
XFRQTIVFDFGLEPVLMQRVMIDAASTEVFFFRYMYVSLNRKVIRTTYRVSQPSAQSLCYYGFHLVLVLCYFFSPDLEYLMHAKQQLVTTAKRWDSSSKTIIDFEPNETTDLEKSLLIRYQIPLSADQLFTQSVLDKSLTKSNYQSRLHDLLYIEEIAQYKEISKFNLKVQLQILASFMLTGVSGGAKYAQNG

SEQ ID NO: 37576 - protein, 1943 aa, Homo sapiens
  Payload ID: 7461
  Gene Symbol: HELZ
  Gene Name: helicase with zinc finger
  ENSP ID: ENSP00000464512
MEDRRAEKSCEQACESLKRQDYEMALKHCTEALLSLGQYSMADFTGPCPLEIERIKIESLLYRIASFLQLKNYVQADEDCRHVLGEGLAKGEDAFRAVLCCMQLKGKLQPVSTILAKSLTGESLNGMVTKDLTRLKTLLSETETATSNALSGYHVEDLDEGSCNGWHFRPPPRGITSSEEYTLCKRFLEQGICRYGAQCTSAHSQEELAEWQKRYASRLIKLKQQNENKQLSGSYMETLIEKWMNSLSPEKVLSECIEGVKVEHNPDLSVTVSTKKSHQTWTFALTCKPARMLYRVALLYDAHRPHFSIIAISAGDSTTQVSQEVPENCQEWIGGKMAQNGLDHYVYKVGIAFNTEIFGTFRQTIVFDFGLEPVLMQRVMIDAASTEDLEYLMHAKQQLVTTAKRWDSSSKTIIDFEPNETTDLEKSLLIRYQIPLSADQLFTQSVLDKSLTKSNYQSRLHDLLYIEEIAQYKEISKFNLKVQLQILASFMLTGVSGGAKYAQNGQLFGRFKLTETLSEDTLAGRLVMTKVNAVYLLPVPKQKLVQTQGTKEKVYEATIEEKTKEYIFLRLSRECCEELNLRPDCDTQVELQFQLNRLPLCEMHYALDRIKDNGVLFPDISMTPTIPWSPNRQWDEQLDPRLNAKQKEAVLAITTPLAIQLPPVLIIGPYGTGKTFTLAQAVKHILQQQETSRILICTHSNSAADLYIKDYLHPYVEAGNPQARPLRVYFRNRWVKTVHPVVHQYCLISSAHSTFQMPQKEDILKHRVVVVTLNTSQYLCQLDLEPGFFTHILLDEAAQAMECETIMPLALATQNTRIVLAGDHMQLSPFVYSEFARERNLHVSLLDRLYEHYPAEFPCRILLCENYRSHEAIINYTSELFYEGKLMASGKQPAHKDFYPLTFFTARGEDVQEKNSTAFYNNAEVFEVVERVEELRRKWPVAWGKLDDGSIGVVTPYADQVFRIRAELRKKRLSDVNVERVLNVQGKQFRVLFLSTVRTRHTCKHKQTPIKKKEQLLEDSTEDLDYGFLSNYKLLNTAITRAQSLVAVVGDPIALCSIGRCRKFWERFIALCHENSSLHGITFEQIKAQLEALELKKTYVLNPLAPEFIPRALRLQHSGSTNKQQQSPPKGKSLHHTQNDHFQNDGIVQPNPSVLIGNPIRAYTPPPPLGPHPNLGKSPSPVQRIDPHTGTSILYVPAVYGGNVVMSVPLPVPWTGYQGRFAVDPRIITHQAAMAYNMNLLQTHGRGSPIPYGLGHHPPVTIGQPQNQHQEKDQHEQNRNGKSDTNNSGPEINKIRTPEKKPTEPKQVDLESNPQNRSPESRPSVVYPSTKFPRKDNLNPRHINLPLPAPHAQYAIPNRHFHPLPQLPRPPFPIPQQHTLLNQQQNNLPEQPNQIPPQPNQVVQQQSQLNQQPQQPPPQLSPAYQAGPNNAFFNSAVAHRPQSPPAEAVIPEQQPPPMLQEGHSPLRAIAQPGPILPSHLNSFIDENPSGLPIGEALDRIHGSVALETLRQQQARFQQWSEHHAFLSQGSAPYPHHHHPHLQHLPQPPLGLHQPPVRADWKLTSSAEDEVETTYSRFQDLIRELSHRDQSETRELAEMPPPQSRLLQYRQVQSRSPPAVPSPPSSTDHSSHFSNFNDNSRDIEVASNPAFPQRLPPQIFNSPFSLPSEHLAPPPLKYLAPDGAWTFANLQQNHLMGPGFPYGLPPLPHRPPQNPFVQIQNHQHAIGQEPFHPLSSRTVSSSSLPSLEEYEPRGPGRPLYQRRISSSSVQPCSEEVSTPQDSLAQCKELQDHSNQSSFNFSSPESWVNTTSSTPYQNIPCNGSSRTAQPRELIAPPKTVKPPEDQLKSENLEVSSSFNYSVLQHLGQFPPLMPNKQIAESANSSSPQSSAGGKPAMSYASALRAPPKPRPPPEQAKKSSDPLSLFQELSLGSSSGSNGFYSYFK

SEQ ID NO: 37577 - protein, 2080 aa, Homo sapiens
  Payload ID: 7462
  Gene Symbol: HELZ2
  Gene Name: helicase with zinc finger 2, transcriptional coactivator
  Uniprot ID: Q9BYK8
  ENSP ID: ENSP00000393257
MSSSPSRSAADIYIREYFHSHVSGGHPEATPLRVMYTDRPLSQTDPVTLQYCCLTDDRQAFRPPTRAELARHRVVVTTTSQARELRVPVGFFSHILIDEAAQMLECEALTPLAYASHGTRLVLAGDHMQVTPRLFSVARARAAEHTLLHRLFLCYQQETHEVARQSRLVFHENYRCTDAIVSFISRHFYVAKGNPIHARGKVPPHPRHYPLMFCHVAGSPDRDMSMASWLNLAEIAQVVEKVQEAYNTWPSCWGGREQRCICVVSHGAQVSALRQELRRRDLGQVSVGSFEILPGRQFRVVVLSTVHTCQSLLSPGALAPEFFTDARVLNTVLTRAQSQLVVVGDAVALCSFGACGKLWESFIRECVERHSVCPEGLSMEQVEQGVAQRRRWPPRGTQAGAAGNWEAAPEPVGDLAEEQAAVVTAMVKAEPGDEALSPASRDITATTAQTEAAAAPAGDAVKEDVVPGACAAGAAAAAGVESTEAEDAEADFWPWDGELNADDAILRELLDESQKVMVTVGEDGLLDTVARPESLQQARLYENLPPAALRKLLHAEPERYRHCSFVPETFERASAIPLDDASSGPIQVRGRLDCGMAFAGDEVLVQLLSGDKAPEGRLRGRVLGVLKRKRHELAFVCRMDTWDPRIMVPINGSVTKIFVAELKDPSQVPIYSLRKGRLQRVGLERLTAEARHSRLFWVQIVLWRQGFYYPLGIVREVLPEASTWEQGLRILGLEYSLRVPPSDQATITKVLQKYHTELGRVAGRREDCRAFLTFTVDPQGACNLDDALSVRDLGPRCEVAVHITDVASFVPRDGVLDVEARRQGAAFYAPGREPVPMLPASLCQDVLSLLPGRDRLAISLFLTMEKASGQLKSLRFAPSVVQSDRQLSYEEAEEVIRQHPGAGRELPARLDSVDACVVAACYFSRLLRRHRLRSDCFYEQPDEDGTLGFRAAHIMVKEYMIQFNRLVAEFLVGSECTRTVTPLRWQPAPRSQQLKALCEKHGDRVPLSLHLGHHLHGGGGSPPDTRLHLLASLWKQVQFAARTQDYEQMVDLVTTDDMHPFLAPAGRDLRKALERSAFGRCARGHQQQGGHYSLQVDWYTWATSPIRRYLDVVLQRQILLALGHGGSAYSARDIDGLCQAFSLQHALAQSYQRRARSLHLAVQLKAQPLDKLGFVVDVEAGSRCFRLLFPSNRETLPDPCPVPYGSLQLAEHPHALAGRPGLRLLWRRRVYSAQGSSPPLPLPGTVPDPHTLAVETALWKQLLELVELQRWPEAAALIQEKGEASQRRELVQVQRSHCGHFLEVARELGSGDTLQVQLGTSLQHGFLVPSPQLWTVAPGFSLCLEHVERPGDCFSGRVYRAPRDRYRDVDEYACVWEPFCALESATGAVAENDSVTLQHLSVSWEASRTPQGQLQGAFRLEAAFLEENCADINFSCCYLCIRLEGLPAPTASPRPGPSSLGPGLNVDPGTYTWVAHGQTQDWDQERRADRQEAPRRVHLFVHHMGMEKVPEEVLRPGTLFTVELLPKQLPDLRKEEAVRGLEEASPLVTSIALGRPVPQPLCRVIPSRFLERQTYNIPGGRHKLNPSQNVAVREALEKPFTVIQGPPGTGKTIVGLHIVFWFHKSNQEQVQPGGPPRGEKRLGGPCILYCGPSNKSVDVLAGLLLRRMELKPLRVYSEQAEASEFPVPRVGSRKLLRKSPREGRPNQSLRSITLHHRIRQAPNPYSSEIKAFDTRLQRGELFSREDLVWYKKVLWEARKFELDRHEVILCTCSCAASASLKILDVRQILVDEAGMATEPETLIPLVQFPQAEKVVLLGDHKQLRPVVKNERLQNLGLDRSLFERYHEDAHMLDTQYRMHEGICAFPSVAFYKSKLKTWQGLRRPPSVLGHAGKESCPVIFGHVQGHERSLLVSTDEGNENSKANLEEVAEVVRITKQLTLGRTVEPQDIAVLTPYNAQASEISKALRREGIAGVAVSSITKSQGSEWRYVLVSTVRTCAKSDLDQRPTKSWLKKFLGFVVDPNQVNVAVTRAQEGLCLIGDHLLLRCCPLWRSLLDFCEAQQTLVPAGQVRVCRRPTMPS

SEQ ID NO: 37578 - protein, 2649 aa, Homo sapiens
  Payload ID: 7462
  Gene Symbol: HELZ2
  Gene Name: helicase with zinc finger 2, transcriptional coactivator
  Uniprot ID: Q9BYK8
  ENSP ID: ENSP00000417401
MAVWEAEQLGGLQRGDLLTPPAPDGDGRTAPLGQPPGAQLYCPACLVTCHSQEAFENHCASSEHAQMVAFDQALPWEHRSPPPGLSKFELCPKPDLCEYGDACTKAHSAQELQEWVRRTQAVELRGQAAWQDGLVPYQERLLAEYQRSSSEVLVLAETLDGVRVTCNQPLMYQAQERKTQYSWTFAVHSEEPLLHVALLKQEPGADFSLVAPGLPPGRLYARGERFRVPSSTADFQVGVRVQAASFGTFEQWVVFDFGRRPVLLQKLGLQLGQGRRPGPCRNLALGHPEEMERWHTGNRHVVPGVERTAEQTALMAKYKGPALALEFNRSSVASGPISPTNYRQRMHQFLYEEEAAQQQLVAKLTLRGQVFLKTALQTPALNMLFAPPGALYAEVPVPSSLMPDTDQGFLLGRAVSTALVAPVPAPDNTVFEVRLERRASSEQALWLLLPARCCLALGLQPEARLVLEVQFQIDPMTFRLWHQAVDTLPEEQLVVPDLPTCALPRPWSVPPLRRGNRKQELAVALIAGWGPGDGRRVPPLLIYGPFGTGKTYTLAMASLEVIRRPETKVLICTHTNSAADIYIREYFHSHVSGGHPEATPLRVMYTDRPLSQTDPVTLQYCCLTDDRQAFRPPTRAELARHRVVVTTTSQARELRVPVGFFSHILIDEAAQMLECEALTPLAYASHGTRLVLAGDHMQVTPRLFSVARARAAEHTLLHRLFLCYQQETHEVARQSRLVFHENYRCTDAIVSFISRHFYVAKGNPIHARGKVPPHPRHYPLMFCHVAGSPDRDMSMASWLNLAEIAQVVEKVQEAYNTWPSCWGGREQRCICVVSHGAQVSALRQELRRRDLGQVSVGSFEILPGRQFRVVVLSTVHTCQSLLSPGALAPEFFTDARVLNTVLTRAQSQLVVVGDAVALCSFGACGKLWESFIRECVERHSVCPEGLSMEQVEQGVAQRRRWPPRGTQAGAAGNWEAAPEPVGDLAEEQAAVVTAMVKAEPGDEALSPASRDITATTAQTEAAAAPAGDAVKEDVVPGACAAGAAAAAGVESTEAEDAEADFWPWDGELNADDAILRELLDESQKVMVTVGEDGLLDTVARPESLQQARLYENLPPAALRKLLHAEPERYRHCSFVPETFERASAIPLDDASSGPIQVRGRLDCGMAFAGDEVLVQLLSGDKAPEGRLRGRVLGVLKRKRHELAFVCRMDTWDPRIMVPINGSVTKIFVAELKDPSQVPIYSLRKGRLQRVGLERLTAEARHSRLFWVQIVLWRQGFYYPLGIVREVLPEASTWEQGLRILGLEYSLRVPPSDQATITKVLQKYHTELGRVAGRREDCRAFLTFTVDPQGACNLDDALSVRDLGPRCEVAVHITDVASFVPRDGVLDVEARRQGAAFYAPGREPVPMLPASLCQDVLSLLPGRDRLAISLFLTMEKASGQLKSLRFAPSVVQSDRQLSYEEAEEVIRQHPGAGRELPARLDSVDACVVAACYFSRLLRRHRLRSDCFYEQPDEDGTLGFRAAHIMVKEYMIQFNRLVAEFLVGSECTRTVTPLRWQPAPRSQQLKALCEKHGDRVPLSLHLGHHLHGGGGSPPDTRLHLLASLWKQVQFAARTQDYEQMVDLVTTDDMHPFLAPAGRDLRKALERSAFGRCARGHQQQGGHYSLQVDWYTWATSPIRRYLDVVLQRQILLALGHGGSAYSARDIDGLCQAFSLQHALAQSYQRRARSLHLAVQLKAQPLDKLGFVVDVEAGSRCFRLLFPSNRETLPDPCPVPYGSLQLAEHPHALAGRPGLRLLWRRRVYSAQGSSPPLPLPGTVPDPHTLAVETALWKQLLELVELQRWPEAAALIQEKGEASQRRELVQVQRSHCGHFLEVARELGSGDTLQVQLGTSLQHGFLVPSPQLWTVAPGFSLCLEHVERPGDCFSGRVYRAPRDRYRDVDEYACVWEPFCALESATGAVAENDSVTLQHLSVSWEASRTPQGQLQGAFRLEAAFLEENCADINFSCCYLCIRLEGLPAPTASPRPGPSSLGPGLNVDPGTYTWVAHGQTQDWDQERRADRQEAPRRVHLFVHHMGMEKVPEEVLRPGTLFTVELLPKQLPDLRKEEAVRGLEEASPLVTSIALGRPVPQPLCRVIPSRFLERQTYNIPGGRHKLNPSQNVAVREALEKPFTVIQGPPGTGKTIVGLHIVFWFHKSNQEQVQPGGPPRGEKRLGGPCILYCGPSNKSVDVLAGLLLRRMELKPLRVYSEQAEASEFPVPRVGSRKLLRKSPREGRPNQSLRSITLHHRIRQAPNPYSSEIKAFDTRLQRGELFSREDLVWYKKVLWEARKFELDRHEVILCTCSCAASASLKILDVRQILVDEAGMATEPETLIPLVQFPQAEKVVLLGDHKQLRPVVKNERLQNLGLDRSLFERYHEDAHMLDTQYRMHEGICAFPSVAFYKSKLKTWQGLRRPPSVLGHAGKESCPVIFGHVQGHERSLLVSTDEGNENSKANLEEVAEVVRITKQLTLGRTVEPQDIAVLTPYNAQASEISKALRREGIAGVAVSSITKSQGSEWRYVLVSTVRTCAKSDLDQRPTKSWLKKFLGFVVDPNQVNVAVTRAQEGLCLIGDHLLLRCCPLWRSLLDFCEAQQTLVPAGQVRVCRRPTMPS

SEQ ID NO: 37579 - protein, 714 aa, Homo sapiens
  Payload ID: 7463
  Gene Symbol: HELLS
  Gene Name: helicase, lymphoid-specific
  ENSP ID: ENSP00000239026
MRKKRGREDESYNISEVMSKEEILSVAKKNKKENEDENSSSTNLCVEDLQKNKDSNSIIKDRLSETVRQNTKFFFDPVRKCNGQPVPFQQPKHFTGGVMRWYQVEGMEWLRMLWENGINGILADEMGLGKTVQCIATIALMIQRGVPGPFLVCGPLSTLPNWMAEFKRFTPDIPTMLYHGTQEERQKLVRNIYKRKGTLQIHPVVITSFEIAMRDRNALQHCYWKYLIVDEGHRIKNMKCRLIRELKRFNADNKLLLTGTPLQNNLSELWSLLNFLLPDVFDDLKSFESWFDITSLSETAEDIIAKEREQNVLHMLHQILTPFLLRRLKSDVALEVPPKREVVVYAPLSKKQEIFYTAIVNRTIANMFGSSEKETIELSPTGRPKRRTRKSINYSKIDDFPNELEKLISQIQPEVDRERAVVEVNIPVESEVNLKLQNIMMLLRKCCNHPYLIEYPIDPVTQEFKIDEELVTNSGKFLILDRMLPELKKRGHKVLLFSQMTSMLDILMDYCHLRDFNFSRLDGSMSYSEREKNMHSFNTDPEVFIFLVSTRAGGLGINLTAADTVIIYDSDWNPQSDLQAQDRCHRIGQTKPVVVYRLVTANTIDQKIVERAAAKRKLEKLIIHKNHFKGGQSGLNLSKNFLDPKELMELLKSRDYEREIKGSREKVISDKDLELLLDRSDLIDQMNASGPIKEKMGIFKILENSEDSSPECLF

SEQ ID NO: 37580 - protein, 838 aa, Homo sapiens
  Payload ID: 7463
  Gene Symbol: HELLS
  Gene Name: helicase, lymphoid-specific
  Uniprot ID: Q9NRZ9
  ENSP ID: ENSP00000239027
MPAERPAGSGGSEAPAMVEQLDTAVITPAMLEEEEQLEAAGLERERKMLEKARMSWDRESTEIRYRRLQHLLEKSNIYSKFLLTKMEQQQLEEQKKKEKLERKKESLKVKKGKNSIDASEEKPVMRKKRGREDESYNISEVMSKEEILSVAKKNKKENEDENSSSTNLCVEDLQKNKDSNSIIKDRLSETVRQNTKFFFDPVRKCNGQPVPFQQPKHFTGGVMRWYQVEGMEWLRMLWENGINGILADEMGLGKTVQCIATIALMIQRGVPGPFLVCGPLSTLPNWMAEFKRFTPDIPTMLYHGTQEERQKLVRNIYKRKGTLQIHPVVITSFEIAMRDRNALQHCYWKYLIVDEGHRIKNMKCRLIRELKRFNADNKLLLTGTPLQNNLSELWSLLNFLLPDVFDDLKSFESWFDITSLSETAEDIIAKEREQNVLHMLHQILTPFLLRRLKSDVALEVPPKREVVVYAPLSKKQEIFYTAIVNRTIANMFGSSEKETIELSPTGRPKRRTRKSINYSKIDDFPNELEKLISQIQPEVDRERAVVEVNIPVESEVNLKLQNIMMLLRKCCNHPYLIEYPIDPVTQEFKIDEELVTNSGKFLILDRMLPELKKRGHKVLLFSQMTSMLDILMDYCHLRDFNFSRLDGSMSYSEREKNMHSFNTDPEVFIFLVSTRAGGLGINLTAADTVIIYDSDWNPQSDLQAQDRCHRIGQTKPVVVYRLVTANTIDQKIVERAAAKRKLEKLIIHKNHFKGGQSGLNLSKNFLDPKELMELLKSRDYEREIKGSREKVISDKDLELLLDRSDLIDQMNASGPIKEKMGIFKILENSEDSSPECLF

SEQ ID NO: 37581 - protein, 310 aa, Homo sapiens
  Payload ID: 7463
  Gene Symbol: HELLS
  Gene Name: helicase, lymphoid-specific
  ENSP ID: ENSP00000360378
MMLLRKCCNHPYLIEYPIDPVTQEFKIDEELVTNSGKFLILDRMLPELKKRGHKVLLFSQMTSMLDILMDYCHLRDFNFSRLDGSMSYSEREKNMHSFNTDPEVFIFLVSTRAGGLGINLTAADTVIIYDSDWNPQSDLQAQDRCHRIGQTKPVVVYRLVTANTIDQKIVERAAAKRKLEKLIIHKNHFKGGQSGLNLSKNFLDPKELMELLKSRDYEREIKGSREKVISDKDLELLLDRSDLIDQMNASGPIKEKMGIFKILENSEDSSPELETGFHHLGLTGPELISGDLPTSASQSAGITSVSHCVA

SEQ ID NO: 37582 - protein, 700 aa, Homo sapiens
  Payload ID: 7463
  Gene Symbol: HELLS
  Gene Name: helicase, lymphoid-specific
  ENSP ID: ENSP00000360383
MQVKRSQEILSVAKKNKKENEDENSSSTNLCVEDLQKNKDSNSIIKDRLSETVRQNTKFFFDPVRKCNGQPVPFQQPKHFTGGVMRWYQVEGMEWLRMLWENGINGILADEMGLGKTVQCIATIALMIQRGVPGPFLVCGPLSTLPNWMAEFKRFTPDIPTMLYHGTQEERQKLVRNIYKRKGTLQIHPVVITSFEIAMRDRNALQHCYWKYLIVDEGHRIKNMKCRLIRELKRFNADNKLLLTGTPLQNNLSELWSLLNFLLPDVFDDLKSFESWFDITSLSETAEDIIAKEREQNVLHMLHQILTPFLLRRLKSDVALEVPPKREVVVYAPLSKKQEIFYTAIVNRTIANMFGSSEKETIELSPTGRPKRRTRKSINYSKIDDFPNELEKLISQIQPEVDRERAVVEVNIPVESEVNLKLQNIMMLLRKCCNHPYLIEYPIDPVTQEFKIDEELVTNSGKFLILDRMLPELKKRGHKVLLFSQMTSMLDILMDYCHLRDFNFSRLDGSMSYSEREKNMHSFNTDPEVFIFLVSTRAGGLGINLTAADTVIIYDSDWNPQSDLQAQDRCHRIGQTKPVVVYRLVTANTIDQKIVERAAAKRKLEKLIIHKNHFKGGQSGLNLSKNFLDPKELMELLKSRDYEREIKGSREKVISDKDLELLLDRSDLIDQMNASGPIKEKMGIFKILENSEDSSPECLF

SEQ ID NO: 37583 - protein, 884 aa, Homo sapiens
  Payload ID: 7463
  Gene Symbol: HELLS
  Gene Name: helicase, lymphoid-specific
  ENSP ID: ENSP00000377601
MPAERPAGSGGSEAPAMVEQLDTAVITPAMLEEEEQLEAAGLERERKMLEKARMSWDRESTEIRYRRLQHLLEKSNIYSKFLLTKMEQQQLEEQKKKEKLERKKESLKVKKGKNSIDASEEKPVMRKKRGREDESYNISEVMSKEEILSVAKKNKKENEDENSSSTNLCVEDLQKNKDSNSIIKDRLSETVRQNTKFFFDPVRKCNGQPVPFQQPKHFTGGVMRWYQVEGMEWLRMLWENGINGILADEMGLGKTVQCIATIALMIQRGVPGPFLVCGPLSTLPNWMAEFKRFTPDIPTMLYHGTQEERQKLVRNIYKRKGTLQIHPVVITSFEIAMRDRNALQHCYWKYLIVDEGHRIKNMKCRLIRELKRFNADNKLLLTGTPLQNNLSELWSLLNFLLPDVFDDLKSFESWFDITSLSETAEDIIAKEREQNVLHMLHQERIPRMYVSEFTDEGFFEGKLPSRKDLYDIRPYENTYLLKLHTNFEILTPFLLRRLKSDVALEVPPKREVVVYAPLSKKQEIFYTAIVNRTIANMFGSSEKETIELSPTGRPKRRTRKSINYSKIDDFPNELEKLISQIQPEVDRERAVVEVNIPVESEVNLKLQNIMMLLRKCCNHPYLIEYPIDPVTQEFKIDEELVTNSGKFLILDRMLPELKKRGHKVLLFSQMTSMLDILMDYCHLRDFNFSRLDGSMSYSEREKNMHSFNTDPEVFIFLVSTRAGGLGINLTAADTVIIYDSDWNPQSDLQAQDRCHRIGQTKPVVVYRLVTANTIDQKIVERAAAKRKLEKLIIHKNHFKGGQSGLNLSKNFLDPKELMELLKSRDYEREIKGSREKVISDKDLELLLDRSDLIDQMNASGPIKEKMGIFKILENSEDSSPECLF

SEQ ID NO: 37584 - protein, 740 aa, Homo sapiens
  Payload ID: 7463
  Gene Symbol: HELLS
  Gene Name: helicase, lymphoid-specific
  Uniprot ID: Q9NRZ9
  ENSP ID: ENSP00000377609
MPAERPAGSGGSEAPAMVEQLDTAVITPAMLEEEEQLEAAGLERERKMLEKARMSWDRESTEIRYRRLQHLLEKSNIYSKFLLTKMEQQQLEEQKKKEKLERKKESLKVKKGKNSIDASEEKPVMRKKRGREDESYNISEVMSKEEILSVAKKNKKENEDENSSSTNLCVEDLQKNKDSNSIIKDRLSETVRQNTKFFFDPVRKCNGQPVPFQQPKHFTGGVMRWYQVEGMEWLRMLWENGINGILADEMGLGKTVQCIATIALMIQRGVPGPFLVCGPLSTLPNWMAEFKRFTPDIPTMLYHGTQEERQKLVRNIYKRKGTLQIHPVVITSFEIAMRDRNALQILTPFLLRRLKSDVALEVPPKREVVVYAPLSKKQEIFYTAIVNRTIANMFGSSEKETIELSPTGRPKRRTRKSINYSKIDDFPNELEKLISQIQPEVDRERAVVEVNIPVESEVNLKLQNIMMLLRKCCNHPYLIEYPIDPVTQEFKIDEELVTNSGKFLILDRMLPELKKRGHKVLLFSQMTSMLDILMDYCHLRDFNFSRLDGSMSYSEREKNMHSFNTDPEVFIFLVSTRAGGLGINLTAADTVIIYDSDWNPQSDLQAQDRCHRIGQTKPVVVYRLVTANTIDQKIVERAAAKRKLEKLIIHKNHFKGGQSGLNLSKNFLDPKELMELLKSRDYEREIKGSREKVISDKDLELLLDRSDLIDQMNASGPIKEKMGIFKILENSEDSSPECLF

SEQ ID NO: 37585 - protein, 192 aa, Homo sapiens
  Payload ID: 7463
  Gene Symbol: HELLS
  Gene Name: helicase, lymphoid-specific
  ENSP ID: ENSP00000409945
MVEQLDTAVITPAMLEEEEQLEAAGLERERKMLEKARMSWDRESTEIRYRRLQHLLEKSNIYSKFLLTKMEQQQLEEQKKKEKLERKKESLKVKKGKNSIDASEEKPVMRKKRGREDESYNISEVMSKEEILSVAKKNKKENEDENSSSTNLCVEDLQKNKDSNSIIKDRLSETVRQNTKFFFDPVRKCNGQ

SEQ ID NO: 37586 - protein, 97 aa, Homo sapiens
  Payload ID: 7463
  Gene Symbol: HELLS
  Gene Name: helicase, lymphoid-specific
  ENSP ID: ENSP00000485823
MPAERPAGSGGSEAPAMVEQLDTAVITPAMLEEEEQLEAAGLERERKMLEKARMSWDRESTEIRYRRLQHLLEKSNIYSKFLLTKMEQQQLETVMKI

SEQ ID NO: 37587 - protein, 1101 aa, Homo sapiens
  Payload ID: 7464
  Gene Symbol: HELQ
  Gene Name: helicase, POLQ-like
  Uniprot ID: Q8TDG4
  ENSP ID: ENSP00000295488
MDECGSRIRRRVSLPKRNRPSLGCIFGAPTAAELVPGDEGKEEEEMVAENRRRKTAGVLPVEVQPLLLSDSPECLVLGGGDTNPDLLRHMPTDRGVGDQPNDSEVDMFGDYDSFTENSFIAQVDDLEQKYMQLPEHKKHATDFATENLCSESIKNKLSITTIGNLTELQTDKHTENQSGYEGVTIEPGADLLYDVPSSQAIYFENLQNSSNDLGDHSMKERDWKSSSHNTVNEELPHNCIEQPQQNDESSSKVRTSSDMNRRKSIKDHLKNAMTGNAKAQTPIFSRSKQLKDTLLSEEINVAKKTVESSSNDLGPFYSLPSKVRDLYAQFKGIEKLYEWQHTCLTLNSVQERKNLIYSLPTSGGKTLVAEILMLQELLCCRKDVLMILPYVAIVQEKISGLSSFGIELGFFVEEYAGSKGRFPPTKRREKKSLYIATIEKGHSLVNSLIETGRIDSLGLVVVDELHMIGEGSRGATLEMTLAKILYTSKTTQIIGMSATLNNVEDLQKFLQAEYYTSQFRPVELKEYLKINDTIYEVDSKAENGMTFSRLLNYKYSDTLKKMDPDHLVALVTEVIPNYSCLVFCPSKKNCENVAEMICKFLSKEYLKHKEKEKCEVIKNLKNIGNGNLCPVLKRTIPFGVAYHHSGLTSDERKLLEEAYSTGVLCLFTCTSTLAAGVNLPARRVILRAPYVAKEFLKRNQYKQMIGRAGRAGIDTIGESILILQEKDKQQVLELITKPLENCYSHLVQEFTKGIQTLFLSLIGLKIATNLDDIYHFMNGTFFGVQQKVLLKEKSLWEITVESLRYLTEKGLLQKDTIYKSEEEVQYNFHITKLGRASFKGTIDLAYCDILYRDLKKGLEGLVLESLLHLIYLTTPYDLVSQCNPDWMIYFRQFSQLSPAEQNVAAILGVSESFIGKKASGQAIGKKVDKNVVNRLYLSFVLYTLLKETNIWTVSEKFNMPRGYIQNLLTGTASFSSCVLHFCEELEEFWVYRALLVELTKKLTYCVKAELIPLMEVTGVLEGRAKQLYSAGYKSLMHLANANPEVLVRTIDHLSRRQAKQIVSSAKMLLHEKAEALQEEVEELLRLPSDFPGAVASSTDKA

SEQ ID NO: 37588 - protein, 489 aa, Homo sapiens
  Payload ID: 7464
  Gene Symbol: HELQ
  Gene Name: helicase, POLQ-like
  ENSP ID: ENSP00000424186
MDECGSRIRRRVSLPKRNRPSLGCIFGAPTAAELVPGDEGKEEEEMVAENRRRKTAGVLPVEVQPLLLSDSPECLVLGGGDTNPDLLRHMPTDRGVGDQPNDSEVDMFGDYDSFTENSFIAQVDDLEQKYMQLPEHKKHATDFATENLCSESIKNKLSITTIGNLTELQTDKHTENQSGYEGVTIEPGADLLYDVPSSQAIYFENLQNSSNDLGDHSMKERDWKSSSHNTVNEELPHNCIEQPQQNDESSSKVRTSSDMNRRKSIKDHLKNAMTGNAKAQTPIFSRSKQLKDTLLSEEINVAKKTVESSSNDLGPFYSLPSKVRDLYAQFKGIEKLYEWQHTCLTLNSVQERKNLIYSLPTSGGKTLVAEILMLQELLCCRKDVLMILPYVAIVQEKISGLSSFGIELGFFVEEYAGSKGRFPPTKRREKKSLYIATIEKGHSLVNSLIETGRIDSLGLVVVDELHMIGEGSRGATLEMTLAKILYTSS

SEQ ID NO: 37589 - protein, 1034 aa, Homo sapiens
  Payload ID: 7464
  Gene Symbol: HELQ
  Gene Name: helicase, POLQ-like
  ENSP ID: ENSP00000424539
MDECGSRIRRRVSLPKRNRPSLGCIFGAPTAAELVPGDEGKEEEEMVAENRRRKTAGVLPVEVQPLLLSDSPECLVLGGGDTNPDLLRHMPTDRGVGDQPNDSEVDMFGDYDSFTENSFIAQVDDLEQKYMQLPEHKKHATDFATENLCSESIKNKLSITTIGNLTELQTDKHTENQSGYEGVTIEPGADLLYDVPSSQAIYFENLQNSSNDLGDHSMKERDWKSSSHNTVNEELPHNCIEQPQQNDESSSKVRTSSDMNRRKSIKDHLKNAMTGNAKAQTPIFSRSKQLKDTLLSEEINVAKKTVESSSNDLGPFYSLPSKVRDLYAQFKGIEKLYEWQHTCLTLNSVQERKNLIYSLPTSGGKTLVAEILMLQELLCCRKDVLMILPYVAIVQEKLHMIGEGSRGATLEMTLAKILYTSKTTQIIGMSATLNNVEDLQKFLQAEYYTSQFRPVELKEYLKINDTIYEVDSKAENGMTFSRLLNYKYSDTLKKMDPDHLVALVTEVIPNYSCLVFCPSKKNCENVAEMICKFLSKEYLKHKEKEKCEVIKNLKNIGNGNLCPVLKRTIPFGVAYHHSGLTSDERKLLEEAYSTGVLCLFTCTSTLAAGVNLPARRVILRAPYVAKEFLKRNQYKQMIGRAGRAGIDTIGESILILQEKDKQQVLELITKPLENCYSHLVQEFTKGIQTLFLSLIGLKIATNLDDIYHFMNGTFFGVQQKVLLKEKSLWEITVESLRYLTEKGLLQKDTIYKSEEEVQYNFHITKLGRASFKGTIDLAYCDILYRDLKKGLEGLVLESLLHLIYLTTPYDLVSQCNPDWMIYFRQFSQLSPAEQNVAAILGVSESFIGKKASGQAIGKKVDKNVVNRLYLSFVLYTLLKETNIWTVSEKFNMPRGYIQNLLTGTASFSSCVLHFCEELEEFWVYRALLVELTKKLTYCVKAELIPLMEVTGVLEGRAKQLYSAGYKSLMHLANANPEVLVRTIDHLSRRQAKQIVSSAKMLLHEKAEALQEEVEELLRLPSDFPGAVASSTDKA

SEQ ID NO: 37590 - protein, 1009 aa, Homo sapiens
  Payload ID: 7465
  Gene Symbol: HLTF
  Gene Name: helicase-like transcription factor
  Uniprot ID: Q14527
  ENSP ID: ENSP00000308944
MSWMFKRDPVWKYLQTVQYGVHGNFPRLSYPTFFPRFEFQDVIPPDDFLTSDEEVDSVLFGSLRGHVVGLRYYTGVVNNNEMVALQRDPNNPYDKNAIKVNNVNGNQVGHLKKELAGALAYIMDNKLAQIEGVVPFGANNAFTMPLHMTFWGKEENRKAVSDQLKKHGFKLGPAPKTLGFNLESGWGSGRAGPSYSMPVHAAVQMTTEQLKTEFDKLFEDLKEDDKTHEMEPAEAIETPLLPHQKQALAWMVSRENSKELPPFWEQRNDLYYNTITNFSEKDRPENVHGGILADDMGLGKTLTAIAVILTNFHDGRPLPIERVKKNLLKKEYNVNDDSMKLGGNNTSEKADGLSKDASRCSEQPSISDIKEKSKFRMSELSSSRPKRRKTAVQYIESSDSEEIETSELPQKMKGKLKNVQSETKGRAKAGSSKVIEDVAFACALTSSVPTTKKKMLKKGACAVEGSKKTDVEERPRTTLIICPLSVLSNWIDQFGQHIKSDVHLNFYVYYGPDRIREPALLSKQDIVLTTYNILTHDYGTKGDSPLHSIRWLRVILDEGHAIRNPNAQQTKAVLDLESERRWVLTGTPIQNSLKDLWSLLSFLKLKPFIDREWWHRTIQRPVTMGDEGGLRRLQSLIKNITLRRTKTSKIKGKPVLELPERKVFIQHITLSDEERKIYQSVKNEGRATIGRYFNEGTVLAHYADVLGLLLRLRQICCHTYLLTNAVSSNGPSGNDTPEELRKKLIRKMKLILSSGSDEECAICLDSLTVPVITHCAHVFCKPCICQVIQNEQPHAKCPLCRNDIHEDNLLECPPEELARDSEKKSDMEWTSSSKINALMHALTDLRKKNPNIKSLVVSQFTTFLSLIEIPLKASGFVFTRLDGSMAQKKRVESIQCFQNTEAGSPTIMLLSLKAGGVGLNLSAASRVFLMDPAWNPAAEDQCFDRCHRLGQKQEVIITKFIVKDSVEENMLKIQNKKRELAAGAFGTKKPNADEMKQAKINEIRTLIDL

SEQ ID NO: 37591 - protein, 1009 aa, Homo sapiens; identical to SEQ ID NO: 37590
  Payload ID: 7465
  Gene Symbol: HLTF
  Gene Name: helicase-like transcription factor
  Uniprot ID: Q14527
  ENSP ID: ENSP00000376644

SEQ ID NO: 37592 - protein, 425 aa, Homo sapiens
  Payload ID: 7465
  Gene Symbol: HLTF
  Gene Name: helicase-like transcription factor
  ENSP ID: ENSP00000420106
DYGTKGDSPLHSIRWLRVILDEGHAIRNPNAQQTKAVLDLESERRWVLTGTPIQNSLKDLWSLLSFLKLKPFIDREWWHRTIQRPVTMGDEGGLRRLQSLIKNITLRRTKTSKIKGKPVLELPERKVFIQHITLSDEERKIYQSVKNEGRATIGRYFNEGTVLAHYADVLGLLLRLRQICCHTYLLTNAVSSNGPSAFSLGNDTPEELRKKLIRKMKLILSSGSDEECAICLDSLTVPVITHCAHVFCKPCICQVIQNEQPHAKCPLCRNDIHEDNLLECPPEELARDSEKKSDMEWTSSSKINALMHALTDLRKKNPNIKSLVVSQFTTFLSLIEIPLKASGFVFTRLDGSMAQKKRVESIQCFQNTEAGSPTIMLLSLKAGGVGLNLSAASRVFLMDPAWNPAAEDQCFDRCHRLGQKQEVII

SEQ ID NO: 37593 - protein, 1009 aa, Homo sapiens; identical to SEQ ID NO: 37590
  Payload ID: 7465
  Gene Symbol: HLTF
  Gene Name: helicase-like transcription factor
  Uniprot ID: Q14527
  ENSP ID: ENSP00000420429

SEQ ID NO: 37594 - protein, 1008 aa, Homo sapiens
  Payload ID: 7465
  Gene Symbol: HLTF
  Gene Name: helicase-like transcription factor
  ENSP ID: ENSP00000420745
MSWMFKRDPVWKYLQTVQYGVHGNFPRLSYPTFFPRFEFQDVIPPDDFLTSDEEVDSVLFGSLRGHVVGLRYYTGVVNNNEMVALQRDPNNPYDKNAIKVNNVNGNQVGHLKKELAGALAYIMDNKLAQIEGVVPFGANNAFTMPLHMTFWGKEENRKAVSDQLKKHGFKLGPAPKTLGFNLESGWGSGRAGPSYSMPVHAAVQMTTEQLKTEFDKLFEDLKEDDKTHEMEPAEAIETPLLPHQKQALAWMVSRENSKELPPFWEQRNDLYYNTITNFSEKDRPENVHGGILADDMGLGKTLTAIAVILTNFHDGRPLPIERVKKNLLKKEYNVNDDSMKLGGNNTSEKADGLSKDASRCSEQPSISDIKEKSKFRMSELSSSRPKRRKTAVQYIESSDSEEIETSELPQKMKGKLKNVQSETKGRAKGSSKVIEDVAFACALTSSVPTTKKKMLKKGACAVEGSKKTDVEERPRTTLIICPLSVLSNWIDQFGQHIKSDVHLNFYVYYGPDRIREPALLSKQDIVLTTYNILTHDYGTKGDSPLHSIRWLRVILDEGHAIRNPNAQQTKAVLDLESERRWVLTGTPIQNSLKDLWSLLSFLKLKPFIDREWWHRTIQRPVTMGDEGGLRRLQSLIKNITLRRTKTSKIKGKPVLELPERKVFIQHITLSDEERKIYQSVKNEGRATIGRYFNEGTVLAHYADVLGLLLRLRQICCHTYLLTNAVSSNGPSGNDTPEELRKKLIRKMKLILSSGSDEECAICLDSLTVPVITHCAHVFCKPCICQVIQNEQPHAKCPLCRNDIHEDNLLECPPEELARDSEKKSDMEWTSSSKINALMHALTDLRKKNPNIKSLVVSQFTTFLSLIEIPLKASGFVFTRLDGSMAQKKRVESIQCFQNTEAGSPTIMLLSLKAGGVGLNLSAASRVFLMDPAWNPAAEDQCFDRCHRLGQKQEVIITKFIVKDSVEENMLKIQNKKRELAAGAFGTKKPNADEMKQAKINEIRTLIDL

SEQ ID NO: 37595 - protein, 327 aa, Homo sapiens
  Payload ID: 7466
  Gene Symbol: HELT
  Gene Name: helt bHLH transcription factor
  ENSP ID: ENSP00000343464
MSDKLKERKVSRLSPNGTCALVVEASDSPTRHLGGPMAGKCPHGTLSVEESRVRTPVSHKVIEKRRRDRINRCLNELGKTVPMALAKQGEPQEALAQIRSRVRSLVLSSATVPDQQALGRCEGPFLLLQSSGKLEKAEILEMTVQYLRALHSADFPRGREKAELLAEFANYFHYGYHECMKNLVHYLTTVERMETKDTKYARILAFLQSKARLGAEPAFPPLGSLPEPDFSYQLHPAGPEFAGHSPGEAAVFPQGSGAGPFPWPPGAARSPALPYLPSAPVPLASPAQQHSPFLTPVQGLDRHYLNLIGHAHPNALNLHTPQHPPVL

SEQ ID NO: 37596 - protein, 241 aa, Homo sapiens
  Payload ID: 7466
  Gene Symbol: HELT
  Gene Name: helt bHLH transcription factor
  Uniprot ID: A6NFD8
  ENSP ID: ENSP00000422140
MSDKLKERKRTPVSHKVIEKRRRDRINRCLNELGKTVPMALAKQSSGKLEKAEILEMTVQYLRALHSADFPRGREKELLAEFANYFHYGYHECMKNLVHYLTTVERMETKDTKYARILAFLQSKARLGAEPAFPPLGSLPEPDFSYQLHPAGPEFAGHSPGEAAVFPQGSGAGPFPWPPGAARSPALPYLPSAPVPLASPAQQHSPFLTPVQGLDRHYLNLIGHAHPNALNLHTPQHPPVL

SEQ ID NO: 37597 - protein, 242 aa, Homo sapiens
  Payload ID: 7466
  Gene Symbol: HELT
  Gene Name: helt bHLH transcription factor
  Uniprot ID: A6NFD8
  ENSP ID: ENSP00000426033
MSDKLKERKRTPVSHKVIEKRRRDRINRCLNELGKTVPMALAKQSSGKLEKAEILEMTVQYLRALHSADFPRGREKAELLAEFANYFHYGYHECMKNLVHYLTTVERMETKDTKYARILAFLQSKARLGAEPAFPPLGSLPEPDFSYQLHPAGPEFAGHSPGEAAVFPQGSGAGPFPWPPGAARSPALPYLPSAPVPLASPAQQHSPFLTPVQGLDRHYLNLIGHAHPNALNLHTPQHPPVL

SEQ ID NO: 37598 - protein, 44 aa, Homo sapiens
  Payload ID: 7467
  Gene Symbol: HN1
  Gene Name: hematological and neurological expressed 1
  ENSP ID: ENSP00000303110
MTTTTTFKGVDPNSRNSSRDTGSCHVAQAGLELLGSSDDPALAS

SEQ ID NO: 37599 - protein, 181 aa, Homo sapiens
  Payload ID: 7467
  Gene Symbol: HN1
  Gene Name: hematological and neurological expressed 1
  Uniprot ID: Q9UK76
  ENSP ID: ENSP00000348316
MTTTTTFKGVDPNSRNSSRVLRPPGGGSNFSLGFDEPTEQPVRKNKMASNIFGTPEENQASWAKSAGAKSSGGREDLESSGLQRRNSSEASSGDFLDLKKMWTQTCQAAWGRVKRSPCLLRLCPARWPRPQCHPEEIPLAASPASSWVSSDCPERCRSVCFLHACELHNLSLTVHLLDLFH

SEQ ID NO: 37600 - protein, 154 aa, Homo sapiens
  Payload ID: 7467
  Gene Symbol: HN1
  Gene Name: hematological and neurological expressed 1
  Uniprot ID: Q9UK76
  ENSP ID: ENSP00000387059
MTTTTTFKGVDPNSRNSSRVLRPPGGGSNFSLGFDEPTEQPVRKNKMASNIFGTPEENQASWAKSAGAKSSGGREDLESSGLQRRNSSEASSGDFLDLKGEGDIHENVDTDLPGSLGQSEEKPVPAAPVPSPVAPAPVPSRRNPPGGKSSLVLG

SEQ ID NO: 37601 - protein, 108 aa, Homo sapiens
  Payload ID: 7467
  Gene Symbol: HN1
  Gene Name: hematological and neurological expressed 1
  Uniprot ID: Q9UK76
  ENSP ID: ENSP00000462478
MASNIFGTPEENQASWAKSAGAKSSGGREDLESSGLQRRNSSEASSGDFLDLKGEGDIHENVDTDLPGSLGQSEEKPVPAAPVPSPVAPAPVPSRRNPPGGKSSLVLG

SEQ ID NO: 37602 - protein, 93 aa, Homo sapiens
  Payload ID: 7467
  Gene Symbol: HN1
  Gene Name: hematological and neurological expressed 1
  ENSP ID: ENSP00000462493
MASNIFGTPEENQASWAKSAGAKSSGGREDLESSGLQRRNSSEASSGDFLDLKGEGDIHENVDTDLPGSLGQSEEKPVPAAPVPSPVAPAPVP

SEQ ID NO: 37603 - protein, 108 aa, Homo sapiens; identical to SEQ ID NO: 37601
  Payload ID: 7467
  Gene Symbol: HN1
  Gene Name: hematological and neurological expressed 1
  Uniprot ID: Q9UK76
  ENSP ID: ENSP00000462784

SEQ ID NO: 37604 - protein, 104 aa, Homo sapiens
  Payload ID: 7467
  Gene Symbol: HN1
  Gene Name: hematological and neurological expressed 1
  ENSP ID: ENSP00000462805
MTTTTTFKGVDPNSRNSSRVLRPPGGGSNFSLGFDEPTEQPVRKNKMASNIFGTPEENQASWAKSAGAKSSGGREDLESSGLQRRNSSEASSGDFLDLKVSVTA

SEQ ID NO: 37605 - protein, 108 aa, Homo sapiens; identical to SEQ ID NO: 37601
  Payload ID: 7467
  Gene Symbol: HN1
  Gene Name: hematological and neurological expressed 1
  Uniprot ID: Q9UK76
  ENSP ID: ENSP00000462834

SEQ ID NO: 37606 - protein, 108 aa, Homo sapiens; identical to SEQ ID NO: 37601
  Payload ID: 7467
  Gene Symbol: HN1
  Gene Name: hematological and neurological expressed 1
  Uniprot ID: Q9UK76
  ENSP ID: ENSP00000464266

SEQ ID NO: 37607 - protein, 190 aa, Homo sapiens
  Payload ID: 7468
  Gene Symbol: HN1L
  Gene Name: hematological and neurological expressed 1-like
  Uniprot ID: Q9H910
  ENSP ID: ENSP00000248098
MFQVPDSEGGRAGSRAMKPPGGESSNLFGSPEEATPSSRPNRMASNIFGPTEEPQNIPKRTNPPGGKGSGIFDESTPVQTRQHLNPPGGKTSDIFGSPVTATSRLAHPNKPKDHVFLCEGEEPKSDLKAARSIPAGAEPGEKGSARKAGPAKEQEPMPTVDSHEPRLGPRPRSHNKVLNPPGGKSSISFY

SEQ ID NO: 37608 - protein, 178 aa, Homo sapiens
  Payload ID: 7468
  Gene Symbol: HN1L
  Gene Name: hematological and neurological expressed 1-like
  ENSP ID: ENSP00000372157
MMRAMKPPGGESSNLFGSPEEATPSSRPNRMASNIFGPTEEPQNIPKRTNPPGGKGSGIFDESTPVQTRQHLNPPGGKTSDIFGSPVTATSRLAHPNKPKDHVFLCEGEEPKSDLKAARSIPAGAEPGEKGSARKAGPAKEQEPMPTVDSHEPRLGPRPRSHNKVLNPPGGKSSISFY

SEQ ID NO: 37609 - protein, 174 aa, Homo sapiens
  Payload ID: 7468
  Gene Symbol: HN1L
  Gene Name: hematological and neurological expressed 1-like
  Uniprot ID: Q9H910
  ENSP ID: ENSP00000372158
MKPPGGESSNLFGSPEEATPSSRPNRMASNIFGPTEEPQNIPKRTNPPGGKGSGIFDESTPVQTRQHLNPPGGKTSDIFGSPVTATSRLAHPNKPKDHVFLCEGEEPKSDLKAARSIPAGAEPGEKGSARKAGPAKEQEPMPTVDSHEPRLGPRPRSHNKVLNPPGGKSSISFY

SEQ ID NO: 37610 - protein, 70 aa, Homo sapiens
  Payload ID: 7468
  Gene Symbol: HN1L
  Gene Name: hematological and neurological expressed 1-like
  ENSP ID: ENSP00000454459
MFQVPDSEGGRAGSRAMKPPGGESSNLFGSPEEATPSSRPNRMASNIFGPTEEPQNIPKRTNPPGSCFLM

SEQ ID NO: 37611 - protein, 115 aa, Homo sapiens
  Payload ID: 7468
  Gene Symbol: HN1L
  Gene Name: hematological and neurological expressed 1-like
  ENSP ID: ENSP00000454529
MKPPGGESSNLFGSPEEATPSSRPNRMASNIFGPTEEPQNIPKRTNPPGGKGSGIFDESTPVQTRQHLNPPGGKTSDIFGSPVTATSRLAHPNKPKDHVFLCEGEEPKSDLKAAR

SEQ ID NO: 37612 - protein, 190 aa, Homo sapiens
  Payload ID: 7468
  Gene Symbol: HN1L
  Gene Name: hematological and neurological expressed 1-like
  ENSP ID: ENSP00000454567
MFQVPDSEGGRAGSRAMKPPGGESSNLFGSPEEATPSSRPNRMASNIFGPTEEPQNIPKRTNPPGGKGSGIFDESTPVQTRQHLNPPGGKTSDIFGSPVTATSRLAHPNKPKDHVFLCEGEEPKSDLKAARSIPAGAEPEKSQLFRYTKEEEELWRPPSTKLYRTSGSNSQTSFQKRLETLGQEMKEFSS

SEQ ID NO: 37613 - protein, 77 aa, Homo sapiens
  Payload ID: 7468
  Gene Symbol: HN1L
  Gene Name: hematological and neurological expressed 1-like
  ENSP ID: ENSP00000456487
MFQVPDSEGGRAGSRKWQLLTGSLASTSPSLLSGQGPWAPLQRSASTRLVSGGHEAPRRRIEQSFWKSRRSYSFQQA

SEQ ID NO: 37614 - protein, 116 aa, Homo sapiens
  Payload ID: 7468
  Gene Symbol: HN1L
  Gene Name: hematological and neurological expressed 1-like
  ENSP ID: ENSP00000457344
PSSRPNRMASNIFGPTEEPQNIPKRTNPPGGKGSGIFDESTPVQTRQHLNPPGGKTSDIFGSPVTATSRLAHPNKPKDHVFLCEGEEPKSDLKAARSIPAGAEPGIMWIQGKLLRL

SEQ ID NO: 37615 - protein, 167 aa, Homo sapiens
  Payload ID: 7468
  Gene Symbol: HN1L
  Gene Name: hematological and neurological expressed 1-like
  ENSP ID: ENSP00000457424
MKPPGGESSNLFGSPEEATPSSRPNRMASNIFGPTEEPQNIPKRTNPPGGKGSGIFDESTPVQTRQHLNPPGGKTSDIFGSPVTATSRLAHPNKPKDHVFLCEGEEPKSDLKAARSIPAGAEPGEKGSARKAGPAKEQEPMPTVDSHEPRLGPRPRSHNKVLNPPGG

SEQ ID NO: 37616 - protein, 98 aa, Homo sapiens
  Payload ID: 7468
  Gene Symbol: HN1L
  Gene Name: hematological and neurological expressed 1-like
  ENSP ID: ENSP00000457536
MFQVPDSEGGRAGSRKWQLLTGSLASTSPSLLSGQGPWAPLQRAMKPPGGESSNLFGSPEEATPSSRPNRMASNIFGPTEEPQNIPKRTNPPGSCFLM

SEQ ID NO: 37617 - protein, 218 aa, Homo sapiens
  Payload ID: 7468
  Gene Symbol: HN1L
  Gene Name: hematological and neurological expressed 1-like
  Uniprot ID: Q9H910
  ENSP ID: ENSP00000457694
MFQVPDSEGGRAGSRKWQLLTGSLASTSPSLLSGQGPWAPLQRAMKPPGGESSNLFGSPEEATPSSRPNRMASNIFGPTEEPQNIPKRTNPPGGKGSGIFDESTPVQTRQHLNPPGGKTSDIFGSPVTATSRLAHPNKPKDHVFLCEGEEPKSDLKAARSIPAGAEPGEKGSARKAGPAKEQEPMPTVDSHEPRLGPRPRSHNKVLNPPGGKSSISFY

SEQ ID NO: 37618 - protein, 93 aa, Homo sapiens
  Payload ID: 7469
  Gene Symbol: HCST
  Gene Name: hematopoietic cell signal transducer
  Uniprot ID: Q9UBK5
  ENSP ID: ENSP00000246551
MIHLGHILFLLLLPVAAAQTTPGERSSLPAFYPGTSGSCSGCGSLSLPLLAGLVAADAVASLLIVGAVFLCARPRRSPAQEDGKVYINMPGRG

SEQ ID NO: 37619 - protein, 92 aa, Homo sapiens
  Payload ID: 7469
  Gene Symbol: HCST
  Gene Name: hematopoietic cell signal transducer
  Uniprot ID: Q9UBK5
  ENSP ID: ENSP00000400516
MIHLGHILFLLLLPVAAAQTTPGERSSLPAFYPGTSGSCSGCGSLSLPLLAGLVAADAVASLLIVGAVFLCARPRRSPAQDGKVYINMPGRG

SEQ ID NO: 37620 - protein, 486 aa, Homo sapiens
  Payload ID: 7470
  Gene Symbol: HCLS1
  Gene Name: hematopoietic cell-specific Lyn substrate 1
  Uniprot ID: P14317
  ENSP ID: ENSP00000320176
MWKSVVGHDVSVSVETQGDDWDTDPDFVNDISEKEQRWGAKTIEGSGRTEHINIHQLRNKVSEEHDVLRKKEMESGPKASHGYGGRFGVERDRMDKSAVGHEYVAEVEKHSSQTDAAKGFGGKYGVERDRADKSAVGFDYKGEVEKHTSQKDYSRGFGGRYGVEKDKWDKAALGYDYKGETEKHESQRDYAKGFGGQYGIQKDRVDKSAVGFNEMEAPTTAYKKTTPIEAASSGTRGLKAKFESMAEEKRKREEEEKAQQVARRQQERKAVTKRSPEAPQPVIAMEEPAVPAPLPKKISSEAWPPVGTPPSSESEPVRTSREHPVPLLPIRQTLPEDNEEPPALPPRTLEGLQVEEEPVYEAEPEPEPEPEPEPENDYEDVEEMDRHEQEDEPEGDYEEVLEPEDSSFSSALAGSSGCPAGAGAGAVALGISAVAVYDYQGEGSDELSFDPDDVITDIEMVDEGWWRGRCHGHFGLFPANYVKLLE

SEQ ID NO: 37621 - protein, 449 aa, Homo sapiens
  Payload ID: 7470
  Gene Symbol: HCLS1
  Gene Name: hematopoietic cell-specific Lyn substrate 1
  ENSP ID: ENSP00000387645
MWKSVVGHDVSVSVETQGDDWDTDPDFVNDISEKEQRWGAKTIEGSGRTEHINIHQLRNKVSEEHDVLRKKEMESGPKASHGYGGRFGVERDRMDKSAVGHEYVAEVEKHSSQTDAAKGFGGKYGVERDRADKSAVGFDYKGEVEKHTSQKDYAKGFGGQYGIQKDRVDKSAVGFNEMEAPTTAYKKTTPIEAASSGTRGLKAKFESMAEEKRKREEEEKAQQVARRQQERKAVTKRSPEAPQPVIAMEEPAVPAPLPKKISSEAWPPVGTPPSSESEPVRTSREHPVPLLPIRQTLPEDNEEPPALPPRTLEGLQVEEEPVYEAEPEPEPEPEPEPENDYEDVEEMDRHEQEDEPEGDYEEVLEPEDSSFSSALAGSSGCPAGAGAGAVALGISAVAVYDYQGEGSDELSFDPDDVITDIEMVDEGWWRGRCHGHFGLFPANYVKLLE

SEQ ID NO: 37622 - protein, 209 aa, Homo sapiens
  Payload ID: 7470
  Gene Symbol: HCLS1
  Gene Name: hematopoietic cell-specific Lyn substrate 1
  Uniprot ID: P14317
  ENSP ID: ENSP00000418299
MWKSVVGHDVSVSVETQGDDWDTDPDFVNDISEKEQRWGAKTIEGSGRTEHINIHQLRNKVSEEHDVLRKKEMESGPKASHGYGGRFGVERDRMDKSAVGHEYVAEVEKHSSQTDAAKGFGGKYGVERDRADKITLVALVAGTGWRRINGTKQLWDMTTRERRRNTSPREIMPRALVASMESRRTEWIRALSASMKWRPRPQLIRRRRP

SEQ ID NO: 37623 - protein, 76 aa, Homo sapiens
  Payload ID: 7470
  Gene Symbol: HCLS1
  Gene Name: hematopoietic cell-specific Lyn substrate 1
  ENSP ID: ENSP00000419614
MWKSVVGHDVSVSVETQGDDWDTDPDFVNDISEKEQRWGAKTIEGSGRTEHIKIDEPWSCGFFQHPPAEEQSIRGA

SEQ ID NO: 37624 - protein, 75 aa, Homo sapiens
  Payload ID: 7470
  Gene Symbol: HCLS1
  Gene Name: hematopoietic cell-specific Lyn substrate 1
  ENSP ID: ENSP00000420507
MWKSVVGHDVSVSVETQGDDWDTDPDFVNDISEKEQRWGAKTIEGSGRTEHINIPWLWRSVWSRKRPNGQECSGP

SEQ ID NO: 37625 - protein, 199 aa, Homo sapiens
  Payload ID: 7471
  Gene Symbol: HPGDS
  Gene Name: hematopoietic prostaglandin D synthase
  Uniprot ID: O60760
  ENSP ID: ENSP00000295256
MPNYKLTYFNMRGRAEIIRYIFAYLDIQYEDHRIEQADWPEIKSTLPFGKIPILEVDGLTLHQSLAIARYLTKNTDLAGNTEMEQCHVDAIVDTLDDFMSCFPWAEKKQDVKEQMFNELLTYNAPHLMQDLDTYLGGREWLIGNSVTWADFYWEICSTTLLVFKPDLLDNHPRLVTLRKKVQAIPAVANWIKRRPQTKL

SEQ ID NO: 37626 - protein, 173 aa, Homo sapiens
  Payload ID: 7472
  Gene Symbol: HSH2D
  Gene Name: hematopoietic SH2 domain containing
  ENSP ID: ENSP00000467189
MTEAGKLPLPLPPRLDWDAENLLESQPLGSFLIRVSHSHVGYTLSYKAQSSCCHFMVKLLDDGTFMIPGEKVAHTSLDALVTFHQQKPIEPRRELLTQPCRQKDPANVDYEDLFLYSNAVAEEAACPVSAPEEASPKPVLCHQSKERKPSAEMNRITTKEATSSCPPKSPLGE

SEQ ID NO: 37627 - protein, 40 aa, Homo sapiens
  Payload ID: 7472
  Gene Symbol: HSH2D
  Gene Name: hematopoietic SH2 domain containing
  ENSP ID: ENSP00000468142
  MOD_RES (1)..(1): Any amino acid
XMLRTCWSHSHWDPFSSGSVTAMWATHSPTKPKAAAAISW

SEQ ID NO: 37628 - protein, 72 aa, Homo sapiens
  Payload ID: 7472
  Gene Symbol: HSH2D
  Gene Name: hematopoietic SH2 domain containing
  ENSP ID: ENSP00000468495
MTEAGKLPLPLPPRLDWFVHTQMGQLAQDGVPEWFHGAISREDAENLLESQPLGSFLIRVSHSHVGYTLSYK

SEQ ID NO: 37629 - protein, 69 aa, Homo sapiens
  Payload ID: 7472
  Gene Symbol: HSH2D
  Gene Name: hematopoietic SH2 domain containing
  ENSP ID: ENSP00000477674
MTEAGKLPLPLPPRLDWFVHTQMGQLAQDGVPEWFHGAISRDSLGSGVYSPLEEAEGQKGRDDCLRSHS

SEQ ID NO: 37630 - protein, 352 aa, Homo sapiens
  Payload ID: 7472
  Gene Symbol: HSH2D
  Gene Name: hematopoietic SH2 domain containing
  Uniprot ID: Q96JZ2
  ENSP ID: ENSP00000482604
MTEAGKLPLPLPPRLDWFVHTQMGQLAQDGVPEWFHGAISREDAENLLESQPLGSFLIRVSHSHVGYTLSYKAQSSCCHFMVKLLDDGTFMIPGEKVAHTSLDALVTFHQQKPIEPRRELLTQPCRQKDPANVDYEDLFLYSNAVAEEAACPVSAPEEASPKPVLCHQSKERKPSAEMNRITTKEATSSCPPKSPLGETRQKLWRSLKMLPERGQRVRQQLKSHLATVNLSSLLDVRRSTVISGPGTGKGSQDHSGDPTSGDRGYTDPCVATSLKSPSQPQAPKDRKVPTRKAERSVSCIEVTPGDRSWHQMVVRALSSQESKPEHQGLAEPENDQLPEEYQQPPPFAPGYC

SEQ ID NO: 37631 - protein, 352 aa, Homo sapiens; identical to SEQ ID NO: 37630
  Payload ID: 7472
  Gene Symbol: HSH2D
  Gene Name: hematopoietic SH2 domain containing
  Uniprot ID: Q96JZ2
  ENSP ID: ENSP00000483354

SEQ ID NO: 37632 - protein, 85 aa, Homo sapiens
  Payload ID: 7472
  Gene Symbol: HSH2D
  Gene Name: hematopoietic SH2 domain containing
  ENSP ID: ENSP00000483685
MTEAGKLPLPLPPRLDWFVHTQMGQLAQDGVPEWFHGAISREDAENLLESQPLGSFLIRVSHSHVGYTLSYNVSAEPKAAAAISW

SEQ ID NO: 37633 - protein, 270 aa, Homo sapiens
  Payload ID: 7473
  Gene Symbol: HHEX
  Gene Name: hematopoietically expressed homeobox
  Uniprot ID: Q03014
  ENSP ID: ENSP00000282728
MQYPHPGPAAGAVGVPLYAPTPLLQPAHPTPFYIEDILGRGPAAPTPAPTLPSPNSSFTSLVSPYRTPVYEPTPIHPAFSHHSAAALAAAYGPGGFGGPLYPFPRTVNDYTHALLRHDPLGKPLLWSPFLQRPLHKRKGGQVRFSNDQTIELEKKFETQKYLSPPERKRLAKMLQLSERQVKTWFQNRRAKWRRLKQENPQSNKKEELESLDSSCDQRQDLPSEQNKGASLDSSQCSPSPASQEDLESEISEDSDQEVDIEGDKSYFNAG

SEQ ID NO: 37634 - protein, 98 aa, Homo sapiens
  Payload ID: 7473
  Gene Symbol: HHEX
  Gene Name: hematopoietically expressed homeobox
  ENSP ID: ENSP00000447953
MLQLSERQVKTWFQNRRAKWRRLKQENPQSNKKEELESLDSSCDQRQDLPSEQNKGASLDSSQCSPSPASQEDLESEISEDSDQEVDIEGDKSYFNAG

SEQ ID NO: 37635 - protein, 98 aa, Homo sapiens; identical to SEQ ID NO: 37634
  Payload ID: 7473
  Gene Symbol: HHEX
  Gene Name: hematopoietically expressed homeobox
  ENSP ID: ENSP00000450017

SEQ ID NO: 37636 - protein, 189 aa, Homo sapiens
  Payload ID: 7474
  Gene Symbol: HEBP1
  Gene Name: heme binding protein 1
  Uniprot ID: Q9NRV9
  ENSP ID: ENSP00000014930
MLGMIKNSLFGSVETWPWQVLSKGDKEEVAYEERACEGGKFATVEVTDKPVDEALREAMPKVAKYAGGTNDKGIGMGMTVPISFAVFPNEDGSLQKKLKVWFRIPNQFQSDPPAPSDKSVKIEEREGITVYSMQFGGYAKEADYVAQATRLRAALEGTATYRGDIYFCTGYDPPMKPYGRRNEIWLLKT

SEQ ID NO: 37637 - protein, 133 aa, Homo sapiens
  Payload ID: 7474
  Gene Symbol: HEBP1
  Gene Name: heme binding protein 1
  ENSP ID: ENSP00000441678
MLGMIKNSLFGSVETWPWQVLSKGDKEEVAYEERACEGGKFATVEVTDKPVDEALREAMPKVAKYAGGTNDKGIGMGMTVPISFAVFPNEDGSLQKKLKVWFRIPNQFQSDPPAPSDKSVKIEEREGITVYSM

SEQ ID NO: 37638 - protein, 62 aa, Homo sapiens
  Payload ID: 7474
  Gene Symbol: HEBP1
  Gene Name: heme binding protein 1
  ENSP ID: ENSP00000442020
KGIGMGMTVPISFAVFPNEDGSLQKKLKVWFRIPNQFQSDPPAPSDKSVKIEEREGITVYSI

SEQ ID NO: 37639 - protein, 116 aa, Homo sapiens
  Payload ID: 7475
  Gene Symbol: HEBP2
  Gene Name: heme binding protein 2
  ENSP ID: ENSP00000356670
MAEPLQPDPGAAEDAAAQAVETPGWKAPEDAGPQPGSYEIRHYGPAKWVSTSVESMDWDSAIQTGFTKLNSYIQGKNEKEMKIKMTAPVTSYVEPGSGPFSLSMDFLVPKRIKNNF

SEQ ID NO: 37640 - protein, 127 aa, Homo sapiens
  Payload ID: 7475
  Gene Symbol: HEBP2
  Gene Name: heme binding protein 2
  ENSP ID: ENSP00000392101
MGVLWGAPEPCRVPAAGDSNAESAWPAERGCWGTEPHPTRLGKALPGSYEIRHYGPAKWVSTSVESMDWDSAIQTGFTKLNSYIQGKNEKEMKIKMTAPVTSYVEPGSGPFSLSMDFLVPKRIKNNF

SEQ ID NO: 37641 - protein, 45 aa, Homo sapiens
  Payload ID: 7475
  Gene Symbol: HEBP2
  Gene Name: heme binding protein 2
  ENSP ID: ENSP00000395958
  MOD_RES (1)..(1): Any amino acid
XMKIKMTAPVTSYVEPGSGPFREGKRGNVQVKIESGKGASTGVLV

SEQ ID NO: 37642 - protein, 205 aa, Homo sapiens
  Payload ID: 7475
  Gene Symbol: HEBP2
  Gene Name: heme binding protein 2
  Uniprot ID: Q9Y5Z4
  ENSP ID: ENSP00000475750
MAEPLQPDPGAAEDAAAQAVETPGWKAPEDAGPQPGSYEIRHYGPAKWVSTSVESMDWDSAIQTGFTKLNSYIQGKNEKEMKIKMTAPVTSYVEPGSGPFSESTITISLYIPSEQQFDPPRPLESDVFIEDRAEMTVFVRSFDGFSSAQKNQEQLLTLASILREDGKVFDEKVYYTAGYNSPVKLLNRNNEVWLIQKNEPTKENE

SEQ ID NO: 37643 - protein, 288 aa, Homo sapiens
  Payload ID: 7476
  Gene Symbol: HMOX1
  Gene Name: heme oxygenase 1
  Uniprot ID: P09601
  ENSP ID: ENSP00000216117
MERPQPDSMPQDLSEALKEATKEVHTQAENAEFMRNFQKGQVTRDGFKLVMASLYHIYVALEEEIERNKESPVFAPVYFPEELHRKAALEQDLAFWYGPRWQEVIPYTPAMQRYVKRLHEVGRTEPELLVAHAYTRYLGDLSGGQVLKKIAQKALDLPSSGEGLAFFTFPNIASATKFKQLYRSRMNSLEMTPAVRQRVIEEAKTAFLLNIQLFEELQELLTHDTKDQSPSRAPGLRQRASNKVQDSAPVETPRGKPPLNTRSQAPLLRWVLTLSFLVATVAVGLYAM

SEQ ID NO: 37644 - protein, 187 aa, Homo sapiens
  Payload ID: 7476
  Gene Symbol: HMOX1
  Gene Name: heme oxygenase 1
  ENSP ID: ENSP00000413316
MERPQPDSMPQDLSEALKEATKEVHTQAENAEFMRNFQKGQVTRDGFKLVMASLYHIYVALEEEIERNKESPVFAPVYFPEELHRKAALEQDLAFWYGPRWQEVIPYTPAMQRYVKRLHEVGRTEPELLVAHAYTRYLGDLSGGQVLKKIAQKALDLPSSGEGLAFFTFPNIASATKFKQLYRSRMN

SEQ ID NO: 37645 - protein, 316 aa, Homo sapiens
  Payload ID: 7477
  Gene Symbol: HMOX2
  Gene Name: heme oxygenase 2
  Uniprot ID: P30519
  ENSP ID: ENSP00000219700
MSAEVETSEGVDESEKKNSGALEKENQMRMADLSELLKEGTKEAHDRAENTQFVKDFLKGNIKKELFKLATTALYFTYSALEEEMERNKDHPAFAPLYFPMELHRKEALTKDMEYFFGENWEEQVQCPKAAQKYVERIHYIGQNEPELLVAHAYTRYMGDLSGGQVLKKVAQRALKLPSTGEGTQFYLFENVDNAQQFKQLYRARMNALDLNMKTKERIVEEANKAFEYNMQIFNELDQAGSTLARETLEDGFPVHDGKGDMRKCPFYAAEQDKGALEGSSCPFRTAMAVLRKPSLQFILAAGVALAAGLLAWYYM

SEQ ID NO: 37646 - protein, 316 aa, Homo sapiens; identical to SEQ ID NO: 37645
  Payload ID: 7477
  Gene Symbol: HMOX2
  Gene Name: heme oxygenase 2
  Uniprot ID: P30519
  ENSP ID: ENSP00000381595

SEQ ID NO: 37647 - protein, 316 aa, Homo sapiens; identical to SEQ ID NO: 37645
  Payload ID: 7477
  Gene Symbol: HMOX2
  Gene Name: heme oxygenase 2
  Uniprot ID: P30519
  ENSP ID: ENSP00000385100

SEQ ID NO: 37648 - protein, 316 aa, Homo sapiens; identical to SEQ ID NO: 37645
  Payload ID: 7477
  Gene Symbol: HMOX2
  Gene Name: heme oxygenase 2
  Uniprot ID: P30519
  ENSP ID: ENSP00000391637

SEQ ID NO: 37649 - protein, 316 aa, Homo sapiens; identical to SEQ ID NO: 37645
  Payload ID: 7477
  Gene Symbol: HMOX2
  Gene Name: heme oxygenase 2
  Uniprot ID: P30519
  ENSP ID: ENSP00000394103

SEQ ID NO: 37650 - protein, 229 aa, Homo sapiens
  Payload ID: 7477
  Gene Symbol: HMOX2
  Gene Name: heme oxygenase 2
  ENSP ID: ENSP00000458592
MSAEVETSEGVDESEKKNSGALEKENQMRMADLSELLKEGTKEAHDRAENTQFVKDFLKGNIKKELFKLATTALYFTYSALEEEMERNKDHPAFAPLYFPMELHRKEALTKDMEYFFGENWEEQVQCPKAAQKYVERIHYIGQNEPELLVAHAYTRYMGDLSGGQVLKKVAQRALKLPSTGEGTQFYLFENVDNAQQFKQLYRARMNALDLNMKTKERIVEEANKAFEY

SEQ ID NO: 37651 - protein, 238 aa, Homo sapiens
  Payload ID: 7477
  Gene Symbol: HMOX2
  Gene Name: heme oxygenase 2
  ENSP ID: ENSP00000458797
MSAEVETSEGVDESEKKNSGALEKENQMRMADLSELLKEGTKEAHDRAENTQFVKDFLKGNIKKELFKLATTALYFTYSALEEEMERNKDHPAFAPLYFPMELHRKEALTKDMEYFFGENWEEQVQCPKAAQKYVERIHYIGQNEPELLVAHAYTRYMGDLSGGQVLKKVAQRALKLPSTGEGTQFYLFENVDNAQQFKQLYRARMNALDLNMKTKERIVEEANKAFEYNMQIFNELD

SEQ ID NO: 37652 - protein, 131 aa, Homo sapiens
  Payload ID: 7477
  Gene Symbol: HMOX2
  Gene Name: heme oxygenase 2
  ENSP ID: ENSP00000458824
MSAEVETSEGVDESEKKNSGALEKENQMRMADLSELLKEGTKEAHDRAENTQFVKDFLKGNIKKELFKLATTALYFTYSALEEEMERNKDHPAFAPLYFPMELHRKEALTKDMEYFFGENWEEQVQCPKAA

SEQ ID NO: 37653 - protein, 110 aa, Homo sapiens
  Payload ID: 7477
  Gene Symbol: HMOX2
  Gene Name: heme oxygenase 2
  ENSP ID: ENSP00000459203
  MOD_RES (1)..(1): Any amino acid
XQFYLFENVDNAQQFKQLYRARMNALDLNMKTKERIVEEANKAFEYNMQIFNELDQAGSTLARETLEDGFPVHDGKGDMRKCPFYAAEQDKGRSVCPELPSWGRCSRRLH

SEQ ID NO: 37654 - protein, 316 aa, Homo sapiens; identical to SEQ ID NO: 37645
  Payload ID: 7477
  Gene Symbol: HMOX2
  Gene Name: heme oxygenase 2
  Uniprot ID: P30519
  ENSP ID: ENSP00000459214

SEQ ID NO: 37655 - protein, 110 aa, Homo sapiens
  Payload ID: 7477
  Gene Symbol: HMOX2
  Gene Name: heme oxygenase 2
  ENSP ID: ENSP00000459445
MSAEVETSEGVDESEKKNSGALEKENQMRMADLSELLKEGTKEAHDRAENTQFVKDFLKGNIKKELFKLATTALYFTYSALEEEMERNKDHPAFAPLYFPMELHRKEALT

SEQ ID NO: 37656 - protein, 287 aa, Homo sapiens
  Payload ID: 7477
  Gene Symbol: HMOX2
  Gene Name: heme oxygenase 2
  Uniprot ID: P30519
  ENSP ID: ENSP00000460926
MADLSELLKEGTKEAHDRAENTQFVKDFLKGNIKKELFKLATTALYFTYSALEEEMERNKDHPAFAPLYFPMELHRKEALTKDMEYFFGENWEEQVQCPKAAQKYVERIHYIGQNEPELLVAHAYTRYMGDLSGGQVLKKVAQRALKLPSTGEGTQFYLFENVDNAQQFKQLYRARMNALDLNMKTKERIVEEANKAFEYNMQIFNELDQAGSTLARETLEDGFPVHDGKGDMRKCPFYAAEQDKGALEGSSCPFRTAMAVLRKPSLQFILAAGVALAAGLLAWYYM

SEQ ID NO: 37657 - protein, 132 aa, Homo sapiens
  Payload ID: 7477
  Gene Symbol: HMOX2
  Gene Name: heme oxygenase 2
  ENSP ID: ENSP00000460992
MSAEVETSEGVDESEKKNSGALEKENQMRMADLSELLKEGTKEAHDRAENTQFVKDFLKGNIKKELFKLATTALYFTYSALEEEMERNKDHPAFAPLYFPMELHRKEALTKDMEYFFGENWEEQVQCPKAAQ

SEQ ID NO: 37658 - protein, 130 aa, Homo sapiens
  Payload ID: 7477
  Gene Symbol: HMOX2
  Gene Name: heme oxygenase 2
  ENSP ID: ENSP00000461428
MSAEVETSEGVDESEKKNSGALEKENQMRMADLSELLKEGTKEAHDRAENTQFVKDFLKGNIKKELFKLATTALYFTYSALEEEMERNKDHPAFAPLYFPMELHRKEALTKDMEYFFGENWEEQVQCPKA

SEQ ID NO: 37659 - protein, 370 aa, Homo sapiens
  Payload ID: 7477
  Gene Symbol: HMOX2
  Gene Name: heme oxygenase 2
  ENSP ID: ENSP00000477572
MESRSVAQAGVQWISLAHCSLHLLGSRDSPASASCVAGITGPEEREQQEPHPAAMSAEVETSEGVDESEKKNSGALEKENQMRMADLSELLKEGTKEAHDRAENTQFVKDFLKGNIKKELFKLATTALYFTYSALEEEMERNKDHPAFAPLYFPMELHRKEALTKDMEYFFGENWEEQVQCPKAAQKYVERIHYIGQNEPELLVAHAYTRYMGDLSGGQVLKKVAQRALKLPSTGEGTQFYLFENVDNAQQFKQLYRARMNALDLNMKTKERIVEEANKAFEYNMQIFNELDQAGSTLARETLEDGFPVHDGKGDMRKCPFYAAEQDKGALEGSSCPFRTAMAVLRKPSLQFILAAGVALAAGLLAWYYM

SEQ ID NO: 37660 - protein, 316 aa, Homo sapiens; identical to SEQ ID NO: 37645
  Payload ID: 7477
  Gene Symbol: HMOX2
  Gene Name: heme oxygenase 2
  Uniprot ID: P30519
  ENSP ID: ENSP00000478785

SEQ ID NO: 37661 - protein, 370 aa, Homo sapiens; identical to SEQ ID NO: 37659
  Payload ID: 7477
  Gene Symbol: HMOX2
  Gene Name: heme oxygenase 2
  ENSP ID: ENSP00000480515

SEQ ID NO: 37662 - protein, 316 aa, Homo sapiens; identical to SEQ ID NO: 37645
  Payload ID: 7477
  Gene Symbol: HMOX2
  Gene Name: heme oxygenase 2
  Uniprot ID: P30519
  ENSP ID: ENSP00000481295

SEQ ID NO: 37663 - protein, 316 aa, Homo sapiens; identical to SEQ ID NO: 37645
  Payload ID: 7477
  Gene Symbol: HMOX2
  Gene Name: heme oxygenase 2
  Uniprot ID: P30519
  ENSP ID: ENSP00000481811

SEQ ID NO: 37664 - protein, 316 aa, Homo sapiens; identical to SEQ ID NO: 37645
  Payload ID: 7477
  Gene Symbol: HMOX2
  Gene Name: heme oxygenase 2
  Uniprot ID: P30519
  ENSP ID: ENSP00000483319

SEQ ID NO: 37665 - protein, 316 aa, Homo sapiens; identical to SEQ ID NO: 37645
  Payload ID: 7477
  Gene Symbol: HMOX2
  Gene Name: heme oxygenase 2
  Uniprot ID: P30519
  ENSP ID: ENSP00000484422

SEQ ID NO: 37666 - protein, 316 aa, Homo sapiens; identical to SEQ ID NO: 37645
  Payload ID: 7477
  Gene Symbol: HMOX2
  Gene Name: heme oxygenase 2
  Uniprot ID: P30519
  ENSP ID: ENSP00000484423

SEQ ID NO: 37667 - protein, 316 aa, Homo sapiens; identical to SEQ ID NO: 37645
  Payload ID: 7477
  Gene Symbol: HMOX2
  Gene Name: heme oxygenase 2
  Uniprot ID: P30519
  ENSP ID: ENSP00000484467

SEQ ID NO: 37668 - protein, 130 aa, Homo sapiens; identical to SEQ ID NO: 37658
  Payload ID: 7477
  Gene Symbol: HMOX2
  Gene Name: heme oxygenase 2
  ENSP ID: ENSP00000487635

SEQ ID NO: 37669 - protein, 316 aa, Homo sapiens; identical to SEQ ID NO: 37645
  Payload ID: 7477
  Gene Symbol: HMOX2
  Gene Name: heme oxygenase 2
  Uniprot ID: P30519
  ENSP ID: ENSP00000487673

SEQ ID NO: 37670 - protein, 229 aa, Homo sapiens; identical to SEQ ID NO: 37650
  Payload ID: 7477
  Gene Symbol: HMOX2
  Gene Name: heme oxygenase 2
  ENSP ID: ENSP00000487781

SEQ ID NO: 37671 - protein, 238 aa, Homo sapiens; identical to SEQ ID NO: 37651
  Payload ID: 7477
  Gene Symbol: HMOX2
  Gene Name: heme oxygenase 2
  ENSP ID: ENSP00000488170

SEQ ID NO: 37672 - protein, 131 aa, Homo sapiens; identical to SEQ ID NO: 37652
  Payload ID: 7477
  Gene Symbol: HMOX2
  Gene Name: heme oxygenase 2
  ENSP ID: ENSP00000488477

SEQ ID NO: 37673 - protein, 110 aa, Homo sapiens; identical to SEQ ID NO: 37655
  Payload ID: 7477
  Gene Symbol: HMOX2
  Gene Name: heme oxygenase 2
  ENSP ID: ENSP00000488577

SEQ ID NO: 37674 - protein, 316 aa, Homo sapiens; identical to SEQ ID NO: 37645
  Payload ID: 7477
  Gene Symbol: HMOX2
  Gene Name: heme oxygenase 2
  Uniprot ID: P30519
  ENSP ID: ENSP00000488579

SEQ ID NO: 37675 - protein, 132 aa, Homo sapiens; identical to SEQ ID NO: 37657
  Payload ID: 7477
  Gene Symbol: HMOX2
  Gene Name: heme oxygenase 2
  ENSP ID: ENSP00000488598

SEQ ID NO: 37676 - protein, 287 aa, Homo sapiens; identical to SEQ ID NO: 37656
  Payload ID: 7477
  Gene Symbol: HMOX2
  Gene Name: heme oxygenase 2
  Uniprot ID: P30519
  ENSP ID: ENSP00000488769

SEQ ID NO: 37677 - protein, 316 aa, Homo sapiens; identical to SEQ ID NO: 37645
  Payload ID: 7477
  Gene Symbol: HMOX2
  Gene Name: heme oxygenase 2
  Uniprot ID: P30519
  ENSP ID: ENSP00000488880

SEQ ID NO: 37678 - protein, 110 aa, Homo sapiens; identical to SEQ ID NO: 37653
  Payload ID: 7477
  Gene Symbol: HMOX2
  Gene Name: heme oxygenase 2
  ENSP ID: ENSP00000488904
  MOD_RES (1)..(1): Any amino acid

SEQ ID NO: 37679 - protein, 5635 aa, Homo sapiens
  Payload ID: 7478
  Gene Symbol: HMCN1
  Gene Name: hemicentin 1
  Uniprot ID: Q96RW7
  ENSP ID: ENSP00000271588
MISWEVVHTVFLFALLYSSLAQDASPQSEIRAEEIPEGASTLAFVFDVTGSMYDDLVQVIEGASKILETSLKRPKRPLFNFALVPFHDPEIGPVTITTDPKKFQYELRELYVQGGGDCPEMSIGAIKIALEISLPGSFIYVFTDARSKDYRLTHEVLQLIQQKQSQVVFVLTGDCDDRTHIGYKVYEEIASTSSGQVFHLDKKQVNEVLKWVEEAVQASKVHLLSTDHLEQAVNTWRIPFDPSLKEVTVSLSGPSPMIEIRNPLGKLIKKGFGLHELLNIHNSAKVVNVKEPEAGMWTVKTSSSGRHSVRITGLSTIDFRAGFSRKPTLDFKKTVSRPVQGIPTYVLLNTSGISTPARIDLLELLSISGSSLKTIPVKYYPHRKPYGIWNISDFVPPNEAFFLKVTGYDKDDYLFQRVSSVSFSSIVPDAPKVTMPEKTPGYYLQPGQIPCSVDSLLPFTLSFVRNGVTLGVDQYLKESASVNLDIAKVTLSDEGFYECIAVSSAGTGRAQTFFDVSEPPPVIQVPNNVTVTPGERAVLTCLIISAVDYNLTWQRNDRDVRLAEPARIRTLANLSLELKSVKFNDAGEYHCMVSSEGGSSAASVFLTVQEPPKVTVMPKNQSFTGGSEVSIMCSATGYPKPKIAWTVNDMFIVGSHRYRMTSDGTLFIKNAAPKDAGIYGCLASNSAGTDKQNSTLRYIEAPKLMVVQSELLVALGDITVMECKTSGIPPPQVKWFKGDLELRPSTFLIIDPLLGLLKIQETQDLDAGDYTCVAINEAGRATGKITLDVGSPPVFIQEPADVSMEIGSNVTLPCYVQGYPEPTIKWRRLDNMPIFSRPFSVSSISQLRTGALFILNLWASDKGTYICEAENQFGKIQSETTVTVTGLVAPLIGISPSVANVIEGQQLTLPCTLLAGNPIPERRWIKNSAMLLQNPYITVRSDGSLHIERVQLQDGGEYTCVASNVAGTNNKTTSVVVHVLPTIQHGQQILSTIEGIPVTLPCKASGNPKPSVIWSKKGELISTSSAKFSAGADGSLYVVSPGGEESGEYVCTATNTAGYAKRKVQLTVYVRPRVFGDQRGLSQDKPVEISVLAGEEVTLPCEVKSLPPPIITWAKETQLISPFSPRHTFLPSGSMKITETRTSDSGMYLCVATNIAGNVTQAVKLNVHVPPKIQRGPKHLKVQVGQRVDIPCNAQGTPLPVITWSKGGSTMLVDGEHHVSNPDGTLSIDQATPSDAGIYTCVATNIAGTDETEITLHVQEPPTVEDLEPPYNTTFQERVANQRIEFPCPAKGTPKPTIKWLHNGRELTGREPGISILEDGTLLVIASVTPYDNGEYICVAVNEAGTTERKYNLKVHVPPVIKDKEQVTNVSVLLNQLTNLFCEVEGTPSPIIMWYKDNVQVTESSTIQTVNNGKILKLFRATPEDAGRYSCKAINIAGTSQKYFNIDVLVPPTIIGTNFPNEVSVVLNRDVALECQVKGTPFPDIHWFKDGKPLFLGDPNVELLDRGQVLHLKNARRNDKGRYQCTVSNAAGKQAKDIKLTIYIPPSIKGGNVTTDISVLINSLIKLECETRGLPMPAITWYKDGQPIMSSSQALYIDKGQYLHIPRAQVSDSATYTCHVANVAGTAEKSFHVDVYVPPMIEGNLATPLNKQVVIAHSLTLECKAAGNPSPILTWLKDGVPVKANDNIRIEAGGKKLEIMSAQEIDRGQYICVATSVAGEKEIKYEVDVLVPPAIEGGDETSYFIVMVNNLLELDCHVTGSPPPTIMWLKDGQLIDERDGFKILLNGRKLVIAQAQVSNTGLYRCMAANTAGDHKKEFEVTVHVPPTIKSSGLSERVVVKYKPVALQCIANGIPNPSITWLKDDQPVNTAQGNLKIQSSGRVLQIAKTLLEDAGRYTCVATNAAGETQQHIQLHVHEPPSLEDAGKMLNETVLVSNPVQLECKAAGNPVPVITWYKDNRLLSGSTSMTFLNRGQIIDIESAQISDAGIYKCVAINSAGATELFYSLQVHVAPSISGSNNMVAVVVNNPVRLECEARGIPAPSLTWLKDGSPVSSFSNGLQVLSGGRILALTSAQISDTGRYTCVAVNAAGEKQRDIDLRVYVPPNIMGEEQNVSVLISQAVELLCQSDAIPPPTLTWLKDGHPLLKKPGLSISENRSVLKIEDAQVQDTGRYTCEATNVAGKTEKNYNVNIWVPPNIGGSDELTQLTVIEGNLISLLCESSGIPPPNLIWKKKGSPVLTDSMGRVRILSGGRQLQISIAEKSDAALYSCVASNVAGTAKKEYNLQVYIRPTITNSGSHPTEIIVTRGKSISLECEVQGIPPPTVTWMKDGHPLIKAKGVEILDEGHILQLKNIHVSDTGRYVCVAVNVAGMTDKKYDLSVHAPPSIIGNHRSPENISVVEKNSVSLTCEASGIPLPSITWFKDGWPVSLSNSVRILSGGRMLRLMQTTMEDAGQYTCVVRNAAGEERKIFGLSVLVPPHIVGENTLEDVKVKEKQSVTLTCEVTGNPVPEITWHKDGQPLQEDEAHHIISGGRFLQITNVQVPHTGRYTCLASSPAGHKSRSFSLNVFVSPTIAGVGSDGNPEDVTVILNSPTSLVCEAYSYPPATITWFKDGTPLESNRNIRILPGGRTLQILNAQEDNAGRYSCVATNEAGEMIKHYEVKVYIPPIINKGDLWGPGLSPKEVKIKVNNTLTLECEAYAIPSASLSWYKDGQPLKSDDHVNIAANGHTLQIKEAQISDTGRYTCVASNIAGEDELDFDVNIQVPPSFQKLWEIGNMLDTGRNGEAKDVIINNPISLYCETNAAPPPTLTWYKDGHPLTSSDKVLILPGGRVLQIPRAKVEDAGRYTCVAVNEAGEDSLQYDVRVLVPPIIKGANSDLPEEVTVLVNKSALIECLSSGSPAPRNSWQKDGQPLLEDDHHKFLSNGRILQILNTQITDIGRYVCVAENTAGSAKKYFNLNVHVPPSVIGPKSENLTVVVNNFISLTCEVSGFPPPDLSWLKNEQPIKLNTNTLIVPGGRTLQIIRAKVSDGGEYTCIAINQAGESKKKFSLTVYVPPSIKDHDSESLSVVNVREGTSVSLECESNAVPPPVITWYKNGRMITESTHVEILADGQMLHIKKAEVSDTGQYVCRAINVAGRDDKNFHLNVYVPPSIEGPEREVIVETISNPVTLTCDATGIPPPTIAWLKNHKRIENSDSLEVRILSGGSKLQIARSQHSDSGNYTCIASNMEGKAQKYYFLSIQVPPSVAGAEIPSDVSVLLGENVELVCNANGIPTPLIQWLKDGKPIASGETERIRVSANGSTLNIYGALTSDTGKYTCVATNPAGEEDRIFNLNVYVTPTIRGNKDEAEKLMTLVDTSINIECRATGTPPPQINWLKNGLPLPLSSHIRLLAAGQVIRIVRAQVSDVAVYTCVASNRAGVDNKHYNLQVFAPPNMDNSMGTEEITVLKGSSTSMACITDGTPAPSMAWLRDGQPLGLDAHLTVSTHGMVLQLLKAETEDSGKYTCIASNEAGEVSKHFILKVLEPPHINGSEEHEEISVIVNNPLELTCIASGIPAPKMTWMKDGRPLPQTDQVQTLGGGEVLRISTAQVEDTGRYTCLASSPAGDDDKEYLVRVHVPPNIAGTDEPRDITVLRNRQVTLECKSDAVPPPVITWLRNGERLQATPRVRILSGGRYLQINNADLGDTANYTCVASNIAGKTTREFILTVNVPPNIKGGPQSLVILLNKSTVLECIAEGVPTPRITWRKDGAVLAGNHARYSILENGFLHIQSAHVTDTGRYLCMATNAAGTDRRRIDLQVHVPPSIAPGPTNMTVIVNVQTTLACEATGIPKPSINWRKNGHLLNVDQNQNSYRLLSSGSLVIISPSVDDTATYECTVTNGAGDDKRTVDLTVQVPPSIADEPTDFLVTKHAPAVITCTASGVPFPSIHWTKNGIRLLPRGDGYRILSSGAIEILATQLNHAGRYTCVARNAAGSAHRHVTLHVHEPPVIQPQPSELHVILNNPILLPCEATGTPSPFITWQKEGINVNTSGRNHAVLPSGGLQISRAVREDAGTYMCVAQNPAGTALGKIKLNVQVPPVISPHLKEYVIAVDKPITLSCEADGLPPPDITWHKDGRAIVESIRQRVLSSGSLQIAFVQPGDAGHYTCMAANVAGSSSTSTKLTVHVPPRIRSTEGHYTVNENSQAILPCVADGIPTPAINWKKDNVLLANLLGKYTAEPYGELILENVVLEDSGFYTCVANNAAGEDTHTVSLTVHVLPTFTELPGDVSLNKGEQLRLSCKATGIPLPKLTWTFNNNIIPAHFDSVNGHSELVIERVSKEDSGTYVCTAENSVGFVKAIGFVYVKEPPVFKGDYPSNWIEPLGGNAILNCEVKGDPTPTIQWNRKGVDIEISHRIRQLGNGSLAIYGTVNEDAGDYTCVATNEAGVVERSMSLTLQSPPIITLEPVETVINAGGKIILNCQATGEPQPTITWSRQGHSISWDDRVNVLSNNSLYIADAQKEDTSEFECVARNLMGSVLVRVPVIVQVHGGFSQWSAWRACSVTCGKGIQKRSRLCNQPLPANGGKPCQGSDLEMRNCQNKPCPVDGSWSEWSLWEECTRSCGRGNQTRTRTCNNPSVQHGGRPCEGNAVEIIMCNIRPCPVHGAWSAWQPWGTCSESCGKGTQTRARLCNNPPPAFGGSYCDGAETQMQVCNERNCPIHGKWATWASWSACSVSCGGGARQRTRGCSDPVPQYGGRKCEGSDVQSDFCNSDPCPTHGNWSPWSGWGTCSRTCNGGQMRRYRTCDNPPPSNGGRACGGPDSQIQRCNTDMCPVDGSWGSWHSWSQCSASCGGGEKTRKRLCDHPVPVKGGRPCPGDTTQVTRCNVQACPGGPQRARGSVIGNINDVEFGIAFLNATITDSPNSDTRIIRAKITNVPRSLGSAMRKIVSILNPIYWTTAKEIGEAVNGFTLTNAVFKRETQVEFATGEILQMSHIARGLDSDGSLLLDIVVSGYVLQLQSPAEVTVKDYTEDYIQTGPGQLYAYSTRLFTIDGISIPYTWNHTVFYDQAQGRMPFLVETLHASSVESDYNQIEETLGFKIHASISKGDRSNQCPSGFTLDSVGPFCADEDECAAGNPCSHSCHNAMGTYYCSCPKGLTIAADGRTCQDIDECALGRHTCHAGQDCDNTIGSYRCVVRCGSGFRRTSDGLSCQDINECQESSPCHQRCFNAIGSFHCGCEPGYQLKGRKCMDVNECRQNVCRPDQHCKNTRGGYKCIDLCPNGMTKAENGTCIDIDECKDGTHQCRYNQICENTRGSYRCVCPRGYRSQGVGRPCMDINECEQVPKPCAHQCSNTPGSFKCICPPGQHLLGDGKSCAGLERLPNYGTQYSSYNLARFSPVRNNYQPQQHYRQYSHLYSSYSEYRNSRTSLSRTRRTIRKTCPEGSEASHDTCVDIDECENTDACQHECKNTFGSYQCICPPGYQLTHNGKTCQDIDECLEQNVHCGPNRMCFNMRGSYQCIDTPCPPNYQRDPVSGFCLKNCPPNDLECALSPYALEYKLVSLPFGIATNQDLIRLVAYTQDGVMHPRTTFLMVDEEQTVPFALRDENLKGVVYTTRPLREAETYRMRVRASSYSANGTIEYQTTFIVYIAVSAYPY

SEQ ID NO: 37680 - protein, 240 aa, Homo sapiens
  Payload ID: 7478
  Gene Symbol: HMCN1
  Gene Name: hemicentin 1
  ENSP ID: ENSP00000406205
AIGSFHCGCEPGYQLKGRKCMDVNECRQNVCRPDQHCKNTRGGYKCIDLCPNGMTKAENGTCIDIDECKDGTHQCRYNQICENTRGSYRCVCPRGYRSQGVGRPCMDIDECENTDACQHECKNTFGSYQCICPPGYQLTHNGKTCQDIDECLEQNVHCGPNRMCFNMRGSYQCIDTPCPPNYQRDPVSGFCLKNCPPNDLECALSPYALEYKLVSLPFGIATNQDLIRLVAYTQDGVMHP

SEQ ID NO: 37681 - protein, 309 aa, Homo sapiens
  Payload ID: 7479
  Gene Symbol: HMCN2
  Gene Name: hemicentin 2
  ENSP ID: ENSP00000387564
  MOD_RES (1)..(1): Any amino acid
XPGQLFVGSTQRFFQGGLPSFLRCNHSIQYNAARGPQPQLVQHLRASAISSAFDPEAEALRFQLATALQAEENEVGCPEGFELDSQGAFCVDVDECAWDAHLCREGQRCVNLLGSYRCLPDCGPGFRVADGAGCEDVDECLEGLDDCHYNQLCENTPGGHRCSCPRGYRMQGPSLPCLDVNECLQLPKACAYQCHNLQGSYRCLCPPGQTLLRDGKACTSLERNGQNVTTVSHRGPLLPWLRPWASIPGTSYHAWVSLRPGPMALSSVGRAWCPPGFIRQNGVCTDLDECRVRNLCQHACRNTEGSYQC

SEQ ID NO: 37682 - protein, 595 aa, Homo sapiens
  Payload ID: 7479
  Gene Symbol: HMCN2
  Gene Name: hemicentin 2
  ENSP ID: ENSP00000481543
MILAPEGSSSGKLRIPAAQERDAGTYTCRAVNELGDASAEIQLAVGHAPQLTELPRDVTVELGRSALLACRATGRPPPTVTWRRGDGQPLGLRLGAGRGSRSRQPDSGVLFFESVAPEDQAPYVCEARNVFGKVQAEARLIVTGHAPPQIASSAPTVRVLEGQPVSLPCIVLAGRPLPERHWLKDGRPLPPGSRHSIRADGSLHLDRALQEHAGRYSCVATNTAGSQHRDVELVVQVPPRIHPTATHHITNEGVAASLPCVASGVPAPTITWTKETNALTSRGPHYNVSKEGTLLIAQPSAQDAGAYVCTATNTVGFSSQEMRLSVNTKPRIHMNGSRNADVPLQVTAKAGEEVTLDCEAKGSPPPLVTWTKDSRPVPPITNRYGLLPSGSLRLAQVQVGDSGHYECTASNPAGSASHRYVLGVQGRTSWQPQSLPVPHHPACLSGLSVPLLQPTPRSVRLCHLSLRAPLPPPFATPTSCLSQACLSSSTLSLHLSPYPLRGPGDAVQRPPTTQGRAQWGLGFGRTGVRGEPMKVGLRGSLPGTRGPAGSPGCGDGKRPVRCHRAPPAGSILMPPRGPSEPLLPPLPSTRHFVHL

SEQ ID NO: 37683 - protein, 5059 aa, Homo sapiens
  Payload ID: 7479
  Gene Symbol: HMCN2
  Gene Name: hemicentin 2
  ENSP ID: ENSP00000485357
MPGAPLLRLLTAVSAAVAVAVAGAPGTVMPPTTGDATLAFVFDVTGSMWDELMQVIDGASRILERSLSRRSQAIANYALVPFHDPDIGPVTLTADPTVFQRELRELYVQGGGDCPEMSVGAIKAAVEVANPGSFIYVFSDARAKDYHKKEELLRLLQLKQSQVVFVLTGDCGDRTHPGYLAYEEIAATSSGQVFHLDKQQVTEVLKWVESAIQASKVHLLSTDHEEEGEHTWRLPFDPSLKEVTISLSGPGPEIEVQDPLGRILQEDEGLNVLLNIPDSAKVVAFKPEHPGLWSIKVYSSGRHSVRITGVSNIDFRAGFSTQPLLDLNHTLEWPLQGVPISLVINSTGLKAPGRLDSVELAQSSGKPLLTLPTKPLSNGSTHQLWGGPPFHTPKERFYLKVKGKDHEGNPLLRVSGVSYSGVAPGAPLVSMAPRIHGYLHQPLLVSCSVHSALPFRLQLRRGEARLGEERHFQESGNSSWEILRASKAEEGTYECTAVSRAGTGRAKAQIVVTDPPPQLVPAPNVTVSPGETAVLSCRVLGEAPYNLTWVRDWRVLPASTGRVAQLADLSLEISGIIPTDGGRYQCVASNANGVTRASVWLLVREAPQVSIHTSSQHFSQGVEVKVSCSASGYPTPHISWSRESQALQEDSRIHVDAQGTLIIQGVAPEDAGNYSCQATNEVGTDQETVTLYYTDPPSVSAVNAVVLVAVGEEAVLVCEASGVPPPRVIWYRGGLEMILAPEGSSSGKLRIPAAQERDAGTYTCRAVNELGDASAEIQLAVGHAPQLTELPRDVTVELGRSALLACRATGRPPPTVTWRRGDGQPLGLRLGAGRGSRSRQPDSGVLFFESVAPEDQAPYVCEARNVFGKVQAEARLIVTGHAPPQIASSAPTVRVLEGQPVSLPCIVLAGRPLPERHWLKDGRPLPPGSRHSIRADGSLHLDRALQEHAGRYSCVATNTAGSQHRDVELVVQVPPRIHPTATHHITNEGVAASLPCVASGVPAPTITWTKETNALTSRGPHYNVSKEGTLLIAQPSAQDAGAYVCTATNTVGFSSQEMRLSVNTKPRIHMNGSRNADVPLQVTAKAGEEVTLDCEAKGSPPPLVTWTKDSRPVPPITNRYGLLPSGSLRLAQVQVGDSGHYECTASNPAGSASHRYVLGVQVPPQVQPGPRVLKVLVGEALDLNCVAEGNPEPQLSWSKDGVVLQGRGPQGSVHFAAIRTSDAGRYRCEASNSAGVDAWEVELRVLEPPHWGADETSGLLERVAGENASLPCPARGTPKPQVTWRKGPSSEPLHGQPGVAVLEEGSLFLASVSPADSGDYECQATNEVGSTSRRAKLVVYVPPSIREDGRKANVSGMAGQSLTLECDANGFPVPEIVWLKDAQLIPKVGGHRLLDEGQSLHFPRIQEGDSGLYSCRAENQAGTAQRDFHLLVLTPPSVLGAGAAQEVLGLAGADVELQCWTSGVPTPQVEWTKDRQPVLPGGPHLQVQEDGQVLRITGSHVGDEGRYQCVAFSPAGQQARDFQLRVHAPPTIWGSNETGEVAVMEDHLVQLLCEARGVPTPNITWFKDGALLPTSTKVVYTRGGRQLQLGRAQSSDAGVYTCKASNAVGAAEKATRLDVYVPPTIEGAGGRPYVVKAVAGRPVALECVARGHPSPTLSWHHEGLPVAESNESRLETDGSVLRLESPGEASSGLYSCVASSPAGEAVLQYSVEVQVPPQLLVAEGLGQVTTIVGQPLELPCQASGSPVPTIQWLQNGRPAEELAGVQVASQGTTLHIDHVELDHSGLFACQATNEAGTAGAEVEVSVHEFPSVSIIGGENITAPFLQPVTLQCIGDGVPTPSLRWWKDGVALAAFGGNLQIEKVDLRDEGIYTCAATNLAGESKREVALKVLVPPNIEPGPVNKAVLENASVTLECLASGVPPPDVSWFKGHQPVSSWMGVTVSVDGRVLRIEQAQLSDAGSYRCVASNVAGSTELRYGLRVNVPPRITLPPSLPGPVLVNTPVRLTCNATGAPSPTLMWLKDGNPVSPAGTPGLQVFPGGRVLTLASARASDSGRYSCVAVSAVGEDRQDVVLQVHMPPSILGEELNVSVVANESVALECQSHAMPPPVLSWWKDGRPLEPRPGVHLSADKALLQVDRADVWDAGHYTCEALNQAGHSEKHYNLNVWVAPVFPLRESHTLTVREGHPTRLSCECRGVPFPKISWRKDGQPLPGEGAGLQHVSAVGRLLYLGQAQLAQEGTYTCECSNVVGNSSQDLQLEVHVPPQIAGPREPPTQVSVVQDGVATLECNATGKPPPTVTWERDGQPVGAELGLQLQNQGQSLHVERAQAAHTGRYSCVAENLAGRAERKFELSVLVPPELIGDLDPLTNITAALHSPLTLLCEAMGIPPPAIRWFRGEEPVSPGEDTYLLAGGWMLKMTQTQEQDSGLYSCLASNEAGEARRNFSVEVLVPPSIENEDLEEVIKVLDGQTAHLMCNVTGHPQPKLTWFKDGRPLARGDAHHISPDGVLLQVLQANLSSAGHYSCIAANAVGEKTKHFQLSVLLAPTILGGAEDSADEEVTVTVNNPISLICEALAFPSPNITWMKDGAPFEASRNIQLLPGTHGLQILNAQKEDAGQYTCVVTNELGEAVKNYHVEVLIPPSISKDDPLAEVGVKEVKTKVNSTLTLECESWAVPPPTIRWYKDGQPVTPSSRLQVLGEGRLLQIQPTQVSDSGRYLCVATNVAGEDDQDFNVLIQVPPMFQKVGDFSAAFEILSREEEARGGVTEYREIVENNPAYLYCDTNAIPPPDLTWYREDQPLSAGDEVSVLQGGRVLQIPLVRAENAGRYSCKASNEVGEDWLHYELLVLTPPVILGDTEELVEEVTVNASSTVSLQCPALGNPVPTISWLQNGLPFSPSPRLQVLEDGQVLQVSTAEVADAASYMCVAENQAGSAEKLFTLRVQVPPRIAGLDLEQVTAILNSSVSLPCDVHAHPNPEVTWYKDSQALSLGEEVFLLPGTHTLQLGRARLSDSGMYTCEALNAAGRDQKLVQLSVLVPPAFRQAPRGPQDAVLVRVGDKAVLSCETDALPEPTVTWYKDGQPLVLAQRTQALRGGQRLEIQEAQVSDKGLYSCKVSNVAGEAVRTFTLTVQVPPTFENPKTETVSQVAGSPLVLTCDVSGVPAPTVTWLKDRMPVESSAVHGVVSRGGRLQLSRLQPAQAGTYTCVAENTQAEARKDFVVAVLVAPRIRSSGVAREHHVLEGQEVRLDCEADGQPPPDVAWLKDGSPLGQDMGPHLRFYLDGGSLVLKGLRASDAGAYTCVAHNPAGEDARLHTVNVLVPPTIKQGADGSGTLVSRPGELVTMVCPVRGSPPIHVSWLKDGLPLPLSQRTLLHGSGHTLRISKVQLADAGIFTCVAASPAGVADRNFTLQVQVPPVLEPVEFQNDVVVVRGSLVELPCEARGVPLPLVSWMKDGEPLLSQSLEQGPSLQLEAVGAGDSGTYSCVAVSEAGEARRHFQLTVMEPPHIEDSGQPTELSLTPGAPMELLCDAQGTPQPNITWHKDGQALTRLENNSRATRVLRVENVQVRDAGLYTCLAESPAGAIEKSFRVRVQAPPNIVGPRGPRFVVGLAPGQLVLECSVEAEPAPKITWHRDGIVLQEDAHTQFPERGRFLQLQALSTADSGDYSCTARNAAGSTSVAFRVEIHTVPTIRSGPPAVNVSVNQTALLPCQADGVPAPLVSWRKDRVPLDPRSPRFEILPEGSLRIQPVLAQDAGHYLCLASNSAGSDRQGRDLRVLALLPCEASGSPKPLVVWWKDGQKLDFRLQQGAYRLLPSNALLLTAPGPQDSAQFECVVSNEVGEAHRLYQVTVHVPPTIADDQTDFTVTMMAPVVLTCHSTGIPAPTVSWSKAGAQLGARGSGYRVSPSGALEIGQALPIHAGRYTCSARNSAGVAHKHVFLTVQASPVVKPLPSVVRAVAEEEVLLPCEASGIPRPTITWQKEGLNVATGVSTQVLPGGQLRIAHASPEDAGNYLCIAKNSAGSAMGKTRLVVQVPPVIENGLPDLSTTEGSHAFLPCKARGSPEPNITWDKDGQPVSGAEGKFTIQPSGELLVKNLEGQDAGTYTCTAENAVGRARRRVHLTILVLPVFTTLPGDRSLRLGDRLWLRCAARGSPTPRIGWTVNDRPVTEGVSEQDGGSTLQRAAVSREDSGTYVCWAENRVGRTQAVSFVHVKEAPVLQGEAFSYLVEPVGGSIQLDCVVRGDPVPDIHWIKDGLPLRGSHLRHQLQNGSLTIRRTERDDAGRYQCLAENEMGVAKKVVILVLQSAPVFQVEPQDMTVRSGDDVALRCQATGEPTPTIEWLQAGQPLRASRRLRTLPDGSLWLENVETGDAGTYDCVAHNLLGSATARAFLVVRGEPQGSWGSMTGVINGRKFGVATLNTSVMQEAHSGVSSIHSSIRHVPANVGPLMRVLVVTIAPIYWALARESGEALNGHSLTGGRFRQESHVEFATGELLTMTQVARGLDPDGLLLLDVVVNGVVPESLADADLQVQDFEEHYVQTGPGQLFVGSTQRFFQGGLPSFLRCNHSIQYNAARGPQPQLVQHLRASAISSAFDPEAEALRFQLATALQAEENEVGCPEGFELDSQGAFCVDRDECSGGPSPCSHACLNAPGRFSCTCPTGFALAWDDRNCRDVDECAWDAHLCREGQRCVNLLGSYRCLPDCGPGFRVADGAGCEDVDECLEGLDDCHYNQLCENTPGGHRCSCPRGYRMQGPSLPCLDVNECLQLPKACAYQCHNLQGSYRCLCPPGQTLLRDGKACTSLERNGQNVTTVSHRGPLLPWLRPWASIPGTSYHAWVSLRPGPMALSSVGRAWCPPGFIRQNGVCTDLDECRVRNLCQHACRNTEGSYQCLCPAGYRLLPSGKNCQDINECEEESIECGPGQMCFNTRGSYQCVDTPCPATYRQGPSPGTCFRRCSQDCGTGGPSTLQYRLLPLPLGVRAHHDVARLTAFSEVGVPANRTELSMLEPDPRSPFALRPLRAGLGAVYTRRALTRAGLYRLTVRAAAPRHQSVFVLLIAVSPYPY

SEQ ID NO: 37684 - protein, 479 aa, Homo sapiens
  Payload ID: 7479
  Gene Symbol: HMCN2
  Gene Name: hemicentin 2
  ENSP ID: ENSP00000485578
  MOD_RES (1)..(1): Any amino acid
XVHAHPNPEVTWYKDSQALSLGEEVFLLPGTHTLQLGRARLSDSGMYTCEALNAAGRDQKLVQLSVLVPPAFRQAPRGPQDAVLVRVGDKAVLSCETDALPEPTVTWYKDGQPLVLAQRTQALRGGQRLEIQEAQVSDKGLYSCKVSNVAGEAVRTFTLTVQVPPTFENPKTETVSQVAGSPLVLTCDVSGVPAPTVTWLKDRMPVESSAVHGVVSRGGRLQLSRLQPAQAGTYTCVAENTQAEARKDFVVAVLVAPRIRSSGVAREHHVLEGQEVRLDCEADGQPPPDVAWLKDGSPLGQDMGPHLRFYLDGGSLVLKGLRASDAGAYTCVAHNPAGEDARLHTVNVLVPPTIKQGADGSGTLVSRPGELVTMVCPVRGSPPIHVSWLKDGLPLPLSQRTLLHGSGHTLRISKVQLADAGIFTCVAASPAGVADRNFTLQCPLSWSRWSSRMTWWWFVAPWWNSRARPGAFPCLSCRG

SEQ ID NO: 37685 - protein, 338 aa, Homo sapiens
  Payload ID: 7480
  Gene Symbol: HEMK1
  Gene Name: HemK methyltransferase family member 1
  Uniprot ID: Q9Y5R4
  ENSP ID: ENSP00000232854
MELWGRMLWALLSGPGRRGSTRGWAFSSWQPQPPLAGLSSAIELVSHWTGVFEKRGIPEARESSEYIVAHVLGAKTFQSLRPALWTQPLTSQQLQCIRELSSRRLQRMPVQYILGEWDFQGLSLRMVPPVFIPRPETEELVEWVLEEVAQRSHAVGSPGSPLILEVGCGSGAISLSLLSQLPQSRVIAVDKREAAISLTHENAQRLRLQDRIWIIHLDMTSERSWTHLPWGPMDLIVSNPPYVFHQDMEQLAPEIRSYEDPAALDGGEEGMDIITHILALAPRLLKDSGSIFLEVDPRHPELVSSWLQSRPDLYLNLVAVRRDFCGRPRFLHIRRSGP

SEQ ID NO: 37686 - protein, 88 aa, Homo sapiens
  Payload ID: 7480
  Gene Symbol: HEMK1
  Gene Name: HemK methyltransferase family member 1
  ENSP ID: ENSP00000394027
MELWGRMLWALLSGPGRRGSTRGWAFSSWQPQPPLAGLSSAIELVSHWTGVFEKRGIPEARESISEPEAGTLDPALDLSATTVYPGAE

SEQ ID NO: 37687 - protein, 88 aa, Homo sapiens; identical to SEQ ID NO: 37686
  Payload ID: 7480
  Gene Symbol: HEMK1
  Gene Name: HemK methyltransferase family member 1
  ENSP ID: ENSP00000397966

SEQ ID NO: 37688 - protein, 124 aa, Homo sapiens
  Payload ID: 7480
  Gene Symbol: HEMK1
  Gene Name: HemK methyltransferase family member 1
  ENSP ID: ENSP00000404168
ILEVGCGSGAISLSLLSQLPQSRVIAVDKREAAISLTHENAQSYEDPAALDGGEEGMDIITHILALAPRLLKDSGSIFLEVDPRHPELVSSWLQSRPDLYLNLVAVRRDFCGRPRFLHIRRSGP

SEQ ID NO: 37689 - protein, 338 aa, Homo sapiens; identical to SEQ ID NO: 37685
  Payload ID: 7480
  Gene Symbol: HEMK1
  Gene Name: HemK methyltransferase family member 1
  Uniprot ID: Q9Y5R4
  ENSP ID: ENSP00000404334

SEQ ID NO: 37690 - protein, 338 aa, Homo sapiens; identical to SEQ ID NO: 37685
  Payload ID: 7480
  Gene Symbol: HEMK1
  Gene Name: HemK methyltransferase family member 1
  Uniprot ID: Q9Y5R4
  ENSP ID: ENSP00000404843

SEQ ID NO: 37691 - protein, 260 aa, Homo sapiens
  Payload ID: 7481
  Gene Symbol: HFE
  Gene Name: hemochromatosis
  Uniprot ID: Q30201
  ENSP ID: ENSP00000259699
MGPRARPALLLLMLLQTAVLQGRLLQSHTLQVILGCEMQEDNSTEGYWKYGYDGQDHLEFCPDTLDWRAAEPRAWPTKLEWERHKIRARQNRAYLERDCPAQLQQLLELGRGVLDQQVPPLVKVTHHVTSSVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAERE

SEQ ID NO: 37692 - protein, 337 aa, Homo sapiens
  Payload ID: 7481
  Gene Symbol: HFE
  Gene Name: hemochromatosis
  ENSP ID: ENSP00000311698
MGPRARPALLLLMLLQTAVLQGRLLRSHSLHYLFMGASEQDLGLSLFEALGYVDDQLFVFYDHESRRVEPRTPWVSSRISSQMWLQLSQSLKGWDHMFTVDFWTIMENHNHSKESHTLQVILGCEMQEDNSTEGYWKYGYDGQDHLEFCPDTLDWRAAEPRAWPTKLEWERHKIRARQNRAYLERDCPAQLQQLLELGRGVLDQQVPPLVKVTHHVTSSVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSSF

SEQ ID NO: 37693 - protein, 168 aa, Homo sapiens
  Payload ID: 7481
  Gene Symbol: HFE
  Gene Name: hemochromatosis
  Uniprot ID: Q30201
  ENSP ID: ENSP00000312342
MGPRARPALLLLMLLQTAVLQGRLLLPPLVKVTHHVTSSVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAERE

SEQ ID NO: 37694 - protein, 256 aa, Homo sapiens
  Payload ID: 7481
  Gene Symbol: HFE
  Gene Name: hemochromatosis
  Uniprot ID: Q30201
  ENSP ID: ENSP00000313776
MGPRARPALLLLMLLQTAVLQGRLLRSHSLHYLFMGASEQDLGLSLFEALGYVDDQLFVFYDHESRRVEPRTPWVSSRISSQMWLQLSQSLKGWDHMFTVDFWTIMENHNHSKVPPLVKVTHHVTSSVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAERE

SEQ ID NO: 37695 - protein, 76 aa, Homo sapiens
  Payload ID: 7481
  Gene Symbol: HFE
  Gene Name: hemochromatosis
  Uniprot ID: Q30201
  ENSP ID: ENSP00000315936
MGPRARPALLLLMLLQTAVLQGRLLQPSPSGTLVIGVISGIAVFVVILFIGILFIILRKRQGSRGAMGHYVLAERE

SEQ ID NO: 37696 - protein, 242 aa, Homo sapiens
  Payload ID: 7481
  Gene Symbol: HFE
  Gene Name: hemochromatosis
  Uniprot ID: Q30201
  ENSP ID: ENSP00000337819
MGPRARPALLLLMLLQTAVLQGRLLRSHSLHYLFMGASEQDLGLSLFEALGYVDDQLFVFYDHESRRVEPRTPWVSSRISSQMWLQLSQSLKGWDHMFTVDFWTIMENHNHSKVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAERE

SEQ ID NO: 37697 - protein, 325 aa, Homo sapiens
  Payload ID: 7481
  Gene Symbol: HFE
  Gene Name: hemochromatosis
  Uniprot ID: Q30201
  ENSP ID: ENSP00000380217
MGPRARPALLLLMLLQTAVLQGRLLPLGYVDDQLFVFYDHESRRVEPRTPWVSSRISSQMWLQLSQSLKGWDHMFTVDFWTIMENHNHSKESHTLQVILGCEMQEDNSTEGYWKYGYDGQDHLEFCPDTLDWRAAEPRAWPTKLEWERHKIRARQNRAYLERDCPAQLQQLLELGRGVLDQQVPPLVKVTHHVTSSVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAERE

SEQ ID NO: 37698 - protein, 348 aa, Homo sapiens
  Payload ID: 7481
  Gene Symbol: HFE
  Gene Name: hemochromatosis
  Uniprot ID: Q30201
  ENSP ID: ENSP00000417404
MGPRARPALLLLMLLQTAVLQGRLLRSHSLHYLFMGASEQDLGLSLFEALGYVDDQLFVFYDHESRRVEPRTPWVSSRISSQMWLQLSQSLKGWDHMFTVDFWTIMENHNHSKESHTLQVILGCEMQEDNSTEGYWKYGYDGQDHLEFCPDTLDWRAAEPRAWPTKLEWERHKIRARQNRAYLERDCPAQLQQLLELGRGVLDQQVPPLVKVTHHVTSSVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAERE

SEQ ID NO: 37699 - protein, 55 aa, Homo sapiens
  Payload ID: 7481
  Gene Symbol: HFE
  Gene Name: hemochromatosis
  ENSP ID: ENSP00000417534
IVIWEPSPSGTLVIGVISGIAVFVVILFIGILFIILRKRQGSRGAMGHYVLAERF

SEQ ID NO: 37700 - protein, 345 aa, Homo sapiens
  Payload ID: 7481
  Gene Symbol: HFE
  Gene Name: hemochromatosis
  ENSP ID: ENSP00000419725
MGPRARPALLLLMLLQTAVLQGRLLRSHSLHYLFMGASEQDLGLSLFEALGYVDDQLFVFYDHESRRVEPRTPWVSSRISSQMWLQLSQSLKGWDHMFTVDFWTIMENHNHSKESHTLQVILGCEMQEDNSTEGYWKYGYDGQDHLEFCPDTLDWRAAEPRAWPTKLEWERHKIRARQNRAYLERDCPAQLQQLLELGRGVLDQQEGSESSSLPGKVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAERE

SEQ ID NO: 37701 - protein, 246 aa, Homo sapiens
  Payload ID: 7481
  Gene Symbol: HFE
  Gene Name: hemochromatosis
  Uniprot ID: Q30201
  ENSP ID: ENSP00000420559
MGPRARPALLLLMLLQTAVLQGRLLQSHTLQVILGCEMQEDNSTEGYWKYGYDGQDHLEFCPDTLDWRAAEPRAWPTKLEWERHKIRARQNRAYLERDCPAQLQQLLELGRGVLDQQVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAERE

SEQ ID NO: 37702 - protein, 334 aa, Homo sapiens
  Payload ID: 7481
  Gene Symbol: HFE
  Gene Name: hemochromatosis
  Uniprot ID: Q30201
  ENSP ID: ENSP00000420802
MGPRARPALLLLMLLQTAVLQGRLLRSHSLHYLFMGASEQDLGLSLFEALGYVDDQLFVFYDHESRRVEPRTPWVSSRISSQMWLQLSQSLKGWDHMFTVDFWTIMENHNHSKESHTLQVILGCEMQEDNSTEGYWKYGYDGQDHLEFCPDTLDWRAAEPRAWPTKLEWERHKIRARQNRAYLERDCPAQLQQLLELGRGVLDQQVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAERE

SEQ ID NO: 37703 - protein, 426 aa, Homo sapiens
  Payload ID: 7482
  Gene Symbol: HFE2
  Gene Name: hemochromatosis type 2 (juvenile)
  Uniprot ID: Q6ZVN8
  ENSP ID: ENSP00000337014
MGEPGQSPSPRSSHGSPPTLSTLTLLLLLCGHAHSQCKILRCNAEYVSSTLSLRGGGSSGALRGGGGGGRGGGVGSGGLCRALRSYALCTRRTARTCRGDLAFHSAVHGIEDLMIQHNCSRQGPTAPPPPRGPALPGAGSGLPAPDPCDYEGRFSRLHGRPPGFLHCASFGDPHVRSFHHHFHTCRVQGAWPLLDNDFLFVQATSSPMALGANATATRKLTIIFKNMQECIDQKVYQAEVDNLPVAFEDGSINGGDRPGGSSLSIQTANPGNHVEIQAAYIGTTIIIRQTAGQLSFSIKVAEDVAMAFSAEQDLQLCVGGCPPSQRLSRSERNRRGAITIDTARRLCKEGLPVEDAYFHSCVFDVLISGDPNFTVAAQAALEDARAFLPDLEKLHLFPSDAGVPLSSATLLAPLLSGLFVLWLCIQ

SEQ ID NO: 37704 - protein, 313 aa, Homo sapiens
  Payload ID: 7482
  Gene Symbol: HFE2
  Gene Name: hemochromatosis type 2 (juvenile)
  Uniprot ID: Q6ZVN8
  ENSP ID: ENSP00000350495
MIQHNCSRQGPTAPPPPRGPALPGAGSGLPAPDPCDYEGRFSRLHGRPPGFLHCASFGDPHVRSFHHHFHTCRVQGAWPLLDNDFLFVQATSSPMALGANATATRKLTIIFKNMQECIDQKVYQAEVDNLPVAFEDGSINGGDRPGGSSLSIQTANPGNHVEIQAAYIGTTIIIRQTAGQLSFSIKVAEDVAMAFSAEQDLQLCVGGCPPSQRLSRSERNRRGAITIDTARRLCKEGLPVEDAYFHSCVFDVLISGDPNFTVAAQAALEDARAFLPDLEKLHLFPSDAGVPLSSATLLAPLLSGLFVLWLCIQ

SEQ ID NO: 37705 - protein, 93 aa, Homo sapiens
  Payload ID: 7482
  Gene Symbol: HFE2
  Gene Name: hemochromatosis type 2 (juvenile)
  ENSP ID: ENSP00000411863
MGEPGQSPSPRSSHGSPPTLSTLTLLLLLCGHAHSQCKILRCNAEYVSSTLSLRGGGSSGALRGGGGGGRGGGVGSGGLCRALRSYALCTRRT

SEQ ID NO: 37706 - protein, 200 aa, Homo sapiens
  Payload ID: 7482
  Gene Symbol: HFE2
  Gene Name: hemochromatosis type 2 (juvenile)
  Uniprot ID: Q6ZVN8
  ENSP ID: ENSP00000421820
MQECIDQKVYQAEVDNLPVAFEDGSINGGDRPGGSSLSIQTANPGNHVEIQAAYIGTTIIIRQTAGQLSFSIKVAEDVAMAFSAEQDLQLCVGGCPPSQRLSRSERNRRGAITIDTARRLCKEGLPVEDAYFHSCVFDVLISGDPNFTVAAQAALEDARAFLPDLEKLHLFPSDAGVPLSSATLLAPLLSGLFVLWLCIQ

SEQ ID NO: 37707 - protein, 200 aa, Homo sapiens; identical to SEQ ID NO: 37706
  Payload ID: 7482
  Gene Symbol: HFE2
  Gene Name: hemochromatosis type 2 (juvenile)
  Uniprot ID: Q6ZVN8
  ENSP ID: ENSP00000425716

SEQ ID NO: 37708 - protein, 70 aa, Homo sapiens
  Payload ID: 7482
  Gene Symbol: HFE2
  Gene Name: hemochromatosis type 2 (juvenile)
  ENSP ID: ENSP00000489347
MGEPGQSPSPRSSHGSPPTLSTLTLLLLLCGHAHSQCKILRCNADSPSYLRTCRNALIRRCIRLRWIIFL

SEQ ID NO: 37709 - protein, 484 aa, Homo sapiens
  Payload ID: 7483
  Gene Symbol: HEMGN
  Gene Name: hemogen
  Uniprot ID: Q9BXL5
  ENSP ID: ENSP00000259456
MDLGKDQSHLKHHQTPDPHQEENHSPEVIGTWSLRNRELLRKRKAEVHEKETSQWLFGEQKKRKQQRTGKGNRRGRKRQQNTELKVEPQPQIEKEIVEKALAPIEKKTEPPGSITKVFPSVASPQKVVPEEHFSEICQESNIYQENFSEYQEIAVQNHSSETCQHVSEPEDLSPKMYQEISVLQDNSSKICQDMKEPEDNSPNTCQVISVIQDHPFKMYQDMAKREDLAPKMCQEAAVPKILPCPTSEDTADLAGCSLQAYPKPDVPKGYILDTDQNPAEPEEYNETDQGIAETEGLFPKIQEIAEPKDLSTKTHQESAEPKYLPHKTCNEIIVPKAPSHKTIQETPHSEDYSIEINQETPGSEKYSPETYQEIPGLEEYSPEIYQETSQLEEYSPEIYQETPGPEDLSTETYKNKDVPKECFPEPHQETGGPQGQDPKAHQEDAKDAYTFPQEMKEKPKEEPGIPAILNESHPENDVYSYVLF

SEQ ID NO: 37710 - protein, 484 aa, Homo sapiens; identical to SEQ ID NO: 37709
  Payload ID: 7483
  Gene Symbol: HEMGN
  Gene Name: hemogen
  Uniprot ID: Q9BXL5
  ENSP ID: ENSP00000480020

SEQ ID NO: 37711 - protein, 142 aa, Homo sapiens
  Payload ID: 7484
  Gene Symbol: HBA1
  Gene Name: hemoglobin, alpha 1
  Uniprot ID: P69905
  ENSP ID: ENSP00000322421
MVLSPADKTNVKAAWGKVGAHAGEYGAEALERMFLSFPTTKTYFPHFDLSHGSAQVKGHGKKVADALTNAVAHVDDMPNALSALSDLHAHKLRVDPVNFKLLSHCLLVTLAAHLPAEFTPAVHASLDKFLASVSTVLTSKYR

SEQ ID NO: 37712 - protein, 110 aa, Homo sapiens
  Payload ID: 7484
  Gene Symbol: HBA1
  Gene Name: hemoglobin, alpha 1
  ENSP ID: ENSP00000380899
MFLSFPTTKTYFPHFDLSHGSAQVKGHGKKVADALTNAVAHVDDMPNALSALSDLHAHKLRVDPVNFKLLSHCLLVTLAAHLPAEFTPAVHASLDKFLASVSTVLTSKYR

SEQ ID NO: 37713 - protein, 142 aa, Homo sapiens; identical to SEQ ID NO: 37711
  Payload ID: 7485
  Gene Symbol: HBA2
  Gene Name: hemoglobin, alpha 2
  Uniprot ID: P69905
  ENSP ID: ENSP00000251595

SEQ ID NO: 37714 - protein, 110 aa, Homo sapiens; identical to SEQ ID NO: 37712
  Payload ID: 7485
  Gene Symbol: HBA2
  Gene Name: hemoglobin, alpha 2
  ENSP ID: ENSP00000380908

SEQ ID NO: 37715 - protein, 147 aa, Homo sapiens
  Payload ID: 7486
  Gene Symbol: HBB
  Gene Name: hemoglobin, beta
  Uniprot ID: P68871
  ENSP ID: ENSP00000333994
MVHLTPEEKSAVTALWGKVNVDEVGGEALGRLLVVYPWTQRFFESFGDLSTPDAVMGNPKVKAHGKKVLGAFSDGLAHLDNLKGTFATLSELHCDKLHVDPENFRLLGNVLVCVLAHHFGKEFTPPVQAAYQKVVAGVANALAHKYH

SEQ ID NO: 37716 - protein, 90 aa, Homo sapiens
  Payload ID: 7486
  Gene Symbol: HBB
  Gene Name: hemoglobin, beta
  ENSP ID: ENSP00000369671
MVHLTPEEKSAVTALWGKVNVDEVGGEALGRLLVVYPWTQRFFESFGDLSTPDAVMGNPKVKAHGKKVLGAFSDGLAHLDNLKGTFATLS

SEQ ID NO: 37717 - protein, 55 aa, Homo sapiens
  Payload ID: 7486
  Gene Symbol: HBB
  Gene Name: hemoglobin, beta
  ENSP ID: ENSP00000488004
MVHLTPEEKSAVTALWGKVNVDEVGGCWWSTLGPRGSLSPLGICPLLMLLWATLR

SEQ ID NO: 37718 - protein, 141 aa, Homo sapiens
  Payload ID: 7487
  Gene Symbol: HBD
  Gene Name: hemoglobin, delta
  ENSP ID: ENSP00000292901
MVHLTPEEKTAVNALWGKVNVDAVGGEALGRLLVVYPWTQRFFESFGDLSSPDAVMGNPKVKAHGKKVLGAFSDGLAHLDNLKGTFSQLSELHCDKLHVDPENFRVCKKVPEALQIGSTCLFYKEYMGKEKSKGTVQGING

SEQ ID NO: 37719 - protein, 147 aa, Homo sapiens
  Payload ID: 7487
  Gene Symbol: HBD
  Gene Name: hemoglobin, delta
  Uniprot ID: P02042
  ENSP ID: ENSP00000369654
MVHLTPEEKTAVNALWGKVNVDAVGGEALGRLLVVYPWTQRFFESFGDLSSPDAVMGNPKVKAHGKKVLGAFSDGLAHLDNLKGTFSQLSELHCDKLHVDPENFRLLGNVLVCVLARNFGKEFTPQMQAAYQKVVAGVANALAHKYH

SEQ ID NO: 37720 - protein, 104 aa, Homo sapiens
  Payload ID: 7487
  Gene Symbol: HBD
  Gene Name: hemoglobin, delta
  ENSP ID: ENSP00000393810
MVHLTPEEKTAVNALWGKVNVDAVGGEALGRLLVVYPWTQRFFESFGDLSSPDAVMGNPKVKAHGKKVLGAFSDGLAHLDNLKGTFSQLSELHCDKLHVDPENF

SEQ ID NO: 37721 - protein, 85 aa, Homo sapiens
  Payload ID: 7487
  Gene Symbol: HBD
  Gene Name: hemoglobin, delta
  ENSP ID: ENSP00000414741
MVHLTPEEKTAVNALWGKVNVDAVGGEALGSSWAMCWCVCWPATLARNSPHKCRLPIRRWWLVWLMPWLTSTIEILDCFLITIRR

SEQ ID NO: 37722 - protein, 147 aa, Homo sapiens
  Payload ID: 7488
  Gene Symbol: HBE1
  Gene Name: hemoglobin, epsilon 1
  Uniprot ID: P02100
  ENSP ID: ENSP00000292896
MVHFTAEEKAAVTSLWSKMNVEEAGGEALGRLLVVYPWTQRFFDSFGNLSSPSAILGNPKVKAHGKKVLTSFGDAIKNMDNLKPAFAKLSELHCDKLHVDPENFKLLGNVMVIILATHFGKEFTPEVQAAWQKLVSAVAIALAHKYH

SEQ ID NO: 37723 - protein, 147 aa, Homo sapiens; identical to SEQ ID NO: 37722
  Payload ID: 7488
  Gene Symbol: HBE1
  Gene Name: hemoglobin, epsilon 1
  Uniprot ID: P02100
  ENSP ID: ENSP00000369586

SEQ ID NO: 37724 - protein, 87 aa, Homo sapiens
  Payload ID: 7488
  Gene Symbol: HBE1
  Gene Name: hemoglobin, epsilon 1
  ENSP ID: ENSP00000380104
MVHFTAEEKAAVTSLWSKMNVEEAGGEALGRLLVVYPWTQRFFDSFGNLSSPSAILGNPKVKAHGKKVLTSFGDAIKNMDNLKPAFA

SEQ ID NO: 37725 - protein, 147 aa, Homo sapiens
  Payload ID: 7489
  Gene Symbol: HBG1
  Gene Name: hemoglobin, gamma A
  Uniprot ID: P69891
  ENSP ID: ENSP00000327431
MGHFTEEDKATITSLWGKVNVEDAGGETLGRLLVVYPWTQRFFDSFGNLSSASAIMGNPKVKAHGKKVLTSLGDATKHLDDLKGTFAQLSELHCDKLHVDPENFKLLGNVLVTVLAIHFGKEFTPEVQASWQKMVTAVASALSSRYH

SEQ ID NO: 37726 - protein, 30 aa, Homo sapiens
  Payload ID: 7489
  Gene Symbol: HBG1
  Gene Name: hemoglobin, gamma A
  ENSP ID: ENSP00000488759
MGHFTEEDKATITSLWGKAPGCLPMDPEVL

SEQ ID NO: 37727 - protein, 147 aa, Homo sapiens
  Payload ID: 7490
  Gene Symbol: HBG2
  Gene Name: hemoglobin, gamma G
  Uniprot ID: P69892
  ENSP ID: ENSP00000338082
MGHFTEEDKATITSLWGKVNVEDAGGETLGRLLVVYPWTQRFFDSFGNLSSASAIMGNPKVKAHGKKVLTSLGDAIKHLDDLKGTFAQLSELHCDKLHVDPENFKLLGNVLVTVLAIHFGKEFTPEVQASWQKMVTGVASALSSRYH

SEQ ID NO: 37728 - protein, 137 aa, Homo sapiens
  Payload ID: 7490
  Gene Symbol: HBG2
  Gene Name: hemoglobin, gamma G
  ENSP ID: ENSP00000369602
MVVLGEMKRKVLPLHFLPFMRLLVVYPWTQRFFDSFGNLSSASAIMGNPKVKAHGKKVLTSLGDAIKHLDDLKGTFAQLSELHCDKLHVDPENFKLLGNVLVTVLAIHFGKEFTPEVQASWQKMVTGVASALSSRYH

SEQ ID NO: 37729 - protein, 147 aa, Homo sapiens; identical to SEQ ID NO: 37727
  Payload ID: 7490
  Gene Symbol: HBG2
  Gene Name: hemoglobin, gamma G
  Uniprot ID: P69892
  ENSP ID: ENSP00000369609

SEQ ID NO: 37730 - protein, 147 aa, Homo sapiens
  Payload ID: 7490
  Gene Symbol: HBG2
  Gene Name: hemoglobin, gamma G
  ENSP ID: ENSP00000479637
MGHFTEEDKATITSLWGKVNVEDAGGETLGRLLVVYPWTQRFFDSFGNLSSASAIMGNPKVKAHGKKVLTSLGDAIKHLDDLKGTFAQLSELHCDKLHVDPENFKLLGNVLVTVLAIHFGKEFTPEVQASWQKMVTAVASALSSRYH

SEQ ID NO: 37731 - protein, 30 aa, Homo sapiens; identical to SEQ ID NO: 37726
  Payload ID: 7490
  Gene Symbol: HBG2
  Gene Name: hemoglobin, gamma G
  ENSP ID: ENSP00000488218

SEQ ID NO: 37732 - protein, 141 aa, Homo sapiens
  Payload ID: 7491
  Gene Symbol: HBM
  Gene Name: hemoglobin, mu
  Uniprot ID: Q6B0K9
  ENSP ID: ENSP00000349270
MLSAQERAQIAQVWDLIAGHEAQFGAELLLRLFTVYPSTKVYFPHLSACQDATQLLSHGQRMLAAVGAAVQHVDNLRAALSPLADLHALVLRVDPANFPLLIQCFHVVLASHLQDEFTVQMQAAWDKFLTGVAVVLTEKYR

SEQ ID NO: 37733 - protein, 142 aa, Homo sapiens
  Payload ID: 7492
  Gene Symbol: HBQ1
  Gene Name: hemoglobin, theta 1
  Uniprot ID: P09105
  ENSP ID: ENSP00000199708
MALSAEDRALVRALWKKLGSNVGVYTTEALERTFLAFPATKTYFSHLDLSPGSSQVRAHGQKVADALSLAVERLDDLPHALSALSHLHACQLRVDPASFQLLGHCLLVTLARHYPGDFSPALQASLDKFLSHVISALVSEYR

SEQ ID NO: 37734 - protein, 142 aa, Homo sapiens
  Payload ID: 7493
  Gene Symbol: HBZ
  Gene Name: hemoglobin, zeta
  Uniprot ID: P02008
  ENSP ID: ENSP00000252951
MSLTKTERTIIVSMWAKISTQADTIGTETLERLFLSHPQTKTYFPHFDLHPGSAQLRAHGSKVVAAVGDAVKSIDDIGGALSKLSELHAYILRVDPVNFKLLSHCLLVTLAARFPADFTAEAHAAWDKFLSVVSSVLTEKYR

SEQ ID NO: 37735 - protein, 462 aa, Homo sapiens
  Payload ID: 7494
  Gene Symbol: HPX
  Gene Name: hemopexin
  Uniprot ID: P02790
  ENSP ID: ENSP00000265983
MARVLGAPVALGLWSLCWSLAIATPLPPTSAHGNVAEGETKPDPDVTERCSDGWSFDATTLDDNGTMLFFKGEFVWKSHKWDRELISERWKNFPSPVDAAFRQGHNSVFLIKGDKVWVYPPEKKEKGYPKLLQDEFPGIPSPLDAAVECHRGECQAEGVLFFQGDREWFWDLATGTMKERSWPAVGNCSSALRWLGRYYCFQGNQFLRFDPVRGEVPPRYPRDVRDYFMPCPGRGHGHRNGTGHGNSTHHGPEYMRCSPHLVLSALTSDNHGATYAFSGTHYWRLDTSRDGWHSWPIAHQWPQGPSAVDAAFSWEEKLYLVQGTQVYVFLTKGGYTLVSGYPKRLEKEVGTPHGIILDSVDAAFICPGSSRLHIMAGRRLWWLDLKSGAQATWTELPWPHEKVDGALCMEKSLGPNSCSANGPGLYLIHGPNLYCYSDVEKLNAAKALPQPQNVTSLLGCTH

SEQ ID NO: 37736 - protein, 254 aa, Homo sapiens [sequence omitted]

SEQ ID NO: 37737 - protein, 424 aa, Homo sapiens
  Payload ID: 7495
  Gene Symbol: HENMT1
  Gene Name: HEN1 methyltransferase homolog 1 (Arabidopsis)
  ENSP ID: ENSP00000359048
MEENNLQCSSVVDGNFEEVPRETAIQFKPPLYRQRYQFVKNLVDQHEPKKVADLGCGDTSLLRLLKVNPCIELLVGVDINEDKLRWRGDSLAPFLGDFLKPRDLNLTITLYHGSVVERDSRLLGFDLITCIELIEHLDSGDLARFPEVVFGYLSPSMIVISTPNSEFNPLFPSVTLRDSDHKFEWTRMEFQTWALYVANRYDYSVEFTGVGEPPAGAENVGYCTQIGIFRKNGGKATESCLSEQHDQHVYKARQGLTMLPRLVLNFHPQAILLPHLPKMLRLQVFTTSYPSLQQERFFKLVLVNEVSQQVESLRVSHLPRRKEQAGERGDKPKDIGGSKAPVPCFGPVFTEVEKAKIENSPTPFCVGDKFFVPLQRLLAYPKLNRLCANEEMMRSVIADSIPLSSDGSAVVADLRNYFDEQFEF

SEQ ID NO: 37738 - protein, 393 aa, Homo sapiens
  Payload ID: 7495
  Gene Symbol: HENMT1
  Gene Name: HEN1 methyltransferase homolog 1 (Arabidopsis)
  Uniprot ID: Q5T8I9
  ENSP ID: ENSP00000359049
MEENNLQCSSVVDGNFEEVPRETAIQFKPPLYRQRYQFVKNLVDQHEPKKVADLGCGDTSLLRLLKVNPCIELLVGVDINEDKLRWRGDSLAPFLGDFLKPRDLNLTITLYHGSVVERDSRLLGFDLITCIELIEHLDSGDLARFPEVVFGYLSPSMIVISTPNSEFNPLFPSVTLRDSDHKFEWTRMEFQTWALYVANRYDYSVEFTGVGEPPAGAENVGYCTQIGIFRKNGGKATESCLSEQHDQHVYKAVFTTSYPSLQQERFFKLVLVNEVSQQVESLRVSHLPRRKEQAGERGDKPKDIGGSKAPVPCFGPVFTEVEKAKIENSPTPFCVGDKFFVPLQRLLAYPKLNRLCANEEMMRSVIADSIPLSSDGSAVVADLRNYFDEQFEF

SEQ ID NO: 37739 - protein, 393 aa, Homo sapiens; identical to SEQ ID NO: 37738
  Payload ID: 7495
  Gene Symbol: HENMT1
  Gene Name: HEN1 methyltransferase homolog 1 (Arabidopsis)
  Uniprot ID: Q5T8I9
  ENSP ID: ENSP00000385655

SEQ ID NO: 37740 - protein, 316 aa, Homo sapiens
  Payload ID: 7495
  Gene Symbol: HENMT1
  Gene Name: HEN1 methyltransferase homolog 1 (Arabidopsis)
  ENSP ID: ENSP00000403953
MEENNLQCSSVVDGNFEEVPRETAIQFKPPLYRQRYQFVKNLVDQHEPKKVADLGCGDTSLLRLLKVNPCIELLVGVDINEDKLRWRGDSLAPFLGDFLKPRDLNLTITLYHGSVVERDSRLLGFDLITCIELIEHLDSGDLARFPEVVFGYLSPSMIVISTPNSEFNPLFPSVTLRDSDHKFEWTRMEFQTWALYVANRYDYSVEFTGVGEPPAGAENVGYCTQIGIFRKNGGKATESCLSEQHDQHVYKAVFTTSYPSLQQERFFKLVLVNEVSQQVESLRVSHLPRRKEQAGERGDKPKDIGGSKAPVPCFGP

SEQ ID NO: 37741 - protein, 450 aa, Homo sapiens
  Payload ID: 7496
  Gene Symbol: HEPACAM2
  Gene Name: HEPACAM family member 2
  Uniprot ID: A8MVW5
  ENSP ID: ENSP00000340532
MWLKVFTTFLSFATGACSGLKVTVPSHTVHGVRGQALYLPVHYGFHTPASDIQIIWLFERPHTMPKYLLGSVNKSVVPDLEYQHKFTMMPPNASLLINPLQFPDEGNYIVKVNIQGNGTLSASQKIQVTVDDPVTKPVVQIHPPSGAVEYVGNMTLTCHVEGGTRLAYQWLKNGRPVHTSSTYSFSPQNNTLHIAPVTKEDIGNYSCLVRNPVSEMESDIIMPIIYYGPYGLQVNSDKGLKVGEVFTVDLGEAILFDCSADSHPPNTYSWIRRTDNTTYIIKHGPRLEVASEKVAQKTMDYVCCAYNNITGRQDETHFTVIITSVGLEKLAQKGKSLSPLASITGISLFLIISMCLLFLWKKYQPYKVIKQKLEGRPETEYRKAQTFSGHEDALDDFGIYEFVAFPDVSGVSRIPSRSVPASDCVSGQDLHSTVYEVIQHIPAQQQDHPE

SEQ ID NO: 37742 - protein, 462 aa, Homo sapiens
  Payload ID: 7496
  Gene Symbol: HEPACAM2
  Gene Name: HEPACAM family member 2
  Uniprot ID: A8MVW5
  ENSP ID: ENSP00000377980
MGQDAFMEPFGDTLGVFQCKIYLLLFGACSGLKVTVPSHTVHGVRGQALYLPVHYGFHTPASDIQIIWLFERPHTMPKYLLGSVNKSVVPDLEYQHKFTMMPPNASLLINPLQFPDEGNYIVKVNIQGNGTLSASQKIQVTVDDPVTKPVVQIHPPSGAVEYVGNMTLTCHVEGGTRLAYQWLKNGRPVHTSSTYSFSPQNNTLHIAPVTKEDIGNYSCLVRNPVSEMESDIIMPIIYYGPYGLQVNSDKGLKVGEVFTVDLGEAILFDCSADSHPPNTYSWIRRTDNTTYIIKHGPRLEVASEKVAQKTMDYVCCAYNNITGRQDETHFTVIITSVGLEKLAQKGKSLSPLASITGISLFLIISMCLLFLWKKYQPYKVIKQKLEGRPETEYRKAQTFSGHEDALDDFGIYEFVAFPDVSGVSRIPSRSVPASDCVSGQDLHSTVYEVIQHIPAQQQDHPE

SEQ ID NO: 37743 - protein, 455 aa, Homo sapiens
  Payload ID: 7496
  Gene Symbol: HEPACAM2
  Gene Name: HEPACAM family member 2
  ENSP ID: ENSP00000389592
MWLKVFTTFLSFATGACSGLKVTVPSHTVHGVRGQALYLPVHYGFHTPASDIQIIWLFERPHTMPKYLLGSVNKSVVPDLEYQHKFTMMPPNASLLINPLQFPDEGNYIVKVNIQGNGTLSASQKIQVTVDDPVTKPVVQIHPPSGAVEYVGNMTLTCHVEGGTRLAYQWLKNGRPVHTSSTYSFSPQNNTLHIAPVTKEDIGNYSCLVRNPVSEMESDIIMPIIYYGPYGLQVNSDKGLKVGEVFTVDLGEAILFDCSADSHPPNTYSWIRRTDNTTYIIKHGPRLEVASEKVAQKTMDYVCCAYNNITGRQDETHFTVIITSVGLEKLAQKGKSLSPLASITGISLFLIISMCLLFLWKKYQPYKGQKQNTGKLKHFQAMKMLWMTSEYMNLLLFQMFLVFPGSQAGLFQPLIVYRGKICTVQCMKLFSTSLPSSKTIQSELSWAKQYIRVKF

SEQ ID NO: 37744 - protein, 485 aa, Homo sapiens
  Payload ID: 7496
  Gene Symbol: HEPACAM2
  Gene Name: HEPACAM family member 2
  Uniprot ID: A8MVW5
  ENSP ID: ENSP00000390204
MGQDAFMEPFGDTLGVFQCKIYLLLFDIVANCLLLRFKLSVSSYEIWKKGACSGLKVTVPSHTVHGVRGQALYLPVHYGFHTPASDIQIIWLFERPHTMPKYLLGSVNKSVVPDLEYQHKFTMMPPNASLLINPLQFPDEGNYIVKVNIQGNGTLSASQKIQVTVDDPVTKPVVQIHPPSGAVEYVGNMTLTCHVEGGTRLAYQWLKNGRPVHTSSTYSFSPQNNTLHIAPVTKEDIGNYSCLVRNPVSEMESDIIMPIIYYGPYGLQVNSDKGLKVGEVFTVDLGEAILFDCSADSHPPNTYSWIRRTDNTTYIIKHGPRLEVASEKVAQKTMDYVCCAYNNITGRQDETHFTVIITSVGLEKLAQKGKSLSPLASITGISLFLIISMCLLFLWKKYQPYKVIKQKLEGRPETEYRKAQTFSGHEDALDDFGIYEFVAFPDVSGVSRIPSRSVPASDCVSGQDLHSTVYEVIQHIPAQQQDHPE

SEQ ID NO: 37745 - protein, 307 aa, Homo sapiens
  Payload ID: 7497
  Gene Symbol: HS3ST1
  Gene Name: heparan sulfate (glucosamine) 3-O-sulfotransferase 1
  Uniprot ID: O14792
  ENSP ID: ENSP00000002596
MAALLLGAVLLVAQPQLVPSRPAELGQQELLRKAGTLQDDVRDGVAPNGSAQQLPQTIIIGVRKGGTRALLEMLSLHPDVAAAENEVHFFDWEEHYSHGLGWYLSQMPFSWPHQLTVEKTPAYFTSPKVPERVYSMNPSIRLLLILRDPSERVLSDYTQVFYNHMQKHKPYPSIEEFLVRDGRLNVDYKALNRSLYHVHMQNWLRFFPLRHIHIVDGDRLIRDPFPEIQKVERFLKLSPQINASNFYFNKTKGFYCLRDSGRDRCLHESKGRAHPQVDPKLLNKLHEYFHEPNKKFFELVGRTFDWH

SEQ ID NO: 37746 - protein, 82 aa, Homo sapiens
  Payload ID: 7497
  Gene Symbol: HS3ST1
  Gene Name: heparan sulfate (glucosamine) 3-O-sulfotransferase 1
  ENSP ID: ENSP00000422629
MAALLLGAVLLVAQPQLVPSRPAELGQQELLRKAGTLQDDVRDGVAPNGSAQQLPQTIIIGVRKGGTRALLEMLSLHPDVAA

SEQ ID NO: 37747 - protein, 82 aa, Homo sapiens; identical to SEQ ID NO: 37746
  Payload ID: 7497
  Gene Symbol: HS3ST1
  Gene Name: heparan sulfate (glucosamine) 3-O-sulfotransferase 1
  ENSP ID: ENSP00000425673

SEQ ID NO: 37748 - protein, 367 aa, Homo sapiens
  Payload ID: 7498
  Gene Symbol: HS3ST2
  Gene Name: heparan sulfate (glucosamine) 3-O-sulfotransferase 2
  Uniprot ID: Q9Y278
  ENSP ID: ENSP00000261374
MAYRVLGRAGPPQPRRARRLLFAFTLSLSCTYLCYSFLCCCDDLGRSRLLGAPRCLRGPSAGGQKLLQKSRPCDPSGPTPSEPSAPSAPAAAVPAPRLSGSNHSGSPKLGTKRLPQALIVGVKKGGTRAVLEFIRVHPDVRALGTEPHFFDRNYGRGLDWYRSLMPRTLESQITLEKTPSYFVTQEAPRRIFNMSRDTKLIVVVRNPVTRAISDYTQTLSKKPDIPTFEGLSFRNRTLGLVDVSWNAIRIGMYVLHLESWLQYFPLAQIHFVSGERLITDPAGEMGRVQDFLGIKRFITDKHFYFNKTKGFPCLKKTESSLLPRCLGKSKGRTHVQIDPEVIDQLREFYRPYNIKFYETVGQDFRWE

SEQ ID NO: 37749 - protein, 162 aa, Homo sapiens
  Payload ID: 7498
  Gene Symbol: HS3ST2
  Gene Name: heparan sulfate (glucosamine) 3-O-sulfotransferase 2
  ENSP ID: ENSP00000454505
MAYRVLGRAGPPQPRRARRLLFAFTLSLSCTYLCYSFLCCCDDLGRSRLLGAPRCLRGPSAGGQKLLQKSRPCDPSGPTPSEPSAPSAPAAAVPAPRLSGSNHSGSPKLGTKRLPQALIVGVKKGGTRAVLEFIRVHPDVRALGTEPHFFDRNYGRGLDWYR

SEQ ID NO: 37750 - protein, 406 aa, Homo sapiens
  Payload ID: 7499
  Gene Symbol: HS3ST3A1
  Gene Name: heparan sulfate (glucosamine) 3-O-sulfotransferase 3A1
  Uniprot ID: Q9Y663
  ENSP ID: ENSP00000284110
MAPPGPASALSTSAEPLSRSIFRKFLLMLCSLLTSLYVFYCLAERCQTLSGPVVGLSGGGEEAGAPGGGVLAGGPRELAVWPAAAQRKRLLQLPQWRRRRPPAPRDDGEEAAWEEESPGLSGGPGGSGAGSTVAEAPPGTLALLLDEGSKQLPQAIIIGVKKGGTRALLEFLRVHPDVRAVGAEPHFFDRSYDKGLAWYRDLMPRTLDGQITMEKTPSYFVTREAPARISAMSKDTKLIVVVRDPVTRAISDYTQTLSKRPDIPTFESLTFKNRTAGLIDTSWSAIQIGIYAKHLEHWLRHFPIRQMLFVSGERLISDPAGELGRVQDFLGLKRIITDKHFYFNKTKGFPCLKKAEGSSRPHCLGKTKGRTHPEIDREVVRRLREFYRPFNLKFYQMTGHDFGWDG

SEQ ID NO: 37751 - protein, 204 aa, Homo sapiens
  Payload ID: 7499
  Gene Symbol: HS3ST3A1
  Gene Name: heparan sulfate (glucosamine) 3-O-sulfotransferase 3A1
  ENSP ID: ENSP00000462696
MPRTLDGQITMEKTPSYFVTREAPARISAMSKDTKLIVVVRDPVTRAISDYTQTLSKRPDIPTFESLTFKNRTAGLIDTSWSAIQIGIYAKHLEHWLRHFPIRQMLFVSGERLISDPAGELGRVQDFLGLKRIITDKHFYFNKTKGFPCLKKAEGSSRPHCLGKTKGRTHPEIDREVVRRLREFYRPFNLKFYQMTGHDFGWDG

SEQ ID NO: 37752 - protein, 390 aa, Homo sapiens
  Payload ID: 7500
  Gene Symbol: HS3ST3B1
  Gene Name: heparan sulfate (glucosamine) 3-O-sulfotransferase 3B1
  Uniprot ID: Q9Y662
  ENSP ID: ENSP00000354213
MGQRLSGGRSCLDVPGRLLPQPPPPPPPVRRKLALLFAMLCVWLYMFLYSCAGSCAAAPGLLLLGSGSRAAHDPPALATAPDGTPPRLPFRAPPATPLASGKEMAEGAASPEEQSPEVPDSPSPISSFFSGSGSKQLPQAIIIGVKKGGTRALLEFLRVHPDVRAVGAEPHFFDRSYDKGLAWYRDLMPRTLDGQITMEKTPSYFVTREAPARISAMSKDTKLIVVVRDPVTRAISDYTQTLSKRPDIPTFESLTFKNRTAGLIDTSWSAIQIGIYAKHLEHWLRHFPIRQMLFVSGERLISDPAGELGRVQDFLGLKRIITDKHFYFNKTKGFPCLKKAEGSSRPHCLGKTKGRTHPEIDREVVRRLREFYRPFNLKFYQMTGHDFGWD

SEQ ID NO: 37753 - protein, 390 aa, Homo sapiens; identical to SEQ ID NO: 37752
  Payload ID: 7500
  Gene Symbol: HS3ST3B1
  Gene Name: heparan sulfate (glucosamine) 3-O-sulfotransferase 3B1
  Uniprot ID: Q9Y662
  ENSP ID: ENSP00000436078

SEQ ID NO: 37754 - protein, 456 aa, Homo sapiens
  Payload ID: 7501
  Gene Symbol: HS3ST4
  Gene Name: heparan sulfate (glucosamine) 3-O-sulfotransferase 4
  Uniprot ID: Q9Y661
  ENSP ID: ENSP00000330606
MARWPAPPPPPPPPPPLAAPPPPGASAKGPPARKLLFMCTLSLSVTYLCYSLLGGSGSLQFPLALQESPGAAAEPPPSPPPPSLLPTPVRLGAPSQPPAPPPLDNASHGEPPEPPEQPAAPGTDGWGLPSGGGGAQDAWLRTPLAPSEMITAQSALPEREAQESSTTDEDLAGRRAANGSSERGGAVSTPDYGEKKLPQALIIGVKKGGTRALLEAIRVHPDVRAVGVEPHFFDRNYEKGLEWYRNVMPKTLDGQITMEKTPSYFVTNEAPKRIHSMAKDIKLIVVVRNPVTRAISDYTQTLSKKPEIPTFEVLAFKNRTLGLIDASWSAIRIGIYALHLENWLQYFPLSQILFVSGERLIVDPAGEMAKVQDFLGLKRVVTEKHFYFNKTKGFPCLKKPEDSSAPRCLGKSKGRTHPRIDPDVIHRLRKFYKPFNLMFYQMTGQDFQWEQEEGDK

SEQ ID NO: 37755 - protein, 346 aa, Homo sapiens
  Payload ID: 7502
  Gene Symbol: HS3ST5
  Gene Name: heparan sulfate (glucosamine) 3-O-sulfotransferase 5
  Uniprot ID: Q8IZT8
  ENSP ID: ENSP00000427888
MLFKQQAWLRQKLLVLGSLAVGSLLYLVARVGSLDRLQPICPIEGRLGGARTQAEFPLRALQFKRGLLHEFRKGNASKEQVRLHDLVQQLPKAIIIGVRKGGTRALLEMLNLHPAVVKASQEIHFFDNDENYGKGIEWYRKKMPFSYPQQITIEKSPAYFITEEVPERIYKMNSSIKLLIIVREPTTRAISDYTQVLEGKERKNKTYYKFEKLAIDPNTCEVNTKYKAVRTSIYTKHLERWLKYFPIEQFHVVDGDRLITEPLPELQLVEKFLNLPPRISQYNLYFNATRGFYCLRFNIIFNKCLAGSKGRIHPEVDPSVITKLRKFFHPFNQKFYQITGRTLNWP

SEQ ID NO: 37756 - protein, 346 aa, Homo sapiens; identical to SEQ ID NO: 37755
  Payload ID: 7502
  Gene Symbol: HS3ST5
  Gene Name: heparan sulfate (glucosamine) 3-O-sulfotransferase 5
  Uniprot ID: Q8IZT8
  ENSP ID: ENSP00000440332

SEQ ID NO: 37757 - protein, 342 aa, Homo sapiens
  Payload ID: 7503
  Gene Symbol: HS3ST6
  Gene Name: heparan sulfate (glucosamine) 3-O-sulfotransferase 6
  Uniprot ID: Q96QI5
  ENSP ID: ENSP00000293937
MAGSGGLGGGAGGGQGAGAGQGAALRASRAPMLLVALVLGAYCLCALPGRCPPAARAPAPAPAPSEPSSSVHRPGAPGLPLASGPGRRRFPQALIVGVKKGGTRALLEFLRLHPDVRALGSEPHFFDRCYERGLAWYRSLMPRTLDGQITMEKTPSYFVTREAPRRIHAMSPDTKLIVVVRNPVTRAISDYAQTLSKTPGLPSFRALAFRHGLGPVDTAWSAVRIGLYAQHLDHWLRYFPLSHFLFVSGERLVSDPAGEVGRVQDFLGLKRVVTDKHFYFNATKGFPCLKKAQGGSRPRCLGKSKGRPHPRVPQALVRRLQEFYRPFNRRFYQMTGQDFGWG

SEQ ID NO: 37758 - protein, 342 aa, Homo sapiens; identical to SEQ ID NO: 37757
  Payload ID: 7503
  Gene Symbol: HS3ST6
  Gene Name: heparan sulfate (glucosamine) 3-O-sulfotransferase 6
  Uniprot ID: Q96QI5
  ENSP ID: ENSP00000416741

SEQ ID NO: 37759 - protein, 356 aa, Homo sapiens
  Payload ID: 7504
  Gene Symbol: HS2ST1
  Gene Name: heparan sulfate 2-O-sulfotransferase 1
  Uniprot ID: Q7LGA3
  ENSP ID: ENSP00000359581
MGLLRIMMPPKLQLLAVVAFAVAMLFLENQIQKLEESRSKLERAIARHEVREIEQRHTMDGPRQDATLDEEEDMVIIYNRVPKTASTSFTNIAYDLCAKNKYHVLHINTTKNNPVMSLQDQVRFVKNITSWKEMKPGFYHGHVSYLDFAKFGVKKKPIYINVIRDPIERLVSYYYFLRFGDDYRPGLRRRKQGDKKTFDECVAEGGSDCAPEKLWLQIPFFCGHSSECWNVGSRWAMDQAKYNLINEYFLVGVTEELEDFIMLLEAALPRFFRGATELYRTGKKSHLRKTTEKKLPTKQTIAKLQQSDIWKMENEFYEFALEQFQFIRAHAVREKDGDLYILAQNFFYEKIYPKSN

SEQ ID NO: 37760 - protein, 229 aa, Homo sapiens
  Payload ID: 7504
  Gene Symbol: HS2ST1
  Gene Name: heparan sulfate 2-O-sulfotransferase 1
  Uniprot ID: Q7LGA3
  ENSP ID: ENSP00000359582
MGLLRIMMPPKLQLLAVVAFAVAMLFLENQIQKLEESRSKLERAIARHEVREIEQRHTMDGPRQDATLDEEEDMVIIYNRVPKTASTSFTNIAYDLCAKNKYHVLHINTTKNNPVMSLQDQVRFVKNITSWKEMKPGFYHGHVSYLDFAKFGVKKKPIYINVIRDPIERLVSYYYFLRFGDDYRPGLRRRKQGDKKTFDECVAEGGSDCAPEKLWLQIPFFCGHSSECW

SEQ ID NO: 37761 - protein, 111 aa, Homo sapiens
  Payload ID: 7504
  Gene Symbol: HS2ST1
  Gene Name: heparan sulfate 2-O-sulfotransferase 1
  ENSP ID: ENSP00000467253
MDGPRQDATLDEEEDMVIIYNRVPKTASTSFTNIAYDLCAKNKYHVLHINTTKNNPVMSLQDQVRFVKNITSWKEMKPGFYHGHVSYLDFAKFGVKKKPIYINVIRDPIER

SEQ ID NO: 37762 - protein, 411 aa, Homo sapiens
  Payload ID: 7505
  Gene Symbol: HS6ST1
  Gene Name: heparan sulfate 6-O-sulfotransferase 1
  Uniprot ID: O60243
  ENSP ID: ENSP00000259241
MRRRRAGGRTMVERASKFVLVVAGSVCFMLILYQYAGPGLSLGAPGGRAPPDDLDLFPTPDPHYEKKYYFPVRELERSLRFDMKGDDVIVFLHIQKTGGTTFGRHLVQNVRLEVPCDCRPGQKKCTCYRPNRRETWLFSRFSTGWSCGLHADWTELTNCVPGVLDRRDSAALRTPRKFYYITLLRDPVSRYLSEWRHVQRGATWKTSLHMCDGRTPTPEELPPCYEGTDWSGCTLQEFMDCPYNLANNRQVRMLADLSLVGCYNLSFIPEGKRAQLLLESAKKNLRGMAFFGLTEFQRKTQYLFERTFNLKFIRPFMQYNSTRAGGVEVDEDTIRRIEELNDLDMQLYDYAKDLFQQRYQYKRQLERREQRLRSREERLLHRAKEALPREDADEPGRVPTEDYMSHIIEKW

SEQ ID NO: 37763 - protein, 645 aa, Homo sapiens
  Payload ID: 7506
  Gene Symbol: HS6ST2
  Gene Name: heparan sulfate 6-O-sulfotransferase 2
  Uniprot ID: Q96MM7
  ENSP ID: ENSP00000359870
MALPACAVREFEPPRQPERGAPVRTTCPRRHSRVEAELAASRPGSVAASVRAGPPRGVSHGFHTRPLLDKPRKASSSLAGAACAPLFALLSRGRRRRMHVLRRRWDLGSLCRALLTRGLAALGHSLKHVLGAIFSKIFGPMASVGNMDEKSNKLLLALVMLFLFAVIVLQYVCPGTECQLLRLQAFSSPVPDPYRSEDESSARFVPRYNFTRGDLLRKVDFDIKGDDLIVFLHIQKTGGTTFGRHLVRNIQLEQPCECRVGQKKCTCHRPGKRETWLFSRFSTGWSCGLHADWTELTSCVPSVVDGKRDARLRPSRWRIFQILDAASKDKRGSPNTNAGANSPSSTKTRNTSKSGKNFHYITILRDPVSRYLSEWRHVQRGATWKASLHVCDGRPPTSEELPSCYTGDDWSGCPLKEFMDCPYNLANNRQVRMLSDLTLVGCYNLSVMPEKQRNKVLLESAKSNLKHMAFFGLTEFQRKTQYLFEKTFNMNFISPFTQYNTTRASSVEINEEIQKRIEGLNFLDMELYSYAKDLFLQRYQFMRQKEHQEARRKRQEQRKFLKGRLLQTHFQSQGQGQSQNPNQNQSQNPNPNANQNLTQNLMQNLTQSLSQKENRESPKQNSGKEQNDNTSNGTNDYIGSVEKWR

SEQ ID NO: 37764 - protein, 605 aa, Homo sapiens
  Payload ID: 7506
  Gene Symbol: HS6ST2
  Gene Name: heparan sulfate 6-O-sulfotransferase 2
  Uniprot ID: Q96MM7
  ENSP ID: ENSP00000359873
MALPACAVREFEPPRQPERGAPVRTTCPRRHSRVEAELAASRPGSVAASVRAGPPRGVSHGFHTRPLLDKPRKASSSLAGAACAPLFALLSRGRRRRMHVLRRRWDLGSLCRALLTRGLAALGHSLKHVLGAIFSKIFGPMASVGNMDEKSNKLLLALVMLFLFAVIVLQYVCPGTECQLLRLQAFSSPVPDPYRSEDESSARFVPRYNFTRGDLLRKVDFDIKGDDLIVFLHIQKTGGTTFGRHLVRNIQLEQPCECRVGQKKCTCHRPGKRETWLFSRFSTGWSCGLHADWTELTSCVPSVVDGKRDARLRPSRNFHYITILRDPVSRYLSEWRHVQRGATWKASLHVCDGRPPTSEELPSCYTGDDWSGCPLKEFMDCPYNLANNRQVRMLSDLTLVGCYNLSVMPEKQRNKVLLESAKSNLKHMAFFGLTEFQRKTQYLFEKTFNMNFISPFTQYNTTRASSVEINEEIQKRIEGLNFLDMELYSYAKDLFLQRYQFMRQKEHQEARRKRQEQRKFLKGRLLQTHFQSQGQGQSQNPNQNQSQNPNPNANQNLTQNLMQNLTQSLSQKENRESPKQNSGKEQNDNTSNGTNDYIGSVEKWR

SEQ ID NO: 37765 - protein, 605 aa, Homo sapiens; identical to SEQ ID NO: 37764
  Payload ID: 7506
  Gene Symbol: HS6ST2
  Gene Name: heparan sulfate 6-O-sulfotransferase 2
  Uniprot ID: Q96MM7
  ENSP ID: ENSP00000384013

SEQ ID NO: 37766 - protein, 645 aa, Homo sapiens; identical to SEQ ID NO: 37763
  Payload ID: 7506
  Gene Symbol: HS6ST2
  Gene Name: heparan sulfate 6-O-sulfotransferase 2
  Uniprot ID: Q96MM7
  ENSP ID: ENSP00000429473

SEQ ID NO: 37767 - protein, 471 aa, Homo sapiens
  Payload ID: 7507
  Gene Symbol: HS6ST3
  Gene Name: heparan sulfate 6-O-sulfotransferase 3
  Uniprot ID: Q8IZP7
  ENSP ID: ENSP00000365895
MDERFNKWLLTPVLTLLFVVIMYQYVSPSCTSSCTNFGEQPRAGEAGPPAVPGPARRAQAPPEEWERRPQLPPPPRGPPEGPRGAAAPEEEDEEPGDPREGEEEEEEDEPDPEAPENGSLPRFVPRFNFSLKDLTRFVDFNIKGRDVIVFLHIQKTGGTTFGRHLVKNIRLEQPCSCKAGQKKCTCHRPGKKETWLFSRFSTGWSCGLHADWTELTNCVPAIMEKKDCPRNHSHTRNFYYITMLRDPVSRYLSEWKHVQRGATWKTSLHMCDGRSPTPDELPTCYPGDDWSGVSLREFMDCTYNLANNRQVRMLADLSLVGCYNLTFMNESERNTILLQSAKNNLKNMAFFGLTEFQRKTQFLFERTFNLKFISPFTQFNITRASNVEINEGARQRIEDLNFLDMQLYEYAKDLFQQRYHHTKQLEHQRDRQKRREERRLQREHRDHQWPKEDGAAEGTVTEDYNSQVVRW

SEQ ID NO: 37768 - protein, 236 aa, Homo sapiens
  Payload ID: 7507
  Gene Symbol: HS6ST3
  Gene Name: heparan sulfate 6-O-sulfotransferase 3
  ENSP ID: ENSP00000483366
RNFYYITMLRDPVSRYLSEWKHVQRGATWKTSLHMCDGRSPTPDELPTCYPGDDWSGVSLREFMDCTYNLANNRQVRMLADLSLVGCYNLTFMNESERNTILLQSAKNNLKNMAFFGLTEFQRKTQFLFERTFNLKFISPFTQFNITRASNVEINEGARQRIEDLNFLDMQLYEYAKDLFQQRYHHTKQLEHQRDRQKRREERRLQREHRDHQWPKEDGAAEGTVTEDYNSQVVRW

SEQ ID NO: 37769 - protein, 109 aa, Homo sapiens
  Payload ID: 7508
  Gene Symbol: HSPG2
  Gene Name: heparan sulfate proteoglycan 2
  ENSP ID: ENSP00000363808
  MOD_RES (1)..(1): Any amino acid
XGTPPLTFQWSRVGSSLPGRATARNELLHFERAAPEDSGRYRCRVTNKVGSAEAFAQLLVQESRTWTRAAKGRIYARPMDLGGRPRPVPSWLSKVGGWLQASAKSREQR

SEQ ID NO: 37770 - protein, 4391 aa, Homo sapiens
  Payload ID: 7508
  Gene Symbol: HSPG2
  Gene Name: heparan sulfate proteoglycan 2
  Uniprot ID: P98160
  ENSP ID: ENSP00000363827
MGWRAAGALLLALLLHGRLLAVTHGLRAYDGLSLPEDIETVTASQMRWTHSYLSDDEDMLADSISGDDLGSGDLGSGDFQMVYFRALVNFTRSIEYSPQLEDAGSREFREVSEAVVDTLESEYLKIPGDQVVSVVFIKELDGWVFVELDVGSEGNADGAQIQEMLLRVISSGSVASYVTSPQGFQFRRLGTVPQFPRACTEAEFACHSYNECVALEYRCDRRPDCRDMSDELNCEEPVLGISPTFSLLVETTSLPPRPETTIMRQPPVTHAPQPLLPGSVRPLPCGPQEAACRNGHCIPRDYLCDGQEDCEDGSDELDCGPPPPCEPNEFPCGNGHCALKLWRCDGDFDCEDRTDEANCPTKRPEEVCGPTQFRCVSTNMCIPASFHCDEESDCPDRSDEFGCMPPQVVTPPRESIQASRGQTVTFTCVAIGVPTPIINWRLNWGHIPSHPRVTVTSEGGRGTLIIRDVKESDQGAYTCEAMNARGMVFGIPDGVLELVPQRGPCPDGHFYLEHSAACLPCFCFGITSVCQSTRRFRDQIRLRFDQPDDFKGVNVTMPAQPGTPPLSSTQLQIDPSLHEFQLVDLSRRFLVHDSFWALPEQFLGNKVDSYGGSLRYNVRYELARGMLEPVQRPDVVLMGAGYRLLSRGHTPTQPGALNQRQVQFSEEHWVHESGRPVQRAELLQVLQSLEAVLIQTVYNTKMASVGLSDIAMDTTVTHATSHGRAHSVEECRCPIGYSGLSCESCDAHFTRVPGGPYLGTCSGCNCNGHASSCDPVYGHCLNCQHNTEGPQCNKCKAGFFGDAMKATATSCRPCPCPYIDASRRFSDTCFLDTDGQATCDACAPGYTGRRCESCAPGYEGNPIQPGGKCRPVNQEIVRCDERGSMGTSGEACRCKNNVVGRLCNECADGSFHLSTRNPDGCLKCFCMGVSRHCTSSSWSRAQLHGASEEPGHFSLTNAASTHTTNEGIFSPTPGELGFSSFHRLLSGPYFWSLPSRFLGDKVTSYGGELRFTVTQRSQPGSTPLHGQPLVVLQGNNIILEHHVAQEPSPGQPSTFIVPFREQAWQRPDGQPATREHLLMALAGIDTLLIRASYAQQPAESRVSGISMDVAVPEETGQDPALEVEQCSCPPGYRGPSCQDCDTGYTRTPSGLYLGTCERCSCHGHSEACEPETGACQGCQHHTEGPRCEQCQPGYYGDAQRGTPQDCQLCPCYGDPAAGQAAHTCFLDTDGHPTCDACSPGHSGRHCERCAPGYYGNPSQGQPCQRDSQVPGPIGCNCDPQGSVSSQCDAAGQCQCKAQVEGLTCSHCRPHHFHLSASNPDGCLPCFCMGITQQCASSAYTRHLISTHFAPGDFQGFALVNPQRNSRLTGEFTVEPVPEGAQLSFGNFAQLGHESFYWQLPETYQGDKVAAYGGKLRYTLSYTAGPQGSPLSDPDVQITGNNIMLVASQPALQGPERRSYEIMFREEFWRRPDGQPATREHLLMALADLDELLIRATFSSVPLAASISAVSLEVAQPGPSNRPRALEVEECRCPPGYIGLSCQDCAPGYTRTGSGLYLGHCELCECNGHSDLCHPETGACSQCQHNAAGEFCELCAPGYYGDATAGTPEDCQPCACPLTNPENMFSRTCESLGAGGYRCTACEPGYTGQYCEQCGPGYVGNPSVQGGQCLPETNQAPLVVEVHPARSIVPQGGSHSLRCQVSGSPPHYFYWSREDGRPVPSGTQQRHQGSELHFPSVQPSDAGVYICTCRNLHQSNTSRAELLVTEAPSKPITVTVEEQRSQSVRPGADVTFICTAKSKSPAYTLVWTRLHNGKLPTRAMDFNGILTIRNVQLSDAGTYVCTGSNMFAMDQGTATLHVQASGTLSAPVVSIHPPQLTVQPGQLAEFRCSATGSPTPTLEWTGGPGGQLPAKAQIHGGILRLPAVEPTDQAQYLCRAHSSAGQQVARAVLHVHGGGGPRVQVSPERTQVHAGRTVRLYCRAAGVPSATITWRKEGGSLPPQARSERTDIATLLIPAITTADAGFYLCVATSPAGTAQARIQVVVLSASDASPPPVKIESSSPSVTEGQTLDLNCVVAGSAHAQVTWYRRGGSLPPHTQVHGSRLRLPQVSPADSGEYVCRVENGSGPKEASITVSVLHGTHSGPSYTPVPGSTRPIRIEPSSSHVAEGQTLDLNCVVPGQAHAQVTWHKRGGSLPARHQTHGSLLRLHQVTPADSGEYVCHVVGTSGPLEASVLVTIEASVIPGPIPPVRIESSSSTVAEGQTLDLSCVVAGQAHAQVTWYKRGGSLPARHQVRGSRLYIFQASPADAGQYVCRASNGMEASITVTVTGTQGANLAYPAGSTQPIRIEPSSSQVAEGQTLDLNCVVPGQSHAQVTWHKRGGSLPVRHQTHGSLLRLYQASPADSGEYVCRVLGSSVPLEASVLVTIEPAGSVPALGVTPTVRIESSSSQVAEGQTLDLNCLVAGQAHAQVTWHKRGGSLPARHQVHGSRLRLLQVTPADSGEYVCRVVGSSGTQEASVLVTIQQRLSGSHSQGVAYPVRIESSSASLANGHTLDLNCLVASQAPHTITWYKRGGSLPSRHQIVGSRLRIPQVTPADSGEYVCHVSNGAGSRETSLIVTIQGSGSSHVPSVSPPIRIESSSPTVVEGQTLDLNCVVARQPQAIITWYKRGGSLPSRHQTHGSHLRLHQMSVADSGEYVCRANNNIDALEASIVISVSPSAGSPSAPGSSMPIRIESSSSHVAEGETLDLNCVVPGQAHAQVTWHKRGGSLPSHHQTRGSRLRLHHVSPADSGEYVCRVMGSSGPLEASVLVTIEASGSSAVHVPAPGGAPPIRIEPSSSRVAEGQTLDLKCVVPGQAHAQVTWHKRGGNLPARHQVHGPLLRLNQVSPADSGEYSCQVTGSSGTLEASVLVTIEPSSPGPIPAPGLAQPIYIEASSSHVTEGQTLDLNCVVPGQAHAQVTWYKRGGSLPARHQTHGSQLRLHLVSPADSGEYVCRAASGPGPEQEASFTVTVPPSEGSSYRLRSPVISIDPPSSTVQQGQDASFKCLIHDGAAPISLEWKTRNQELEDNVHISPNGSIITIVGTRPSNHGTYRCVASNAYGVAQSVVNLSVHGPPTVSVLPEGPVWVKVGKAVTLECVSAGEPRSSARWTRISSTPAKLEQRTYGLMDSHAVLQISSAKPSDAGTYVCLAQNALGTAQKQVEVIVDTGAMAPGAPQVQAEEAELTVEAGHTATLRCSATGSPAPTIHWSKLRSPLPWQHRLEGDTLIIPRVAQQDSGQYICNATSPAGHAEATIILHVESPPYATTVPEHASVQAGETVQLQCLAHGTPPLTFQWSRVGSSLPGRATARNELLHFERAAPEDSGRYRCRVTNKVGSAEAFAQLLVQGPPGSLPATSIPAGSTPTVQVTPQLETKSIGASVEFHCAVPSDRGTQLRWFKEGGQLPPGHSVQDGVLRIQNLDQSCQGTYICQAHGPWGKAQASAQLVIQALPSVLINIRTSVQTVVVGHAVEFECLALGDPKPQVTWSKVGGHLRPGIVQSGGVVRIAHVELADAGQYRCTATNAAGTTQSHVLLLVQALPQISMPQEVRVPAGSAAVFPCIASGYPTPDISWSKLDGSLPPDSRLENNMLMLPSVRPQDAGTYVCTATNRQGKVKAFAHLQVPERVVPYFTQTPYSFLPLPTIKDAYRKFEIKITFRPDSADGMLLYNGQKRVPGSPTNLANRQPDFISFGLVGGRPEFRFDAGSGMATIRHPTPLALGHFHTVTLLRSLTQGSLIVGDLAPVNGTSQGKFQGLDLNEELYLGGYPDYGAIPKAGLSSGFIGCVRELRIQGEEIVFHDLNLTAHGISHCPTCRDRPCQNGGQCHDSESSSYVCVCPAGFTGSRCEHSQALHCHPEACGPDATCVNRPDGRGYTCRCHLGRSGLRCEEGVTVTTPSLSGAGSYLALPALTNTHHELRLDVEFKPLAPDGVLLFSGGKSGPVEDFVSLAMVGGHLEFRYELGSGLAVLRSAEPLALGRWHRVSAERLNKDGSLRVNGGRPVLRSSPGKSQGLNLHTLLYLGGVEPSVPLSPATNMSAHFRGCVGEVSVNGKRLDLTYSFLGSQGIGQCYDSSPCERQPCQHGATCMPAGEYEFQCLCRDGFKGDLCEHEENPCQLREPCLHGGTCQGTRCLCLPGFSGPRCQQGSGHGIAESDWHLEGSGGNDAPGQYGAYFHDDGFLAFPGHVFSRSLPEVPETIELEVRTSTASGLLLWQGVEVGEAGQGKDFISLGLQDGHLVFRYQLGSGEARLVSEDPINDGEWHRVTALREGRRGSIQVDGEELVSGRSPGPNVAVNAKGSVYIGGAPDVATLTGGRFSSGITGCVKNLVLHSARPGAPPPQPLDLQHRAQAGANTRPCPS

SEQ ID NO: 37771 - protein, 197 aa, Homo sapiens
  Payload ID: 7508
  Gene Symbol: HSPG2
  Gene Name: heparan sulfate proteoglycan 2
  ENSP ID: ENSP00000397573
  MOD_RES (1)..(1): Any amino acid
XTPSGLYLGTCERCSCHGHSEACEPETGACQGCQHHTEGPRCEQCQPGYYGDAQRGTPQDCQLCPCYGDPAAGQAAHTCFLDTDGHPTCDACSPGHSGRHCERCAPGYYGNPSQGQPCQRDSQVPGPIGCNCDPQGSVSSQCDAAGQCQCKVSPNPCPCGACSAPLPRPCGEIRQHLVEAETWAWGAGHGGQGRGCP

SEQ ID NO: 37772 - protein, 307 aa, Homo sapiens
  Payload ID: 7508
  Gene Symbol: HSPG2
  Gene Name: heparan sulfate proteoglycan 2
  ENSP ID: ENSP00000489161
  MOD_RES (1)..(1): Any amino acid
XNMLMLPSVRPQDAGTYVCTATNRQGKVKAFAHLQVPERVVPYFTQTPYSFLPLPTIKDAYRKFEIKITFRPDSADGLLLYSGMLLYNGQKRVPGSPTNLANRQPDFISFGLVGGRPEFRFDAGSGMATIRHPTPLALGHFHTVTLLRSLTQGSLIVGDLAPVNGTSQGKFQGLDLNEELYLGGYPDYGAIPKAGLSSGFIGCVRELRIQGEEIVFHDLNLTAHGISHCPTCRDRPCQNGGQCHDSESSSYVCVCPAGFTGSRCEHSQALHCHPEACGPDATCVNRPDGRGYTCRCHLGRSGLRCEE

SEQ ID NO: 37773 - protein, 635 aa, Homo sapiens
  Payload ID: 7509
  Gene Symbol: HGSNAT
  Gene Name: heparan-alpha-glucosaminide N-acetyltransferase
  Uniprot ID: Q68CP4
  ENSP ID: ENSP00000368965
MSGAGRALAALLLAASVLSAALLAPGGSSGRDAQAAPPRDLDKKRHAELKMDQALLLIHNELLWTNLTVYWKSECCYHCLFQVLVNVPQSPKAGKPSAAAASVSTQHGSILQLNDTLEEKEVCRLEYRFGEFGNYSLLVKNIHNGVSEIACDLAVNEDPVDSNLPVSIAFLIGLAVIIVISFLRLLLSLDDFNNWISKAISSRETDRLINSELGSPSRTDPLDGDVQPATWRLSALPPRLRSVDTFRGIALILMVFVNYGGGKYWYFKHASWNGLTVADLVFPWFVFIMGSSIFLSMTSILQRGCSKFRLLGKIAWRSFLLICIGIIIVNPNYCLGPLSWDKVRIPGVLQRLGVTYFVVAVLELLFAKPVPEHCASERSCLSLRDITSSWPQWLLILVLEGLWLGLTFLLPVPGCPTGYLGPGGIGDFGKYPNCTGGAAGYIDRLLLGDDHLYQHPSSAVLYHTEVAYDPEGILGTINSIVMAFLGVQAGKILLYYKARTKDILIRFTAWCCILGLISVALTKVSENEGFIPVNKNLWSLSYVTTLSSFAFFILLVLYPVVDVKGLWTGTPFFYPGMNSILVYVGHEVFENYFPFQWKLKDNQSHKEHLTQNIVATALWVLIAYILYRKKIFWKI

SEQ ID NO: 37774 - protein, 253 aa, Homo sapiens
  Payload ID: 7509
  Gene Symbol: HGSNAT
  Gene Name: heparan-alpha-glucosaminide N-acetyltransferase
  ENSP ID: ENSP00000428322
  MOD_RES (1)..(1): Any amino acid
XILQRGCSKFRLLGKIAWRSFLLICIGIIIVNPNYCLGPLSWDKVRIPGVLQRLGVTYFVVAVLELLFAKPVPEHCASERSCLSLRDITSSWPQWLLILVLEGLWLGLTFLLPVPGCPTGYLGPGGIGDFGKYPNCTGGAAGYIDRLLLGDDHLYQHPSSAVLYHTEVAYDPEGILGTINSIVMAFLGVQCCPDWVTKQACLTEPLSPLWRILFGPCLEVRATEPAQAGKILLYYKARTKDILIRFTAWCCIL

SEQ ID NO: 37775 - protein, 352 aa, Homo sapiens
  Payload ID: 7509
  Gene Symbol: HGSNAT
  Gene Name: heparan-alpha-glucosaminide N-acetyltransferase
  ENSP ID: ENSP00000429029
MAAGQRRSSLSRLGSQAEGLLTSQTMGGQAETLLTSQTGWLLGRGCNLGSPGGQVSWDKVRIPGVLQRLGVTYFVVAVLELLFAKPVPEHCASERSCLSLRDITSSWPQWLLILVLEGLWLGLTFLLPVPGCPTGYLGPGGIGDFGKYPNCTGGAAGYIDRLLLGDDHLYQHPSSAVLYHTEVAYDPEGILGTINSIVMAFLGVQAGKILLYYKARTKDILIRFTAWCCILGLISVALTKVSENEGFIPVNKNLWSLSYVTTLSSFAFFILLVLYPVVDVKGLWTGTPFFYPGMNSILVYVGHEVFENYFPFQWKLKDNQSHKEHLTQNIVATALWVLIAYILYRKKIFWKI

SEQ ID NO: 37776 - protein, 172 aa, Homo sapiens
  Payload ID: 7509
  Gene Symbol: HGSNAT
  Gene Name: heparan-alpha-glucosaminide N-acetyltransferase
  ENSP ID: ENSP00000429109
MDQALLLIHNELLWTNLTVYWKSECCYHCLFQVLVNVPQSPKAGKPSAAAASVSTQHGSILQLNDTLEEKEVCRLEYRFGEFGNYSLLVKNIHNGVSEIACDLAVNEDPVDSNLPVSIAFLIGLAVIIVISFLRLLLRVLLCHPGWSAVAPSRLTPSSASRVHTILLPQPPE

SEQ ID NO: 37777 - protein, 97 aa, Homo sapiens
  Payload ID: 7509
  Gene Symbol: HGSNAT
  Gene Name: heparan-alpha-glucosaminide N-acetyltransferase
  ENSP ID: ENSP00000430032
MSGAGRALAALLLAASVLSAALLAPGGSSGRDAQAAPPRDLDKKRHAELKMDQALLLIHNELLWTNLTVYWKSECCYHVGIQIWRIWKLFSLGKEHP

SEQ ID NO: 37778 - protein, 184 aa, Homo sapiens
  Payload ID: 7509
  Gene Symbol: HGSNAT
  Gene Name: heparan-alpha-glucosaminide N-acetyltransferase
  ENSP ID: ENSP00000430151
MVFVNYGGGKYWYFKHASWNGLTVADLVFPWFVFIMGSSIFLSMTSILQRGCSKFRLLGKIAWRSFLLICIGIIIVNPNYCLGPLSWDKVRIPGVLQRLGVTYFVVAVLELLFAKPVPEHCASTGPSLLASSDPPALATQSAGITGEELPFSSRHHVQLAPVAAHPGAGRPVAGLDIPPASPWV

SEQ ID NO: 37779 - protein, 543 aa, Homo sapiens
  Payload ID: 7510
  Gene Symbol: HPSE
  Gene Name: heparanase
  Uniprot ID: Q9Y251
  ENSP ID: ENSP00000308107
MLLRSKPALPPPLMLLLLGPLGPLSPGALPRPAQAQDVVDLDFFTQEPLHLVSPSFLSVTIDANLATDPRFLILLGSPKLRTLARGLSPAYLRFGGTKTDFLIFDPKKESTFEERSYWQSQVNQDICKYGSIPPDVEEKLRLEWPYQEQLLLREHYQKKFKNSTYSRSSVDVLYTFANCSGLDLIFGLNALLRTADLQWNSSNAQLLLDYCSSKGYNISWELGNEPNSFLKKADIFINGSQLGEDFIQLHKLLRKSTFKNAKLYGPDVGQPRRKTAKMLKSFLKAGGEVIDSVTWHHYYLNGRTATKEDFLNPDVLDIFISSVQKVFQVVESTRPGKKVWLGETSSAYGGGAPLLSDTFAAGFMWLDKLGLSARMGIEVVMRQVFFGAGNYHLVDENFDPLPDYWLSLLFKKLVGTKVLMASVQGSKRRKLRVYLHCTNTDNPRYKEGDLTLYAINLHNVTKYLRLPYPFSNKQVDKYLLRPLGPHGLLSKSVQLNGLTLKMVDDQTLPPLMEKPLRPGSSLGLPAFSYSFFVIRNAKVAACI

SEQ ID NO: 37780 - protein, 543 aa, Homo sapiens; identical to SEQ ID NO: 37779
  Payload ID: 7510
  Gene Symbol: HPSE
  Gene Name: heparanase
  Uniprot ID: Q9Y251
  ENSP ID: ENSP00000384262

SEQ ID NO: 37781 - protein, 380 aa, Homo sapiens
  Payload ID: 7510
  Gene Symbol: HPSE
  Gene Name: heparanase
  Uniprot ID: Q9Y251
  ENSP ID: ENSP00000421038
MLLRSKPALPPPLMLLLLGPLGPLSPGALPRPAQAQDVVDLDFFTQEPLHLVSPSFLSVTIDANLATDPRFLILLGSPKLRTLARGLSPAYLRFGGTKTDFLIFDPKKESTFEERSYWQSQVNQDICKYGSIPPDVEEKLRLEWPYQEQLLLREHYQKKFKNSTYSRSSVDVLYTFANCSGLDLIFGLNALLRTADLQWNSSNAQLLLDYCSSKGYNISWELGNEPNSFLKKADIFINGSQLGEDFIQLHKLLRKSTFKNAKLYGPDVGQPRRKTAKMLKSFLKAGGEVIDSVTWHHYYLNGRTATKEDFLNPDVLDIFISSVQKVFQVVESTRPGKKVWLGETSSAYGGGAPLLSDTFAAGFMIIGYLFCSRNWWAPRC

SEQ ID NO: 37782 - protein, 485 aa, Homo sapiens
  Payload ID: 7510
  Gene Symbol: HPSE
  Gene Name: heparanase
  Uniprot ID: Q9Y251
  ENSP ID: ENSP00000421365
MLLRSKPALPPPLMLLLLGPLGPLSPGALPRPAQAQDVVDLDFFTQEPLHLVSPSFLSVTIDANLATDPRFLILLGSPKLRTLARGLSPAYLRFGGTKTDFLIFDPKKESTFEERSYWQSQVNQDICKYGSIPPDVEEKLRLEWPYQEQLLLREHYQKKFKNSTYSKPNSFLKKADIFINGSQLGEDFIQLHKLLRKSTFKNAKLYGPDVGQPRRKTAKMLKSFLKAGGEVIDSVTWHHYYLNGRTATKEDFLNPDVLDIFISSVQKVFQVVESTRPGKKVWLGETSSAYGGGAPLLSDTFAAGFMWLDKLGLSARMGIEVVMRQVFFGAGNYHLVDENFDPLPDYWLSLLFKKLVGTKVLMASVQGSKRRKLRVYLHCTNTDNPRYKEGDLTLYAINLHNVTKYLRLPYPFSNKQVDKYLLRPLGPHGLLSKSVQLNGLTLKMVDDQTLPPLMEKPLRPGSSLGLPAFSYSFFVIRNAKVAACI

SEQ ID NO: 37783 - protein, 168 aa, Homo sapiens
  Payload ID: 7510
  Gene Symbol: HPSE
  Gene Name: heparanase
  ENSP ID: ENSP00000421827
MLLRSKPALPPPLMLLLLGPLGPLSPGALPRPAQAQDVVDLDFFTQEPLHLVSPSFLSVTIDANLATDPRFLILLGSPKLRTLARGLSPAYLRFGGTKTDFLIFDPKKESTFEERSYWQSQVNQDICKYGSIPPDVEEKLRLEWPYQEQLLLREHYQKKFKNSTYSTS

SEQ ID NO: 37784 - protein, 469 aa, Homo sapiens
  Payload ID: 7510
  Gene Symbol: HPSE
  Gene Name: heparanase
  Uniprot ID: Q9Y251
  ENSP ID: ENSP00000423265
MLLRSKPALPPPLMLLLLGPLGPLSPGALPRPAQAQDVVDLDFFTQEPLHLVSPSFLSVTIDANLATDPRFLILLGSPKLRTLARGLSPAYLRFGGTKTDFLIFDPKKESTFEERSYWQSQVNQDICKYGSIPPDVEEKLRLEWPYQEQLLLREHYQKKFKNSTYSRSSVDVLYTFANCSGLDLIFGLNALLRTADLQWNSSNAQLLLDYCSSKGYNISWELGNEPNSFLKKADIFINGSQLGEDFIQLHKLLRKSTFKNAKLYGPDVGQPRRKTAKMLKSFLKAGGEVIDSVTWHHYYLNGRTATKEDFLNPDVLDIFISSVQKVFQDYWLSLLFKKLVGTKVLMASVQGSKRRKLRVYLHCTNTDNPRYKEGDLTLYAINLHNVTKYLRLPYPFSNKQVDKYLLRPLGPHGLLSKSVQLNGLTLKMVDDQTLPPLMEKPLRPGSSLGLPAFSYSFFVIRNAKVAACI

SEQ ID NO: 37785 - protein, 226 aa, Homo sapiens
  Payload ID: 7510
  Gene Symbol: HPSE
  Gene Name: heparanase
  ENSP ID: ENSP00000426139
MLLRSKPALPPPLMLLLLGPLGPLSPGALPRPAQAQDVVDLDFFTQEPLHLVSPSFLSVTIDANLATDPRFLILLGSPKLRTLARGLSPAYLRFGGTKTDFLIFDPKKESTFEERSYWQSQVNQDICKYGSIPPDVEEKLRLEWPYQEQLLLREHYQKKFKNSTYSRSSVDVLYTFANCSGLDLIFGLNALLRTADLQWNSSNAQLLLDYCSSKGYNISWELGNAS

SEQ ID NO: 37786 - protein, 548 aa, Homo sapiens
  Payload ID: 7511
  Gene Symbol: HPSE2
  Gene Name: heparanase 2 (inactive)
  Uniprot ID: Q8WWQ2
  ENSP ID: ENSP00000359577
MRVLCAFPEAMPSSNSRPPACLAPGALYLALLLHLSLSSQAGDRRPLPVDRAAGLKEKTLILLDVSTKNPVRTVNENFLSLQLDPSIIHDGWLDFLSSKRLVTLARGLSPAFLRFGGKRTDFLQFQNLRNPAKSRGGPGPDYYLKNYEDDIVRSDVALDKQKGCKIAQHPDVMLELQREKAAQMHLVLLKEQFSNTYSNLILTARSLDKLYNFADCSGLHLIFALNALRRNPNNSWNSSSALSLLKYSASKKYNISWELGNEPNNYRTMHGRAVNGSQLGKDYIQLKSLLQPIRIYSRASLYGPNIGRPRKNVIALLDGFMKVAGSTVDAVTWQHCYIDGRVVKVMDFLKTRLLDTLSDQIRKIQKVVNTYTPGKKIWLEGVVTTSAGGTNNLSDSYAAGFLWLNTLGMLANQGIDVVIRHSFFDHGYNHLVDQNFNPLPDYWLSLLYKRLIGPKVLAVHVAGLQRKPRPGRVIRDKLRIYAHCTNHHNHNYVRGSITLFIINLHRSRKKIKLAGTLRDKLVHQYLLQPYGQEGLKSKTQRCQYCGII

SEQ ID NO: 37787 - protein, 534 aa, Homo sapiens
  Payload ID: 7511
  Gene Symbol: HPSE2
  Gene Name: heparanase 2 (inactive)
  Uniprot ID: Q8WWQ2
  ENSP ID: ENSP00000359580
MRVLCAFPEAMPSSNSRPPACLAPGALYLALLLHLSLSSQAGDRRPLPVDRAAGLKEKTLILLDVSTKNPVRTVNENFLSLQLDPSIIHDGWLDFLSSKRLVTLARGLSPAFLRFGGKRTDFLQFQNLRNPAKSRGGPGPDYYLKNYEDDIVRSDVALDKQKGCKIAQHPDVMLELQREKAAQMHLVLLKEQFSNTYSNLILTEPNNYRTMHGRAVNGSQLGKDYIQLKSLLQPIRIYSRASLYGPNIGRPRKNVIALLDGFMKVAGSTVDAVTWQHCYIDGRVVKVMDFLKTRLLDTLSDQIRKIQKVVNTYTPGKKIWLEGVVTTSAGGTNNLSDSYAAGFLWLNTLGMLANQGIDVVIRHSFFDHGYNHLVDQNFNPLPDYWLSLLYKRLIGPKVLAVHVAGLQRKPRPGRVIRDKLRIYAHCTNHHNHNYVRGSITLFIINLHRSRKKIKLAGTLRDKLVHQYLLQPYGQEGLKSKSVQLNGQPLVMVDDGTLPELKPRPLRAGRTLVIPPVTMGFYVVKNVNALACRYR

SEQ ID NO: 37788 - protein, 592 aa, Homo sapiens
  Payload ID: 7511
  Gene Symbol: HPSE2
  Gene Name: heparanase 2 (inactive)
  Uniprot ID: Q8WWQ2
  ENSP ID: ENSP00000359583
MRVLCAFPEAMPSSNSRPPACLAPGALYLALLLHLSLSSQAGDRRPLPVDRAAGLKEKTLILLDVSTKNPVRTVNENFLSLQLDPSIIHDGWLDFLSSKRLVTLARGLSPAFLRFGGKRTDFLQFQNLRNPAKSRGGPGPDYYLKNYEDDIVRSDVALDKQKGCKIAQHPDVMLELQREKAAQMHLVLLKEQFSNTYSNLILTARSLDKLYNFADCSGLHLIFALNALRRNPNNSWNSSSALSLLKYSASKKYNISWELGNEPNNYRTMHGRAVNGSQLGKDYIQLKSLLQPIRIYSRASLYGPNIGRPRKNVIALLDGFMKVAGSTVDAVTWQHCYIDGRVVKVMDFLKTRLLDTLSDQIRKIQKVVNTYTPGKKIWLEGVVTTSAGGTNNLSDSYAAGFLWLNTLGMLANQGIDVVIRHSFFDHGYNHLVDQNFNPLPDYWLSLLYKRLIGPKVLAVHVAGLQRKPRPGRVIRDKLRIYAHCTNHHNHNYVRGSITLFIINLHRSRKKIKLAGTLRDKLVHQYLLQPYGQEGLKSKSVQLNGQPLVMVDDGTLPELKPRPLRAGRTLVIPPVTMGFYVVKNVNALACRYR

SEQ ID NO: 37789 - protein, 389 aa, Homo sapiens
  Payload ID: 7511
  Gene Symbol: HPSE2
  Gene Name: heparanase 2 (inactive)
  ENSP ID: ENSP00000384384
ARSLDKLYNFADCSGLHLIFALNALRRNPNNSWNSSSALSLLKYSASKKYNISWELGNEPNNYRTMHGRAVNGSQLGKDYIQLKSLLQPIRIYSRASLYGPNIGRPRKNVIALLDGFMKVAGSTVDAVTWQHCYIDGRVVKVMDFLKTRLLDTLSDQIRKIQKVVNTYTPGKKIWLEGVVTTSAGGTNNLSDSYAAGFLWLNTLGMLANQGIDVVIRHSFFDHGYNHLVDQNFNPLPDYWLSLLYKRLIGPKVLAVHVAGLQRKPRPGRVIRDKLRIYAHCTNHHNHNYVRGSITLFIINLHRSRKKIKLAGTLRDKLVHQYLLQPYGQEGLKSKSVQLNGQPLVMVDDGTLPELKPRPLRAGRTLVIPPVTMGFYVVKNVNALACRYR

SEQ ID NO: 37790 - protein, 149 aa, Homo sapiens
  Payload ID: 7511
  Gene Symbol: HPSE2
  Gene Name: heparanase 2 (inactive)
  ENSP ID: ENSP00000484672
MRVLCAFPEAMPSSNSRPPACLAPGALYLALLLHLSLSSQAGDRRPLPVDRAAGLKEKTLILLDVSTKNPVRTVNENFLSLQLDPSIIHDGWLDFLSSKRLVTLARGLSPAFLRFGGKRTDFLQFQNLRNPAKSRGGPGPDYYLKNYED

SEQ ID NO: 37791 - protein, 480 aa, Homo sapiens
  Payload ID: 7511
  Gene Symbol: HPSE2
  Gene Name: heparanase 2 (inactive)
  Uniprot ID: Q8WWQ2
  ENSP ID: ENSP00000485916
MRVLCAFPEAMPSSNSRPPACLAPGALYLALLLHLSLSSQAGDRRPLPVDRAAGLKEKTLILLDVSTKNPVRTVNENFLSLQLDPSIIHDGWLDFLSSKRLVTLARGLSPAFLRFGGKRTDFLQFQNLRNPAKSRGGPGPDYYLKNYEDEPNNYRTMHGRAVNGSQLGKDYIQLKSLLQPIRIYSRASLYGPNIGRPRKNVIALLDGFMKVAGSTVDAVTWQHCYIDGRVVKVMDFLKTRLLDTLSDQIRKIQKVVNTYTPGKKIWLEGVVTTSAGGTNNLSDSYAAGFLWLNTLGMLANQGIDVVIRHSFFDHGYNHLVDQNFNPLPDYWLSLLYKRLIGPKVLAVHVAGLQRKPRPGRVIRDKLRIYAHCTNHHNHNYVRGSITLFIINLHRSRKKIKLAGTLRDKLVHQYLLQPYGQEGLKSKSVQLNGQPLVMVDDGTLPELKPRPLRAGRTLVIPPVTMGFYVVKNVNALACRYR

SEQ ID NO: 37792 - protein, 208 aa, Homo sapiens
  Payload ID: 7512
  Gene Symbol: HBEGF
  Gene Name: heparin-binding EGF-like growth factor
  Uniprot ID: Q99075
  ENSP ID: ENSP00000230990
MKLLPSVVLKLFLAAVLSALVTGESLERLRRGLAAGTSNPDPPTVSTDQLLPLGGGRDRKVRDLQEADLDLLRVTLSSKPQALATPNKEEHGKRKKKGKGLGKKRDPCLRKYKDFCIHGECKYVKELRAPSCICHPGYHGERCHGLSLPVENRLYTYDHTTILAVVAVVLSSVCLLVIVGLLMFRYHRRGGYDVENEEKVKLGMTNSH

SEQ ID NO: 37793 - protein, 416 aa, Homo sapiens
  Payload ID: 7513
  Gene Symbol: HEPACAM
  Gene Name: hepatic and glial cell adhesion molecule
  Uniprot ID: Q14CZ8
  ENSP ID: ENSP00000298251
MKRERGALSRASRALRLAPFVYLLLIQTDPLEGVNITSPVRLIHGTVGKSALLSVQYSSTSSDRPVVKWQLKRDKPVTVVQSIGTEVIGTLRPDYRDRIRLFENGSLLLSDLQLADEGTYEVEISITDDTFTGEKTINLTVDVPISRPQVLVASTTVLELSEAFTLNCSHENGTKPSYTWLKDGKPLLNDSRMLLSPDQKVLTITRVLMEDDDLYSCMVENPISQGRSLPVKITVYRRSSLYIILSTGGIFLLVTLVTVCACWKPSKRKQKKLEKQNSLEYMDQNDDRLKPEADTLPRSGEQERKNPMALYILKDKDSPETEENPAPEPRSATEPGPPGYSVSPAVPGRSPGLPIRSARRYPRSPARSPATGRTHSSPPRAPSSPGRSRSASRTLRTAGVHIIREQDEAGPVEISA

SEQ ID NO: 37794 - protein, 295 aa, Homo sapiens
  Payload ID: 7514
  Gene Symbol: HLF
  Gene Name: hepatic leukemia factor
  Uniprot ID: Q16534
  ENSP ID: ENSP00000226067
MEKMSRPLPLNPTFIPPPYGVLRSLLENPLKLPLHHEDAFSKDKDKEKKLDDESNSPTVPQSAFLGPTLWDKTLPYDGDTFQLEYMDLEEFLSENGIPPSPSQHDHSPHPPGLQPASSAAPSVMDLSSRASAPLHPGIPSPNCMQSPIRPGQLLPANRNTPSPIDPDTIQVPVGYEPDPADLALSSIPGQEMFDPRKRKFSEEELKPQPMIKKARKVFIPDDLKDDKYWARRRKNNMAAKRSRDARRLKENQIAIRASFLEKENSALRQEVADLRKELGKCKNILAKYEARHGPL

SEQ ID NO: 37795 - protein, 210 aa, Homo sapiens
  Payload ID: 7514
  Gene Symbol: HLF
  Gene Name: hepatic leukemia factor
  Uniprot ID: Q16534
  ENSP ID: ENSP00000402496
MDLEEFLSENGIPPSPSQHDHSPHPPGLQPASSAAPSVMDLSSRASAPLHPGIPSPNCMQSPIRPGQLLPANRNTPSPIDPDTIQVPVGYEPDPADLALSSIPGQEMFDPRKRKFSEEELKPQPMIKKARKVFIPDDLKDDKYWARRRKNNMAAKRSRDARRLKENQIAIRASFLEKENSALRQEVADLRKELGKCKNILAKYEARHGPL

SEQ ID NO: 37796 - protein, 77 aa, Homo sapiens
  Payload ID: 7514
  Gene Symbol: HLF
  Gene Name: hepatic leukemia factor
  ENSP ID: ENSP00000460265
MDLEEFLSENGIPPSPSQHDHSPHPPGLQPASSAAPSVMDLSSRASAPLHPGIPSPNCMQSPIRPAVASKPQYTKSH

SEQ ID NO: 37797 - protein, 210 aa, Homo sapiens; identical to SEQ ID NO: 37795
  Payload ID: 7514
  Gene Symbol: HLF
  Gene Name: hepatic leukemia factor
  Uniprot ID: Q16534
  ENSP ID: ENSP00000460296

SEQ ID NO: 37798 - protein, 210 aa, Homo sapiens; identical to SEQ ID NO: 37795
  Payload ID: 7514
  Gene Symbol: HLF
  Gene Name: hepatic leukemia factor
  Uniprot ID: Q16534
  ENSP ID: ENSP00000460572

SEQ ID NO: 37799 - protein, 236 aa, Homo sapiens
  Payload ID: 7514
  Gene Symbol: HLF
  Gene Name: hepatic leukemia factor
  ENSP ID: ENSP00000461455
QSAFLGPTLWDKTLPYDGDTFQLEYMDLEEFLSENGIPPSPSQHDHSPHPPGLQPASSAAPSVMDLSSRASAPLHPGIPSPNCMQSPIRPGQLLPANRNTPSPIDPDTIQVPVGYEPDPADLALSSIPGQEMFDPRKRKFSEEELKPQPMIKKARKVFIPDDLKQDDKYWARRRKNNMAAKRSRDARRLKENQIAIRASFLEKENSALRQEVADLRKELGKCKNILAKYEARHGPL

SEQ ID NO: 37800 - protein, 364 aa, Homo sapiens
  Payload ID: 7515
  Gene Symbol: HAVCR1
  Gene Name: hepatitis A virus cellular receptor 1
  Uniprot ID: Q96D42
  ENSP ID: ENSP00000344844
MHPQVVILSLILHLADSVAGSVKVGGEAGPSVTLPCHYSGAVTSMCWNRGSCSLFTCQNGIVWTNGTHVTYRKDTRYKLLGDLSRRDVSLTIENTAVSDSGVYCCRVEHRGWFNDMKITVSLEIVPPKVTTTPIVTTVPTVTTVRTSTTVPTTTTVPMTTVPTTTVPTTMSIPTTTTVLTTMTVSTTTSVPTTTSIPTTTSVPVTTTVSTFVPPMPLPRQNHEPVATSPSSPQPAETHPTTLQGAIRREPTSSPLYSYTTDGNDTVTESSDGLWNNNQTQLFLEHSLLTANTTKGIYAGVCISVLVLLALLGVIIAKKYFFKKEVQQLSVSFSSLQIKALQNAVEKEVQAEDNIYIENSLYATD

SEQ ID NO: 37801 - protein, 364 aa, Homo sapiens; identical to SEQ ID NO: 37800
  Payload ID: 7515
  Gene Symbol: HAVCR1
  Gene Name: hepatitis A virus cellular receptor 1
  Uniprot ID: Q96D42
  ENSP ID: ENSP00000427898

SEQ ID NO: 37802 - protein, 223 aa, Homo sapiens
  Payload ID: 7515
  Gene Symbol: HAVCR1
  Gene Name: hepatitis A virus cellular receptor 1
  ENSP ID: ENSP00000428422
MHPQVVILSLILHLADSVAGSVKVGGEAGPSVTLPCHYSGAVTSMCWNRGSCSLFTCQNGIVWTNGTHVTYRKDTRYKLLGDLSRRDVSLTIENTAVSDSGVYCCRVEHRGWFNDMKITVSLEIVPPKVTTTPIVTTVPTVTTVRTSTTVPTTTTVPMTTVPTTTVPTTMSIPTTTTVLTTMTVSTTTSVPTTTSIPTTTSVPVTTTVSTFVPPMPLPRQNHE

SEQ ID NO: 37803 - protein, 401 aa, Homo sapiens
  Payload ID: 7515
  Gene Symbol: HAVCR1
  Gene Name: hepatitis A virus cellular receptor 1
  ENSP ID: ENSP00000428524
MHPQVVILSLILHLADSVAGSVKVGGEAGPSVTLPCHYSGAVTSMCWNRGSCSLFTCQNGIVWTNGTHVTYRKDTRYKLLGDLSRRDVSLTIENTAVSDSGVYCCRVEHRGWFNDMKITVSLEIVPPKVTTTPIVTTVPTVTTVRTSTTVPTTTTVPMTTVPTTTVPTTMSIPTTTTVLTTMTVSTTTSVPTTTSIPTTTSVPVTTTVSTFVPPMPLPRQNHEPVATSPSSPQPAETHPTTLQGAIRREPTSSPLYSYTTDGNDTVTESSDGLWNNNQTQLFLEHSLLTANTTKGIYAGVCISVLVLLALLGVIIAKMFHLAAFKLKLCKMQLKRKSKQKTISTLRIVFMPRTKTQWCSLRVYAHECRRLNRHQHIRRLLDPKTIFLFQFHLAFQHVSDTG

SEQ ID NO: 37804 - protein, 401 aa, Homo sapiens; identical to SEQ ID NO: 37803
  Payload ID: 7515
  Gene Symbol: HAVCR1
  Gene Name: hepatitis A virus cellular receptor 1
  ENSP ID: ENSP00000487363

SEQ ID NO: 37805 - protein, 301 aa, Homo sapiens
  Payload ID: 7516
  Gene Symbol: HAVCR2
  Gene Name: hepatitis A virus cellular receptor 2
  Uniprot ID: Q8TDQ0
  ENSP ID: ENSP00000312002
MFSHLPFDCVLLLLLLLLTRSSEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIGIYIGAGICAGLALALIFGALIFKWYSHSKEKIQNLSLISLANLPPSGLANAVAEGIRSEENIYTIEENVYEVEEPNEYYCYVSSRQQPSQPLGCRFAMP

SEQ ID NO: 37806 - protein, 74 aa, Homo sapiens
  Payload ID: 7516
  Gene Symbol: HAVCR2
  Gene Name: hepatitis A virus cellular receptor 2
  ENSP ID: ENSP00000430328
MNDEKFNLKLVIKPAKVTPAPTRQRDFTAAFPRMLTTRGHGPAETQTLGSLPDINLTQISTLANELRDSRLAND

SEQ ID NO: 37807 - protein, 273 aa, Homo sapiens
  Payload ID: 7516
  Gene Symbol: HAVCR2
  Gene Name: hepatitis A virus cellular receptor 2
  ENSP ID: ENSP00000430873
MFSHLPFDCVLLLLLLLLTRSSEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAETQTLGSLPDINLTQISTLANELRDSRLANDLRDSGATIRIGIYIGAGICAGLALALIFGALIFKWYSHSKEKIQNLSLISLANLPPSGLANAVAEGIRSEENIYTIEENVYEVEEPNEYYCYVSSRQQPSQPLGCRFAMP

SEQ ID NO: 37808 - protein, 88 aa, Homo sapiens
  Payload ID: 7517
  Gene Symbol: HEPN1
  Gene Name: hepatocellular carcinoma, down-regulated 1
  Uniprot ID: Q6WQI6
  ENSP ID: ENSP00000386143
MGNWGLGIAPWVDGESELEFRRLGMQGPLEALRRREWNTQRASFSFSFLIALSPHTVDYCHSYELFNRRWHGHVLATQRPSLFILMLV

SEQ ID NO: 37809 - protein, 728 aa, Homo sapiens
  Payload ID: 7518
  Gene Symbol: HGF
  Gene Name: hepatocyte growth factor (hepapoietin A
  scatter factor)
  Uniprot ID: P14210
  ENSP ID: ENSP00000222390
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCADNTMNDTDVPLETTECIQGQGEGYRGTVNTIWNGIPCQRWDSQYPHEHDMTPENFKCKDLRENYCRNPDGSESPWCFTTDPNIRVGYCSQIPNCDMSHGQDCYRGNGKNYMGNLSQTRSGLTCSMWDKNMEDLHRHIFWEPDASKLNENYCRNPDDDAHGPWCYTGNPLIPWDYCPISRCEGDTTPTIVNLDHPVISCAKTKQLRVVNGIPTRTNIGWMVSLRYRNKHICGGSLIKESWVLTARQCFPSRDLKDYEAWLGIHDVHGRGDEKCKQVLNVSQLVYGPEGSDLVLMKLARPAVLDDFVSTIDLPNYGCTIPEKTSCSVYGWGYTGLINYDGLLRVAHLYIMGNEKCSQHHRGKVTLNESEICAGAEKIGSGPCEGDYGGPLVCEQHKMRMVLGVIVPGRGCAIPNRPGIFVRVAYYAKWIHKIILTYKVPQS

SEQ ID NO: 37810 - protein, 184 aa, Homo sapiens
  Payload ID: 7518
  Gene Symbol: HGF
  Gene Name: hepatocyte growth factor (hepapoietin A
  scatter factor)
  ENSP ID: ENSP00000346164
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSGGDDCLVESTFYSIPFWGHNSAR

SEQ ID NO: 37811 - protein, 118 aa, Homo sapiens
  Payload ID: 7518
  Gene Symbol: HGF
  Gene Name: hepatocyte growth factor (hepapoietin A
  scatter factor)
  ENSP ID: ENSP00000388592
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDL

SEQ ID NO: 37812 - protein, 290 aa, Homo sapiens
  Payload ID: 7518
  Gene Symbol: HGF
  Gene Name: hepatocyte growth factor (hepapoietin A
  scatter factor)
  Uniprot ID: P14210
  ENSP ID: ENSP00000389854
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCET

SEQ ID NO: 37813 - protein, 723 aa, Homo sapiens
  Payload ID: 7518
  Gene Symbol: HGF
  Gene Name: hepatocyte growth factor (hepapoietin A
  scatter factor)
  Uniprot ID: P14210
  ENSP ID: ENSP00000391238
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCADNTMNDTDVPLETTECIQGQGEGYRGTVNTIWNGIPCQRWDSQYPHEHDMTPENFKCKDLRENYCRNPDGSESPWCFTTDPNIRVGYCSQIPNCDMSHGQDCYRGNGKNYMGNLSQTRSGLTCSMWDKNMEDLHRHIFWEPDASKLNENYCRNPDDDAHGPWCYTGNPLIPWDYCPISRCEGDTTPTIVNLDHPVISCAKTKQLRVVNGIPTRTNIGWMVSLRYRNKHICGGSLIKESWVLTARQCFPSRDLKDYEAWLGIHDVHGRGDEKCKQVLNVSQLVYGPEGSDLVLMKLARPAVLDDFVSTIDLPNYGCTIPEKTSCSVYGWGYTGLINYDGLLRVAHLYIMGNEKCSQHHRGKVTLNESEICAGAEKIGSGPCEGDYGGPLVCEQHKMRMVLGVIVPGRGCAIPNRPGIFVRVAYYAKWIHKIILTYKVPQS

SEQ ID NO: 37814 - protein, 58 aa, Homo sapiens
  Payload ID: 7518
  Gene Symbol: HGF
  Gene Name: hepatocyte growth factor (hepapoietin A
  scatter factor)
  ENSP ID: ENSP00000395468
MSSGVKKEFGHEFDLYENKDYIRNCIIGKGRSYKGTVSITKSGIKCQPWSSMIPHEHR

SEQ ID NO: 37815 - protein, 141 aa, Homo sapiens
  Payload ID: 7518
  Gene Symbol: HGF
  Gene Name: hepatocyte growth factor (hepapoietin A
  scatter factor)
  ENSP ID: ENSP00000396307
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVS

SEQ ID NO: 37816 - protein, 285 aa, Homo sapiens
  Payload ID: 7518
  Gene Symbol: HGF
  Gene Name: hepatocyte growth factor (hepapoietin A
  scatter factor)
  Uniprot ID: P14210
  ENSP ID: ENSP00000408270
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCET

SEQ ID NO: 37817 - protein, 210 aa, Homo sapiens
  Payload ID: 7518
  Gene Symbol: HGF
  Gene Name: hepatocyte growth factor (hepapoietin A
  scatter factor)
  Uniprot ID: P14210
  ENSP ID: ENSP00000413829
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCSEGK

SEQ ID NO: 37818 - protein, 777 aa, Homo sapiens
  Payload ID: 7519
  Gene Symbol: HGS
  Gene Name: hepatocyte growth factor-regulated tyrosine kinase substrate
  Uniprot ID: O14964
  ENSP ID: ENSP00000331201
MGRGSGTFERLLDKATSQLLLETDWESILQICDLIRQGDTQAKYAVNSIKKKVNDKNPHVALYALEVMESVVKNCGQTVHDEVANKQTMEELKDLLKRQVEVNVRNKILYLIQAWAHAFRNEPKYKVVQDTYQIMKVEGHVFPEFKESDAMFAAERAPDWVDAEECHRCRVQFGVMTRKHHCRACGQIFCGKCSSKYSTIPKFGIEKEVRVCEPCYEQLNRKAEGKATSTTELPPEYLTSPLSQQSQLPPKRDETALQEEEELQLALALSQSEAEEKERLRQKSTYTSYPKAEPMPSASSAPPASSLYSSPVNSSAPLAEDIDPELARYLNRNYWEKKQEEARKSPTPSAPVPLTEPAAQPGEGHAAPTNVVENPLPETDSQPIPPSGGPFSEPQFHNGESEESHEQFLKALQNAVTTFVNRMKSNHMRGRSITNDSAVLSLFQSINGMHPQLLELLNQLDERRLYYEGLQDKLAQIRDARGALSALREEHREKLRRAAEEAERQRQIQLAQKLEIMRQKKQEYLEVQRQLAIQRLQEQEKERQMRLEQQKQTVQMRAQMPAFPLPYAQLQAMPAAGGVLYQPSGPASFPSTFSPAGSVEGSPMHGVYMSQPAPAAGPYPSMPSTAADPSMVSAYMYPAGATGAQAAPQAQAGPTASPAYSSYQPTPTAGYQNVASQAPQSLPAISQPPQSSTMGYMGSQSVSMGYQPYNMQNLMTTLPSQDASLPPQQPYIAGQQPMYQQMAPSGGPPQQQPPVAQQPQAQGPPAQGSEAQLISFD

SEQ ID NO: 37819 - protein, 71 aa, Homo sapiens
  Payload ID: 7519
  Gene Symbol: HGS
  Gene Name: hepatocyte growth factor-regulated tyrosine kinase substrate
  ENSP ID: ENSP00000458603
MESVVKNCGQTVHDEVANKQTMEELKDLLKRQVEVNVRNKILYLIQAWAHAFRNEPKYKVVQDTYQIMKVE

SEQ ID NO: 37820 - protein, 292 aa, Homo sapiens
  Payload ID: 7519
  Gene Symbol: HGS
  Gene Name: hepatocyte growth factor-regulated tyrosine kinase substrate
  ENSP ID: ENSP00000458775
RQKSTYTSYPKAEPMPSASSAPPASSLYSSPVNSSAPLAEDIDPELARYLNRNYWEKKQEEARKSPTPSAPVPLTEPAAQPGEGHAAPTNVVENPLPETDSQPIPPSGGPFSESINGMHPQLLELLNQLDERRLYYEGLQDKLAQIRDARGALSALREEHREKLRRAAEEAERQRQIQLAQKLEIMRQKKQEYLEVQRQLAIQRLQEQEKERQMRLEQQKQTVQMRAQMPAFPLPYAQLQAMPAAGGVLYQPSGPASFPSTFSPAGSVEGSPMHGVYMSQPAPAAGPYPSMP

SEQ ID NO: 37821 - protein, 63 aa, Homo sapiens
  Payload ID: 7519
  Gene Symbol: HGS
  Gene Name: hepatocyte growth factor-regulated tyrosine kinase substrate
  ENSP ID: ENSP00000458789
  MOD_RES (1)..(1): Any amino acid
XYQPYNMQNLMTTLPSQDASLPPQQPYIAGQQPMYQQQPPVAQQPQAQGPPAQGSEAQLISFD

SEQ ID NO: 37822 - protein, 263 aa, Homo sapiens
  Payload ID: 7519
  Gene Symbol: HGS
  Gene Name: hepatocyte growth factor-regulated tyrosine kinase substrate
  ENSP ID: ENSP00000458987
MGRGSGTFERLLDKATSQLLLETDWESILQICDLIRQGDTQAKYAVNSIKKKVNDKNPHVALYALEVMESVVKNCGQTVHDEVANKQTMEELKDLLKAWAHAFRNEPKYKVVQDTYQIMKVEGHVFPEFKESDAMFAAERAPDWVDAEECHRCRVQFGVMTRKHHCRACGQIFCGKCSSKYSTIPKFGIEKEVRVCEPCYEQLNRKAEGKATSTTELPPEYLTSPLSQQSQLPPKRDETALQEEEELQLALALSQSEAEEKER

SEQ ID NO: 37823 - protein, 59 aa, Homo sapiens
  Payload ID: 7519
  Gene Symbol: HGS
  Gene Name: hepatocyte growth factor-regulated tyrosine kinase substrate
  ENSP ID: ENSP00000459685
MESVVKNCGQTVHDEVANKQTMEELKDLLKRQVEVNVRNKILYLIQAWAHAFRNEPKYK

SEQ ID NO: 37824 - protein, 110 aa, Homo sapiens
  Payload ID: 7519
  Gene Symbol: HGS
  Gene Name: hepatocyte growth factor-regulated tyrosine kinase substrate
  ENSP ID: ENSP00000460130
PTAGYQNVASQAPQSLPAISQPPQSSTMGYMGSQSVSMGYQPYNMQNLMTTLPSQDASLPPQQPYIAGQQPMYQQGETHTRGPFSADRTRTQVSGQIRASASVDRKNREF

SEQ ID NO: 37825 - protein, 38 aa, Homo sapiens
  Payload ID: 7519
  Gene Symbol: HGS
  Gene Name: hepatocyte growth factor-regulated tyrosine kinase substrate
  ENSP ID: ENSP00000460165
  MOD_RES (1)..(1): Any amino acid
XQMAPSGGPPQQQPPVAQQPQAQGPPAQGSEAQLISFD

SEQ ID NO: 37826 - protein, 474 aa, Homo sapiens
  Payload ID: 7520
  Gene Symbol: HNF4A
  Gene Name: hepatocyte nuclear factor 4, alpha
  Uniprot ID: P41235
  ENSP ID: ENSP00000312987
MRLSKTLVDMDMADYSAALDPAYTTLEFENVQVLTMGNDTSPSEGTNLNAPNSLGVSALCAICGDRATGKHYGASSCDGCKGFFRRSVRKNHMYSCRFSRQCVVDKDKRNQCRYCRLKKCFRAGMKKEAVQNERDRISTRRSSYEDSSLPSINALLQAEVLSRQITSPVSGINGDIRAKKIASIADVCESMKEQLLVLVEWAKYIPAFCELPLDDQVALLRAHAGEHLLLGATKRSMVFKDVLLLGNDYIVPRHCPELAEMSRVSIRILDELVLPFQELQIDDNEYAYLKAIIFFDPDAKGLSDPGKIKRLRSQVQVSLEDYINDRQYDSRGRFGELLLLLPTLQSITWQMIEQIQFIKLFGMAKIDNLLQEMLLGGSPSDAPHAHHPLHPHLMQEHMGTNVIVANTMPTHLSNGQMCEWPRPRGQAATPETPQPSPPGGSGSEPYKLLPGAVATIVKPLSAIPQPTITKQEVI

SEQ ID NO: 37827 - protein, 452 aa, Homo sapiens
  Payload ID: 7520
  Gene Symbol: HNF4A
  Gene Name: hepatocyte nuclear factor 4, alpha
  Uniprot ID: P41235
  ENSP ID: ENSP00000315180
MVSVNAPLGAPVESSYDTSPSEGTNLNAPNSLGVSALCAICGDRATGKHYGASSCDGCKGFFRRSVRKNHMYSCRFSRQCVVDKDKRNQCRYCRLKKCFRAGMKKEAVQNERDRISTRRSSYEDSSLPSINALLQAEVLSRQITSPVSGINGDIRAKKIASIADVCESMKEQLLVLVEWAKYIPAFCELPLDDQVALLRAHAGEHLLLGATKRSMVFKDVLLLGNDYIVPRHCPELAEMSRVSIRILDELVLPFQELQIDDNEYAYLKAIIFFDPDAKGLSDPGKIKRLRSQVQVSLEDYINDRQYDSRGRFGELLLLLPTLQSITWQMIEQIQFIKLFGMAKIDNLLQEMLLGGSPSDAPHAHHPLHPHLMQEHMGTNVIVANTMPTHLSNGQMCEWPRPRGQAATPETPQPSPPGGSGSEPYKLLPGAVATIVKPLSAIPQPTITKQEVI

SEQ ID NO: 37828 - protein, 107 aa, Homo sapiens
  Payload ID: 7520
  Gene Symbol: HNF4A
  Gene Name: hepatocyte nuclear factor 4, alpha
  ENSP ID: ENSP00000362011
MRLSKTLVDMDMADYSAALDPAYTTLEFENVQVLTMGNDFVAAASRQIEASPPTSLEHIWRGGQFSTGRHVPIRRHQPQRAQQPGCQRPVCHLRGPGHGQTLRCLEL

SEQ ID NO: 37829 - protein, 442 aa, Homo sapiens
  Payload ID: 7520
  Gene Symbol: HNF4A
  Gene Name: hepatocyte nuclear factor 4, alpha
  Uniprot ID: P41235
  ENSP ID: ENSP00000396216
MVSVNAPLGAPVESSYDTSPSEGTNLNAPNSLGVSALCAICGDRATGKHYGASSCDGCKGFFRRSVRKNHMYSCRFSRQCVVDKDKRNQCRYCRLKKCFRAGMKKEAVQNERDRISTRRSSYEDSSLPSINALLQAEVLSRQITSPVSGINGDIRAKKIASIADVCESMKEQLLVLVEWAKYIPAFCELPLDDQVALLRAHAGEHLLLGATKRSMVFKDVLLLGNDYIVPRHCPELAEMSRVSIRILDELVLPFQELQIDDNEYAYLKAIIFFDPDAKGLSDPGKIKRLRSQVQVSLEDYINDRQYDSRGRFGELLLLLPTLQSITWQMIEQIQFIKLFGMAKIDNLLQEMLLGGSPSDAPHAHHPLHPHLMQEHMGTNVIVANTMPTHLSNGQMSTPETPQPSPPGGSGSEPYKLLPGAVATIVKPLSAIPQPTITKQEVI

SEQ ID NO: 37830 - protein, 417 aa, Homo sapiens
  Payload ID: 7520
  Gene Symbol: HNF4A
  Gene Name: hepatocyte nuclear factor 4, alpha
  Uniprot ID: P41235
  ENSP ID: ENSP00000410911
MRLSKTLVDMDMADYSAALDPAYTTLEFENVQVLTMGNDTSPSEGTNLNAPNSLGVSALCAICGDRATGKHYGASSCDGCKGFFRRSVRKNHMYSCRFSRQCVVDKDKRNQCRYCRLKKCFRAGMKKEAVQNERDRISTRRSSYEDSSLPSINALLQAEVLSRQITSPVSGINGDIRAKKIASIADVCESMKEQLLVLVEWAKYIPAFCELPLDDQVALLRAHAGEHLLLGATKRSMVFKDVLLLGNDYIVPRHCPELAEMSRVSIRILDELVLPFQELQIDDNEYAYLKAIIFFDPDAKGLSDPGKIKRLRSQVQVSLEDYINDRQYDSRGRFGELLLLLPTLQSITWQMIEQIQFIKLFGMAKIDNLLQEMLLGGPCQAQEGRGWSGDSPGDRPHTVSSPLSSLASPLCRFGQVA

SEQ ID NO: 37831 - protein, 464 aa, Homo sapiens
  Payload ID: 7520
  Gene Symbol: HNF4A
  Gene Name: hepatocyte nuclear factor 4, alpha
  Uniprot ID: P41235
  ENSP ID: ENSP00000412111
MRLSKTLVDMDMADYSAALDPAYTTLEFENVQVLTMGNDTSPSEGTNLNAPNSLGVSALCAICGDRATGKHYGASSCDGCKGFFRRSVRKNHMYSCRFSRQCVVDKDKRNQCRYCRLKKCFRAGMKKEAVQNERDRISTRRSSYEDSSLPSINALLQAEVLSRQITSPVSGINGDIRAKKIASIADVCESMKEQLLVLVEWAKYIPAFCELPLDDQVALLRAHAGEHLLLGATKRSMVFKDVLLLGNDYIVPRHCPELAEMSRVSIRILDELVLPFQELQIDDNEYAYLKAIIFFDPDAKGLSDPGKIKRLRSQVQVSLEDYINDRQYDSRGRFGELLLLLPTLQSITWQMIEQIQFIKLFGMAKIDNLLQEMLLGGSPSDAPHAHHPLHPHLMQEHMGTNVIVANTMPTHLSNGQMSTPETPQPSPPGGSGSEPYKLLPGAVATIVKPLSAIPQPTITKQEVI

SEQ ID NO: 37832 - protein, 103 aa, Homo sapiens
  Payload ID: 7520
  Gene Symbol: HNF4A
  Gene Name: hepatocyte nuclear factor 4, alpha
  ENSP ID: ENSP00000476310
MSDWGQGFPQDPPDTSPSEGTNLNAPNSLGVSALCAICGDRATGKHYGASSCDGCKGFFRRSVRKNHMYSCRFSRQCVVDKDKRNQCRYCRLKKCFRAGMKKE

SEQ ID NO: 37833 - protein, 395 aa, Homo sapiens
  Payload ID: 7520
  Gene Symbol: HNF4A
  Gene Name: hepatocyte nuclear factor 4, alpha
  Uniprot ID: P41235
  ENSP ID: ENSP00000476609
MVSVNAPLGAPVESSYDTSPSEGTNLNAPNSLGVSALCAICGDRATGKHYGASSCDGCKGFFRRSVRKNHMYSCRFSRQCVVDKDKRNQCRYCRLKKCFRAGMKKEAVQNERDRISTRRSSYEDSSLPSINALLQAEVLSRQITSPVSGINGDIRAKKIASIADVCESMKEQLLVLVEWAKYIPAFCELPLDDQVALLRAHAGEHLLLGATKRSMVFKDVLLLGNDYIVPRHCPELAEMSRVSIRILDELVLPFQELQIDDNEYAYLKAIIFFDPDAKGLSDPGKIKRLRSQVQVSLEDYINDRQYDSRGRFGELLLLLPTLQSITWQMIEQIQFIKLFGMAKIDNLLQEMLLGGPCQAQEGRGWSGDSPGDRPHTVSSPLSSLASPLCRFGQVA

SEQ ID NO: 37834 - protein, 449 aa, Homo sapiens
  Payload ID: 7520
  Gene Symbol: HNF4A
  Gene Name: hepatocyte nuclear factor 4, alpha
  ENSP ID: ENSP00000481331
MSDWGQGFPQDPPDTSPSEGTNLNAPNSLGVSALCAICGDRATGKHYGASSCDGCKGFFRRSVRKNHMYSCRFSRQCVVDKDKRNQCRYCRLKKCFRAGMKKEAVQNERDRISTRRSSYEDSSLPSINALLQAEVLSRQITSPVSGINGDIRAKKIASIADVCESMKEQLLVLVEWAKYIPAFCELPLDDQVALLRAHAGEHLLLGATKRSMVFKDVLLLGNDYIVPRHCPELAEMSRVSIRILDELVLPFQELQIDDNEYAYLKAIIFFDPDAKGLSDPGKIKRLRSQVQVSLEDYINDRQYDSRGRFGELLLLLPTLQSITWQMIEQIQFIKLFGMAKIDNLLQEMLLGGSPSDAPHAHHPLHPHLMQEHMGTNVIVANTMPTHLSNGQMCEWPRPRGQAATPETPQPSPPGGSGSEPYKLLPGAVATIVKPLSAIPQPTITKQEVI

SEQ ID NO: 37835 - protein, 408 aa, Homo sapiens
  Payload ID: 7521
  Gene Symbol: HNF4G
  Gene Name: hepatocyte nuclear factor 4, gamma
  Uniprot ID: Q14541
  ENSP ID: ENSP00000346339
MNTTDNGVNCLCAICGDRATGKHYGASSCDGCKGFFRRSIRKSHVYSCRFSRQCVVDKDKRNQCRYCRLRKCFRAGMKKEAVQNERDRISTRRSTFDGSNIPSINTLAQAEVRSRQISVSSPGSSTDINVKKIASIGDVCESMKQQLLVLVEWAKYIPAFCELPLDDQVALLRAHAGEHLLLGATKRSMMYKDILLLGNNYVIHRNSCEVEISRVANRVLDELVRPFQEIQIDDNEYACLKAIVFFDPDAKGLSDPVKIKNMRFQVQIGLEDYINDRQYDSRGRFGELLLLLPTLQSITWQMIEQIQFVKLFGMVKIDNLLQEMLLGGASNDGSHLHHPMHPHLSQDPLTGQTILLGPMSTLVHADQISTPETPLPSPPQGSGQEQYKIAANQASVISHQHLSKQKQL

SEQ ID NO: 37836 - protein, 445 aa, Homo sapiens
  Payload ID: 7521
  Gene Symbol: HNF4G
  Gene Name: hepatocyte nuclear factor 4, gamma
  Uniprot ID: Q14541
  ENSP ID: ENSP00000379701
MDMANYSEVLDPTYTTLEFETMQILYNSSDSSAPETSMNTTDNGVNCLCAICGDRATGKHYGASSCDGCKGFFRRSIRKSHVYSCRFSRQCVVDKDKRNQCRYCRLRKCFRAGMKKEAVQNERDRISTRRSTFDGSNIPSINTLAQAEVRSRQISVSSPGSSTDINVKKIASIGDVCESMKQQLLVLVEWAKYIPAFCELPLDDQVALLRAHAGEHLLLGATKRSMMYKDILLLGNNYVIHRNSCEVEISRVANRVLDELVRPFQEIQIDDNEYACLKAIVFFDPDAKGLSDPVKIKNMRFQVQIGLEDYINDRQYDSRGRFGELLLLLPTLQSITWQMIEQIQFVKLFGMVKIDNLLQEMLLGGASNDGSHLHHPMHPHLSQDPLTGQTILLGPMSTLVHADQISTPETPLPSPPQGSGQEQYKIAANQASVISHQHLSKQKQL

SEQ ID NO: 37837 - protein, 251 aa, Homo sapiens
  Payload ID: 7522
  Gene Symbol: HDGFL1
  Gene Name: hepatoma derived growth factor-like 1
  Uniprot ID: Q5TGJ6
  ENSP ID: ENSP00000442129
MSAYGMPMYKSGDLVFAKLKGYAHWPARIEHMTQPNRYQVFFFGTHETAFLSPKRLFPYKECKEKFGKPNKRRGFSAGLWEIENNPTVQASDCPLASEKGSGDGPWPEPEAAEGDEDKPTHAGGGGDELGKPDDDKPTEEEKGPLKRSAGDPPEDAPKRPKEAAPDQEEEAEAERAAEAERAAAAAAATAVDEESPFLVAVENGSAPSEPGLVCEPPQPEEEELREEEVADEEASQEWHAEAPGGGDRDSL

SEQ ID NO: 37838 - protein, 240 aa, Homo sapiens
  Payload ID: 7523
  Gene Symbol: HDGF
  Gene Name: hepatoma-derived growth factor
  Uniprot ID: P51858
  ENSP ID: ENSP00000349878
MSRSNRQKEYKCGDLVFAKMKGYPHWPARIDEMPEAAVKSTANKYQVFFFGTHETAFLGPKDLFPYEESKEKFGKPNKRKGFSEGLWEIENNPTVKASGYQSSQKKSCVEEPEPEPEAAEGDGDKKGNAEGSSDEEGKLVIDEPAKEKNEKGALKRRAGDLLEDSPKRPKEAENPEGEEKEAATLEVERPLPMEVEKNSTPSEPGSGRGPPQEEEEEEDEEEEATKEDAEAPGIRDHESL

SEQ ID NO: 37839 - protein, 256 aa, Homo sapiens
  Payload ID: 7523
  Gene Symbol: HDGF
  Gene Name: hepatoma-derived growth factor
  Uniprot ID: P51858
  ENSP ID: ENSP00000357189
MHPEGGQFVPQLLGHLLATKLKRFLLSKGGRRAQIPDVSRATPHTIDEMPEAAVKSTANKYQVFFFGTHETAFLGPKDLFPYEESKEKFGKPNKRKGFSEGLWEIENNPTVKASGYQSSQKKSCVEEPEPEPEAAEGDGDKKGNAEGSSDEEGKLVIDEPAKEKNEKGALKRRAGDLLEDSPKRPKEAENPEGEEKEAATLEVERPLPMEVEKNSTPSEPGSGRGPPQEEEEEEDEEEEATKEDAEAPGIRDHESL

SEQ ID NO: 37840 - protein, 233 aa, Homo sapiens
  Payload ID: 7523
  Gene Symbol: HDGF
  Gene Name: hepatoma-derived growth factor
  Uniprot ID: P51858
  ENSP ID: ENSP00000357192
MEQRAGGNRVQTSTLNCAGAAVIDEMPEAAVKSTANKYQVFFFGTHETAFLGPKDLFPYEESKEKFGKPNKRKGFSEGLWEIENNPTVKASGYQSSQKKSCVEEPEPEPEAAEGDGDKKGNAEGSSDEEGKLVIDEPAKEKNEKGALKRRAGDLLEDSPKRPKEAENPEGEEKEAATLEVERPLPMEVEKNSTPSEPGSGRGPPQEEEEEEDEEEEATKEDAEAPGIRDHESL

SEQ ID NO: 37841 - protein, 240 aa, Homo sapiens; identical to SEQ ID NO: 37838
  Payload ID: 7523
  Gene Symbol: HDGF
  Gene Name: hepatoma-derived growth factor
  Uniprot ID: P51858
  ENSP ID: ENSP00000443120

SEQ ID NO: 37842 - protein, 121 aa, Homo sapiens
  Payload ID: 7524
  Gene Symbol:
  Gene Name: Hepatoma-derived growth factor-related protein 2 [Source:UniProtKB/Swiss-Prot
  Acc:Q7Z4V5]
  ENSP ID: ENSP00000465267
MAVTAVTATAASDRMESDSDSDKSSDNSGLKRKTPALKMSVSKRARKASSDLDQASVSPSEEENSESSSESEKTSDQDFTPEKKAAVRAPRRGPLGGRKKKKAPSASDSDSKADSDGAKPE

SEQ ID NO: 37843 - protein, 153 aa, Homo sapiens
  Payload ID: 7524
  Gene Symbol:
  Gene Name: Hepatoma-derived growth factor-related protein 2 [Source:UniProtKB/Swiss-Prot
  Acc:Q7Z4V5]
  ENSP ID: ENSP00000467513
KVDSPDVKRCLNALEELGTLQVTSQILQKNTDVVATLKKIRRYKANKDVMEKAAEVYTRLKSRVLGPKIEAVQKVNKAGMEKEKAEEKLAGEELAGEEAPQEKAEDKPSTDLSAPVNGEATSQKGESAEDKEHEEGRDSEEGPRCGSSEDLHE

SEQ ID NO: 37844 - protein, 24 aa, Homo sapiens
  Payload ID: 7524
  Gene Symbol:
  Gene Name: Hepatoma-derived growth factor-related protein 2 [Source:UniProtKB/Swiss-Prot
  Acc:Q7Z4V5]
  ENSP ID: ENSP00000467617
MAVTAVTATAASDRMESDSDSDKS

SEQ ID NO: 37845 - protein, 175 aa, Homo sapiens
  Payload ID: 7524
  Gene Symbol:
  Gene Name: Hepatoma-derived growth factor-related protein 2 [Source:UniProtKB/Swiss-Prot
  Acc:Q7Z4V5]
  ENSP ID: ENSP00000468175
  MOD_RES (1)..(1): Any amino acid
XSTEPARKPGQKEKRVRPEEKQQAKPVKVERTRKRSEGFSMDRKVEKKKEPSVEEKLQKLHSEIKFALKVDSPDVKRCLNALEELGTLQVTSQILQKNTDVVATLKKIRRYKANKDVMEKAAEVYTRLKSRVLGPKIEAVQKVNKAQWSHSLTQQLPCAMPGWRQRGDPGDGCGL

SEQ ID NO: 37846 - protein, 97 aa, Homo sapiens
  Payload ID: 7524
  Gene Symbol:
  Gene Name: Hepatoma-derived growth factor-related protein 2 [Source:UniProtKB/Swiss-Prot
  Acc:Q7Z4V5]
  ENSP ID: ENSP00000471276
MPHAFKPGDLVFAKMKGYPHWPARIDDIADGAVKPPPNKYPIFFFGTHETAFLGPKDLFPYDKCKDKYGKPNKRKGFNEGLWEIQNNPHASYSAPPQ

SEQ ID NO: 37847 - protein, 473 aa, Homo sapiens
  Payload ID: 7524
  Gene Symbol:
  Gene Name: Hepatoma-derived growth factor-related protein 2 [Source:UniProtKB/Swiss-Prot
  Acc:Q7Z4V5]
  ENSP ID: ENSP00000477592
  MOD_RES (1)..(1): Any amino acid
XTAFLGPKDLFPYDKCKDKYGKPNKRKGFNEGLWEIQNNPHASYSAPPPVSSSDSEAPEANPADGSDADEDDEDRGVMAVTAVTATAASDRMESDSDSDKSSDNSGLKRKTPALKMSVSKRARKASSDLDQASVSPSEEENSESSSESEKTSDQDFTPEKKAAVRAPRRGPLGGRKKKKAPSASDSDSKADSDGAKPEPVAMARSASSSSSSSSSSDSDVSVKKPPRGRKPAEKPLPKPRGRKPKPERPPSSSSSDSDSDEVDRISEWKRRDEARRRELEARRRREQEEELRRLREQEKEEKERRRERADRGEAERGSGGSSGDELREDDEPVKKRGRKGRGRGPPSSSDSEPEAELEREAKKSAKKPQSSSTEPARKPGQKEKRVRPEEKQQAKLECNGVISAHCNLRLPGSSDSPASALPSSWDYRHPPPRLANFCCFSRHGVSSCWPGWSRSPDPVICPPQPPKVLGLQV

SEQ ID NO: 37848 - protein, 68 aa, Homo sapiens
  Payload ID: 7524
  Gene Symbol:
  Gene Name: Hepatoma-derived growth factor-related protein 2 [Source:UniProtKB/Swiss-Prot
  Acc:Q7Z4V5]
  ENSP ID: ENSP00000480754
EEKLAGEELAGEEAPQEKAEDKPSTDLSAPVNGEATSQKGESAEDKEHEEGRDSEEGPRCGSSEDLHD

SEQ ID NO: 37849 - protein, 71 aa, Homo sapiens
  Payload ID: 7524
  Gene Symbol:
  Gene Name: Hepatoma-derived growth factor-related protein 2 [Source:UniProtKB/Swiss-Prot
  Acc:Q7Z4V5]
  ENSP ID: ENSP00000482480
AESEQGWDGEGEGRGEAGRGGAGRGGGPPGEGGGQAQHRSVREGPDLDRPGSDRQERERARGDSEALDEES

SEQ ID NO: 37850 - protein, 671 aa, Homo sapiens
  Payload ID: 7524
  Gene Symbol:
  Gene Name: Hepatoma-derived growth factor-related protein 2 [Source:UniProtKB/Swiss-Prot
  Acc:Q7Z4V5]
  Uniprot ID: Q7Z4V5
  ENSP ID: ENSP00000483345
MPHAFKPGDLVFAKMKGYPHWPARIDDIADGAVKPPPNKYPIFFFGTHETAFLGPKDLFPYDKCKDKYGKPNKRKGFNEGLWEIQNNPHASYSAPPPVSSSDSEAPEANPADGSDADEDDEDRGVMAVTAVTATAASDRMESDSDSDKSSDNSGLKRKTPALKMSVSKRARKASSDLDQASVSPSEEENSESSSESEKTSDQDFTPEKKAAVRAPRRGPLGGRKKKKAPSASDSDSKADSDGAKPEPVAMARSASSSSSSSSSSDSDVSVKKPPRGRKPAEKPLPKPRGRKPKPERPPSSSSSDSDSDEVDRISEWKRRDEARRRELEARRRREQEEELRRLREQEKEEKERRRERADRGEAERGSGGSSGDELREDDEPVKKRGRKGRGRGPPSSSDSEPEAELEREAKKSAKKPQSSSTEPARKPGQKEKRVRPEEKQQAKPVKVERTRKRSEGFSMDRKVEKKKEPSVEEKLQKLHSEIKFALKVDSPDVKRCLNALEELGTLQVTSQILQKNTDVVATLKKIRRYKANKDVMEKAAEVYTRLKSRVLGPKIEAVQKVNKAGMEKEKAEEKLAGEELAGEEAPQEKAEDKPSTDLSAPVNGEATSQKGESAEDKEHEEGRDSEEGPRCGSSEDLHDSVREGPDLDRPGSDRQERERARGDSEALDEES

SEQ ID NO: 37851 - protein, 670 aa, Homo sapiens
  Payload ID: 7524
  Gene Symbol:
  Gene Name: Hepatoma-derived growth factor-related protein 2 [Source:UniProtKB/Swiss-Prot
  Acc:Q7Z4V5]
  ENSP ID: ENSP00000483702
MPHAFKPGDLVFAKMKGYPHWPARIDDIADGAVKPPPNKYPIFFFGTHETAFLGPKDLFPYDKCKDKYGKPNKRKGFNEGLWEIQNNPHASYSAPPPVSSSDSEAPEANPADGSDADEDDEDRGVMAVTAVTATAASDRMESDSDSDKSSDNSGLKRKTPALKMSVSKRARKASSDLDQASVSPSEEENSESSSESEKTSDQDFTPEKKAAVRAPRRGPLGGRKKKKAPSASDSDSKADSDGAKPEPVAMARSASSSSSSSSSSDSDVSVKKPPRGRKPAEKPLPKPRGRKPKPERPPSSSSSDSDSDEVDRISEWKRRDEARRRELEARRRREQEEELRRLREQEKEEKERRRERADRGEAERGSGGSSGDELREDDEPVKKRGRKGRGRGPPSSSDSEPEAELEREAKKSAKKPQSSSTEPARKPGQKEKRVRPEEKQQAKPVKVERTRKRSEGFSMDRKVEKKKEPSVEEKLQKLHSEIKFALKVDSPDVKRCLNALEELGTLQVTSQILQKNTDVVATLKKIRRYKANKDVMEKAAEVYTRLKSRVLGPKIEAVQKVNKAGMEKEKAEEKLAGEELAGEEAPQEKAEDKPSTDLSAPVNGEATSQKGESAEDKEHEEGRDSEEGPRCGSSEDLHDVREGPDLDRPGSDRQERERARGDSEALDEES

SEQ ID NO: 37852 - protein, 203 aa, Homo sapiens
  Payload ID: 7525
  Gene Symbol:
  Gene Name: Hepatoma-derived growth factor-related protein 3 [Source:UniProtKB/Swiss-Prot
  Acc:Q9Y3E1]
  Uniprot ID: Q9Y3E1
  ENSP ID: ENSP00000299633
MARPRPREYKAGDLVFAKMKGYPHWPARIDELPEGAVKPPANKYPIFFFGTHETAFLGPKDLFPYKEYKDKFGKSNKRKGFNEGLWEIENNPGVKFTGYQAIQQQSSSETEGEGGNTADASSEEEGDRVEEDGKGKRKNEKAGSKRKKSYTSKKSSKQSRKSPGDEDDKDCKEEENKSSSEGGDAGNDTRNTTSDLQKTSEGT

SEQ ID NO: 37853 - protein, 141 aa, Homo sapiens
  Payload ID: 7525
  Gene Symbol:
  Gene Name: Hepatoma-derived growth factor-related protein 3 [Source:UniProtKB/Swiss-Prot
  Acc:Q9Y3E1]
  ENSP ID: ENSP00000455388
FGKSNKRKGFNEGLWEIENNPGVKFTGYQAIQQQSSSETEGEGGNTADASSEEEGDRVEEDGKGKRKNEKAGSKRKKSYTSKKSSKQSRKSPGDEDDKDCKEEENKSSSEGGDAGNDTRNTTSDLQKTSEGKMLWTIIEID

SEQ ID NO: 37854 - protein, 44 aa, Homo sapiens
  Payload ID: 7525
  Gene Symbol:
  Gene Name: Hepatoma-derived growth factor-related protein 3 [Source:UniProtKB/Swiss-Prot
  Acc:Q9Y3E1]
  ENSP ID: ENSP00000455425
MARPRPREYKAGDLVFAKMKGYPHWPARIGTFGRKSKLSSYLYP

SEQ ID NO: 37855 - protein, 44 aa, Homo sapiens; identical to SEQ ID NO: 37854
  Payload ID: 7525
  Gene Symbol:
  Gene Name: Hepatoma-derived growth factor-related protein 3 [Source:UniProtKB/Swiss-Prot
  Acc:Q9Y3E1]
  ENSP ID: ENSP00000456699

SEQ ID NO: 37856 - protein, 84 aa, Homo sapiens
  Payload ID: 7526
  Gene Symbol: HAMP
  Gene Name: hepcidin antimicrobial peptide
  Uniprot ID: P81172
  ENSP ID: ENSP00000222304
MALSSQIWAACLLLLLLLASLTSGSVFPQQTGQLAELQPQDRAGARASWMPMFQRRRRRDTHFPICIFCCGCCHRSKCGMCCKT

SEQ ID NO: 37857 - protein, 84 aa, Homo sapiens; identical to SEQ ID NO: 37856
  Payload ID: 7526
  Gene Symbol: HAMP
  Gene Name: hepcidin antimicrobial peptide
  Uniprot ID: P81172
  ENSP ID: ENSP00000471894

SEQ ID NO: 37858 - protein, 891 aa, Homo sapiens
  Payload ID: 7527
  Gene Symbol: HEPH
  Gene Name: hephaestin
  Uniprot ID: Q9BQS7
  ENSP ID: ENSP00000337418
MHAINGFVFGNLPELNMCAQKRVAWHLFGMGNEIDVHTAFFHGQMLTTRGHHTDVANIFPATFVTAEMVPWEPGTWLISCQVNSHFRDGMQALYKVKSCSMAPPVDLLTGKVRQYFIEAHEIQWDYGPMGHDGSTGKNLREPGSISDKFFQKSSSRIGGTYWKVRYEAFQDETFQEKMHLEEDRHLGILGPVIRAEVGDTIQVVFYNRASQPFSMQPHGVFYEKDYEGTVYNDGSSYPGLVAKPFEKVTYRWTVPPHAGPTAQDPACLTWMYFSAADPIRDTNSGLVGPLLVCRAGALGADGKQKGVDKEFFLLFTVLDENKSWYSNANQAAAMLDFRLLSEDIEGFQDSNRMHAINGFLFSNLPRLDMCKGDTVAWHLLGLGTETDVHGVMFQGNTVQLQGMRKGAAMLFPHTFVMAIMQPDNLGTFEIYCQAGSHREAGMRAIYNVSQCPGHQATPRQRYQAARIYYIMAEEVEWDYCPDRSWEREWHNQSEKDSYGYIFLSNKDGLLGSRYKKAVFREYTDGTFRIPRPRTGPEEHLGILGPLIKGEVGDILTVVFKNNASRPYSVHAHGVLESTTVWPLAAEPGEVVTYQWNIPERSGPGPNDSACVSWIYYSAVDPIKDMYSGLVGPLAICQKGILEPHGGRSDMDREFALLFLIFDENKSWYLEENVATHGSQDPGSINLQDETFLESNKMHAINGKLYANLRGLTMYQGERVAWYMLAMGQDVDLHTIHFHAESFLYRNGENYRADVVDLFPGTFEVVEMVASNPGTWLMHCHVTDHVHAGMETLFTVFSRTEHLSPLTVITKETEKAVPPRDIEEGNVKMLGMQIPIKNVEMLASVLVAISVTLLLVVLALGGVVWYQHRQRKLRRNRRSILDDSFKLLSFKQ

SEQ ID NO: 37859 - protein, 1158 aa, Homo sapiens
  Payload ID: 7527
  Gene Symbol: HEPH
  Gene Name: hephaestin
  Uniprot ID: Q9BQS7
  ENSP ID: ENSP00000343939
MESGHLLWALLFMQSLWPQLTDGATRVYYLGIRDVQWNYAPKGRNVITNQPLDSDIVASSFLKSDKNRIGGTYKKTIYKEYKDDSYTDEVAQPAWLGFLGPVLQAEVGDVILIHLKNFATRPYTIHPHGVFYEKDSEGSLYPDGSSGPLKADDSVPPGGSHIYNWTIPEGHAPTDADPACLTWIYHSHVDAPRDIATGLIGPLITCKRGALDGNSPPQRQDVDHDFFLLFSVVDENLSWHLNENIATYCSDPASVDKEDETFQESNRMHAINGFVFGNLPELNMCAQKRVAWHLFGMGNEIDVHTAFFHGQMLTTRGHHTDVANIFPATFVTAEMVPWEPGTWLISCQVNSHFRDGMQALYKVKSCSMAPPVDLLTGKVRQYFIEAHEIQWDYGPMGHDGSTGKNLREPGSISDKFFQKSSSRIGGTYWKVRYEAFQDETFQEKMHLEEDRHLGILGPVIRAEVGDTIQVVFYNRASQPFSMQPHGVFYEKDYEGTVYNDGSSYPGLVAKPFEKVTYRWTVPPHAGPTAQDPACLTWMYFSAADPIRDTNSGLVGPLLVCRAGALGADGKQKGVDKEFFLLFTVLDENKSWYSNANQAAAMLDFRLLSEDIEGFQDSNRMHAINGFLFSNLPRLDMCKGDTVAWHLLGLGTETDVHGVMFQGNTVQLQGMRKGAAMLFPHTFVMAIMQPDNLGTFEIYCQAGSHREAGMRAIYNVSQCPGHQATPRQRYQAARIYYIMAEEVEWDYCPDRSWEREWHNQSEKDSYGYIFLSNKDGLLGSRYKKAVFREYTDGTFRIPRPRTGPEEHLGILGPLIKGEVGDILTVVFKNNASRPYSVHAHGVLESTTVWPLAAEPGEVVTYQWNIPERSGPGPNDSACVSWIYYSAVDPIKDMYSGLVGPLAICQKGILEPHGGRSDMDREFALLFLIFDENKSWYLEENVATHGSQDPGSINLQDETFLESNKMHAINGKLYANLRGLTMYQGERVAWYMLAMGQDVDLHTIHFHAESFLYRNGENYRADVVDLFPGTFEVVEMVASNPGTWLMHCHVTDHVHAGMETLFTVFSRTEHLSPLTVITKETEKAVPPRDIEEGNVKMLGMQIPIKNVEMLASVLVAISVTLLLVVLALGGVVWYQHRQRKLRRNRRSILDDSFKLLSFKQ

SEQ ID NO: 37860 - protein, 63 aa, Homo sapiens
  Payload ID: 7527
  Gene Symbol: HEPH
  Gene Name: hephaestin
  ENSP ID: ENSP00000392319
MWAMESGHLLWALLFMQSLWPQLTDGATRVYYLGIRDVQWNYAPKGRNVITNQPLDSDIYVKM

SEQ ID NO: 37861 - protein, 208 aa, Homo sapiens
  Payload ID: 7527
  Gene Symbol: HEPH
  Gene Name: hephaestin
  ENSP ID: ENSP00000396907
MESGHLLWALLFMQSLWPQLTDGATRVYYLGIRDVQWNYAPKGRNVITNQPLDSDIVASSFLKSDKNRIGGTYKKTIYKEYKDDSYTDEVAQPAWLGFLGPVLQAEVGDVILIHLKNFATRPYTIHPHGVFYEKDSEGSLYPDGSSGPLKADDSVPPGGSHIYNWTIPEGHAPTDADPACLTWIYHSHVDAPRDIATGLIGPLITCKR

SEQ ID NO: 37862 - protein, 811 aa, Homo sapiens
  Payload ID: 7527
  Gene Symbol: HEPH
  Gene Name: hephaestin
  ENSP ID: ENSP00000398078
MESGHLLWALLFMQSLWPQLTDGATRVYYLGIRDVQWNYAPKGRNVITNQPLDSDIVASSFLKSDKNRIGGTYKKTIYKEYKDDSYTDEVAQPAWLGFLGPVLQAEVGDVILIHLKNFATRPYTIHPHGVFYEKDSEGSLYPDGSSGPLKADDSVPPGGSHIYNWTIPEGHAPTDADPACLTWIYHSHVDAPRDIATGLIGPLITCKRGALDGNSPPQRQDVDHDFFLLFSVVDENLSWHLNENIATYCSDPASVDKEDETFQESNRMHAINGFVFGNLPELNMCAQKRVAWHLFGMGNEIDVHTAFFHGQMLTTRGHHTDVANIFPATFVTAEMVPWEPGTWLISCQVNSHFRDGMQALYKVKSCSMAPPVDLLTGKVRQYFIEAHEIQWDYGPMGHDGSTGKNLREPGSISDKFFQKSSSRIGGTYWKVRYEAFQDETFQEKMHLEEDRHLGILGPVIRAEVGDTIQVVFYNRASQPFSMQPHGVFYEKDYEGTVYNDDPIRDTNSGLVGPLLVCRAGALGADGKQKGVDKEFFLLFTVLDENKSWYSNANQAAAMLDFRLLSEDIEGFQDSNRMHAINGFLFSNLPRLDMCKGDTVAWHLLGLGTETDVHGVMFQGNTVQLQGMRKGAAMLFPHTFVMAIMQPDNLGTFEIYCQAGSHREAGMRAIYNVSQCPGHQATPRQRYQAARIYYIMAEEVEWDYCPDRSWEREWHNQSEKDSYGYIFLSNKDGLLGSRYKKAVFREYTDGTFRIPRPRTGPEEHLGILGPLIKGEVGDILTVVFKNNASRPYSVHAHGVLESTTVWPLAAEP

SEQ ID NO: 37863 - protein, 1160 aa, Homo sapiens
  Payload ID: 7527
  Gene Symbol: HEPH
  Gene Name: hephaestin
  ENSP ID: ENSP00000411687
MWAMESGHLLWALLFMQSLWPQLTDGATRVYYLGIRDVQWNYAPKGRNVITNQPLDSDIVASSFLKSDKNRIGGTYKKTIYKEYKDDSYTDEVAQPAWLGFLGPVLQAEVGDVILIHLKNFATRPYTIHPHGVFYEKDSEGSLYPDGSSGPLKADDSVPPGGSHIYNWTIPEGHAPTDADPACLTWIYHSHVDAPRDIATGLIGPLITCKRGALDGNSPPQRQDVDHDFFLLFSVVDENLSWHLNENIATYCSDPASVDKEDETFQESNRMHAINGFVFGNLPELNMCAQKRVAWHLFGMGNEIDVHTAFFHGQMLTTRGHHTDVANIFPATFVTAEMVPWEPGTWLISCQVNSHFRDGMQALYKVKSCSMAPPVDLLTGKVRQYFIEAHEIQWDYGPMGHDGSTGKNLREPGSISDKFFQKSSSRIGGTYWKVRYEAFQDETFQEKMHLEEDRHLGILGPVIRAEVGDTIQVVFYNRASQPFSMQPHGVFYEKDYEGTVYNDGSSYPGLVAKPFEKVTYRWTVPPHAGPTAQDPACLTWMYFSAADPIRDTNSGLVGPLLVCRAGALGADGKQKGVDKEFFLLFTVLDENKSWYSNANQAAAMLDFRLLSEDIEGFQDSNRMHAINGFLFSNLPRLDMCKGDTVAWHLLGLGTETDVHGVMFQGNTVQLQGMRKGAAMLFPHTFVMAIMQPDNLGTFEIYCQAGSHREAGMRAIYNVSQCPGHQATPRQRYQAARIYYIMAEEVEWDYCPDRSWEREWHNQSEKDSYGYIFLSNKDGLLGSRYKKAVFREYTDGTFRIPRPRTGPEEHLGILGPLIKGEVGDILTVVFKNNASRPYSVHAHGVLESTTVWPLAAEPGEVVTYQWNIPERSGPGPNDSACVSWIYYSAVDPIKDMYSGLVGPLAICQKGILEPHGGRSDMDREFALLFLIFDENKSWYLEENVATHGSQDPGSINLQDETFLESNKMHAINGKLYANLRGLTMYQGERVAWYMLAMGQDVDLHTIHFHAESFLYRNGENYRADVVDLFPGTFEVVEMVASNPGTWLMHCHVTDHVHAGMETLFTVFSRTEHLSPLTVITKETEKVPPRDIEEGNVKMLGMQIPIKNVEMLASVLVAISVTLLLVVLALGGVVWYQHRQRKLRRNRRSILDDSFKLLSFKQ

SEQ ID NO: 37864 - protein, 969 aa, Homo sapiens
  Payload ID: 7527
  Gene Symbol: HEPH
  Gene Name: hephaestin
  ENSP ID: ENSP00000413211
MWAMESGHLLWALLFMQSLWPQLTDGATRVYYLGIRDVQWNYAPKGRNVITNQPLDSDIVASSFLKSDKNRIGGTYKKTIYKEYKDDSYTDEVAQPAWLGFLGPVLQAEVGDVILIHLKNFATRPYTIHPHGVFYEKDSEGSLYPDGSSGPLKADDSVPPGGSHIYNWTIPEGHAPTDADPACLTWIYHSHVDAPRDIATGLIGPLITCKRGALDGNSPPQRQDVDHDFFLLFSVVDENLSWHLNENIATYCSDPASVDKEDETFQESNRMHAINGFVFGNLPELNMCAQKRVAWHLFGMGNEIDVHTAFFHGQMLTTRGHHTDVANIFPATFVTAEMVPWEPGTWLISCQVNSHFRDGMQALYKVKSCSMAPPVDLLTGKVRQYFIEAHEIQWDYGPMGHDGSTGKNLREPGSISDKFFQKSSSRIGGTYWKVRYEAFQDETFQEKMHLEEDRHLGILGPVIRAEVGDTIQVVFYNRASQPFSMQPHGVFYEKDYEGTVYNDGTFEIYCQAGSHREAGMRAIYNVSQCPGHQATPRQRYQAARIYYIMAEEVEWDYCPDRSWEREWHNQSEKDSYGYIFLSNKDGLLGSRYKKAVFREYTDGTFRIPRPRTGPEEHLGILGPLIKGEVGDILTVVFKNNASRPYSVHAHGVLESTTVWPLAAEPGEVVTYQWNIPERSGPGPNDSACVSWIYYSAVDPIKDMYSGLVGPLAICQKGILEPHGGRSDMDREFALLFLIFDENKSWYLEENVATHGSQDPGSINLQDETFLESNKMHAINGKLYANLRGLTMYQGERVAWYMLAMGQDVDLHTIHFHAESFLYRNGENYRADVVDLFPGTFEVVEMVASNPGTWLMHCHVTDHVHAGMETLFTVFSRTEHLSPLTVITKETEKAVPPRDIEEGNVKMLGMQIPIKNVEMLASVLVAISVTLLLVVLALGGVVWYQHRQRKLRRNRRSILDDSFKLLSFKQ

SEQ ID NO: 37865 - protein, 1212 aa, Homo sapiens
  Payload ID: 7527
  Gene Symbol: HEPH
  Gene Name: hephaestin
  Uniprot ID: Q9BQS7
  ENSP ID: ENSP00000430620
MTQTLPYHLSLLNVLFPGPCSRHFKFRRGKCAQPAWRKVSAPSQDLLITKVMWAMESGHLLWALLFMQSLWPQLTDGATRVYYLGIRDVQWNYAPKGRNVITNQPLDSDIVASSFLKSDKNRIGGTYKKTIYKEYKDDSYTDEVAQPAWLGFLGPVLQAEVGDVILIHLKNFATRPYTIHPHGVFYEKDSEGSLYPDGSSGPLKADDSVPPGGSHIYNWTIPEGHAPTDADPACLTWIYHSHVDAPRDIATGLIGPLITCKRGALDGNSPPQRQDVDHDFFLLFSVVDENLSWHLNENIATYCSDPASVDKEDETFQESNRMHAINGFVFGNLPELNMCAQKRVAWHLFGMGNEIDVHTAFFHGQMLTTRGHHTDVANIFPATFVTAEMVPWEPGTWLISCQVNSHFRDGMQALYKVKSCSMAPPVDLLTGKVRQYFIEAHEIQWDYGPMGHDGSTGKNLREPGSISDKFFQKSSSRIGGTYWKVRYEAFQDETFQEKMHLEEDRHLGILGPVIRAEVGDTIQVVFYNRASQPFSMQPHGVFYEKDYEGTVYNDGSSYPGLVAKPFEKVTYRWTVPPHAGPTAQDPACLTWMYFSAADPIRDTNSGLVGPLLVCRAGALGADGKQKGVDKEFFLLFTVLDENKSWYSNANQAAAMLDFRLLSEDIEGFQDSNRMHAINGFLFSNLPRLDMCKGDTVAWHLLGLGTETDVHGVMFQGNTVQLQGMRKGAAMLFPHTFVMAIMQPDNLGTFEIYCQAGSHREAGMRAIYNVSQCPGHQATPRQRYQAARIYYIMAEEVEWDYCPDRSWEREWHNQSEKDSYGYIFLSNKDGLLGSRYKKAVFREYTDGTFRIPRPRTGPEEHLGILGPLIKGEVGDILTVVFKNNASRPYSVHAHGVLESTTVWPLAAEPGEVVTYQWNIPERSGPGPNDSACVSWIYYSAVDPIKDMYSGLVGPLAICQKGILEPHGGRSDMDREFALLFLIFDENKSWYLEENVATHGSQDPGSINLQDETFLESNKMHAINGKLYANLRGLTMYQGERVAWYMLAMGQDVDLHTIHFHAESFLYRNGENYRADVVDLFPGTFEVVEMVASNPGTWLMHCHVTDHVHAGMETLFTVFSRTEHLSPLTVITKETEKAVPPRDIEEGNVKMLGMQIPIKNVEMLASVLVAISVTLLLVVLALGGVVWYQHRQRKLRRNRRSILDDSFKLLSFKQ

SEQ ID NO: 37866 - protein, 1159 aa, Homo sapiens
  Payload ID: 7528
  Gene Symbol: HEPHL1
  Gene Name: hephaestin-like 1
  Uniprot ID: Q6MZM0
  ENSP ID: ENSP00000313699
MPRKQPAGCIFLLTFLGLSGLVGTVTRTYYIGIVEEYWNYVPQGKNVITGKSFTEDKLATLFLERGPNRIGSIYKKAVYRRFTDGTYSIEIPKPPWLGFLGPILRAEVGDVIVIHLKNFASRPYSLHPHGVFYNKDSEGALYPDGTSGRNKNDDMVPPGKNYTYVWPVREEYAPTPADANCLTWVYHSHIDAPKDICSGLIGPLLVCKEGILNRYSGTRNDVDREFVIMFTLVDENQSWYLNENIKHFCTNPDSVDKKDAVFQRSNKMHALNGYLFGNFPEPDMCVGESVSWHLFGMGNEIDIHSIYFYGNTFISRGHRTDVVNLFPATFLTTEMIAENPGKWMITCQVSDHLQAGMLGQYNVDNCKSDIFYPKMKGQQRRYFIAAEKILWDYAPQGYNKFSGLPLNASGSDSDLYFTQGDNRIGGKYWKVRYTEFVDATFTKRKRLSAEEAHLGILGPVIKAEVGDTLLVTFANKADKVYSILPHGVIYDKASDAAPNLDGFVKPGAHVKPGETFTYKWTVPESVSPTAGDPPCLTYLYFSAVDPIKDTSSGLVGPLLVCKKGVLNADGTQKGIDKEFYLLFTVFDENLSRYFDENIQKFIWHPFSIDKEDKEFVKSNRMHAVNGYMYGNQPGLNMCKRDRVSWHLIGLGTDTDMHGIVFQGNTIHLRGTHRDSLALFPHMATTAFMQPDHAGIFRVFCATMPHLSRGMGQIYEVSSCDNRDPSEQRYGMIRTFYIAAEEVEWDYAPNKNWEFEKQHVDARGERHGDIFMNRTENWIGSQYKKVVYREYTDGEFVEIKARPPREEHLELLGPMIHAEVGNTVLIIFKNKASRPYSISAQGVEEMDSGKQFQVPMTKPGEVKTYRWNIPKRSGPGPSDPNCIPWVYYSTVNFVKDTYSGLMGPLITCRKGVLNEKGRRSDVDYEFALLFLVFNENESWYLDDNIKKYLNKDPRDFKRTDDFEESNRMHAINGKIFGNLHGLIMNEDTMTNWYLLGIGSEVDIHTIHYHAESFLFKIDKSYREDVYDLFPGTFQTIELFADHPGTWLLHCHVSDHIHAGMETTYTVLRNIDNRIPYSTTSPGVASHPATVPSNERPGKEQLYFFGKNLGPTGAKAALVILFIIGLLLLITTVILSLRLCSAMKQTDYQQVQSCALPTDAL

SEQ ID NO: 37867 - protein, 417 aa, Homo sapiens
  Payload ID: 7529
  Gene Symbol: HPN
  Gene Name: hepsin
  Uniprot ID: P05981
  ENSP ID: ENSP00000262626
MAQKEGGRTVPCCSRPKVAALTAGTLLLLTAIGAASWAIVAVLLRSDQEPLYPVQVSSADARLMVFDKTEGTWRLLCSSRSNARVAGLSCEEMGFLRALTHSELDVRTAGANGTSGFFCVDEGRLPHTQRLLEVISVCDCPRGRFLAAICQDCGRRKLPVDRIVGGRDTSLGRWPWQVSLRYDGAHLCGGSLLSGDWVLTAAHCFPERNRVLSRWRVFAGAVAQASPHGLQLGVQAVVYHGGYLPFRDPNSEENSNDIALVHLSSPLPLTEYIQPVCLPAAGQALVDGKICTVTGWGNTQYYGQQAGVLQEARVPIISNDVCNGADFYGNQIKPKMFCAGYPEGGIDACQGDSGGPFVCEDSISRTPRWRLCGIVSWGTGCALAQKPGVYTKVSDFREWIFQAIKTHSEASGMVTQL

SEQ ID NO: 37868 - protein, 417 aa, Homo sapiens; identical to SEQ ID NO: 37867
  Payload ID: 7529
  Gene Symbol: HPN
  Gene Name: hepsin
  Uniprot ID: P05981
  ENSP ID: ENSP00000376060

SEQ ID NO: 37869 - protein, 259 aa, Homo sapiens
  Payload ID: 7529
  Gene Symbol: HPN
  Gene Name: hepsin
  ENSP ID: ENSP00000470327
MAQKEVQVSSADARLMVFDKTEGTWRLLCSSRSNARVAGLSCEEMGFLRRNRVLSRWRVFAGAVAQASPHGLQLGVQAVVYHGGYLPFRDPNSEENSNDIALVHLSSPLPLTEYIQPVCLPAAGQALVDGKICTVTGWGNTQYYGQQAGVLQEARVPIISNDVCNGADFYGNQIKPKMFCAGYPEGGIDACQGDSGGPFVCEDSISRTPRWRLCGIVSWGTGCALAQKPGVYTKVSDFREWIFQAIKTHSEASGMVTQL

SEQ ID NO: 37870 - protein, 80 aa, Homo sapiens
  Payload ID: 7529
  Gene Symbol: HPN
  Gene Name: hepsin
  ENSP ID: ENSP00000472310
MAQKEGGRTVPCCSRPKVAALTAGTLLLLTAIGAASWAIVAVLLRSDQEPLYPVQVSSADARLMVFDKTEGTWRLLCSSR

SEQ ID NO: 37871 - protein, 700 aa, Homo sapiens [sequence omitted]

SEQ ID NO: 37872 - protein, 324 aa, Homo sapiens
  Payload ID: 7530
  Gene Symbol: HPS1
  Gene Name: Hermansky-Pudlak syndrome 1
  Uniprot ID: Q92902
  ENSP ID: ENSP00000343638
MKCVLVATEGAEVLFYWTDQEFEESLRLKFGQSENEEEELPALEDQLSTLLAPVIISSMTMLEKLSDTYTCFSTENGNFLYVLHLFGECLFIAINGDHTESEGDLRRKLYVLKYLFEVHFGLVTVDGHLIRKELRPPDLAQRVQLWEHFQSLLWTYSRLREQEQCFAVEALERLIHPQLCELCIEALERHVIQAVNTSPERGGEEALHAFLLVHSKLLAFYSSHSASSLRPADLLALILLVQDLYPSESTAEDDIQPSPRRARSSQNIPVQQAWSPHSTGPTGGSSAETETDSFSLPEEYFTPAPSPGDQSSGEDRRKAGGNNS

SEQ ID NO: 37873 - protein, 326 aa, Homo sapiens
  Payload ID: 7530
  Gene Symbol: HPS1
  Gene Name: Hermansky-Pudlak syndrome 1
  ENSP ID: ENSP00000352652
RLIHPQLCELCIEALERHVIQAVNTSPERGGEEALHAFLLVHSKLLAFYSSHSASSLRPADLLALILLVQDLYPSESTAEDDIQETDSFSLPEEYFTPAPSPGDQSSGSTIWLEGGTPPMDALQIAEDTLQTLVPHCPVPSGPRRIFLDANVKESYCPLVPHTMYCLPLWQGINLVLLTRSPSAPLALVLSQLMDGFSMLEKKLKEGPEPGASLRSQPLVGDLRQRMDKFVKNRGAQEIQSTWLEFKAKAFSKSEPGSSWELLQACGKLKRQLCAIYRLNFLTTAPSRGGPHLPQHLQDQVQRLMREKLTDWKDFLLVKSRRNITM

SEQ ID NO: 37874 - protein, 700 aa, Homo sapiens [sequence omitted]

SEQ ID NO: 37875 - protein, 159 aa, Homo sapiens
  Payload ID: 7530
  Gene Symbol: HPS1
  Gene Name: Hermansky-Pudlak syndrome 1
  ENSP ID: ENSP00000392462
  MOD_RES (1)..(1): Any amino acid
XLRPPDLAQRVQLWEHFQSLLWTYSRLREQEQCFAVEALERLIHPQLCELCIEALERHVIQAVNTSPERGGEEALHAFLLVHSKLLAFYSSHSASSLRPADLLALILLVQDLYPSESTAEDDIQETDSFSLPEEYFTPAPSPGDQSSGEDRRKAGGNNS

SEQ ID NO: 37876 - protein, 700 aa, Homo sapiens [sequence omitted]

SEQ ID NO: 37877 - protein, 1004 aa, Homo sapiens
  Payload ID: 7531
  Gene Symbol: HPS3
  Gene Name: Hermansky-Pudlak syndrome 3
  Uniprot ID: Q969F9
  ENSP ID: ENSP00000296051
MVQLYNLHPFGSQQVVPCKLEPDRFCGGGRDALFVAAGCKVEAFAVAGQELCQPRCAFSTLGRVLRLAYSEAGDYLVAIEEKNKATFLRAYVNWRNKRTENSRVCIRMIGHNVEGPFSKAFRDQMYIIEMPLSEAPLCISCCPVKGDLLVGCTNKLVLFSLKYQIINEEFSLLDFERSLIIHIDNITPVEVSFCVGYVAVMSDLEVLIVKLESGPKNGERVHHHPHKTNNRIRRTEEGISNEISQLESDDFVICQKPLELLGEKSEQSGLSVTLESTGLADEKRKYSHFQHLLYRRFAPDISSYVLSDDIKLHSLQLLPIYQTGSLTSDGKNLSQEKELLSLFCFFSLPHVGYLYMVVKSVELMSVYQYPEKSQQAVLTPQFLHVITSNNLQCFTVRCSAAAAREEDPYMDTTLKACPPVSMDVCALRIQLFIGLKAICHFKNHIILLTKAEPEAIPERRQSPKRLLSRKDTSVKIKIPPVAEAGWNLYIVNTISPVQLYKEMVDYSNTYKTVKTQSCIHLLSEAHLLVRAALMDASQLEPGEKAELLEAFKESCGHLGDCYSRLDSQHSHLTLPYYKMSGLSMAEVLARTDWTVEDGLQKYERGLIFYINHSLYENLDEELNEELAAKVVQMFYVAEPKQVPHILCSPSMKNINPLTAMSYLRKLDTSGFSSILVTLTKAAVALKMGDLDMHRNEMKSHSEMKLVCGFILEPRLLIQQRKGQIVPTELALHLKETQPGLLVASVLGLQKNNKIGIEEADSFFKVLCAKDEDTIPQLLVDFWEAQLVACLPDVVLQELFFKLTSQYIWRLSKRQPPDTTPLRTSEDLINACSHYGLIYPWVHVVISSDSLADKNYTEDLSKLQSLICGPSFDIASIIPFLEPLSEDTIAGLSVHVLCRTRLKEYEQCIDILLERCPEAVIPYANHELKEENRTLWWKKLLPELCQRIKCGGEKYQLYLSSLKETLSIVAVELELKDFMNVLPEDGTATFFLPYLLYCSRKKPLT

SEQ ID NO: 37878 - protein, 839 aa, Homo sapiens
  Payload ID: 7531
  Gene Symbol: HPS3
  Gene Name: Hermansky-Pudlak syndrome 3
  ENSP ID: ENSP00000418230
MVQLYNLHPFGSQQVVPCKLEPDRFCGGGRDALFVAAGCKVEAFAVAGQELCQPRCAFSTLGRVLRLAYSEAGISNEISQLESDDFVICQKPLELLGEKSEQSGLSVTLESTGLADEKRKYSHFQHLLYRRFAPDISSYVLSDDIKLHSLQLLPIYQTGSLTSDGKNLSQEKELLSLFCFFSLPHVGYLYMVVKSVELMSVYQYPEKSQQAVLTPQFLHVITSNNLQCFTVRCSAAAAREEDPYMDTTLKACPPVSMDVCALRIQLFIGLKAICHFKNHIILLTKAEPEAIPERRQSPKRLLSRKDTSVKIKIPPVAEAGWNLYIVNTISPVQLYKEMVDYSNTYKTVKTQSCIHLLSEAHLLVRAALMDASQLEPGEKAELLEAFKESCGHLGDCYSRLDSQHSHLTLPYYKMSGLSMAEVLARTDWTVEDGLQKYERGLIFYINHSLYENLDEELNEELAAKVVQMFYVAEPKQVPHILCSPSMKNINPLTAMSYLRKLDTSGFSSILVTLTKAAVALKMGDLDMHRNEMKSHSEMKLVCGFILEPRLLIQQRKGQIVPTELALHLKETQPGLLVASVLGLQKNNKIGIEEADSFFKVLCAKDEDTIPQLLVDFWEAQLVACLPDVVLQELFFKLTSQYIWRLSKRQPPDTTPLRTSEDLINACSHYGLIYPWVHVVISSDSLADKNYTEDLSKLQSLICGPSFDIASIIPFLEPLSEDTIAGLSVHVLCRTRLKEYEQCIDILLERCPEAVIPYANHELKEENRTLWWKKLLPELCQRIKCGGEKYQLYLSSLKETLSIVAVELELKDFMNVLPEDGTATFFLPYLLYCSRKKPLT

SEQ ID NO: 37879 - protein, 266 aa, Homo sapiens
  Payload ID: 7531
  Gene Symbol: HPS3
  Gene Name: Hermansky-Pudlak syndrome 3
  ENSP ID: ENSP00000419824
ELAAKVVQMFYVAEPKQVPHILCSPSMKNINPLTAMSYLRKLDTSGFSSILVTLTKAAVALKMGDLDMHRNEMKSHSEMKLVCGFILEPRLLIQQRKGQIVPTELALHLKETQPGLLVASVLGLQKNNKIGIEEADSFFKVLCAKDEDTIPQLLVDFWEAQLVACLPDVVLQELFFKLTSQYIWRLSKRQPPDTTPLRTSEDLINACSHYGLIYPWVHVVISSDSLADKNYTEDLSKLQLPLFRSWSHFQKTLLPASVSMFCVVHA

SEQ ID NO: 37880 - protein, 708 aa, Homo sapiens
  Payload ID: 7532
  Gene Symbol: HPS4
  Gene Name: Hermansky-Pudlak syndrome 4
  Uniprot ID: Q9NQG7
  ENSP ID: ENSP00000338457
MATSTSTEAKSASWWNYFFLYDGSKVKEEGDPTRAGICYFYPSQTLLDQQELLCGQIAGVVRCVSDISDSPPTLVRLRKLKFAIKVDGDYLWVLGCAVELPDVSCKRFLDQLVGFFNFYNGPVSLAYENCSQEELSTEWDTFIEQILKNTSDLHKIFNSLWNLDQTKVEPLLLLKAARILQTCQRSPHILAGCILYKGLIVSTQLPPSLTAKVLLHRTAPQEQRLPTGEDAPQEHGAALPPNVQIIPVFVTKEEAISLHEFPVEQMTRSLASPAGLQDGSAQHHPKGGSTSALKENATGHVESMAWTTPDPTSPDEACPDGRKENGCLSGHDLESIRPAGLHNSARGEVLGLSSSLGKELVFLQEELDLSEIHIPEAQEVEMASGHFAFLHVPVPDGRAPYCKASLSASSSLEPTPPEDTAISSLRPPSAPEMLTQHGAQEQLEDHPGHSSQAPIPRADPLPRRTRRPLLLPRLDPGQRGNKLPTGEQGLDEDVDGVCESHAAPGLECSSGSANCQGAGPSADGISSRLTPAESCMGLVRMNLYTHCVKGLVLSLLAEEPLLGDSAAIEEVYHSSLASLNGLEVHLKETLPRDEAASTSSTYNFTHYDRIQSLLMANLPQVATPQDRRFLQAVSLMHSEFAQLPALYEMTVRNASTAVYACCNPIQETYFQQLAPAARSSGFPNPQDGAFSLSGKAKQKLLKHGVNLL

SEQ ID NO: 37881 - protein, 708 aa, Homo sapiens; identical to SEQ ID NO: 37880
  Payload ID: 7532
  Gene Symbol: HPS4
  Gene Name: Hermansky-Pudlak syndrome 4
  Uniprot ID: Q9NQG7
  ENSP ID: ENSP00000381213

SEQ ID NO: 37882 - protein, 703 aa, Homo sapiens
  Payload ID: 7532
  Gene Symbol: HPS4
  Gene Name: Hermansky-Pudlak syndrome 4
  Uniprot ID: Q9NQG7
  ENSP ID: ENSP00000384185
MAPLCSLARWNYFFLYDGSKVKEEGDPTRAGICYFYPSQTLLDQQELLCGQIAGVVRCVSDISDSPPTLVRLRKLKFAIKVDGDYLWVLGCAVELPDVSCKRFLDQLVGFFNFYNGPVSLAYENCSQEELSTEWDTFIEQILKNTSDLHKIFNSLWNLDQTKVEPLLLLKAARILQTCQRSPHILAGCILYKGLIVSTQLPPSLTAKVLLHRTAPQEQRLPTGEDAPQEHGAALPPNVQIIPVFVTKEEAISLHEFPVEQMTRSLASPAGLQDGSAQHHPKGGSTSALKENATGHVESMAWTTPDPTSPDEACPDGRKENGCLSGHDLESIRPAGLHNSARGEVLGLSSSLGKELVFLQEELDLSEIHIPEAQEVEMASGHFAFLHVPVPDGRAPYCKASLSASSSLEPTPPEDTAISSLRPPSAPEMLTQHGAQEQLEDHPGHSSQAPIPRADPLPRRTRRPLLLPRLDPGQRGNKLPTGEQGLDEDVDGVCESHAAPGLECSSGSANCQGAGPSADGISSRLTPAESCMGLVRMNLYTHCVKGLVLSLLAEEPLLGDSAAIEEVYHSSLASLNGLEVHLKETLPRDEAASTSSTYNFTHYDRIQSLLMANLPQVATPQDRRFLQAVSLMHSEFAQLPALYEMTVRNASTAVYACCNPIQETYFQQLAPAARSSGFPNPQDGAFSLSGKAKQKLLKHGVNLL

SEQ ID NO: 37883 - protein, 191 aa, Homo sapiens
  Payload ID: 7532
  Gene Symbol: HPS4
  Gene Name: Hermansky-Pudlak syndrome 4
  ENSP ID: ENSP00000399705
MAPLCSLARWNYFFLYDGSKVKEEGDPTRAGICYFYPSQTLLDQQELLCGQIAGVVRCVSDISDSPPTLVRLRKLKFAIKVDGDYLWVLGCAVELPDVSCKRFLDQLVGFFNFYNGPVSLAYENCSQEELSTEWDTFIEQILKNTSDLHKIFNSLWNLDQTKALSYTLSSCSVQPFPLFSLPDCEHADGWA

SEQ ID NO: 37884 - protein, 196 aa, Homo sapiens
  Payload ID: 7532
  Gene Symbol: HPS4
  Gene Name: Hermansky-Pudlak syndrome 4
  ENSP ID: ENSP00000406764
MATSTSTEAKSASWWNYFFLYDGSKVKEEGDPTRAGICYFYPSQTLLDQQELLCGQIAGVVRCVSDISDSPPTLVRLRKLKFAIKVDGDYLWVLGCAVELPDVSCKRFLDQLVGFFNFYNGPVSLAYENCSQEELSTEWDTFIEQILKNTSDLHKIFNSLWNLDQTKALSYTLSSCSVQPFPLFSLPDCEHADGWA

SEQ ID NO: 37885 - protein, 481 aa, Homo sapiens
  Payload ID: 7532
  Gene Symbol: HPS4
  Gene Name: Hermansky-Pudlak syndrome 4
  ENSP ID: ENSP00000415081
MATSTSTEAKSASWWNYFFLYDGSKVKEEGDPTRAGICYFYPSQTLLDQQELLCGQIAGVVRCVSDISDSPPTLVRLRKLKFAIKVDGDYLWVLGCAVELPDVSCKRFLDQLVGFFNFYNGPVSLAYENCSQEELSTEWDTFIEQILKNTSDLHKIFNSLWNLDQTKVEPLLLLKAARILQTCQRSPHILAGCILYKGLIVSTQLPPSLTAKVLLHRTAPQEQRLPTGEDAPQEHGKWMLWSFKNRVTHQNPNGAALPPNVQIIPVFVTKEEAISLHEFPVEQMTRSLASPAGLQDGSAQHHPKGGSTSALKENATGHVESMAWTTPDPTSPDEACPDGRKENGCLSGHDLESIRPAGLHNSARGEVLGLSSSLGKELVFLQEELDLSEIHIPEAQEVEMASGHFAFLHVPVPDGRAPYCKASLSASSSLEPTPPEDTAISSLRPPSAPEMLTQHGAQEQLEDHPGHSSQAPIPRADPLPR

SEQ ID NO: 37886 - protein, 167 aa, Homo sapiens
  Payload ID: 7532
  Gene Symbol: HPS4
  Gene Name: Hermansky-Pudlak syndrome 4
  ENSP ID: ENSP00000430291
MAPLCSLARWNYFFLYDGSKVKEEGDPTRAGICYFYPSQTLLDQQELLCGQIAGVVRCVSDISDSPPTLVRLRKLKFAIKVDGDYLWVLGCAVELPDVSCKRFLDQLVGFFNFYNGPVSLAYENCSQEELSTEWDTFIEQILKNTSDLHKIFNSLWNLDQTKGLLGP

SEQ ID NO: 37887 - protein, 1129 aa, Homo sapiens
  Payload ID: 7533
  Gene Symbol: HPS5
  Gene Name: Hermansky-Pudlak syndrome 5
  Uniprot ID: Q9UPZ3
  ENSP ID: ENSP00000265967
MAFVPVIPESYSHVLAEFESLDPLLSALRLDSSRLKCTSIAVSRKWLALGSSGGGLHLIQKEGWKHRLFLSHREGAISQVACCLHDDDYVAVATSQGLVVVWELNQERRGKPEQMYVSSEHKGRRVTALCWDTAILRVFVGDHAGKVSAIKLNTSKQAKAAAAFVMFPVQTITTVDSCVVQLDYLDGRLLISSLTRSFLCDTEREKFWKIGNKERDGEYGACFFPGRCSGGQQPLIYCARPGSRMWEVNFDGEVISTHQFKKLLSLPPLPVITLRSEPQYDHTAGSSQSLSFPKLLHLSEHCVLTWTERGIYIFIPQNVQVLLWSEVKDIQDVAVCRNELFCLHLNGKVSHLSLISVERCVERLLRRGLWNLAARTCCLFQNSVIASRARKTLTADKLEHLKSQLDHGTYNDLISQLEELILKFEPLDSACSSRRSSISSHESFSILDSGIYRIISSRRGSQSDEDSCSLHSQTLSEDERFKEFTSQQEEDLPDQCCGSHGNEDNVSHAPVMFETDKNETFLPFGIPLPFRSPSPLVSLQAVKESVSSFVRKTTEKIGTLHTSPDLKVRPELRGDEQSCEEDVSSDTCPKEEDTEEEKEVTSPPPEEDRFQELKVATAEAMTKLQDPLVLFESESLRMVLQEWLSHLEKTFAMKDFSGVSDTDNSSMKLNQDVLLVNESKKGILDEDNEKEKRDSLGNEESVDKTACECVRSPRESLDDLFQICSPCAIASGLRNDLAELTTLCLELNVLNSKIKSTSGHVDHTLQQYSPEILACQFLKKYFFLLNLKRAKESIKLSYSNSPSVWDTFIEGLKEMASSNPVYMEMEKGDLPTRLKLLDDEVPFDSPLLVVYATRLYEKFGESALRSLIKFFPSILPSDIIQLCHHHPAEFLAYLDSLVKSRPEDQRSSFLESLLQPESLRLDWLLLAVSLDAPPSTSTMDDEGYPRPHSHLLSWGYSQLILHLIKLPADFITKEKMTDICRSCGFWPGYLILCLELERRREAFTNIVYLNDMSLMEGDNGWIPETVEEWKLLLHLIQSKSTRPAPQESLNGSLSDGPSPINVENVALLLAKAMGPDRAWSLLQECGLALELSEKFTRTCDILRIAEKRQRALIQSMLEKCDRFLWSQQA

SEQ ID NO: 37888 - protein, 1015 aa, Homo sapiens
  Payload ID: 7533
  Gene Symbol: HPS5
  Gene Name: Hermansky-Pudlak syndrome 5
  Uniprot ID: Q9UPZ3
  ENSP ID: ENSP00000379552
MYVSSEHKGRRVTALCWDTAILRVFVGDHAGKVSAIKLNTSKQAKAAAAFVMFPVQTITTVDSCVVQLDYLDGRLLISSLTRSFLCDTEREKFWKIGNKERDGEYGACFFPGRCSGGQQPLIYCARPGSRMWEVNFDGEVISTHQFKKLLSLPPLPVITLRSEPQYDHTAGSSQSLSFPKLLHLSEHCVLTWTERGIYIFIPQNVQVLLWSEVKDIQDVAVCRNELFCLHLNGKVSHLSLISVERCVERLLRRGLWNLAARTCCLFQNSVIASRARKTLTADKLEHLKSQLDHGTYNDLISQLEELILKFEPLDSACSSRRSSISSHESFSILDSGIYRIISSRRGSQSDEDSCSLHSQTLSEDERFKEFTSQQEEDLPDQCCGSHGNEDNVSHAPVMFETDKNETFLPFGIPLPFRSPSPLVSLQAVKESVSSFVRKTTEKIGTLHTSPDLKVRPELRGDEQSCEEDVSSDTCPKEEDTEEEKEVTSPPPEEDRFQELKVATAEAMTKLQDPLVLFESESLRMVLQEWLSHLEKTFAMKDFSGVSDTDNSSMKLNQDVLLVNESKKGILDEDNEKEKRDSLGNEESVDKTACECVRSPRESLDDLFQICSPCAIASGLRNDLAELTTLCLELNVLNSKIKSTSGHVDHTLQQYSPEILACQFLKKYFFLLNLKRAKESIKLSYSNSPSVWDTFIEGLKEMASSNPVYMEMEKGDLPTRLKLLDDEVPFDSPLLVVYATRLYEKFGESALRSLIKFFPSILPSDIIQLCHHHPAEFLAYLDSLVKSRPEDQRSSFLESLLQPESLRLDWLLLAVSLDAPPSTSTMDDEGYPRPHSHLLSWGYSQLILHLIKLPADFITKEKMTDICRSCGFWPGYLILCLELERRREAFTNIVYLNDMSLMEGDNGWIPETVEEWKLLLHLIQSKSTRPAPQESLNGSLSDGPSPINVENVALLLAKAMGPDRAWSLLQECGLALELSEKFTRTCDILRIAEKRQRALIQSMLEKCDRFLWSQQA

SEQ ID NO: 37889 - protein, 1015 aa, Homo sapiens; identical to SEQ ID NO: 37888
  Payload ID: 7533
  Gene Symbol: HPS5
  Gene Name: Hermansky-Pudlak syndrome 5
  Uniprot ID: Q9UPZ3
  ENSP ID: ENSP00000399590

SEQ ID NO: 37890 - protein, 400 aa, Homo sapiens
  Payload ID: 7533
  Gene Symbol: HPS5
  Gene Name: Hermansky-Pudlak syndrome 5
  ENSP ID: ENSP00000431758
MYVSSEHKGRRVTALCWDTAILRVFVGDHAGKVSAIKLNTSKQAKAAAAFVMFPVQTITTVDSCVVQLDYLDGRLLISSLTRSFLCDTEREKFWKIGNKERDGEYGACFFPGRCSGGQQPLIYCARPGSRMWEVNFDGEVISTHQFKKLLSLPPLPVITLRSEPQYDHTAGSSQSLSFPKLLHLSEHCVLTWTERGIYIFIPQNVQVLLWSEVKDIQDVAVCRNELFCLHLNGKVSHLSLISVERCVERLLRRGLWNLAARTCCLFQNSVIASRARKTLTADKLEHLKSQLDHGTYNDLISQLEELILKFEPLDSACSSRRSSISSHESFSILDSGIYRIISSRRGSQSDEDSCSLHSQTLSEDERFKEFTSQQEEDLPDQCCGSHGNEGDECVCCWFLM

SEQ ID NO: 37891 - protein, 263 aa, Homo sapiens
  Payload ID: 7533
  Gene Symbol: HPS5
  Gene Name: Hermansky-Pudlak syndrome 5
  ENSP ID: ENSP00000437437
MKIGDFFPQLSLRSSFLESLLQPESLRLDWLLLAVSLDAPPSTSTMDDEGYPRPHSHLLSWGYSQLILHLIKLPADFITKEKMTDICRSCGFWPGYLILCLELERRREAFTNIVYLNDMSLMEGDNGWIPETVEEWKLLLHLIQSKSTRPAPQESLNGSLSDGPSPINVENVALLLAKAMGPDRAWSLLQECGLALELSEKFTRTCDILRIAEKRQRHLNCFHFLAIVNNAAMNMSIQICLPDTAFSSFGYIPESGILESYGP

SEQ ID NO: 37892 - protein, 160 aa, Homo sapiens
  Payload ID: 7533
  Gene Symbol: HPS5
  Gene Name: Hermansky-Pudlak syndrome 5
  ENSP ID: ENSP00000441781
MASSNPVYMEMEKGDLPTRLKLLDDEVPFDSPLLVVYATRLYEKFGESALRSLIKFFPSILPSDIIQLCHHHPAEFLAYLDSLVKSRPEDQRSSFLESLLQPESLRLDWLLLAVSLDAPPSTSTMDDEGYPRPHSHLLSWGYSQLILHLIKLPADFITKE

SEQ ID NO: 37893 - protein, 775 aa, Homo sapiens
  Payload ID: 7534
  Gene Symbol: HPS6
  Gene Name: Hermansky-Pudlak syndrome 6
  Uniprot ID: Q86YV9
  ENSP ID: ENSP00000299238
MKRSGTLRLLSDLSAFGGAARLRELVAGDSAVRVRGSPDGRHLLLLRPPGAVAPQLLVASRGPGAELERAWPAGQPSPLDAFFLPWPARPALVLVWESGLAEVWGAGVGPGWRPLQSTELCPGGGARVVAVAALRGRLVWCEERQARAEGPSGSPAAAFSHCVCVRTLEPSGEASTSLGRTHVLLHHCPAFGLLASCRQLFLVPTATTWPGVAHVLLIWSPGKGKVMVAAPRLGLSYSKSLNPGRGDTWDFRTLLRGLPGLLSPREPLAVHTWAPTPQGLLLLDFGGTVSLLQSHGGTRAVGTLQEAPVGPWGSAALGTFQGTLACVLGSTLELLDMGSGQLLERKVLSTDRVHLLEPPAPGMEDEEELETRGNLRLLSALGLFCVGWEAPQGVELPSAKDLVFEEACGYYQRRSLRGAQLTPEELRHSSTFRAPQALASILQGHLPPSALLTMLRTELRDYRGLEQLKAQLVAGDDEEAGWTELAEQEVARLLRTELIGDQLAQLNTVFQALPTAAWGATLRALQLQLDGNGKLRSQAPPDVWKKVLGGITAGKEPPNGILPPFELLCQCLCQLEPRWLPPFVELAQQQGGPGWGAGGPGLPLYRRALAVLGEEGTRPEALELELLLSSGRPKAVLQAVGQLVQKEQWDRALDAGLALGPSSPLLRSEIFKLLLAEFAQHRRLDAHLPLLCRLCPPELAPAELLLLLRTYLPDEVGPPTPFPEPGAEPPLTVGLLKALLEQTGAQGWLSGPVLSPYEDILWDPSTPPPTPPRDL

SEQ ID NO: 37894 - protein, 406 aa, Homo sapiens
  Payload ID: 7535
  Gene Symbol: HERPUD2
  Gene Name: HERPUD family member 2
  Uniprot ID: Q9BSE4
  ENSP ID: ENSP00000310729
MDQSGMEIPVTLIIKAPNQKYSDQTISCFLNWTVGKLKTHLSNVYPSKPLTKDQRLVYSGRLLPDHLQLKDILRKQDEYHMVHLVCTSRTPPSSPKSSTNRESHEALASSSNSSSDHSGSTTPSSGQETLSLAVGSSSEGLRQRTLPQAQTDQAQSHQFPYVMQGNVDNQFPGQAAPPGFPVYPAFSPLQMLWWQQMYAHQYYMQYQAAVSAQATSNVNPTQPTTSQPLNLAHVPGEEPPPAPNLVAQENRPMNENVQMNAQGGPVLNEEDFNRDWLDWMYTFSRAAILLSIVYFYSSFSRFIMVMGAMLLVYLHQAGWFPFRQEGGHQQAPNNNAEVNNDGQNANNLELEEMERLMDDGLEDESGEDGGEDASAIQRPGLMASAWSFITTFFTSLIPEGPPQVAN

SEQ ID NO: 37895 - protein, 406 aa, Homo sapiens; identical to SEQ ID NO: 37894
  Payload ID: 7535
  Gene Symbol: HERPUD2
  Gene Name: HERPUD family member 2
  Uniprot ID: Q9BSE4
  ENSP ID: ENSP00000379390

SEQ ID NO: 37896 - protein, 190 aa, Homo sapiens
  Payload ID: 7535
  Gene Symbol: HERPUD2
  Gene Name: HERPUD family member 2
  ENSP ID: ENSP00000391015
MDQSGMEIPVTLIIKAPNQKYSDQTISCFLNWTVGKLKTHLSNVYPSKPQDEYHMVHLVCTSRTPPSSPKSSTNRESHEALASSSNSSSDHSGSTTPSSGQETLSLAVGSSSEGLRQRTLPQAQTDQAQSHQFPYVMQGNVDNQFPGQAAPPGFPVYPAFSPLQMLWWQQMYAHQYYMQYQAAVSAQATS

SEQ ID NO: 37897 - protein, 60 aa, Homo sapiens
  Payload ID: 7535
  Gene Symbol: HERPUD2
  Gene Name: HERPUD family member 2
  ENSP ID: ENSP00000412895
MDQSGMEIPVTLIIKAPNQKYSDQTISCFLNWTVGKLKTHLSNVYPSKPSSDHSGSTTPS

SEQ ID NO: 37898 - protein, 180 aa, Homo sapiens
  Payload ID: 7535
  Gene Symbol: HERPUD2
  Gene Name: HERPUD family member 2
  ENSP ID: ENSP00000415475
MDQSGMEIPVTLIIKAPNQKYSDQTISCFLNWTVGKLKTHLSNVYPSKPSSDHSGSTTPSSGQETLSLAVGSSSEGLRQRTLPQAQTDQAQSHQFPYVMQGNVDNQFPGQAAPPGFPVYPAFSPLQMLWWQQMYAHQYYMQYQAAVSAQATSNVNPTQPTTSQPLNLAHVPGEEPPPAPN

SEQ ID NO: 37899 - protein, 18 aa, Homo sapiens
  Payload ID: 7535
  Gene Symbol: HERPUD2
  Gene Name: HERPUD family member 2
  ENSP ID: ENSP00000474978
MDQSGMEIPVTLIIKAPN

SEQ ID NO: 37900 - protein, 531 aa, Homo sapiens
  Payload ID: 7536
  Gene Symbol: HHLA1
  Gene Name: HERV-H LTR-associating 1
  Uniprot ID: C9JL84
  ENSP ID: ENSP00000388322
MLGFLSRGPSMKLCMGLACVLSLWNTVSGIKGEAKKEKGMTFLPTTVSGLREEERKEKGVAFLATTELPARSIDLSALNLTELVNGMLSRALKDSKKFFSLLSVTSYSSFAFHKFSVAVYNISNLKTVDPAKFPTRYCYCLNNRTNDLSDFTALLVDIIGNSTSYLTEIFKSTSILSVNQSNESDCIFICVMTGKSGRNLSDFWEIEEKYPIINYTFTSGLSGVLGAATRGTARTSKPTTKSQKTLPSTSPGHWTQSTPWASALRSSPWTETAAPSETEETLNTGRPPELPARATATWFSASHTLPALATRRVARTQWLTADRQTWASISSVPWAQTISEKKPGGSLWETRSSPPTTAGTEEAMNTTSLLAPAAEIMATPGSPSQASPTLGAFTHGTQTPSPTKATAPRYPQTGDLSAEWPFTAGEEPVLVPRPHQVSRCPQPLFKVGAMAAAPLTLAIQRLNPCLMELCQFFQQCLCMSQRSPRTEDMRYCLEYYSWFLKNATYICQRVKRVSHSHTLKQKCLENICKSV

SEQ ID NO: 37901 - protein, 543 aa, Homo sapiens
  Payload ID: 7536
  Gene Symbol: HHLA1
  Gene Name: HERV-H LTR-associating 1
  ENSP ID: ENSP00000407107
MLGFLSRGPSMKLCMGLACVLSLWNTVSGIKGEAKKEKGMTFLPTTGKWVIRAPFQLTCLEIKMLRRKKMGHSRAALNPDLLLSGLREEERKEKGVAFLATTELPARSIDLSALNLTELVNGMLSRALKDSKKFFSLLSVTSYSSFAFHKFSVAVYNISNLKTVDPAKFPTRYCYCLNNRTNDLSDFTALLVDIIGNSTSYLTEIFKSTSILSVNQSNESDCIFICVMTGKSGRNLSDFWEIEEKYPIINYTFTSGLSGVLGAATRGTARTSKPTTKSQKTLPSTSPGHWTQSTPWASALRSSPWTETAAPSETEETLNTGRPPELPARATATWFSASHTLPALATRRVARTQWLTADRQTWASISSVPWAQTISEKKPGGSLWETRSSPPTTAGTEEAMNTTSLLAPAAEIMATPGSPSQASPTLGAFTHGTQTPSPTKATAPRYPQTGDLSAEWPFTAGEEPVLVPRPHQVSRCPQPLFKVGAMAAAPLTLAIQRLNPCLMELCQFFQQCLCMSQRSPRTEDMSSFINPYQSSTSKISWKT

SEQ ID NO: 37902 - protein, 414 aa, Homo sapiens
  Payload ID: 7537
  Gene Symbol: HHLA2
  Gene Name: HERV-H LTR-associating 2
  Uniprot ID: Q9UM44
  ENSP ID: ENSP00000350402
MKAQTALSFFLILITSLSGSQGIFPLAFFIYVPMNEQIVIGRLDEDIILPSSFERGSEVVIHWKYQDSYKVHSYYKGSDHLESQDPRYANRTSLFYNEIQNGNASLFFRRVSLLDEGIYTCYVGTAIQVITNKVVLKVGVFLTPVMKYEKRNTNSFLICSVLSVYPRPIITWKMDNTPISENNMEETGSLDSFSINSPLNITGSNSSYECTIENSLLKQTWTGRWTMKDGLHKMQSEHVSLSCQPVNDYFSPNQDFKVTWSRMKSGTFSVLAYYLSSSQNTIINESRFSWNKELINQSDFSMNLMDLNLSDSGEYLCNISSDEYTLLTIHTVHVEPSQETASHNKGLWILVPSAILAAFLLIWSVKCCRAQLEARRSRHPADGAQQERCCVPPGERCPSAPDNGEENVPLSGKV

SEQ ID NO: 37903 - protein, 414 aa, Homo sapiens; identical to SEQ ID NO: 37902
  Payload ID: 7537
  Gene Symbol: HHLA2
  Gene Name: HERV-H LTR-associating 2
  Uniprot ID: Q9UM44
  ENSP ID: ENSP00000417856

SEQ ID NO: 37904 - protein, 136 aa, Homo sapiens
  Payload ID: 7537
  Gene Symbol: HHLA2
  Gene Name: HERV-H LTR-associating 2
  ENSP ID: ENSP00000418174
MKAQTALSFFLILITSLSGSQGIFPLAFFIYVPMNEQIVIGRLDEDIILPSSFERGSEVVIHWKYQDSYKVHSYYKGSDHLESQDPRYANRTSLFYNEIQNGNASLFFRRVSLLDEGIYTCYVGTAIQVITNKVVL

SEQ ID NO: 37905 - protein, 397 aa, Homo sapiens
  Payload ID: 7537
  Gene Symbol: HHLA2
  Gene Name: HERV-H LTR-associating 2
  ENSP ID: ENSP00000418284
MKAQTALSFFLILITSLSGSQGIFPLAFFIYVPMNEQIVIGRLDEDIILPSSFERGSEVVIHWKYQDSYKVHSYYKGSDHLESQDPRYANRTSLFYNEIQNGNASLFFRRVSLLDEGIYTCYVGTAIQVITNKVVLKVGVFLTPVMKYEKRNTNSFLICSVLSVYPRPIITWKMDNTPISENNMEETGSLDSFSINSPLNITGSNSSYECTIENSLLKQTWTGRWTMKDGLHKMQSEHVSLSCQPVNDYFSPNQDFKVTWSRMKSGTFSVLAYYLSSSQNTIINESRFSWNKELINQSDFSMNLMDLNLSDSGEYLCNISSDEYTLLTIHTVHVEPSQETASHNKGLWILVPSAILAAFLLIWSVKCCRERCCVPPGERCPSAPDNGEENVPLSGKV

SEQ ID NO: 37906 - protein, 350 aa, Homo sapiens
  Payload ID: 7537
  Gene Symbol: HHLA2
  Gene Name: HERV-H LTR-associating 2
  Uniprot ID: Q9UM44
  ENSP ID: ENSP00000418345
MVMWNILKPRTHLLCMTNMFCTRHEGTDSTVFLPHSHNISEWISRRVSLLDEGIYTCYVGTAIQVITNKVVLKVGVFLTPVMKYEKRNTNSFLICSVLSVYPRPIITWKMDNTPISENNMEETGSLDSFSINSPLNITGSNSSYECTIENSLLKQTWTGRWTMKDGLHKMQSEHVSLSCQPVNDYFSPNQDFKVTWSRMKSGTFSVLAYYLSSSQNTIINESRFSWNKELINQSDFSMNLMDLNLSDSGEYLCNISSDEYTLLTIHTVHVEPSQETASHNKGLWILVPSAILAAFLLIWSVKCCRAQLEARRSRHPADGAQQERCCVPPGERCPSAPDNGEENVPLSGKV

SEQ ID NO: 37907 - protein, 328 aa, Homo sapiens
  Payload ID: 7537
  Gene Symbol: HHLA2
  Gene Name: HERV-H LTR-associating 2
  ENSP ID: ENSP00000418797
  MOD_RES (1)..(1): Any amino acid
XIQNGNASLFFRRVSLLDEGIYTCYVGTAIQVITNKVVLKVGVFLTPVMKYEKRNTNSFLICSVLSVYPRPIITWKMDNTPISENNMEETGSLDSFSINSPLNITGSNSSYECTIENSLLKQTWTGRWTMKDGLHKMQSEHVSLSCQPVNDYFSPNQDFKVTWSRMKSGTFSVLAYYLSSSQNTIINESRFSWNKELINQSDFSMNLMDLNLSDSGEYLCNISSDEYTLLTIHTVHVEPSQETASHNKGLWILVPSAILAAFLLIWSVKCCRAQLEARRSRHPADGAQQERCCVPPGERCPSAPDNGEENVVRHYFLYQTIYSIKMLL

SEQ ID NO: 37908 - protein, 414 aa, Homo sapiens; identical to SEQ ID NO: 37902
  Payload ID: 7537
  Gene Symbol: HHLA2
  Gene Name: HERV-H LTR-associating 2
  Uniprot ID: Q9UM44
  ENSP ID: ENSP00000419207

SEQ ID NO: 37909 - protein, 97 aa, Homo sapiens
  Payload ID: 7537
  Gene Symbol: HHLA2
  Gene Name: HERV-H LTR-associating 2
  ENSP ID: ENSP00000419911
MKAQTALSFFLILITSLSGSQGIFPLAFFIYVPMNEQIVIGRLDEDIILPSSFERGSEVVIHWKYQDSYKVHSYYKGSDHLESQDPRYANRTSLFYN

SEQ ID NO: 37910 - protein, 144 aa, Homo sapiens
  Payload ID: 7537
  Gene Symbol: HHLA2
  Gene Name: HERV-H LTR-associating 2
  ENSP ID: ENSP00000419940
MKAQTALSFFLILITSLSGSQGIFPLAFFIYVPMNEQIVIGRLDEDIILPSSFERGSEVVIHWKYQDSYKVHSYYKGSDHLESQDPRYANRTSLFYNEIQNGNASLFFRRVSLLDEGIYTCYVGTAIQVITNKVVLKVGVFLTP

SEQ ID NO: 37911 - protein, 128 aa, Homo sapiens
  Payload ID: 7537
  Gene Symbol: HHLA2
  Gene Name: HERV-H LTR-associating 2
  ENSP ID: ENSP00000420622
MNEQIVIGRLDEDIILPSSFERGSEVVIHWKYQDSYKVHSYYKGSDHLESQDPRYANRTSLFYNEIQNGNASLFFRRVSLLDEGIYTCYVGTAIQVITNKVVLKVGVFLTPVMKYEKRNTNSFLICSV

SEQ ID NO: 37912 - protein, 414 aa, Homo sapiens; identical to SEQ ID NO: 37902
  Payload ID: 7537
  Gene Symbol: HHLA2
  Gene Name: HERV-H LTR-associating 2
  Uniprot ID: Q9UM44
  ENSP ID: ENSP00000482187

SEQ ID NO: 37913 - protein, 114 aa, Homo sapiens
  Payload ID: 7538
  Gene Symbol: HHLA3
  Gene Name: HERV-H LTR-associating 3
  Uniprot ID: Q9XRX5
  ENSP ID: ENSP00000352938
MFGACYKQPLKPSGSEPPAEECRMTPRHAGCDVTEMQRILSQPTFTEHLLRAVCTKLANMYSTSTDCREHCRRGMKAKQLKAEAGRSCQRKGVPIQTPREHSWISCKKEFEANP

SEQ ID NO: 37914 - protein, 76 aa, Homo sapiens
  Payload ID: 7538
  Gene Symbol: HHLA3
  Gene Name: HERV-H LTR-associating 3
  Uniprot ID: Q9XRX5
  ENSP ID: ENSP00000354815
MFGACYKQPLKPSGSEPPAEECRMTPRHAGCDVTEMQRILSQPTFTEHLLRAVLSTERGPYPDPKRAFLDLLQERI

SEQ ID NO: 37915 - protein, 121 aa, Homo sapiens
  Payload ID: 7538
  Gene Symbol: HHLA3
  Gene Name: HERV-H LTR-associating 3
  Uniprot ID: Q9XRX5
  ENSP ID: ENSP00000359978
MFGACYKQPLKPSGSEPPAEECRMTPRHAGCDVTEMQRILSQPTFTEHLLRAVCLVNGKGSLSRPQESILGSLARKNLRRIHRVSLVMCVRPLSPSKAIISPVTCMYTSRWPEASEESQKK

SEQ ID NO: 37916 - protein, 114 aa, Homo sapiens; identical to SEQ ID NO: 37913
  Payload ID: 7538
  Gene Symbol: HHLA3
  Gene Name: HERV-H LTR-associating 3
  Uniprot ID: Q9XRX5
  ENSP ID: ENSP00000431678

SEQ ID NO: 37917 - protein, 76 aa, Homo sapiens; identical to SEQ ID NO: 37914
  Payload ID: 7538
  Gene Symbol: HHLA3
  Gene Name: HERV-H LTR-associating 3
  Uniprot ID: Q9XRX5
  ENSP ID: ENSP00000432048

SEQ ID NO: 37918 - protein, 74 aa, Homo sapiens
  Payload ID: 7538
  Gene Symbol: HHLA3
  Gene Name: HERV-H LTR-associating 3
  ENSP ID: ENSP00000434063
MFGACYKQPLKPSGSEPPAEECRMTPRHAGCDVTEMQRILSQPTFTEHLLRAIDSFRRHLVFRLATLLTPQPFV

SEQ ID NO: 37919 - protein, 280 aa, Homo sapiens
  Payload ID: 7539
  Gene Symbol: HES1
  Gene Name: hes family bHLH transcription factor 1
  Uniprot ID: Q14469
  ENSP ID: ENSP00000232424
MPADIMEKNSSSPVAATPASVNTTPDKPKTASEHRKSSKPIMEKRRRARINESLSQLKTLILDALKKDSSRHSKLEKADILEMTVKHLRNLQRAQMTAALSTDPSVLGKYRAGFSECMNEVTRFLSTCEGVNTEVRTRLLGHLANCMTQINAMTYPGQPHPALQAPPPPPPGPGGPQHAPFAPPPPLVPIPGGAAPPPGGAPCKLGSQAGEAAKVFGGFQVVPAPDGQFAFLIPNGAFAHSGPVIPVYTSNSGTSVGPNAVSPSSGPSLTADSMWRPWRN

SEQ ID NO: 37920 - protein, 173 aa, Homo sapiens
  Payload ID: 7540
  Gene Symbol: HES2
  Gene Name: hes family bHLH transcription factor 2
  Uniprot ID: Q9Y543
  ENSP ID: ENSP00000367065
MGLPRRAGDAAELRKSLKPLLEKRRRARINQSLSQLKGLILPLLGRENSNCSKLEKADVLEMTVRFLQELPASSWPTAAPLPCDSYREGYSACVARLARVLPACRVLEPAVSARLLEHLWRRAASATLDGGRAGDSSGPSAPAPAPASAPEPASAPVPSPPSPPCGPGLWRPW

SEQ ID NO: 37921 - protein, 76 aa, Homo sapiens
  Payload ID: 7540
  Gene Symbol: HES2
  Gene Name: hes family bHLH transcription factor 2
  Uniprot ID: Q9Y543
  ENSP ID: ENSP00000367067
MGLPRRAGDAAELRKSLKPLLEKRRRARINQSLSQLKGLILPLLGREDASGWHTWLPLHAQNCFLLYIQAPEQPPA

SEQ ID NO: 37922 - protein, 76 aa, Homo sapiens; identical to SEQ ID NO: 37921
  Payload ID: 7540
  Gene Symbol: HES2
  Gene Name: hes family bHLH transcription factor 2
  Uniprot ID: Q9Y543
  ENSP ID: ENSP00000367068

SEQ ID NO: 37923 - protein, 77 aa, Homo sapiens
  Payload ID: 7540
  Gene Symbol: HES2
  Gene Name: hes family bHLH transcription factor 2
  ENSP ID: ENSP00000465248
MGLPRRAGDAAELRKSLKPLLEKRRRARINQSLSQLKGLILPLLGRECLATATARATAPVWRAWPACCPPAVSWSPP

SEQ ID NO: 37924 - protein, 82 aa, Homo sapiens
  Payload ID: 7540
  Gene Symbol: HES2
  Gene Name: hes family bHLH transcription factor 2
  ENSP ID: ENSP00000465270
MGLPRRAGDAAELRKSLKPLLEKRRRARINQSLSQLKGLILPLLGRENSNCSKLEKADVLEMTVRFLQELPASSWPTAAPRE

SEQ ID NO: 37925 - protein, 186 aa, Homo sapiens
  Payload ID: 7541
  Gene Symbol: HES3
  Gene Name: hes family bHLH transcription factor 3
  Uniprot ID: Q5TGS1
  ENSP ID: ENSP00000367130
MEKKRRARINVSLEQLKSLLEKHYSHQIRKRKLEKADILELSVKYMRSLQNSLQGLWPVPRGAEQPSGFRSCLPGVSQLLRRGDEVGSGLRCPLVPESAAGSTMDSAGLGQEAPALFRPCTPAVWAPAPAAGGPRSPPPLLLLPESLPGSSASVPPPQPASSRCAESPGLGLRVWRPWGSPGDDLN

SEQ ID NO: 37926 - protein, 221 aa, Homo sapiens
  Payload ID: 7542
  Gene Symbol: HES4
  Gene Name: hes family bHLH transcription factor 4
  Uniprot ID: Q9HCC6
  ENSP ID: ENSP00000304595
MAADTPGKPSASPMAGAPASASRTPDKPRSAAEHRKSSKPVMEKRRRARINESLAQLKTLILDALRKESSRHSKLEKADILEMTVRHLRSLRRVQVTAALSADPAVLGKYRAGFHECLAEVNRFLAGCEGVPADVRSRLLGHLAACLRQLGPSRRPASLSPAAPAEAPAPEVYAGRPLLPSLGGPFPLLAPPLLPGLTRALPAAPRAGPQGPGGPWRPWLR

SEQ ID NO: 37927 - protein, 247 aa, Homo sapiens
  Payload ID: 7542
  Gene Symbol: HES4
  Gene Name: hes family bHLH transcription factor 4
  ENSP ID: ENSP00000393198
MAADTPGKPSASPMAGAPASASRTPDKPRSAAEHRKVGSRPGVRGATGGREGRGTQPVPDPQSSKPVMEKRRRARINESLAQLKTLILDALRKESSRHSKLEKADILEMTVRHLRSLRRVQVTAALSADPAVLGKYRAGFHECLAEVNRFLAGCEGVPADVRSRLLGHLAACLRQLGPSRRPASLSPAAPAEAPAPEVYAGRPLLPSLGGPFPLLAPPLLPGLTRALPAAPRAGPQGPGGPWRPWLR

SEQ ID NO: 37928 - protein, 189 aa, Homo sapiens
  Payload ID: 7542
  Gene Symbol: HES4
  Gene Name: hes family bHLH transcription factor 4
  ENSP ID: ENSP00000425085
MAADTPGKPSASPMAGAPASASRTPDKPRSAAEHRKSSRHSKLEKADILEMTVRHLRSLRRVQVTAALSADPAVLGKYRAGFHECLAEVNRFLAGCEGVPADVRSRLLGHLAACLRQLGPSRRPASLSPAAPAEAPAPEVYAGRPLLPSLGGPFPLLAPPLLPGLTRALPAAPRAGPQGPGGPWRPWLR

SEQ ID NO: 37929 - protein, 166 aa, Homo sapiens
  Payload ID: 7543
  Gene Symbol: HES5
  Gene Name: hes family bHLH transcription factor 5
  Uniprot ID: Q5TA89
  ENSP ID: ENSP00000367714
MAPSTVAVELLSPKEKNRLRKPVVEKMRRDRINSSIEQLKLLLEQEFARHQPNSKLEKADILEMAVSYLKHSKAFVAAAGPKSLHQDYSEGYSWCLQEAVQFLTLHAASDTQMKLLYHFQRPPAAPAAPAKEPKAPGAAPPPALSAKATAAAAAAHQPACGLWRPW

SEQ ID NO: 37930 - protein, 166 aa, Homo sapiens; identical to SEQ ID NO: 37929
  Payload ID: 7543
  Gene Symbol: HES5
  Gene Name: hes family bHLH transcription factor 5
  Uniprot ID: Q5TA89
  ENSP ID: ENSP00000482150

SEQ ID NO: 37931 - protein, 224 aa, Homo sapiens
  Payload ID: 7544
  Gene Symbol: HES6
  Gene Name: hes family bHLH transcription factor 6
  Uniprot ID: Q96HZ4
  ENSP ID: ENSP00000272937
MAPPAAPGRDRVGREDEDGWETRGDRKARKPLVEKKRRARINESLQELRLLLAGAEVQAKLENAEVLELTVRRVQGVLRGRAREREQLQAEASERFAAGYIQCMHEVHTFVSTCQAIDATVAAELLNHLLESMPLREGSSFQDLLGDALAGPPRAPGRSGWPAGGAPGSPIPSPPGPGDDLCSDLEEAPEAELSQAPAEGPDLVPAALGSLTTAQIARSVWRPW

SEQ ID NO: 37932 - protein, 112 aa, Homo sapiens
  Payload ID: 7544
  Gene Symbol: HES6
  Gene Name: hes family bHLH transcription factor 6
  Uniprot ID: Q96HZ4
  ENSP ID: ENSP00000387008
MAPPAAPGRDRVGREDEDGWETRGDRKARKPLVEKKRRARINESLQELRLLLAGAEVQAKLENAEVLELTSASSCRRKRASASLPATSSACTRCTRSCPRARPSTLPSLPSS

SEQ ID NO: 37933 - protein, 94 aa, Homo sapiens
  Payload ID: 7544
  Gene Symbol: HES6
  Gene Name: hes family bHLH transcription factor 6
  ENSP ID: ENSP00000387107
MAPPAAPGRDRVGREDEDGWETRGDRKVRAGAMGEQAGGRPCGAGIQCPAPRRPGSPWWRRSGARGSTRACRSCGCCWRAPRCRPSWRTPKCWS

SEQ ID NO: 37934 - protein, 222 aa, Homo sapiens
  Payload ID: 7544
  Gene Symbol: HES6
  Gene Name: hes family bHLH transcription factor 6
  Uniprot ID: Q96HZ4
  ENSP ID: ENSP00000387155
MAPPAAPGRDRVGREDEDGWETRGDRKARKPLVEKKRRARINESLQELRLLLAGAEAKLENAEVLELTVRRVQGVLRGRAREREQLQAEASERFAAGYIQCMHEVHTFVSTCQAIDATVAAELLNHLLESMPLREGSSFQDLLGDALAGPPRAPGRSGWPAGGAPGSPIPSPPGPGDDLCSDLEEAPEAELSQAPAEGPDLVPAALGSLTTAQIARSVWRPW

SEQ ID NO: 37935 - protein, 214 aa, Homo sapiens
  Payload ID: 7544
  Gene Symbol: HES6
  Gene Name: hes family bHLH transcription factor 6
  Uniprot ID: Q96HZ4
  ENSP ID: ENSP00000387215
MAPPAAPGRDRVGREDEDGWETRGDRKARKPLVEKKRRARINESLQELRLLLAGAEVQAKLENAEVLELTVRRVQGVLRGRARGEWRRGGRGRRPRAPVTPARRRTSLPAPLSCRRRGLPPEQGAPPRLLGEPRPRGPGGLGHAVAAHRAGRGSLPPTLGPRARAAAGGSERALRCRLHPVHARGAHVRVHVPGHRRYRRCRAPEPSARVHAAA

SEQ ID NO: 37936 - protein, 195 aa, Homo sapiens
  Payload ID: 7544
  Gene Symbol: HES6
  Gene Name: hes family bHLH transcription factor 6
  ENSP ID: ENSP00000387343
MAPPAAPGRDRVGREDEDGWETRGDRKVQAKLENAEVLELTVRRVQGVLRGRAREREQLQAEASERFAAGYIQCMHEVHTFVSTCQAIDATVAAELLNHLLESMPLREGSSFQDLLGDALAGPPRAPGRSGWPAGGAPGSPIPSPPGPGDDLCSDLEEAPEAELSQAPAEGPDLVPAALGSLTTAQIARSVWRPW

SEQ ID NO: 37937 - protein, 144 aa, Homo sapiens
  Payload ID: 7544
  Gene Symbol: HES6
  Gene Name: hes family bHLH transcription factor 6
  ENSP ID: ENSP00000390870
MAPPAAPGRDRVGREDEDGWETRGDRKVQAKLENAEVLELTVRRVQGVLRGRARGEWRRGGRGRRPRAPVTPARRRTSLPAPLSCRRRGLPPEQGAPPRLLGEPRPRGPGGLGHAVAAHRAGRGSLPPTLGPRARAAAGGSERA

SEQ ID NO: 37938 - protein, 170 aa, Homo sapiens
  Payload ID: 7544
  Gene Symbol: HES6
  Gene Name: hes family bHLH transcription factor 6
  ENSP ID: ENSP00000392596
VLAEGGVGGPARRLDESGRNSGAAPPPLPNGPCLPGAWQPPQPGPETPLGPETADLTVALHTRDASPGASGPSAQLWRRHRRRREMNELMGPEAPGGEEAARADQREPAGAAAAAGGRRGAGQAGERRSAGADGAAGPGCAAGPGARARAAAGGSERALRCRLHPVHARG

SEQ ID NO: 37939 - protein, 16 aa, Homo sapiens
  Payload ID: 7544
  Gene Symbol: HES6
  Gene Name: hes family bHLH transcription factor 6
  ENSP ID: ENSP00000401797
RAPRCRPSWRTPKCWS

SEQ ID NO: 37940 - protein, 225 aa, Homo sapiens
  Payload ID: 7545
  Gene Symbol: HES7
  Gene Name: hes family bHLH transcription factor 7
  Uniprot ID: Q9BYE0
  ENSP ID: ENSP00000314774
MVTRDRAENRDGPKMLKPLVEKRRRDRINRSLEELRLLLLERTRDQNLRNPKLEKAEILEFAVGYLRERSRVEPPGVPRSPVQDAEALASCYLSGFRECLLRLAAFAHDASPAARAQLFSALHGYLRPKPPRPKPVDPRPPAPRPSLDPAAPALGPALHQRPPVHQGHPSPRCAWSPSLCSPRAGDSGAPAPLTGLLPPPPPPHRQDGAPKAPLPPPPAFWRPWP

SEQ ID NO: 37941 - protein, 230 aa, Homo sapiens
  Payload ID: 7545
  Gene Symbol: HES7
  Gene Name: hes family bHLH transcription factor 7
  Uniprot ID: Q9BYE0
  ENSP ID: ENSP00000446205
MVTRDRAENRDGPKMLKPLVEKRRRDRINRSLEELRLLLLERTRDQNLRNPKLEKAEILEFAVGYLRERSRVEPPAAAAPGVPRSPVQDAEALASCYLSGFRECLLRLAAFAHDASPAARAQLFSALHGYLRPKPPRPKPVDPRPPAPRPSLDPAAPALGPALHQRPPVHQGHPSPRCAWSPSLCSPRAGDSGAPAPLTGLLPPPPPPHRQDGAPKAPLPPPPAFWRPWP

SEQ ID NO: 37942 - protein, 145 aa, Homo sapiens
  Payload ID: 7545
  Gene Symbol: HES7
  Gene Name: hes family bHLH transcription factor 7
  ENSP ID: ENSP00000462491
MRRSGEMLKPLVEKRRRDRINRSLEELRLLLLERTRDQNLRNPKLEKAEILEFAVGYLRERSRVEPPAAAAPGVPRSPVQDAEALASCYLSGFRECLLRLAAFAHDASPAARAQLFSALHGYLRPKPPRPKPVDPRPPAPRPSLD

SEQ ID NO: 37943 - protein, 308 aa, Homo sapiens
  Payload ID: 7546
  Gene Symbol: HEY1
  Gene Name: hes-related family bHLH transcription factor with YRPW motif 1
  Uniprot ID: Q9Y5J3
  ENSP ID: ENSP00000338272
MKRAHPEYSSSDSELDETIEVEKESADENGNLSSALGSMSPTTSSQILARKRRRGIIEKRRRDRINNSLSELRRLVPSAFEKQVMEQGSAKLEKAEILQMTVDHLKMLHTAGGKGYFDAHALAMDYRSLGFRECLAEVARYLSIIEGLDASDPLRVRLVSHLNNYASQREAASGAHAGLGHIPWGTVFGHHPHIAHPLLLPQNGHGNAGTTASPTEPHHQGRLGSAHPEAPALRAPPSGSLGPVLPVVTSASKLSPPLLSSVASLSAFPFSFGSFHLLSPNALSPSAPTQAANLGKPYRPWGTEIGAF

SEQ ID NO: 37944 - protein, 304 aa, Homo sapiens
  Payload ID: 7546
  Gene Symbol: HEY1
  Gene Name: hes-related family bHLH transcription factor with YRPW motif 1
  Uniprot ID: Q9Y5J3
  ENSP ID: ENSP00000346761
MKRAHPEYSSSDSELDETIEVEKESADENGNLSSALGSMSPTTSSQILARKRRRGIIEKRRRDRINNSLSELRRLVPSAFEKQGSAKLEKAEILQMTVDHLKMLHTAGGKGYFDAHALAMDYRSLGFRECLAEVARYLSIIEGLDASDPLRVRLVSHLNNYASQREAASGAHAGLGHIPWGTVFGHHPHIAHPLLLPQNGHGNAGTTASPTEPHHQGRLGSAHPEAPALRAPPSGSLGPVLPVVTSASKLSPPLLSSVASLSAFPFSFGSFHLLSPNALSPSAPTQAANLGKPYRPWGTEIGAF

SEQ ID NO: 37945 - protein, 186 aa, Homo sapiens
  Payload ID: 7546
  Gene Symbol: HEY1
  Gene Name: hes-related family bHLH transcription factor with YRPW motif 1
  ENSP ID: ENSP00000429705
MSPTTSSQILARKRRRGIIEKRRRDRINNSLSELRRLVPSAFEKQGSAKLEKAEILQMTVDHLKMLHTAGGKGYFDAHALAMDYRSLGFRECLAEVARYLSIIEGLDASDPLRVRLVSHLNNYASQREAASGAHAGLGHIPWGTVFGHHPHIAHPLLLPQNGHGNAGTTASPTEPHHQGRLGSAHP

SEQ ID NO: 37946 - protein, 214 aa, Homo sapiens
  Payload ID: 7546
  Gene Symbol: HEY1
  Gene Name: hes-related family bHLH transcription factor with YRPW motif 1
  ENSP ID: ENSP00000429792
MPLEERNVFWLSKGNLTGDQGYFDAHALAMDYRSLGFRECLAEVARYLSIIEGLDASDPLRVRLVSHLNNYASQREAASGAHAGLGHIPWGTVFGHHPHIAHPLLLPQNGHGNAGTTASPTEPHHQGRLGSAHPEAPALRAPPSGSLGPVLPVVTSASKLSPPLLSSVASLSAFPFSFGSFHLLSPNALSPSAPTQAANLGKPYRPWGTEIGAF

SEQ ID NO: 37947 - protein, 337 aa, Homo sapiens
  Payload ID: 7547
  Gene Symbol: HEY2
  Gene Name: hes-related family bHLH transcription factor with YRPW motif 2
  Uniprot ID: Q9UBP5
  ENSP ID: ENSP00000357348
MKRPCEETTSESDMDETIDVGSENNYSGQSTSSVIRLNSPTTTSQIMARKKRRGIIEKRRRDRINNSLSELRRLVPTAFEKQGSAKLEKAEILQMTVDHLKMLQATGGKGYFDAHALAMDFMSIGFRECLTEVARYLSSVEGLDSSDPLRVRLVSHLSTCATQREAAAMTSSMAHHHHPLHPHHWAAAFHHLPAALLQPNGLHASESTPCRLSTTSEVPPAHGSALLTATFAHADSALRMPSTGSVAPCVPPLSTSLLSLSATVHAAAAAATAAAHSFPLSFAGAFPMLPPNAAAAVAAATAISPPLSVSATSSPQQTSSGTNNKPYRPWGTEVGAF

SEQ ID NO: 37948 - protein, 291 aa, Homo sapiens
  Payload ID: 7547
  Gene Symbol: HEY2
  Gene Name: hes-related family bHLH transcription factor with YRPW motif 2
  ENSP ID: ENSP00000357349
MARKKRRGIIEKRRRDRINNSLSELRRLVPTAFEKQGSAKLEKAEILQMTVDHLKMLQATGGKGYFDAHALAMDFMSIGFRECLTEVARYLSSVEGLDSSDPLRVRLVSHLSTCATQREAAAMTSSMAHHHHPLHPHHWAAAFHHLPAALLQPNGLHASESTPCRLSTTSEVPPAHGSALLTATFAHADSALRMPSTGSVAPCVPPLSTSLLSLSATVHAAAAAATAAAHSFPLSFAGAFPMLPPNAAAAVAAATAISPPLSVSATSSPQQTSSGTNNKPYRPWGTEVGAF

SEQ ID NO: 37949 - protein, 328 aa, Homo sapiens
  Payload ID: 7548
  Gene Symbol: HEYL
  Gene Name: hes-related family bHLH transcription factor with YRPW motif-like
  Uniprot ID: Q9NQ87
  ENSP ID: ENSP00000361943
MKRPKEPSGSDGESDGPIDVGQEGQLSQMARPLSTPSSSQMQARKKHRGIIEKRRRDRINSSLSELRRLVPTAFEKQGSSKLEKAEVLQMTVDHLKMLHATGGTGFFDARALAVDFRSIGFRECLTEVIRYLGVLEGPSSRADPVRIRLLSHLNSYAAEMEPSPTPTGPLAFPAWPWSFFHSCPGLPALSNQLAILGRVPSPVLPGVSSPAYPIPALRTAPLRRATGIILPARRNVLPSRGASSTRRARPLERPATPVPVAPSSRAARSSHIAPLLQSSSPTPPGPTGSAAYVAVPTPNSSSPGPAGRPAGAMLYHSWVSEITEIGAF

SEQ ID NO: 37950 - protein, 185 aa, Homo sapiens
  Payload ID: 7549
  Gene Symbol: HESX1
  Gene Name: HESX homeobox 1
  Uniprot ID: Q9UBX0
  ENSP ID: ENSP00000295934
MSPSLQEGAQLGENKPSTCSFSIERILGLDQKKDCVPLMKPHRPWADTCSSSGKDGNLCLHVPNPPSGISFPSVVDHPMPEERASKYENYFSASERLSLKRELSWYRGRRPRTAFTQNQIEVLENVFRVNCYPGIDIREDLAQKLNLEEDRIQIWFQNRRAKLKRSHRESQFLMAKKNFNTNLLE

SEQ ID NO: 37951 - protein, 151 aa, Homo sapiens
  Payload ID: 7549
  Gene Symbol: HESX1
  Gene Name: HESX homeobox 1
  ENSP ID: ENSP00000418918
MSPSLQEGAQLGENKPSTCSFSIERILGLDQKKDCVPLMKPHRPWADTCSSSGKDGNLCLHVPNPPSGISFPSVVDHPMPEERASKYENYFSASERLSLKRELSWYRGRRPRTAFTQNQIWFQNRRAKLKRSHRESQFLMAKKNFNTNLLE

SEQ ID NO: 37952 - protein, 107 aa, Homo sapiens
  Payload ID: 7549
  Gene Symbol: HESX1
  Gene Name: HESX homeobox 1
  ENSP ID: ENSP00000419615
MSPSLQEGAQLGENKPSTCSFSIERILGLDQKKDCVPLMKPHRPWADTCSSSGKDGNLCLHVPNPPSGISFPSVVDHPMPEERASKYENYFSASERLSLKRELSWYR

SEQ ID NO: 37953 - protein, 553 aa, Homo sapiens
  Payload ID: 7550
  Gene Symbol: HP1BP3
  Gene Name: heterochromatin protein 1, binding protein 3
  Uniprot ID: Q5SSJ5
  ENSP ID: ENSP00000312625
MATDTSQGELVHPKALPLIVGAQLIHADKLGEKVEDSTMPIRRTVNSTRETPPKSKLAEGEEEKPEPDISSEESVSTVEEQENETPPATSSEAEQPKGEPENEEKEENKSSEETKKDEKDQSKEKEKKVKKTIPSWATLSASQLARAQKQTPMASSPRPKMDAILTEAIKACFQKSGASVVAIRKYIIHKYPSLELERRGYLLKQALKRELNRGVIKQVKGKGASGSFVVVQKSRKTPQKSRNRKNRSSAVDPEPQVKLEDVLPLAFTRLCEPKEASYSLIRKYVSQYYPKLRVDIRPQLLKNALQRAVERGQLEQITGKGASGTFQLKKSGEKPLLGGSLMEYAILSAIAAMNEPKTCSTTALKKYVLENHPGTNSNYQMHLLKKTLQKCEKNGWMEQISGKGFSGTFQLCFPYYPSPGVLFPKKEPDDSRDEDEDEDESSEEDSEDEEPPPKRRLQKKTPAKSPGKAASVKQRGSKPAPKVSAAQRGKARPLPKKAPPKAKTPAKKTRPSSTVIKKPSGGSSKKPATSARKEVKLPGKGKSTMKKSFRVKK

SEQ ID NO: 37954 - protein, 133 aa, Homo sapiens
  Payload ID: 7550
  Gene Symbol: HP1BP3
  Gene Name: heterochromatin protein 1, binding protein 3
  Uniprot ID: Q5SSJ5
  ENSP ID: ENSP00000364139
MATDTSQGELVHPKALPLIVGAQLIHADKLGEKVEDSTMPIRRTVNSTRETPPKSKLAEGEEEKPEPDISSEESVSTVEEQENETPPATSSEAEQPKGEPENEEKEENKSSEETKKERADSIHSTLFIIGQNS

SEQ ID NO: 37955 - protein, 401 aa, Homo sapiens
  Payload ID: 7550
  Gene Symbol: HP1BP3
  Gene Name: heterochromatin protein 1, binding protein 3
  Uniprot ID: Q5SSJ5
  ENSP ID: ENSP00000364142
MASSPRPKMDAILTEAIKACFQKSGASVVAIRKYIIHKYPSLELERRGYLLKQALKRELNRGVIKQVKGKGASGSFVVVQKSRKTPQKSRNRKNRSSAVDPEPQVKLEDVLPLAFTRLCEPKEASYSLIRKYVSQYYPKLRVDIRPQLLKNALQRAVERGQLEQITGKGASGTFQLKKSGEKPLLGGSLMEYAILSAIAAMNEPKTCSTTALKKYVLENHPGTNSNYQMHLLKKTLQKCEKNGWMEQISGKGFSGTFQLCFPYYPSPGVLFPKKEPDDSRDEDEDEDESSEEDSEDEEPPPKRRLQKKTPAKSPGKAASVKQRGSKPAPKVSAAQRGKARPLPKKAPPKAKTPAKKTRPSSTVIKKPSGGSSKKPATSARKEVKLPGKGKSTMKKSFRVKK

SEQ ID NO: 37956 - protein, 124 aa, Homo sapiens
  Payload ID: 7550
  Gene Symbol: HP1BP3
  Gene Name: heterochromatin protein 1, binding protein 3
  ENSP ID: ENSP00000391281
MATDTSQGELVHPKALPLIVGAQLIHADKLGEKVEDSTMPIRRTVNSTRETPPKSKLAEGEEEKPEPDISSEESVSTVEEQENETPPATSSEAEQPKGEPENEEKEENKSSEETKKDEKDQSKE

SEQ ID NO: 37957 - protein, 253 aa, Homo sapiens
  Payload ID: 7550
  Gene Symbol: HP1BP3
  Gene Name: heterochromatin protein 1, binding protein 3
  ENSP ID: ENSP00000391721
KKDEKDQSKEKEKKVKKTIPSWATLSASQLARAQKQTPMASSPRPKMDAILTEAIKACFQKSGASVVAIRKYIIHKYPSLELERRGYLLKQALKRELNRGVIKQNRSSAVDPEPQVKLEDVLPLAFTRLCEPKEASYSLIRKYVSQYYPKLRVDIRPQLLKNALQRAVERGQLEQITGKGASGTFQLKKSGEKPLLGGSLMEYAILSAIAAMNEPKTCSTTALKKYVLENHPGTNSNYQMHLLKKTLQKCEKN

SEQ ID NO: 37958 - protein, 40 aa, Homo sapiens
  Payload ID: 7550
  Gene Symbol: HP1BP3
  Gene Name: heterochromatin protein 1, binding protein 3
  ENSP ID: ENSP00000397656
MPIRRTVNSTRETPPKSKLAEGEEEKPEPDISSEESVSTV

SEQ ID NO: 37959 - protein, 19 aa, Homo sapiens
  Payload ID: 7550
  Gene Symbol: HP1BP3
  Gene Name: heterochromatin protein 1, binding protein 3
  ENSP ID: ENSP00000401874
MPIRRTVNSTRETPPKSKL

SEQ ID NO: 37960 - protein, 45 aa, Homo sapiens
  Payload ID: 7550
  Gene Symbol: HP1BP3
  Gene Name: heterochromatin protein 1, binding protein 3
  ENSP ID: ENSP00000402096
MPIRRTVNSTRETPPKSKLAEGEEEKPEPDISSEESVSTVEEQEN

SEQ ID NO: 37961 - protein, 278 aa, Homo sapiens
  Payload ID: 7550
  Gene Symbol: HP1BP3
  Gene Name: heterochromatin protein 1, binding protein 3
  ENSP ID: ENSP00000402754
MPIRRTVNSTRETPPKSKLAEGEEEKPEPDISSEESVSTVEEQENETPPATSSEAEQPKGEPENEEKEENKSSEETKKDEKDQSKEKEKKVKKTIPSWATLSASQLARAQKQTPMASSPRPKMDAILTEAIKACFQKSGASVVAIRKYIIHKYPSLELERRGYLLKQALKRELNRGVIKQVKGKGASGSFVVVQKSRKTPQKSRNRKNRSSAVDPEPQVKLEDVLPLAFTRLCEPKEASYSLIRKYVSQYYPKLRVDIRPQLLKNALQRAVERGQLEQ

SEQ ID NO: 37962 - protein, 327 aa, Homo sapiens
  Payload ID: 7550
  Gene Symbol: HP1BP3
  Gene Name: heterochromatin protein 1, binding protein 3
  ENSP ID: ENSP00000403039
MATDTSQGELVHPKALPLIVGAQLIHADKLGEKVEDSTMPIRRTVNSTRETPPKSKLAEGEEEKPEPDISSEESVSTVEEQENETPPATSSEAEQPKGEPENEEKEENKSSEETKKDEKDQSKEKEKKVKKTIPSWATLSASQLARAQKQTPMASSPRPKMDAILTEAIKACFQKSGASVVAIRKYIIHKYPSLELERRGYLLKQALKRELNRGVIKQVKGKGASGSFVVVQKSRKTPQKSRNRKNRSSAVDPEPQVKLEDVLPLAFTRLCEPKEASYSLIRKYVSQYYPKLRVDIRPQLLKNALQRAVERGQLEQITGKGASGTFQ

SEQ ID NO: 37963 - protein, 75 aa, Homo sapiens
  Payload ID: 7550
  Gene Symbol: HP1BP3
  Gene Name: heterochromatin protein 1, binding protein 3
  ENSP ID: ENSP00000405362
MATDTSQGELVHPKALPLIVGAQLIHADKLGEKVEDSTMPIRRTVNSTRETPPKSKLAEGEEEKPEPDISSEESV

SEQ ID NO: 37964 - protein, 285 aa, Homo sapiens
  Payload ID: 7551
  Gene Symbol: HNRNPAB
  Gene Name: heterogeneous nuclear ribonucleoprotein A/B
  Uniprot ID: Q99729
  ENSP ID: ENSP00000348093
MSEAGEEQPMETTGATENGHEAVPEGESPAGAGTGAAAGAGGATAAPPSGNQNGAEGDQINASKNEEDAGKMFVGGLSWDTSKKDLKDYFTKFGEVVDCTIKMDPNTGRSRGFGFILFKDAASVEKVLDQKEHRLDGRVIDPKKAMAMKKDPVKKIFVGGLNPEATEEKIREYFGEFGEIEAIELPMDPKLNKRRGFVFITFKEEEPVKKVLEKKFHTVSGSKCEIKVAQPKEVYQQQQYGSGGRGNRNRGNRGSGGGGGGGGQGSTNYGKSQRRGGHQNNYKPY

SEQ ID NO: 37965 - protein, 332 aa, Homo sapiens
  Payload ID: 7551
  Gene Symbol: HNRNPAB
  Gene Name: heterogeneous nuclear ribonucleoprotein A/B
  Uniprot ID: Q99729
  ENSP ID: ENSP00000351108
MSEAGEEQPMETTGATENGHEAVPEGESPAGAGTGAAAGAGGATAAPPSGNQNGAEGDQINASKNEEDAGKMFVGGLSWDTSKKDLKDYFTKFGEVVDCTIKMDPNTGRSRGFGFILFKDAASVEKVLDQKEHRLDGRVIDPKKAMAMKKDPVKKIFVGGLNPEATEEKIREYFGEFGEIEAIELPMDPKLNKRRGFVFITFKEEEPVKKVLEKKFHTVSGSKCEIKVAQPKEVYQQQQYGSGGRGNRNRGNRGSGGGGGGGGQSQSWNQGYGNYWNQGYGYQQGYGPGYGGYDYSPYGYYGYGPGYDYSQGSTNYGKSQRRGGHQNNYKPY

SEQ ID NO: 37966 - protein, 327 aa, Homo sapiens
  Payload ID: 7551
  Gene Symbol: HNRNPAB
  Gene Name: heterogeneous nuclear ribonucleoprotein A/B
  ENSP ID: ENSP00000422501
MSEAGEEQPMETTGATENGHEAVPEGESPAGAGTGAAAGAGGATAAPPSGNQNGAEGDQINASKNEEDAGKMFVGGLSWDTSKKDLKDYFTKFGEVVDCTIKMDPNTGRSRGFGFILFKDAASVEKVLDQKEHRLDGRVIDPKKAMAMKKDPVKKIFVGGLNPEATEEKIREYFGEFGEIEAIELPMDPKLNKRRGFVFITFKEEEPVKKVLEKKFHTVSGSKCEIKVAQPKEVYQQQQYGSGGRGNRNRGNRGSGGGQSQSWNQGYGNYWNQGYGYQQGYGPGYGGYDYSPYGYYGYGPGYDYSQGSTNYGKSQRRGGHQNNYKPY

SEQ ID NO: 37967 - protein, 280 aa, Homo sapiens
  Payload ID: 7551
  Gene Symbol: HNRNPAB
  Gene Name: heterogeneous nuclear ribonucleoprotein A/B
  ENSP ID: ENSP00000423495
MSEAGEEQPMETTGATENGHEAVPEGESPAGAGTGAAAGAGGATAAPPSGNQNGAEGDQINASKNEEDAGKMFVGGLSWDTSKKDLKDYFTKFGEVVDCTIKMDPNTGRSRGFGFILFKDAASVEKVLDQKEHRLDGRVIDPKKAMAMKKDPVKKIFVGGLNPEATEEKIREYFGEFGEIEAIELPMDPKLNKRRGFVFITFKEEEPVKKVLEKKFHTVSGSKCEIKVAQPKEVYQQQQYGSGGRGNRNRGNRGSGGGQGSTNYGKSQRRGGHQNNYKPY

SEQ ID NO: 37968 - protein, 332 aa, Homo sapiens; identical to SEQ ID NO: 37965
  Payload ID: 7551
  Gene Symbol: HNRNPAB
  Gene Name: heterogeneous nuclear ribonucleoprotein A/B
  Uniprot ID: Q99729
  ENSP ID: ENSP00000425031

SEQ ID NO: 37969 - protein, 283 aa, Homo sapiens
  Payload ID: 7551
  Gene Symbol: HNRNPAB
  Gene Name: heterogeneous nuclear ribonucleoprotein A/B
  ENSP ID: ENSP00000427110
MSEAGEEQPMETTGATENGHEAVPEGESPAGAGTGAAAGAGGATAAPPSGNQNGAEGDQINASKNEEDAGKMFVGGLSWDTSKKDLKDYFTKFGEVVDCTIKMDPNTGRSRGFGFILFKDAASVEKVLDQKEHRLDGRVIDPKKAMAMKKDPVKKIFVGGLNPEATEEKIREYFGEFGEIEAIELPMDPKLNKRRGFVFITFKEEEPVKKVLEKKFHTVSGSKCEIKVAQPKEVYQQQQYGSGGRGNRNRGNRGSGGGGGGQGSTNYGKSQRRGGHQNNYKPY

SEQ ID NO: 37970 - protein, 285 aa, Homo sapiens; identical to SEQ ID NO: 37964
  Payload ID: 7551
  Gene Symbol: HNRNPAB
  Gene Name: heterogeneous nuclear ribonucleoprotein A/B
  Uniprot ID: Q99729
  ENSP ID: ENSP00000427465

SEQ ID NO: 37971 - protein, 330 aa, Homo sapiens
  Payload ID: 7551
  Gene Symbol: HNRNPAB
  Gene Name: heterogeneous nuclear ribonucleoprotein A/B
  ENSP ID: ENSP00000482908
MSEAGEEQPMETTGATENGHEAVPEASRGRGWTGAAAGLEARPRRPRAGIRTAPRDQINASKNEEDAGKMFVGGLSWDTSKKDLKDYFTKFGEVVDCTIKMDPNTGRSRGFGFILFKDAASVEKVLDQKEHRLDGRVIDPKKAMAMKKDPVKKIFVGGLNPEATEEKIREYFGEFGEIEAIELPMDPKLNKRRGFVFITFKEEEPVKKVLEKKFHTVSGSKCEIKVAQPKEVYQQQQYGSGGRGNRNRGNRGSGGGGGGGGQSQSWNQGYGNYWNQGYGYQQGYGPGYGGYDYSPYGYYGYGPGYDYSQGSTNYGKSQRRGGHQNNYKPY

SEQ ID NO: 37972 - protein, 305 aa, Homo sapiens
  Payload ID: 7552
  Gene Symbol: HNRNPA0
  Gene Name: heterogeneous nuclear ribonucleoprotein A0
  Uniprot ID: Q13151
  ENSP ID: ENSP00000316042
MENSQLCKLFIGGLNVQTSESGLRGHFEAFGTLTDCVVVVNPQTKRSRCFGFVTYSNVEEADAAMAASPHAVDGNTVELKRAVSREDSARPGAHAKVKKLFVGGLKGDVAEGDLIEHFSQFGTVEKAEIIADKQSGKKRGFGFVYFQNHDAADKAAVVKFHPIQGHRVEVKKAVPKEDIYSGGGGGGSRSSRGGRGGRGRGGGRDQNGLSKGGGGGYNSYGGYGGGGGGGYNAYGGGGGGSSYGGSDYGNGFGGFGSYSQHQSSYGPMKSGGGGGGGGSSWGGRSNSGPYRGGYGGGGGYGGSSF

SEQ ID NO: 37973 - protein, 307 aa, Homo sapiens
  Payload ID: 7553
  Gene Symbol: HNRNPA1
  Gene Name: heterogeneous nuclear ribonucleoprotein A1
  ENSP ID: ENSP00000333504
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGIGDGYNGFGNDGSNFGGGGSYNDFGNYNNQSSNFGPMKGGNFGGRSSGPYGGGGQYFAKPRNQGGYGGSSSSSSYGSGRRF

SEQ ID NO: 37974 - protein, 372 aa, Homo sapiens
  Payload ID: 7553
  Gene Symbol: HNRNPA1
  Gene Name: heterogeneous nuclear ribonucleoprotein A1
  Uniprot ID: P09651
  ENSP ID: ENSP00000341826
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGGFGGSRGGGGYGGSGDGYNGFGNDGGYGGGGPGYSGGSRGYGSGGQGYGNQGSGYGGSGSYDSYNNGGGGGFGGGSGSNFGGGGSYNDFGNYNNQSSNFGPMKGGNFGGRSSGPYGGGGQYFAKPRNQGGYGGSSSSSSYGSGRRF

SEQ ID NO: 37975 - protein, 191 aa, Homo sapiens
  Payload ID: 7553
  Gene Symbol: HNRNPA1
  Gene Name: heterogeneous nuclear ribonucleoprotein A1
  ENSP ID: ENSP00000446486
KIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGGFGGSRGGGGYGGSGDGYNGFGNDGSNFGGGGSYNDFGNYNNQSSNFGPMKGGNFGGRSSGPYGGGGQYFAKPRNQGGYGGSSSSSSYGSGRRF

SEQ ID NO: 37976 - protein, 267 aa, Homo sapiens
  Payload ID: 7553
  Gene Symbol: HNRNPA1
  Gene Name: heterogeneous nuclear ribonucleoprotein A1
  Uniprot ID: P09651
  ENSP ID: ENSP00000447260
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGSYNDFGNYNNQSSNFGPMKGGNFGGRSSGPYGGGGQYFAKPRNQGGYGGSSSSSSYGSGRRF

SEQ ID NO: 37977 - protein, 231 aa, Homo sapiens
  Payload ID: 7553
  Gene Symbol: HNRNPA1
  Gene Name: heterogeneous nuclear ribonucleoprotein A1
  ENSP ID: ENSP00000447782
MRDSLLVAKFLGTQDLCLFLNLALSPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGG

SEQ ID NO: 37978 - protein, 145 aa, Homo sapiens
  Payload ID: 7553
  Gene Symbol: HNRNPA1
  Gene Name: heterogeneous nuclear ribonucleoprotein A1
  ENSP ID: ENSP00000448117
MSKSESPKEPEQLRKLFIGGLSFETTDESLRSHFEQWGTLTDCVDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQR

SEQ ID NO: 37979 - protein, 156 aa, Homo sapiens
  Payload ID: 7553
  Gene Symbol: HNRNPA1
  Gene Name: heterogeneous nuclear ribonucleoprotein A1
  ENSP ID: ENSP00000448229
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGFGGSRGGGGYGGSGDGYNGFGNDGSNFGGGGSYNDFGNYNNQSSN

SEQ ID NO: 37980 - protein, 320 aa, Homo sapiens
  Payload ID: 7553
  Gene Symbol: HNRNPA1
  Gene Name: heterogeneous nuclear ribonucleoprotein A1
  Uniprot ID: P09651
  ENSP ID: ENSP00000448617
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGGFGGSRGGGGYGGSGDGYNGFGNDGSNFGGGGSYNDFGNYNNQSSNFGPMKGGNFGGRSSGPYGGGGQYFAKPRNQGGYGGSSSSSSYGSGRRF

SEQ ID NO: 37981 - protein, 113 aa, Homo sapiens
  Payload ID: 7553
  Gene Symbol: HNRNPA1
  Gene Name: heterogeneous nuclear ribonucleoprotein A1
  ENSP ID: ENSP00000448917
MRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDS

SEQ ID NO: 37982 - protein, 320 aa, Homo sapiens; identical to SEQ ID NO: 37980
  Payload ID: 7553
  Gene Symbol: HNRNPA1
  Gene Name: heterogeneous nuclear ribonucleoprotein A1
  Uniprot ID: P09651
  ENSP ID: ENSP00000449913

SEQ ID NO: 37983 - protein, 320 aa, Homo sapiens
  Payload ID: 7554
  Gene Symbol: HNRNPA1L2
  Gene Name: heterogeneous nuclear ribonucleoprotein A1-like 2
  Uniprot ID: Q32P51
  ENSP ID: ENSP00000350090
MSKSASPKEPEQLRKLFIGGLSFETTDESLRSHFEQWGTLTDCVVMRDPNTKRSRGFGFVTYATVEEVDAAMNTTPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVKGHNCEVRKALPKQEMASASSSQRGRRGSGNFGGGRGDGFGGNDNFGRGGNFSGRGGFGGSCGGGGYGGSGDGYNGFGNDGSNFGGGGSYNDFGNYNNQSSNFGPMKGGNFGGRSSGPYGGGGQYFAKPQNQGGYGVSSSSSSYGSGRRF

SEQ ID NO: 37984 - protein, 353 aa, Homo sapiens
  Payload ID: 7555
  Gene Symbol: HNRNPA2B1
  Gene Name: heterogeneous nuclear ribonucleoprotein A2/B1
  Uniprot ID: P22626
  ENSP ID: ENSP00000346694
MEKTLETVPLERKKREKEQFRKLFIGGLSFETTEESLRNYYEQWGKLTDCVVMRDPASKRSRGFGFVTFSSMAEVDAAMAARPHSIDGRVVEPKRAVAREESGKPGAHVTVKKLFVGGIKEDTEEHHLRDYFEEYGKIDTIEIITDRQSGKKRGFGFVTFDDHDPVDKIVLQKYHTINGHNAEVRKALSRQEMQEVQSSRSGRGGNFGFGDSRGGGGNFGPGPGSNFRGGSDGYGSGRGFGDGYNGYGGGPGGGNFGGSPGYGGGRGGYGGGGPGYGNQGGGYGGGYDNYGGGNYGSGNYNDFGNYNQQPSNYGPMKSGNFGGSRNMGGPYGGGNYGPGGSGGSGGYGGRSRY

SEQ ID NO: 37985 - protein, 341 aa, Homo sapiens
  Payload ID: 7555
  Gene Symbol: HNRNPA2B1
  Gene Name: heterogeneous nuclear ribonucleoprotein A2/B1
  Uniprot ID: P22626
  ENSP ID: ENSP00000349101
MEREKEQFRKLFIGGLSFETTEESLRNYYEQWGKLTDCVVMRDPASKRSRGFGFVTFSSMAEVDAAMAARPHSIDGRVVEPKRAVAREESGKPGAHVTVKKLFVGGIKEDTEEHHLRDYFEEYGKIDTIEIITDRQSGKKRGFGFVTFDDHDPVDKIVLQKYHTINGHNAEVRKALSRQEMQEVQSSRSGRGGNFGFGDSRGGGGNFGPGPGSNFRGGSDGYGSGRGFGDGYNGYGGGPGGGNFGGSPGYGGGRGGYGGGGPGYGNQGGGYGGGYDNYGGGNYGSGNYNDFGNYNQQPSNYGPMKSGNFGGSRNMGGPYGGGNYGPGGSGGSGGYGGRSRY

SEQ ID NO: 37986 - protein, 353 aa, Homo sapiens; identical to SEQ ID NO: 37984
  Payload ID: 7555
  Gene Symbol: HNRNPA2B1
  Gene Name: heterogeneous nuclear ribonucleoprotein A2/B1
  Uniprot ID: P22626
  ENSP ID: ENSP00000354021

SEQ ID NO: 37987 - protein, 261 aa, Homo sapiens
  Payload ID: 7555
  Gene Symbol: HNRNPA2B1
  Gene Name: heterogeneous nuclear ribonucleoprotein A2/B1
  ENSP ID: ENSP00000478691
MEKTLETVPLERKKREKEQFRKLFIGGLSFETTEESLRNYYEQWGKLTDCVVMRDPASKRSRGFGFVTFSSMAEVDAAMAARPHSIDGRVVEPKRAVAREESGKPGAHVTVKKLFVGGIKEDTEEHHLRDYFEEYGKIDTIEIITDRQSGKKRGFGFVTFDDHDPVDKIVLQKYHTINGHNAEVRKALSRQEMQEDLEVAILEVAPVMEEEEEDMVVEDLDMATRVGATEVVMTTMEEEIMEVEITMILEIITSNLLTTVQ

SEQ ID NO: 37988 - protein, 378 aa, Homo sapiens
  Payload ID: 7556
  Gene Symbol: HNRNPA3
  Gene Name: heterogeneous nuclear ribonucleoprotein A3
  Uniprot ID: P51991
  ENSP ID: ENSP00000376309
MEVKPPPGRPQPDSGRRRRRRGEEGHDPKEPEQLRKLFIGGLSFETTDDSLREHFEKWGTLTDCVVMRDPQTKRSRGFGFVTYSCVEEVDAAMCARPHKVDGRVVEPKRAVSREDSVKPGAHLTVKKIFVGGIKEDTEEYNLRDYFEKYGKIETIEVMEDRQSGKKRGFAFVTFDDHDTVDKIVVQKYHTINGHNCEVKKALSKQEMQSAGSQRGRGGGSGNFMGRGGNFGGGGGNFGRGGNFGGRGGYGGGGGGSRGSYGGGDGGYNGFGGDGGNYGGGPGYSSRGGYGGGGPGYGNQGGGYGGGGGYDGYNEGGNFGGGNYGGGGNYNDFGNYSGQQQSNYGPMKGGSFGGRSSGSPYGGGYGSGGGSGGYGSRRF

SEQ ID NO: 37989 - protein, 115 aa, Homo sapiens
  Payload ID: 7556
  Gene Symbol: HNRNPA3
  Gene Name: heterogeneous nuclear ribonucleoprotein A3
  ENSP ID: ENSP00000400688
GHNCEVKKALSKQEMQSAGSQRGRGGGSGNFMGRGGNFGGGGGNFGRDGGYNGFGGDGNYGGGGNYNDFGNYSGQQQSNYGPMKGGSFGGRSSGSPYGGGYGSGGGSGGYGSRRF

SEQ ID NO: 37990 - protein, 356 aa, Homo sapiens
  Payload ID: 7556
  Gene Symbol: HNRNPA3
  Gene Name: heterogeneous nuclear ribonucleoprotein A3
  Uniprot ID: P51991
  ENSP ID: ENSP00000408487
MEGHDPKEPEQLRKLFIGGLSFETTDDSLREHFEKWGTLTDCVVMRDPQTKRSRGFGFVTYSCVEEVDAAMCARPHKVDGRVVEPKRAVSREDSVKPGAHLTVKKIFVGGIKEDTEEYNLRDYFEKYGKIETIEVMEDRQSGKKRGFAFVTFDDHDTVDKIVVQKYHTINGHNCEVKKALSKQEMQSAGSQRGRGGGSGNFMGRGGNFGGGGGNFGRGGNFGGRGGYGGGGGGSRGSYGGGDGGYNGFGGDGGNYGGGPGYSSRGGYGGGGPGYGNQGGGYGGGGGYDGYNEGGNFGGGNYGGGGNYNDFGNYSGQQQSNYGPMKGGSFGGRSSGSPYGGGYGSGGGSGGYGSRRF

SEQ ID NO: 37991 - protein, 378 aa, Homo sapiens; identical to SEQ ID NO: 37988
  Payload ID: 7556
  Gene Symbol: HNRNPA3
  Gene Name: heterogeneous nuclear ribonucleoprotein A3
  Uniprot ID: P51991
  ENSP ID: ENSP00000416340

SEQ ID NO: 37992 - protein, 288 aa, Homo sapiens
  Payload ID: 7557
  Gene Symbol: HNRNPC
  Gene Name: heterogeneous nuclear ribonucleoprotein C (C1/C2)
  ENSP ID: ENSP00000338095
MASNVTNKTDPRSMNSRVFIGNLNTLVVKKSDVEAIFSKYGKIVGCSVHKGFAFVQYVNERNARAAVAGEDGRMIAGQVLDINLAAEPKVNRGKAGVKRSAAEMYGSSFDLDYDFQRDYYDRMYSYPARVPPPPPIARAVVPSKRQRVSGNTSRRGKSGFNSKSGQRGSSKSGKLKGDDLQAIKKELTQIKQKVDSLLENLEKIEKEQSKQAVEMKNDKSEEEQSSSSVKKDETNVKMESEGGADDSAEEGDLLDDDDNEDRGDDQVKTTGKERKRWWRGAQGHMECL

SEQ ID NO: 37993 - protein, 290 aa, Homo sapiens [sequence omitted]

SEQ ID NO: 37994 - protein, 306 aa, Homo sapiens
  Payload ID: 7557
  Gene Symbol: HNRNPC
  Gene Name: heterogeneous nuclear ribonucleoprotein C (C1/C2)
  Uniprot ID: P07910
  ENSP ID: ENSP00000404848
MASNVTNKTDPRSMNSRVFIGNLNTLVVKKSDVEAIFSKYGKIVGCSVHKGFAFVQYVNERNARAAVAGEDGRMIAGQVLDINLAAEPKVNRGKAGVKRSAAEMYGSVTEHPSPSPLLSSSFDLDYDFQRDYYDRMYSYPARVPPPPPIARAVVPSKRQRVSGNTSRRGKSGFNSKSGQRGSSKSGKLKGDDLQAIKKELTQIKQKVDSLLENLEKIEKEQSKQAVEMKNDKSEEEQSSSSVKKDETNVKMESEGGADDSAEEGDLLDDDDNEDRGDDQLELIKDDEKEAEEGEDDRDSANGEDDS

SEQ ID NO: 37995 - protein, 293 aa, Homo sapiens
  Payload ID: 7557
  Gene Symbol: HNRNPC
  Gene Name: heterogeneous nuclear ribonucleoprotein C (C1/C2)
  Uniprot ID: P07910
  ENSP ID: ENSP00000442816
MASNVTNKTDPRSMNSRVFIGNLNTLVVKKSDVEAIFSKYGKIVGCSVHKGFAFVQYVNERNARAAVAGEDGRMIAGQVLDINLAAEPKVNRGKAGVKRSAAEMYGSSFDLDYDFQRDYYDRMYSYPARVPPPPPIARAVVPSKRQRVSGNTSRRGKSGFNSKSGQRGSSKSGKLKGDDLQAIKKELTQIKQKVDSLLENLEKIEKEQSKQAVEMKNDKSEEEQSSSSVKKDETNVKMESEGGADDSAEEGDLLDDDDNEDRGDDQLELIKDDEKEAEEGEDDRDSANGEDDS

SEQ ID NO: 37996 - protein, 126 aa, Homo sapiens
  Payload ID: 7557
  Gene Symbol: HNRNPC
  Gene Name: heterogeneous nuclear ribonucleoprotein C (C1/C2)
  ENSP ID: ENSP00000450467
MASNVTNKTDPRSMNSRVFIGNLNTLVVKKSDVEAIFSKYGKIVGCSVHKGFAFVQYVNERNARAAVAGEDGRMIAGQVLDINLAAEPKVNRGKAGVKRSAAEMYGSSFDLDYDFQRDYYDRMYSY

SEQ ID NO: 37997 - protein, 293 aa, Homo sapiens; identical to SEQ ID NO: 37995
  Payload ID: 7557
  Gene Symbol: HNRNPC
  Gene Name: heterogeneous nuclear ribonucleoprotein C (C1/C2)
  Uniprot ID: P07910
  ENSP ID: ENSP00000450544

SEQ ID NO: 37998 - protein, 288 aa, Homo sapiens; identical to SEQ ID NO: 37992
  Payload ID: 7557
  Gene Symbol: HNRNPC
  Gene Name: heterogeneous nuclear ribonucleoprotein C (C1/C2)
  ENSP ID: ENSP00000450548

SEQ ID NO: 37999 - protein, 214 aa, Homo sapiens
  Payload ID: 7557
  Gene Symbol: HNRNPC
  Gene Name: heterogeneous nuclear ribonucleoprotein C (C1/C2)
  ENSP ID: ENSP00000450601
MNINLAAEPKVNRGKAGVKRSAAEMYGSSFDLDYDFQRDYYDRMYSYPARVPPPPPIARAVVPSKRQRVSGNTSRRGKSGFNSKSGQRGSSKSGKLKGDDLQAIKKELTQIKQKVDSLLENLEKIEKEQSKQAVEMKNDKSEEEQSSSSVKKDETNVKMESEGGADDSAEEGDLLDDDDNEDRGDDQLELIKDDEKEAEEGEDDRDSANGEDDS

SEQ ID NO: 38000 - protein, 250 aa, Homo sapiens
  Payload ID: 7557
  Gene Symbol: HNRNPC
  Gene Name: heterogeneous nuclear ribonucleoprotein C (C1/C2)
  Uniprot ID: P07910
  ENSP ID: ENSP00000450629
MASNVTNKTDPRSMNSRVFIGNLNTLVVKKSDVEAIFSKYGKIVGCSVHKGFAFVQYVNERNARAAVAGEDGRMIAGQVLDINLAAEPKVNRGKAGVKRSAAEMYGSSFDLDYDFQRDYYDRMYSYPARVPPPPPIARAIKKELTQIKQKVDSLLENLEKIEKEQSKQAVEMKNDKSEEEQSSSSVKKDETNVKMESEGGADDSAEEGDLLDDDDNEDRGDDQLELIKDDEKEAEEGEDDRDSANGEDDS

SEQ ID NO: 38001 - protein, 54 aa, Homo sapiens
  Payload ID: 7557
  Gene Symbol: HNRNPC
  Gene Name: heterogeneous nuclear ribonucleoprotein C (C1/C2)
  ENSP ID: ENSP00000450669
MASNVTNKTDPRSMNSRVFIGNLNTLVVKKSDVEAIFSKYGKIVGCSVHKGFAF

SEQ ID NO: 38002 - protein, 293 aa, Homo sapiens; identical to SEQ ID NO: 37995
  Payload ID: 7557
  Gene Symbol: HNRNPC
  Gene Name: heterogeneous nuclear ribonucleoprotein C (C1/C2)
  Uniprot ID: P07910
  ENSP ID: ENSP00000450725

SEQ ID NO: 38003 - protein, 305 aa, Homo sapiens
  Payload ID: 7557
  Gene Symbol: HNRNPC
  Gene Name: heterogeneous nuclear ribonucleoprotein C (C1/C2)
  ENSP ID: ENSP00000450790
MASNVTNKTDPRSMNSRVFIGNLNTLVVKKSDVEAIFSKYGKIVGCSVHKGFAFVQYVNERNARAAVAGEDGRMIAGQVLDINLAAEPKVNRGKAGVKRSAAEMYGSVTEHPSPSPLLSSSFDLDYDFQRDYYDRMYSYPARVPPPPPIARAVVPSKRQRVSGNTSRRGKSGFNSKSGQRGSSKSGKLKGDDLQAIKKELTQIKQKVDSLLENLEKIEKEQSKQAEMKNDKSEEEQSSSSVKKDETNVKMESEGGADDSAEEGDLLDDDDNEDRGDDQLELIKDDEKEAEEGEDDRDSANGEDDS

SEQ ID NO: 38004 - protein, 293 aa, Homo sapiens; identical to SEQ ID NO: 37995
  Payload ID: 7557
  Gene Symbol: HNRNPC
  Gene Name: heterogeneous nuclear ribonucleoprotein C (C1/C2)
  Uniprot ID: P07910
  ENSP ID: ENSP00000451176

SEQ ID NO: 38005 - protein, 231 aa, Homo sapiens
  Payload ID: 7557
  Gene Symbol: HNRNPC
  Gene Name: heterogeneous nuclear ribonucleoprotein C (C1/C2)
  ENSP ID: ENSP00000451187
MASNVTNKTDPRSMNSRVFIGNLNTLVVKKSDVEAIFSKYGKIVGCSVHKGFAFVQYVNERNARAAVAGEDGRMIAGQVLDINLAAEPKVNRGKAGVKRSAAEMYGSVTEHPSPSPLLSSSFDLDYDFQRDYYDRMYSYPARVPPPPPIARAVVPSKRQRVSGNTSRRGKSGFNSKSGQRGSSKSGKLKGDDLQAIKKELTQIKQKVDSLLENLEKIEKEQSKQAAGVDQG

SEQ ID NO: 38006 - protein, 306 aa, Homo sapiens; identical to SEQ ID NO: 37994
  Payload ID: 7557
  Gene Symbol: HNRNPC
  Gene Name: heterogeneous nuclear ribonucleoprotein C (C1/C2)
  Uniprot ID: P07910
  ENSP ID: ENSP00000451291

SEQ ID NO: 38007 - protein, 121 aa, Homo sapiens
  Payload ID: 7557
  Gene Symbol: HNRNPC
  Gene Name: heterogeneous nuclear ribonucleoprotein C (C1/C2)
  ENSP ID: ENSP00000451292
MASNVTNKTDPRSMNSRVFIGNLNTLVVKKSDVEAIFSKYGKIVGCSVHKGFAFVQYVNERNARAAVAGEDGRMIAGQVLDINLAAEPKVNRGKAGVKRSAAEMYGSSFDLDYDFQRDYYD

SEQ ID NO: 38008 - protein, 226 aa, Homo sapiens
  Payload ID: 7557
  Gene Symbol: HNRNPC
  Gene Name: heterogeneous nuclear ribonucleoprotein C (C1/C2)
  Uniprot ID: P07910
  ENSP ID: ENSP00000451652
MASNVTNKTDPRSMNSRVFIGNLNTLVVKKSDVEAIFSNSSFDLDYDFQRDYYDRMYSYPARVPPPPPIARAVVPSKRQRVSGNTSRRGKSGFNSKSGQRGSSKSGKLKGDDLQAIKKELTQIKQKVDSLLENLEKIEKEQSKQAVEMKNDKSEEEQSSSSVKKDETNVKMESEGGADDSAEEGDLLDDDDNEDRGDDQLELIKDDEKEAEEGEDDRDSANGEDDS

SEQ ID NO: 38009 - protein, 292 aa, Homo sapiens
  Payload ID: 7557
  Gene Symbol: HNRNPC
  Gene Name: heterogeneous nuclear ribonucleoprotein C (C1/C2)
  ENSP ID: ENSP00000451708
MASNVTNKTDPRSMNSRVFIGNLNTLVVKKSDVEAIFSKYGKIVGCSVHKGFAFVQYVNERNARAAVAGEDGRMIAGQVLDINLAAEPKVNRGKAGVKRSAAEMYGSSFDLDYDFQRDYYDRMYSYPARVPPPPPIARAVVPSKRQRVSGNTSRRGKSGFNSKSGQRGSSKSGKLKGDDLQAIKKELTQIKQKVDSLLENLEKIEKEQSKQAEMKNDKSEEEQSSSSVKKDETNVKMESEGGADDSAEEGDLLDDDDNEDRGDDQLELIKDDEKEAEEGEDDRDSANGEDDS

SEQ ID NO: 38010 - protein, 66 aa, Homo sapiens
  Payload ID: 7557
  Gene Symbol: HNRNPC
  Gene Name: heterogeneous nuclear ribonucleoprotein C (C1/C2)
  ENSP ID: ENSP00000451892
MASNVTNKTDPRSMNSRVFIGNLNTLVVKKSDVEAIFSKYGKIVGCSVHKGFAFVQYVNERNARAA

SEQ ID NO: 38011 - protein, 262 aa, Homo sapiens
  Payload ID: 7557
  Gene Symbol: HNRNPC
  Gene Name: heterogeneous nuclear ribonucleoprotein C (C1/C2)
  ENSP ID: ENSP00000452021
MASNVTNKTDPRSMNSRVFIGNLNTLVVKKSDVEAIFSKYGKIVGCSVHKGFAFVQYVNERNARAAVAGEDGRMIAGQVLDINLAAEPKVNRGKAGVKRSAAEMYGSSFDLDYDFQRDYYDRMYSYPARVPPPPPIARAVVPSKRQRVSGNTSRRGKSGFNSKSGQRGSSKSGKLKGDDLQAIKKELTQIKQKVDSLLENLEKIEKEQSKQAVEMKNDKSEEEQSSSSVKKDETNVKMESEGGADDSAEEGDLLDDDDNEDR

SEQ ID NO: 38012 - protein, 175 aa, Homo sapiens
  Payload ID: 7557
  Gene Symbol: HNRNPC
  Gene Name: heterogeneous nuclear ribonucleoprotein C (C1/C2)
  ENSP ID: ENSP00000452185
MASNVTNKTDPRSMNSRVFIGNLNTLVVKKSDVEAIFSKYGKIVGCSVHKGFAFVQYVNERNARAAVAGEDGRMIAGQVLDINLAAEPKVNRGKAGVKRSAAEMYGSVTEHPSPSPLLSSSFDLDYDFQRDYYDRMYSYPARVPPPPPIARAVVPSKRQRVSGNTSRRGKSGFNS

SEQ ID NO: 38013 - protein, 187 aa, Homo sapiens
  Payload ID: 7557
  Gene Symbol: HNRNPC
  Gene Name: heterogeneous nuclear ribonucleoprotein C (C1/C2)
  ENSP ID: ENSP00000452213
MASNVTNKTDPRSMNSRVFIGNLNTLVVKKSDVEAIFSKYGKIVGCSVHKGFAFVQYVNERNARAAVAGEDGRMIAGQVLDINLAAEPKVNRGKAGVKRSAAEMYGSVTEHPSPSPLLSSSFDLDYDFQRDYYDRMYSYPARVPPPPPIARAVVPSKRQRVSGNTSRRGKSGFNSKSGQRGSSKSGK

SEQ ID NO: 38014 - protein, 231 aa, Homo sapiens; identical to SEQ ID NO: 38005
  Payload ID: 7557
  Gene Symbol: HNRNPC
  Gene Name: heterogeneous nuclear ribonucleoprotein C (C1/C2)
  ENSP ID: ENSP00000452214

SEQ ID NO: 38015 - protein, 306 aa, Homo sapiens; identical to SEQ ID NO: 37994
  Payload ID: 7557
  Gene Symbol: HNRNPC
  Gene Name: heterogeneous nuclear ribonucleoprotein C (C1/C2)
  Uniprot ID: P07910
  ENSP ID: ENSP00000452276

SEQ ID NO: 38016 - protein, 180 aa, Homo sapiens
  Payload ID: 7557
  Gene Symbol: HNRNPC
  Gene Name: heterogeneous nuclear ribonucleoprotein C (C1/C2)
  ENSP ID: ENSP00000452545
MYGSSFDLDYDFQRDYYDRMYSYPARVPPPPPIARAVVPSKRQRVSGNTSRRGKSGFNSKSGQRGSSKSGKLKGDDLQAIKKELTQIKQKVDSLLENLEKIEKEQSKQAVEMKNDKSEEEQSSSSVKKDETNVKMESEGGADDSAEEGDLLDDDDNEDRGDDQLELIKDDEKEAEEGEDD

SEQ ID NO: 38017 - protein, 117 aa, Homo sapiens
  Payload ID: 7557
  Gene Symbol: HNRNPC
  Gene Name: heterogeneous nuclear ribonucleoprotein C (C1/C2)
  ENSP ID: ENSP00000452573
MASNVTNKTDPRSMNSRVFIGNLNTLVVKKSDVEAIFSKYGKIVGCSVHKGFAFVQYVNERNARAAVAGEDGRMIAGQVLDINLAAEPKVNRGKAGVKRSAAEMYGSSFDLDYDFQR

SEQ ID NO: 38018 - protein, 147 aa, Homo sapiens
  Payload ID: 7557
  Gene Symbol: HNRNPC
  Gene Name: heterogeneous nuclear ribonucleoprotein C (C1/C2)
  ENSP ID: ENSP00000452599
MASNVTNKTDPRSMNSRVFIGNLNTLVVKKSDVEAIFSKYGKIVGCSVHKGFAFVQYVNERNARAAVAGEDGRMIAGQVLDINLAAEPKVNRGKAGVKRSAAEMYGSVTEHPSPSPLLSVYQETLHEGAKVASILRVDSGDLPSLES

SEQ ID NO: 38019 - protein, 293 aa, Homo sapiens
  Payload ID: 7558
  Gene Symbol: HNRNPCL1
  Gene Name: heterogeneous nuclear ribonucleoprotein C-like 1
  Uniprot ID: O60812
  ENSP ID: ENSP00000365370
MASNVTNKMDPHSMNSRVFIGNLNTLVVKKSDVEAIFSKYGKIAGCSVHKGFAFVQYDKEKNARAAVAGEDGRMIASQVVDINLAAEPKVNRGNAGVKRSAAEMYGSSFDLDYGFQRDYYDGMYSFPARVPPPPPIALAVVPSKRQRLSGNTSRRGKSGFNSKSGKRGSSKSGKLKGDDLQAIKQELTQIKQKVDSLLENLEKIEKEQSKQEVEVKNAKSEEEQSSSSMKKDETHVKMESEGGAEDSAEEGDPLDDDVNEDQGDDQLELIKDDEKEAEEGEDDRDSTNGQDDS

SEQ ID NO: 38020 - protein, 293 aa, Homo sapiens; identical to SEQ ID NO: 38019
  Payload ID: 7558
  Gene Symbol: HNRNPCL1
  Gene Name: heterogeneous nuclear ribonucleoprotein C-like 1
  Uniprot ID: O60812
  ENSP ID: ENSP00000479365

SEQ ID NO: 38021 - protein, 293 aa, Homo sapiens; identical to SEQ ID NO: 38019
  Payload ID: 7558
  Gene Symbol: HNRNPCL1
  Gene Name: heterogeneous nuclear ribonucleoprotein C-like 1
  Uniprot ID: O60812
  ENSP ID: ENSP00000488130

SEQ ID NO: 38022 - protein, 293 aa, Homo sapiens; identical to SEQ ID NO: 38019
  Payload ID: 7558
  Gene Symbol: HNRNPCL1
  Gene Name: heterogeneous nuclear ribonucleoprotein C-like 1
  Uniprot ID: O60812
  ENSP ID: ENSP00000488781

SEQ ID NO: 38023 - protein, 293 aa, Homo sapiens
  Payload ID: 7559
  Gene Symbol: HNRNPCL2
  Gene Name: heterogeneous nuclear ribonucleoprotein C-like 2
  Uniprot ID: B2RXH8
  ENSP ID: ENSP00000479203
MASNVTNKMDPHSVNSRVFIGNLNTLVVKKSDVEAIFSKYGKIAGCSVHKGFAFVQYDKEKNARAAVAGEDGRMIASQVAVINLAAEPKVNRGNAGVKRSAAEMYGSSFDLDYGFQRDYYDGMYSFPARVPPPPPIALAVVPSKRQRISGNTSRRGKSGFNSKSGKRGSSKSGKLKGDDLQAIKQELTQIKQKVDSLLENLEKIEKEQSKQEVEVKNAKSEEEQSSSSMKKDETHVKMESEGGAEDSAEEGDPLDDDDNEDQGDNQLHLIKNNEKDAEEGEDNRDSTNGQDDS

SEQ ID NO: 38024 - protein, 293 aa, Homo sapiens
  Payload ID: 7559
  Gene Symbol: HNRNPCL2
  Gene Name: heterogeneous nuclear ribonucleoprotein C-like 2
  ENSP ID: ENSP00000481869
MASNVTNKMDPHSVNSRVFIGNLNTLVVKKSDVEAIFSKYGKIAGCSVHKGFAFVQYDKEKNARAAVAGEDGRMIASQVAVINLAAEPKVNRGNAGVKRSAAEMYGSSFDLDYGFQRDYYDGMYSFPARVPPPPPIALAVVPSKHQRISGNTSRRGKSGFNSKSGKRGSSKSGKLKGDDLQAIKQELTQIKQKVDSLLENLEKIEKEQSKQEVEVKNAKSEEEQSSSSMKKDETHVKMESEGGAEDSAEEGDPLDDDDNEDQGDNQLHLIKNNEKDAEEGEDNRDSTNGQDDS

SEQ ID NO: 38025 - protein, 293 aa, Homo sapiens; identical to SEQ ID NO: 38023
  Payload ID: 7559
  Gene Symbol: HNRNPCL2
  Gene Name: Heterogeneous nuclear ribonucleoprotein C-like 2
  ENSP ID: ENSP00000488742

SEQ ID NO: 38026 - protein, 293 aa, Homo sapiens
  Payload ID: 7560
  Gene Symbol: HNRNPCL3
  Gene Name: heterogeneous nuclear ribonucleoprotein C-like 3
  Uniprot ID: B7ZW38
  ENSP ID: ENSP00000478017
MASNVTNKMDPHSMNSRVFIGNLNTLVVKKSDVEAIFSKYGKIAGCSVHKGFAFVQYDKEKNARAAVAGEDGRMIASQVVDINLAAEPKVNRGNAGVKRSAAEMYGSSFDLDYNLQRDYYGGMYSFPARVPPPPPIALAVVPSKRQRISGNTSRRGKSGFNSKSGKRGSSKSGKLKGDDLQAIKQELTQIKQKVDSLLENLEKIEKEHCKQGVEVKNAKSEEEQTSSSSKKDKTHVKMESEGGADDSVEEGDLLCDDDNEDQGDNQLELIKDDEKGAEEGEDDRDRANGQDDS

SEQ ID NO: 38027 - protein, 293 aa, Homo sapiens; identical to SEQ ID NO: 38026
  Payload ID: 7560
  Gene Symbol: HNRNPCL3
  Gene Name: Heterogeneous nuclear ribonucleoprotein C-like 3
  ENSP ID: ENSP00000488124

SEQ ID NO: 38028 - protein, 293 aa, Homo sapiens
  Payload ID: 7561
  Gene Symbol: HNRNPCL4
  Gene Name: heterogeneous nuclear ribonucleoprotein C-like 4
  ENSP ID: ENSP00000483545
MASNVTNKMDPHSMNSRVFIGNLNTLVVKKSDVEAIFSKYGKIAGCSVHKGFAFVQYDKEKNARAAVAGEDGRMIASQVVDINLAAEPKVNRGNAGVKRSAAEMYGSSFDLDYNLQRDYYGGMYSFPARVPPPPPIALAVVPSKRQRISGNTSRRGKSGFNSKSGKRGSSKSGKLKGDDLQAIKQELTQIKQKVDSLLENLEKIEKEHCKQGVEVKNAKSEEEQTSSSSKKDKTHVKMESEGGADDSVEEGDLLCDDDNEDQGDNQLELIKDDEKGVEEGEDDRDRANGQDDS

SEQ ID NO: 38029 - protein, 293 aa, Homo sapiens; identical to SEQ ID NO: 38026
  Payload ID: 7561
  Gene Symbol: HNRNPCL4
  Gene Name: heterogeneous nuclear ribonucleoprotein C-like 4
  Uniprot ID: P0DMR1
  ENSP ID: ENSP00000485450

SEQ ID NO: 38030 - protein, 293 aa, Homo sapiens; identical to SEQ ID NO: 38026
  Payload ID: 7561
  Gene Symbol: HNRNPCL4
  Gene Name: Heterogeneous nuclear ribonucleoprotein C-like 4
  ENSP ID: ENSP00000488276

SEQ ID NO: 38031 - protein, 336 aa, Homo sapiens
  Payload ID: 7562
  Gene Symbol: HNRNPD
  Gene Name: heterogeneous nuclear ribonucleoprotein D (AU-rich element RNA binding protein 1, 37kDa)
  Uniprot ID: Q14103
  ENSP ID: ENSP00000305860
MSEEQFGGDGAAAAATAAVGGSAGEQEGAMVAATQGAAAAAGSGAGTGGGTASGGTEGGSAESEGAKIDASKNEEDEGKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGGPSQNWNQGYSNYWNQGYGNYGYNSQGYGGYGGYDYTGYNNYYGYGDYSNQQSGYGKVSRRGGHQNSYKPY

SEQ ID NO: 38032 - protein, 355 aa, Homo sapiens
  Payload ID: 7562
  Gene Symbol: HNRNPD
  Gene Name: heterogeneous nuclear ribonucleoprotein D (AU-rich element RNA binding protein 1, 37kDa)
  Uniprot ID: Q14103
  ENSP ID: ENSP00000313199
MSEEQFGGDGAAAAATAAVGGSAGEQEGAMVAATQGAAAAAGSGAGTGGGTASGGTEGGSAESEGAKIDASKNEEDEGHSNSSPRHSEAATAQREEWKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGGPSQNWNQGYSNYWNQGYGNYGYNSQGYGGYGGYDYTGYNNYYGYGDYSNQQSGYGKVSRRGGHQNSYKPY

SEQ ID NO: 38033 - protein, 306 aa, Homo sapiens
  Payload ID: 7562
  Gene Symbol: HNRNPD
  Gene Name: heterogeneous nuclear ribonucleoprotein D (AU-rich element RNA binding protein 1, 37kDa)
  Uniprot ID: Q14103
  ENSP ID: ENSP00000313327
MSEEQFGGDGAAAAATAAVGGSAGEQEGAMVAATQGAAAAAGSGAGTGGGTASGGTEGGSAESEGAKIDASKNEEDEGHSNSSPRHSEAATAQREEWKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGDQQSGYGKVSRRGGHQNSYKPY

SEQ ID NO: 38034 - protein, 260 aa, Homo sapiens
  Payload ID: 7562
  Gene Symbol: HNRNPD
  Gene Name: heterogeneous nuclear ribonucleoprotein D (AU-rich element RNA binding protein 1, 37kDa)
  ENSP ID: ENSP00000420926
SRQDFFPPVVGHSNSSPRHSEAATAQREEWKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGGPSQNWNQGYSNYWNQGYGNYGYNSQGYGGYGGYDYTGYNNYY

SEQ ID NO: 38035 - protein, 221 aa, Homo sapiens
  Payload ID: 7562
  Gene Symbol: HNRNPD
  Gene Name: heterogeneous nuclear ribonucleoprotein D (AU-rich element RNA binding protein 1, 37kDa)
  ENSP ID: ENSP00000421952
MSEEQFGGDGAAAAATAAVGGSAGEQEGAMVAATQGAAAAAGSGAGTGGGTASGGTEGGSAESEGAKIDASKNEEDEGHSNSSPRHSEAATAQREEWKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNK

SEQ ID NO: 38036 - protein, 155 aa, Homo sapiens
  Payload ID: 7562
  Gene Symbol: HNRNPD
  Gene Name: heterogeneous nuclear ribonucleoprotein D (AU-rich element RNA binding protein 1, 37kDa)
  ENSP ID: ENSP00000422615
MSEEQFGGDGAAAAATAAVGGSAGEQEGAMVAATQGAAAAAGSGAGTGGGTASGGTEGGSAESEGAKIDASKNEEDEGKMFIGGLSWDTTKKDLKDYFSKFGEVVDCTLKLDPITGRSRGFGFVLFKESESVDKVMDQKEHKLNGKVIDPKRAKA

SEQ ID NO: 38037 - protein, 86 aa, Homo sapiens
  Payload ID: 7562
  Gene Symbol: HNRNPD
  Gene Name: heterogeneous nuclear ribonucleoprotein D (AU-rich element RNA binding protein 1, 37kDa)
  ENSP ID: ENSP00000424002
MSEEQFGGDGAAAAATAAVGGSAGEQEGAMVAATQGAAAAAGSGAGTGGGTASGGTEGGSAESEGAKIDASKNEEDEGSWIKKNIN

SEQ ID NO: 38038 - protein, 92 aa, Homo sapiens
  Payload ID: 7562
  Gene Symbol: HNRNPD
  Gene Name: heterogeneous nuclear ribonucleoprotein D (AU-rich element RNA binding protein 1, 37kDa)
  ENSP ID: ENSP00000425439
MSEEQFGGDGAAAAATAAGAKIDASKNEEDEGHSNSSPRHSEAATAQREEWKMFIGGLSWDTTKKDLKDYFSKFGEVVDCTLKLDPITGRSR

SEQ ID NO: 38039 - protein, 210 aa, Homo sapiens
  Payload ID: 7562
  Gene Symbol: HNRNPD
  Gene Name: heterogeneous nuclear ribonucleoprotein D (AU-rich element RNA binding protein 1, 37kDa)
  ENSP ID: ENSP00000426446
  MOD_RES (1)..(1): Any amino acid
XKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGDQQSGYGKVSRRGGHQNSYKPY

SEQ ID NO: 38040 - protein, 111 aa, Homo sapiens
  Payload ID: 7562
  Gene Symbol: HNRNPD
  Gene Name: heterogeneous nuclear ribonucleoprotein D (AU-rich element RNA binding protein 1, 37kDa)
  ENSP ID: ENSP00000426666
MFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVE

SEQ ID NO: 38041 - protein, 420 aa, Homo sapiens
  Payload ID: 7563
  Gene Symbol: HNRNPDL
  Gene Name: heterogeneous nuclear ribonucleoprotein D-like
  Uniprot ID: O14979
  ENSP ID: ENSP00000295470
MEVPPRLSHVPPPLFPSAPATLASRSLSHWRPRPPRQLAPLLPSLAPSSARQGARRAQRHVTAQQPSRLAGGAAIKGGRRRRPDLFRRHFKSSSIQRSAAAAAATRTARQHPPADSSVTMEDMNEYSNIEEFAEGSKINASKNQQDDGKMFIGGLSWDTSKKDLTEYLSRFGEVVDCTIKTDPVTGRSRGFGFVLFKDAASVDKVLELKEHKLDGKLIDPKRAKALKGKEPPKKVFVGGLSPDTSEEQIKEYFGAFGEIENIELPMDTKTNERRGFCFITYTDEEPVKKLLESRYHQIGSGKCEIKVAQPKEVYRQQQQQQKGGRGAAAGGRGGTRGRGRGQGQNWNQGFNNYYDQGYGNYNSAYGGDQNYSGYGGYDYTGYNYGNYGYGQGYADYSGQQSTYGKASRGGGNHQNNYQPY

SEQ ID NO: 38042 - protein, 301 aa, Homo sapiens
  Payload ID: 7563
  Gene Symbol: HNRNPDL
  Gene Name: heterogeneous nuclear ribonucleoprotein D-like
  Uniprot ID: O14979
  ENSP ID: ENSP00000338552
MEDMNEYSNIEEFAEGSKINASKNQQDDGKMFIGGLSWDTSKKDLTEYLSRFGEVVDCTIKTDPVTGRSRGFGFVLFKDAASVDKVLELKEHKLDGKLIDPKRAKALKGKEPPKKVFVGGLSPDTSEEQIKEYFGAFGEIENIELPMDTKTNERRGFCFITYTDEEPVKKLLESRYHQIGSGKCEIKVAQPKEVYRQQQQQQKGGRGAAAGGRGGTRGRGRGQGQNWNQGFNNYYDQGYGNYNSAYGGDQNYSGYGGYDYTGYNYGNYGYGQGYADYSGQQSTYGKASRGGGNHQNNYQPY

SEQ ID NO: 38043 - protein, 420 aa, Homo sapiens; identical to SEQ ID NO: 38041
  Payload ID: 7563
  Gene Symbol: HNRNPDL
  Gene Name: heterogeneous nuclear ribonucleoprotein D-like
  Uniprot ID: O14979
  ENSP ID: ENSP00000422040

SEQ ID NO: 38044 - protein, 301 aa, Homo sapiens; identical to SEQ ID NO: 38042
  Payload ID: 7563
  Gene Symbol: HNRNPDL
  Gene Name: heterogeneous nuclear ribonucleoprotein D-like
  Uniprot ID: O14979
  ENSP ID: ENSP00000473677

SEQ ID NO: 38045 - protein, 57 aa, Homo sapiens
  Payload ID: 7563
  Gene Symbol: HNRNPDL
  Gene Name: heterogeneous nuclear ribonucleoprotein D-like
  ENSP ID: ENSP00000478269
MEDMNEYSNIEEFAEGSKINASKNQQDDGLKILNFPWIQKQMKEEDFVLSHILMKSQ

SEQ ID NO: 38046 - protein, 363 aa, Homo sapiens
  Payload ID: 7563
  Gene Symbol: HNRNPDL
  Gene Name: heterogeneous nuclear ribonucleoprotein D-like
  ENSP ID: ENSP00000478723
MEVPPRLSHVPPPLFPSAPATLASRSLSHWRPRPPRQLAPLLPSLAPSSARQGARRAQRHVTAQQPSRLAGGAAIKGGRRRRPDLFRRHFKSSSIQRSAAAAAATRTARQHPPADSSVTMEDMNEYSNIEEFAEGSKINASKNQQDDGKMFIGGLSWDTSKKDLTEYLSRFGEVVDCTIKTDPVTGRSRGFGFVLFKDAASVDKVLELKEHKLDGKLIDPKRAKALKGKEPPKKVFVGGLSPDTSEEQIKEYFGAFGEIENIELPMDTKTNERRGFCFITYTDEEPVKKLLESRYHQIGSGKCEIKVAQPKEVYRQQQQQQKGGRGAAAGGRGGTRGRGRGQQSTYGKASRGGGNHQNNYQPY

SEQ ID NO: 38047 - protein, 301 aa, Homo sapiens; identical to SEQ ID NO: 38042
  Payload ID: 7563
  Gene Symbol: HNRNPDL
  Gene Name: heterogeneous nuclear ribonucleoprotein D-like
  Uniprot ID: O14979
  ENSP ID: ENSP00000480156

SEQ ID NO: 38048 - protein, 420 aa, Homo sapiens; identical to SEQ ID NO: 38041
  Payload ID: 7563
  Gene Symbol: HNRNPDL
  Gene Name: heterogeneous nuclear ribonucleoprotein D-like
  Uniprot ID: O14979
  ENSP ID: ENSP00000483254

SEQ ID NO: 38049 - protein, 301 aa, Homo sapiens; identical to SEQ ID NO: 38042
  Payload ID: 7563
  Gene Symbol: HNRNPDL
  Gene Name: heterogeneous nuclear ribonucleoprotein D-like
  Uniprot ID: O14979
  ENSP ID: ENSP00000485954

SEQ ID NO: 38050 - protein, 301 aa, Homo sapiens; identical to SEQ ID NO: 38042
  Payload ID: 7563
  Gene Symbol: HNRNPDL
  Gene Name: heterogeneous nuclear ribonucleoprotein D-like
  Uniprot ID: O14979
  ENSP ID: ENSP00000486452

SEQ ID NO: 38051 - protein, 415 aa, Homo sapiens
  Payload ID: 7564
  Gene Symbol: HNRNPF
  Gene Name: heterogeneous nuclear ribonucleoprotein F
  Uniprot ID: P52597
  ENSP ID: ENSP00000338477
MMLGPEGGEGFVVKLRGLPWSCSVEDVQNFLSDCTIHDGAAGVHFIYTREGRQSGEAFVELGSEDDVKMALKKDRESMGHRYIEVFKSHRTEMDWVLKHSGPNSADSANDGFVRLRGLPFGCTKEEIVQFFSGLEIVPNGITLPVDPEGKITGEAFVQFASQELAEKALGKHKERIGHRYIEVFKSSQEEVRSYSDPPLKFMSVQRPGPYDRPGTARRYIGIVKQAGLERMRPGAYSTGYGGYEEYSGLSDGYGFTTDLFGRDLSYCLSGMYDHRYGDSEFTVQSTTGHCVHMRGLPYKATENDIYNFFSPLNPVRVHIEIGPDGRVTGEADVEFATHEEAVAAMSKDRANMQHRYIELFLNSTTGASNGAYSSQVMQGMGVSAAQATYSGLESQSVSGCYGAGYSGQNSMGGYD

SEQ ID NO: 38052 - protein, 415 aa, Homo sapiens; identical to SEQ ID NO: 38051
  Payload ID: 7564
  Gene Symbol: HNRNPF
  Gene Name: heterogeneous nuclear ribonucleoprotein F
  Uniprot ID: P52597
  ENSP ID: ENSP00000348345

SEQ ID NO: 38053 - protein, 415 aa, Homo sapiens; identical to SEQ ID NO: 38051
  Payload ID: 7564
  Gene Symbol: HNRNPF
  Gene Name: heterogeneous nuclear ribonucleoprotein F
  Uniprot ID: P52597
  ENSP ID: ENSP00000349573

SEQ ID NO: 38054 - protein, 415 aa, Homo sapiens; identical to SEQ ID NO: 38051
  Payload ID: 7564
  Gene Symbol: HNRNPF
  Gene Name: heterogeneous nuclear ribonucleoprotein F
  Uniprot ID: P52597
  ENSP ID: ENSP00000400433

SEQ ID NO: 38055 - protein, 415 aa, Homo sapiens; identical to SEQ ID NO: 38051
  Payload ID: 7564
  Gene Symbol: HNRNPF
  Gene Name: heterogeneous nuclear ribonucleoprotein F
  Uniprot ID: P52597
  ENSP ID: ENSP00000438061

SEQ ID NO: 38056 - protein, 472 aa, Homo sapiens
  Payload ID: 7565
  Gene Symbol: HNRNPH1
  Gene Name: heterogeneous nuclear ribonucleoprotein H1 (H)
  ENSP ID: ENSP00000327539
MMLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGLEIVPNGITLPVDFQGRSTGEAFVQFASQEIAEKALKKHKERIGHRYIEIFKSSRAEVRTHYDPPRKLMAMQRPGPYDRPGAGRGYNSIGRGAGFERMRRGAYGGGYGGYDDYNGYNDGYGFGSDRFGRDLNYCFSGMSDHRYGDGGSTFQSTTGHCVHMRGLPYRATENDIYNFFSPLNPVRVHIEIGPDGRVTGEADVEFATHEDAVAAMSKDKANMQHRYVELFLNSTAGASGGAYEHRYVELFLNSTAGASGGAYGSQMMGGMGLSNQSSYGGPASQQLSGGYGGGYGGQSSMSGYGNQGAVNSSYYSSGSRASMGVNGMGGLSSMSSMSGGWGM

SEQ ID NO: 38057 - protein, 449 aa, Homo sapiens
  Payload ID: 7565
  Gene Symbol: HNRNPH1
  Gene Name: heterogeneous nuclear ribonucleoprotein H1 (H)
  Uniprot ID: P31943
  ENSP ID: ENSP00000349168
MMLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGLEIVPNGITLPVDFQGRSTGEAFVQFASQEIAEKALKKHKERIGHRYIEIFKSSRAEVRTHYDPPRKLMAMQRPGPYDRPGAGRGYNSIGRGAGFERMRRGAYGGGYGGYDDYNGYNDGYGFGSDRFGRDLNYCFSGMSDHRYGDGGSTFQSTTGHCVHMRGLPYRATENDIYNFFSPLNPVRVHIEIGPDGRVTGEADVEFATHEDAVAAMSKDKANMQHRYVELFLNSTAGASGGAYEHRYVELFLNSTAGASGGAYGSQMMGGMGLSNQSSYGGPASQQLSGGYGGGYGGQSSMSGYDQVLQENSSDFQSNIA

SEQ ID NO: 38058 - protein, 449 aa, Homo sapiens; identical to SEQ ID NO: 38057
  Payload ID: 7565
  Gene Symbol: HNRNPH1
  Gene Name: heterogeneous nuclear ribonucleoprotein H1 (H)
  Uniprot ID: P31943
  ENSP ID: ENSP00000377082

SEQ ID NO: 38059 - protein, 449 aa, Homo sapiens; identical to SEQ ID NO: 38057
  Payload ID: 7565
  Gene Symbol: HNRNPH1
  Gene Name: heterogeneous nuclear ribonucleoprotein H1 (H)
  Uniprot ID: P31943
  ENSP ID: ENSP00000397797

SEQ ID NO: 38060 - protein, 171 aa, Homo sapiens
  Payload ID: 7565
  Gene Symbol: HNRNPH1
  Gene Name: heterogeneous nuclear ribonucleoprotein H1 (H)
  ENSP ID: ENSP00000420850
MMLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGILKSLRAVELKLELIMIHHESLWPCSGQVLMTDLGLVE

SEQ ID NO: 38061 - protein, 130 aa, Homo sapiens
  Payload ID: 7565
  Gene Symbol: HNRNPH1
  Gene Name: heterogeneous nuclear ribonucleoprotein H1 (H)
  ENSP ID: ENSP00000421695
MMLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQF

SEQ ID NO: 38062 - protein, 40 aa, Homo sapiens
  Payload ID: 7565
  Gene Symbol: HNRNPH1
  Gene Name: heterogeneous nuclear ribonucleoprotein H1 (H)
  ENSP ID: ENSP00000422955
MMLGTEGGEGFVVKVRGLPWSCSADEVQRFFSALVTESDL

SEQ ID NO: 38063 - protein, 161 aa, Homo sapiens
  Payload ID: 7565
  Gene Symbol: HNRNPH1
  Gene Name: heterogeneous nuclear ribonucleoprotein H1 (H)
  ENSP ID: ENSP00000423140
MMLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGILKSLRAVELKLELIMIHHESLWPCSGQ

SEQ ID NO: 38064 - protein, 212 aa, Homo sapiens
  Payload ID: 7565
  Gene Symbol: HNRNPH1
  Gene Name: heterogeneous nuclear ribonucleoprotein H1 (H)
  ENSP ID: ENSP00000424087
MMLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGLEIVPNGITLPVDFQGRSTGEAFVQFASQEIAEKALKKHKERIGHRYIEIFKSSRAEVRTHYDPPRKLMAMQRPGPYDR

SEQ ID NO: 38065 - protein, 84 aa, Homo sapiens
  Payload ID: 7565
  Gene Symbol: HNRNPH1
  Gene Name: heterogeneous nuclear ribonucleoprotein H1 (H)
  ENSP ID: ENSP00000425343
MMLGTEGGEGFVVKVRGLPWSCSADEVQRFFSDCKIQNGAQGIRFIYTREGRPSGEAFVELESEDEVKLALKKDRETMGHRYVE

SEQ ID NO: 38066 - protein, 172 aa, Homo sapiens
  Payload ID: 7565
  Gene Symbol: HNRNPH1
  Gene Name: heterogeneous nuclear ribonucleoprotein H1 (H)
  ENSP ID: ENSP00000425732
MMLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGILKSLRAVELKLELIMIHHESLWPCSGQVLMTDLGLVEG

SEQ ID NO: 38067 - protein, 184 aa, Homo sapiens
  Payload ID: 7565
  Gene Symbol: HNRNPH1
  Gene Name: heterogeneous nuclear ribonucleoprotein H1 (H)
  ENSP ID: ENSP00000425851
MMLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGILKSLRAVELKLELIMIHHESLWPCSGQVLMTDLGLVEGITALAEELALRG

SEQ ID NO: 38068 - protein, 429 aa, Homo sapiens
  Payload ID: 7565
  Gene Symbol: HNRNPH1
  Gene Name: heterogeneous nuclear ribonucleoprotein H1 (H)
  ENSP ID: ENSP00000426275
MMLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGLEIVPNGITLPVDFQGRSTGEAFVQFASQEIAEKALKKHKERIGHRYIEIFKSSRAEVRTHYDPPRKLMAMQRPGPYDRPGAGRGYNSIGRGAGFERMRRGAYGGGYGGYDDYNGYNDGYGFGSDRFGRDLNYCFSGMSDHRYGDGGSTFQSTTGHCVHMRGLPYRATENDIYNFFSPLNPVRVHIEIGPDGRVTGEADVEFATHEDAVAAMSKDKANMQHRYVELFLNSTAGASGGAYGSQMLGGMGLSNQSSYGGPASQQLSGGYGGGYGGQSSMSGYDQVLQENSSDFQSNIA

SEQ ID NO: 38069 - protein, 163 aa, Homo sapiens
  Payload ID: 7565
  Gene Symbol: HNRNPH1
  Gene Name: heterogeneous nuclear ribonucleoprotein H1 (H)
  ENSP ID: ENSP00000426518
MMLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGLEIVPNGITLPVDFQGRSTGEAFVQFASQE

SEQ ID NO: 38070 - protein, 49 aa, Homo sapiens
  Payload ID: 7565
  Gene Symbol: HNRNPH1
  Gene Name: heterogeneous nuclear ribonucleoprotein H1 (H)
  ENSP ID: ENSP00000426726
MMLGTEGGEGFVVKVRGLPWSCSADEVQRFFSDCKIQNGAQGIRFIYTR

SEQ ID NO: 38071 - protein, 40 aa, Homo sapiens; identical to SEQ ID NO: 38062
  Payload ID: 7565
  Gene Symbol: HNRNPH1
  Gene Name: heterogeneous nuclear ribonucleoprotein H1 (H)
  ENSP ID: ENSP00000427351

SEQ ID NO: 38072 - protein, 168 aa, Homo sapiens
  Payload ID: 7565
  Gene Symbol: HNRNPH1
  Gene Name: heterogeneous nuclear ribonucleoprotein H1 (H)
  ENSP ID: ENSP00000427388
MMLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGLEIVPNGITLPVDFQGRSTGEAFVQFASQEIAEKA

SEQ ID NO: 38073 - protein, 164 aa, Homo sapiens
  Payload ID: 7565
  Gene Symbol: HNRNPH1
  Gene Name: heterogeneous nuclear ribonucleoprotein H1 (H)
  ENSP ID: ENSP00000427408
MMLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGMSDHRYGDGGSTFQSTTGHCVHMRGLPYRAT

SEQ ID NO: 38074 - protein, 131 aa, Homo sapiens
  Payload ID: 7565
  Gene Symbol: HNRNPH1
  Gene Name: heterogeneous nuclear ribonucleoprotein H1 (H)
  ENSP ID: ENSP00000427845
SGEAFVELESEDEVKLALKKDRETMGHRYVEVFKSNNVEMDWVLKHTGPNSPDTANDGFVRLRGLPFGCSKEEIVQFFSGILKSLRAVELKLELIMIHHESLWPCSGQVLMTDLGLVEGITALAEELALRG

SEQ ID NO: 38075 - protein, 166 aa, Homo sapiens
  Payload ID: 7565
  Gene Symbol: HNRNPH1
  Gene Name: heterogeneous nuclear ribonucleoprotein H1 (H)
  ENSP ID: ENSP00000427986
MMLGTEGGEGFVVKVRGLPWSCSADEVQRFFSDCKIQNGAQGIRFIYTREGRPSGEAFVELESEDEVKLALKKDRETMGHRYVEGLEIVPNGITLPVDFQGRSTGEAFVQFASQEIAEKALKKHKERIGHRYIEIFKSSRAEVRTHYDPPRKLMAMQRPGPYDRPG

SEQ ID NO: 38076 - protein, 277 aa, Homo sapiens
  Payload ID: 7565
  Gene Symbol: HNRNPH1
  Gene Name: heterogeneous nuclear ribonucleoprotein H1 (H)
  ENSP ID: ENSP00000428620
  MOD_RES (1)..(1): Any amino acid
XALYGLEDFPLDVARKKLFSSSQGRSTGEAFVQFASQEIAEKALKKHKERIGHRYIEIFKSSRAEVRTHYDPPRKLMAMQRPGPYDRPGAGRGYNSIGRGAGFERMRRGAYGGGYGGYDDYNGYNDGYGFGSDRFGRDLNYCFSGMSDHRYGDGGSTFQSTTGHCVHMRGLPYRATENDIYNFFSPLNPVRVHIEIGPDGRVTGEADVEFATHEDAVAAMSKDKANMQHRYVELFLNSTAGASGGAYEHRYVELFLNSTAGASGGAYGSQMMGGMGL

SEQ ID NO: 38077 - protein, 28 aa, Homo sapiens
  Payload ID: 7565
  Gene Symbol: HNRNPH1
  Gene Name: heterogeneous nuclear ribonucleoprotein H1 (H)
  ENSP ID: ENSP00000429179
MMLGTEGGEGFVVKVRGLPWSCSADEVQ

SEQ ID NO: 38078 - protein, 194 aa, Homo sapiens
  Payload ID: 7565
  Gene Symbol: HNRNPH1
  Gene Name: heterogeneous nuclear ribonucleoprotein H1 (H)
  ENSP ID: ENSP00000429270
SRAEVRTHYDPPRKLMAMQRPGPYDRPGAGRGYNSIGRGAGFERMRRGAYGGGYGGYDDYNGYNDGYGFGSDRFGRDLNYCFSGMSDHRYGDGGSTFQSTTGHCVHMRGLPYRATENDIYNFFSPLNPVRVHIEIGPDGRVTGEADVEFATHEDAVAAMSKDKANMQHRYVELFLNSTAGASGGAYGSQMMGGM

SEQ ID NO: 38079 - protein, 185 aa, Homo sapiens
  Payload ID: 7565
  Gene Symbol: HNRNPH1
  Gene Name: heterogeneous nuclear ribonucleoprotein H1 (H)
  ENSP ID: ENSP00000429481
DYNGYNDGYGFGSDRFGRDLNYCFSGMSDHRYGDGGSTFQSTTGHCVHMRGLPYRATENDIYNFFSPLNPVRVHIEIGPDGRVTGEADVEFATHEDAVAAMSKDKANMQHRYVELFLNSTAGASGGAYGSQMLGGMGLSNQSSYGGPASQQLSGGYGGGYGGQSSMSGYDQVLQENSSDFQSNIA

SEQ ID NO: 38080 - protein, 115 aa, Homo sapiens
  Payload ID: 7565
  Gene Symbol: HNRNPH1
  Gene Name: heterogeneous nuclear ribonucleoprotein H1 (H)
  ENSP ID: ENSP00000429661
MMLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRL

SEQ ID NO: 38081 - protein, 117 aa, Homo sapiens
  Payload ID: 7565
  Gene Symbol: HNRNPH1
  Gene Name: heterogeneous nuclear ribonucleoprotein H1 (H)
  ENSP ID: ENSP00000429673
  MOD_RES (1)..(1): Any amino acid
XADVEFATHEDAVAAMSKDKANMQHRYVELFLNSTAGASGEHRYVELFLNSTAGASGGAYGSQMMGGMGLSNQSSYGGPASQQLSGGYGGGYGGQSSMSGYDQVLQENSSDFQSNIA

SEQ ID NO: 38082 - protein, 100 aa, Homo sapiens
  Payload ID: 7565
  Gene Symbol: HNRNPH1
  Gene Name: heterogeneous nuclear ribonucleoprotein H1 (H)
  ENSP ID: ENSP00000430156
MGHRYVEVFKSNNVEMDWVLKHTGPNSPDTANDGFVRLRGLPFGCSKEEIVQFFSGLEIVPNGITLPVDFQGRSTGEAFVQFASQEIAEKALKKHKERIG

SEQ ID NO: 38083 - protein, 48 aa, Homo sapiens
  Payload ID: 7565
  Gene Symbol: HNRNPH1
  Gene Name: heterogeneous nuclear ribonucleoprotein H1 (H)
  ENSP ID: ENSP00000430445
  MOD_RES (1)..(1): Any amino acid
XAGASGGAYGSQMMGGMGLCKYPNQSSYGGPASQQLSGGYGGGYGGQS

SEQ ID NO: 38084 - protein, 155 aa, Homo sapiens
  Payload ID: 7565
  Gene Symbol: HNRNPH1
  Gene Name: heterogeneous nuclear ribonucleoprotein H1 (H)
  ENSP ID: ENSP00000430970
MMLGTEGGEGFVVKVRGLPWSCSADEVQRFFSVFKSNNVEMDWVLKHTGPNSPDTANDGFVRLRGLPFGCSKEEIVQFFSGLEIVPNGITLPVDFQGRSTGEAFVQFASQEIAEKALKKHKERIGHRYIEIFKSSRAEVRTHYDPPRKLMAMQRP

SEQ ID NO: 38085 - protein, 40 aa, Homo sapiens; identical to SEQ ID NO: 38062
  Payload ID: 7565
  Gene Symbol: HNRNPH1
  Gene Name: heterogeneous nuclear ribonucleoprotein H1 (H)
  ENSP ID: ENSP00000486889

SEQ ID NO: 38086 - protein, 449 aa, Homo sapiens
  Payload ID: 7566
  Gene Symbol: HNRNPH2
  Gene Name: heterogeneous nuclear ribonucleoprotein H2 (H')
  Uniprot ID: P55795
  ENSP ID: ENSP00000361927
MMLSTEGREGFVVKVRGLPWSCSADEVMRFFSDCKIQNGTSGIRFIYTREGRPSGEAFVELESEEEVKLALKKDRETMGHRYVEVFKSNSVEMDWVLKHTGPNSPDTANDGFVRLRGLPFGCSKEEIVQFFSGLEIVPNGMTLPVDFQGRSTGEAFVQFASQEIAEKALKKHKERIGHRYIEIFKSSRAEVRTHYDPPRKLMAMQRPGPYDRPGAGRGYNSIGRGAGFERMRRGAYGGGYGGYDDYGGYNDGYGFGSDRFGRDLNYCFSGMSDHRYGDGGSSFQSTTGHCVHMRGLPYRATENDIYNFFSPLNPMRVHIEIGPDGRVTGEADVEFATHEDAVAAMAKDKANMQHRYVELFLNSTAGTSGGAYDHSYVELFLNSTAGASGGAYGSQMMGGMGLSNQSSYGGPASQQLSGGYGGGYGGQSSMSGYDQVLQENSSDYQSNLA

SEQ ID NO: 38087 - protein, 346 aa, Homo sapiens
  Payload ID: 7567
  Gene Symbol: HNRNPH3
  Gene Name: heterogeneous nuclear ribonucleoprotein H3 (2H9)
  Uniprot ID: P31942
  ENSP ID: ENSP00000265866
MDWVMKHNGPNDASDGTVRLRGLPFGCSKEEIVQFFQGLEIVPNGITLTMDYQGRSTGEAFVQFASKEIAENALGKHKERIGHRYIEIFRSSRSEIKGFYDPPRRLLGQRPGPYDRPIGGRGGYYGAGRGSMYDRMRRGGDGYDGGYGGFDDYGGYNNYGYGNDGFDDRMRDGRGMGGHGYGGAGDASSGFHGGHFVHMRGLPFRATENDIANFFSPLNPIRVHIDIGADGRATGEADVEFVTHEDAVAAMSKDKNNMQHRYIELFLNSTPGGGSGMGGSGMGGYGRDGMDNQGGYGSVGRMGMGNNYSGGYGTPDGLGGYGRGGGGSGGYYGQGGMSGGGWRGMY

SEQ ID NO: 38088 - protein, 331 aa, Homo sapiens
  Payload ID: 7567
  Gene Symbol: HNRNPH3
  Gene Name: heterogeneous nuclear ribonucleoprotein H3 (2H9)
  Uniprot ID: P31942
  ENSP ID: ENSP00000346726
MDWVMKHNGPNDASDGTVRLRGLPFGCSKEEIVQFFQGLEIVPNGITLTMDYQGRSTGEAFVQFASKEIAENALGKHKERIGHRYIEIFRSSRSEIKGFYDPPRRLLGQRPGPYDRPIGGRGGYYGAGRGSYGGFDDYGGYNNYGYGNDGFDDRMRDGRGMGGHGYGGAGDASSGFHGGHFVHMRGLPFRATENDIANFFSPLNPIRVHIDIGADGRATGEADVEFVTHEDAVAAMSKDKNNMQHRYIELFLNSTPGGGSGMGGSGMGGYGRDGMDNQGGYGSVGRMGMGNNYSGGYGTPDGLGGYGRGGGGSGGYYGQGGMSGGGWRGMY

SEQ ID NO: 38089 - protein, 463 aa, Homo sapiens
  Payload ID: 7568
  Gene Symbol: HNRNPK
  Gene Name: heterogeneous nuclear ribonucleoprotein K
  Uniprot ID: P61978
  ENSP ID: ENSP00000317788
METEQPEETFPNTETNGEFGKRPAEDMEEEQAFKRSRNTDEMVELRILLQSKNAGAVIGKGGKNIKALRTDYNASVSVPDSSGPERILSISADIETIGEILKKIIPTLEEGLQLPSPTATSQLPLESDAVECLNYQHYKGSDFDCELRLLIHQSLAGGIIGVKGAKIKELRENTQTTIKLFQECCPHSTDRVVLIGGKPDRVVECIKIILDLISESPIKGRAQPYDPNFYDETYDYGGFTMMFDDRRGRPVGFPMRGRGGFDRMPPGRGGRPMPPSRRDYDDMSPRRGPPPPPPGRGGRGGSRARNLPLPPPPPPRGGDLMAYDRRGRPGDRYDGMVGFSADETWDSAIDTWSPSEWQMAYEPQGGSGYDYSYAGGRGSYGDLGGPIITTQVTIPKDLAGSIIGKGGQRIKQIRHESGASIKIDEPLEGSEDRIITITGTQDQIQNAQYLLQNSVKQYSGKFF

SEQ ID NO: 38090 - protein, 463 aa, Homo sapiens; identical to SEQ ID NO: 38089
  Payload ID: 7568
  Gene Symbol: HNRNPK
  Gene Name: heterogeneous nuclear ribonucleoprotein K
  Uniprot ID: P61978
  ENSP ID: ENSP00000353552

SEQ ID NO: 38091 - protein, 464 aa, Homo sapiens
  Payload ID: 7568
  Gene Symbol: HNRNPK
  Gene Name: heterogeneous nuclear ribonucleoprotein K
  Uniprot ID: P61978
  ENSP ID: ENSP00000365439
METEQPEETFPNTETNGEFGKRPAEDMEEEQAFKRSRNTDEMVELRILLQSKNAGAVIGKGGKNIKALRTDYNASVSVPDSSGPERILSISADIETIGEILKKIIPTLEEGLQLPSPTATSQLPLESDAVECLNYQHYKGSDFDCELRLLIHQSLAGGIIGVKGAKIKELRENTQTTIKLFQECCPHSTDRVVLIGGKPDRVVECIKIILDLISESPIKGRAQPYDPNFYDETYDYGGFTMMFDDRRGRPVGFPMRGRGGFDRMPPGRGGRPMPPSRRDYDDMSPRRGPPPPPPGRGGRGGSRARNLPLPPPPPPRGGDLMAYDRRGRPGDRYDGMVGFSADETWDSAIDTWSPSEWQMAYEPQGGSGYDYSYAGGRGSYGDLGGPIITTQVTIPKDLAGSIIGKGGQRIKQIRHESGASIKIDEPLEGSEDRIITITGTQDQIQNAQYLLQNSVKQYADVEGF

SEQ ID NO: 38092 - protein, 464 aa, Homo sapiens; identical to SEQ ID NO: 38091
  Payload ID: 7568
  Gene Symbol: HNRNPK
  Gene Name: heterogeneous nuclear ribonucleoprotein K
  Uniprot ID: P61978
  ENSP ID: ENSP00000365458

SEQ ID NO: 38093 - protein, 379 aa, Homo sapiens
  Payload ID: 7568
  Gene Symbol: HNRNPK
  Gene Name: heterogeneous nuclear ribonucleoprotein K
  ENSP ID: ENSP00000409456
METEQPEETFPNTETNGEFGKRPAEDMEEEQAFKRSRNTDEMVELRILLQSKNAGAVIGKGGKNIKALRTDYNASVSVPDSSGPERILSISADIETIGEILKKIIPTLEEYQHYKGSDFDCELRLLIHQSLAGGIIGVKGAKIKELRENTQTTIKLFQECCPHSTDRVVLIGGKPDRVVECIKIILDLISESPIKGRAQPYDPNFYDETYDYGGFTMMFDDRRGRPVGFPMRGRGGFDRMPPGRGGRPMPPSRRDYDDMSPRRGPPPPPPGRGGRGGSRARNLPLPPPPPPRGGDLMAYDRRGRPGDRYDGMVGFSADETWDSAIDTWSPSEWQMAYEPQGGSGYDYSYAGGRGSYGDLGGPIITTQVTIPKDLAGSII

SEQ ID NO: 38094 - protein, 100 aa, Homo sapiens
  Payload ID: 7568
  Gene Symbol: HNRNPK
  Gene Name: heterogeneous nuclear ribonucleoprotein K
  ENSP ID: ENSP00000473957
  MOD_RES (1)..(1): Any amino acid
XQMAYEPQGGSGYDYSYAGGRGSYGDLGGPIITTQVTIPKDLAGSIIGKGGQRIKQIRHESGASIKIDEPLEGSEDRIITITGTQDQIQNAQYLLQNRSV

SEQ ID NO: 38095 - protein, 77 aa, Homo sapiens
  Payload ID: 7568
  Gene Symbol: HNRNPK
  Gene Name: heterogeneous nuclear ribonucleoprotein K
  ENSP ID: ENSP00000475098
METEQPEETFPNTETNGEFGKRPAEDMEEEQAFKRSRNTDEMVELRILLQSKNAGAVIGKGGKNIKALRTDHIEYQC

SEQ ID NO: 38096 - protein, 589 aa, Homo sapiens
  Payload ID: 7569
  Gene Symbol: HNRNPL
  Gene Name: heterogeneous nuclear ribonucleoprotein L
  Uniprot ID: P14866
  ENSP ID: ENSP00000221419
MSRRLLPRAEKRRRRLEQRQQPDEQRRRSGAMVKMAAAGGGGGGGRYYGGGSEGGRAPKRLKTDNAGDQHGGGGGGGGGAGAAGGGGGGENYDDPHKTPASPVVHIRGLIDGVVEADLVEALQEFGPISYVVVMPKKRQALVEFEDVLGACNAVNYAADNQIYIAGHPAFVNYSTSQKISRPGDSDDSRSVNSVLLFTILNPIYSITTDVLYTICNPCGPVQRIVIFRKNGVQAMVEFDSVQSAQRAKASLNGADIYSGCCTLKIEYAKPTRLNVFKNDQDTWDYTNPNLSGQGDPGSNPNKRQRQPPLLGDHPAEYGGPHGGYHSHYHDEGYGPPPPHYEGRRMGPPVGGHRRGPSRYGPQYGHPPPPPPPPEYGPHADSPVLMVYGLDQSKMNCDRVFNVFCLYGNVEKVKFMKSKPGAAMVEMADGYAVDRAITHLNNNFMFGQKLNVCVSKQPAIMPGQSYGLEDGSCSYKDFSESRNNRFSTPEQAAKNRIQHPSNVLHFFNAPLEVTEENFFEICDELGVKRPSSVKVFSGKSERSSSGLLEWESKSDALETLGFLNHYQMKNPNGPYPYTLKLCFSTAQHAS

SEQ ID NO: 38097 - protein, 179 aa, Homo sapiens
  Payload ID: 7569
  Gene Symbol: HNRNPL
  Gene Name: heterogeneous nuclear ribonucleoprotein L
  ENSP ID: ENSP00000373401
MPKKRQALVEFEDVLGACNAVNYAADNQIYIAGHPAFVNYSTSQKISRPGDSDDSRSVNSVLLFTILNPIYSITTDVLYTICNPCGPVQRIVIFRKNGVQAMVEFDSVQSAQRAKASLNGADIYSGCCTLKIEYAKPTRLNVFKNDQDTWDYTNPNLSGQGSQCMFDGTPSFRTVLTHC

SEQ ID NO: 38098 - protein, 530 aa, Homo sapiens
  Payload ID: 7569
  Gene Symbol: HNRNPL
  Gene Name: heterogeneous nuclear ribonucleoprotein L
  ENSP ID: ENSP00000469349
  MOD_RES (1)..(1): Any amino acid
XCCTGRLVGGHPLQGRGQDLLWCSEGSSCQENYDDPHKTPASPVVHIRGLIDGVVEADLVEALQEFGPISYVVVMPKKRQALVEFEDVLGACNAVNYAADNQIYIAGHPAFVNYSTSQKISRPGDSDDSRSVNSVLLFTILNPIYSITTDVLYTICNPCGPVQRIVIFRKNGVQAMVEFDSVQSAQRAKASLNGADIYSGCCTLKIEYAKPTRLNVFKNDQDTWDYTNPNLSGQGDPGSNPNKRQRQPPLLGDHPAEYGGPHGGYHSHYHDEGYGPPPPHYEGRRMGPPVGGHRRGPSRYGPQYGHPPPPPPPPEYGPHADSPVLMVYGLDQSKMNCDRVFNVFCLYGNVEKVKFMKSKPGAAMVEMADGYAVDRAITHLNNNFMFGQKLNVCVSKQPAIMPGQSYGLEDGSCSYKDFSESRNNRFSTPEQAAKNRIQHPSNVLHFFNAPLEVTEENFFEICDELGVKRPSSVKVFSGKSERSSSGLLEWESKSDALETLGFLNHYQMKNPNGPYPYTLKLCFSTAQHAS

SEQ ID NO: 38099 - protein, 198 aa, Homo sapiens
  Payload ID: 7569
  Gene Symbol: HNRNPL
  Gene Name: heterogeneous nuclear ribonucleoprotein L
  ENSP ID: ENSP00000469913
  MOD_RES (1)..(1): Any amino acid
XEKRRRRLEQRQQPDEQRRRSGAMENYDDPHKTPASPVVHIRGLIDGVVEADLVEALQEFGPISYVVVMPKKRQALVEFEDVLGACNAVNYAADNQIYIAGHPAFVNYSTSQKISRPGDSDDSRSVNSVLLFTILNPIYSITTDVLYTICNPCGPVQRIVIFRKNGVQAMVEFDSVQSAQRAKASLNGADIYSGCCTL

SEQ ID NO: 38100 - protein, 456 aa, Homo sapiens
  Payload ID: 7569
  Gene Symbol: HNRNPL
  Gene Name: heterogeneous nuclear ribonucleoprotein L
  Uniprot ID: P14866
  ENSP ID: ENSP00000470231
MPKKRQALVEFEDVLGACNAVNYAADNQIYIAGHPAFVNYSTSQKISRPGDSDDSRSVNSVLLFTILNPIYSITTDVLYTICNPCGPVQRIVIFRKNGVQAMVEFDSVQSAQRAKASLNGADIYSGCCTLKIEYAKPTRLNVFKNDQDTWDYTNPNLSGQGDPGSNPNKRQRQPPLLGDHPAEYGGPHGGYHSHYHDEGYGPPPPHYEGRRMGPPVGGHRRGPSRYGPQYGHPPPPPPPPEYGPHADSPVLMVYGLDQSKMNCDRVFNVFCLYGNVEKVKFMKSKPGAAMVEMADGYAVDRAITHLNNNFMFGQKLNVCVSKQPAIMPGQSYGLEDGSCSYKDFSESRNNRFSTPEQAAKNRIQHPSNVLHFFNAPLEVTEENFFEICDELGVKRPSSVKVFSGKSERSSSGLLEWESKSDALETLGFLNHYQMKNPNGPYPYTLKLCFSTAQHAS

SEQ ID NO: 38101 - protein, 220 aa, Homo sapiens
  Payload ID: 7569
  Gene Symbol: HNRNPL
  Gene Name: heterogeneous nuclear ribonucleoprotein L
  ENSP ID: ENSP00000472150
  MOD_RES (1)..(1): Any amino acid
XGSMRRRSVPARPRGRLGERLENYDDPHKTPASPVVHIRGLIDGVVEADLVEALQEFGPISYVVVMPKKRQALVEFEDVLGACNAVNYAADNQIYIAGHPAFVNYSTSQKISRPGDSDDSRSVNSVLLFTILNPIYSITTDVLYTICNPCGPVQRIVIFRKNGVQAMVEFDSVQSAQRAKASLNGADIYSGCCTLKIEYAKPTRLNVFKNDQDTWDYTNP

SEQ ID NO: 38102 - protein, 220 aa, Homo sapiens; identical to SEQ ID NO: 38101
  Payload ID: 7569
  Gene Symbol: HNRNPL
  Gene Name: Heterogeneous nuclear ribonucleoprotein L
  ENSP ID: ENSP00000488987
  MOD_RES (1)..(1): Any amino acid

SEQ ID NO: 38103 - protein, 589 aa, Homo sapiens; identical to SEQ ID NO: 38096
  Payload ID: 7569
  Gene Symbol: HNRNPL
  Gene Name: Heterogeneous nuclear ribonucleoprotein L
  ENSP ID: ENSP00000489021

SEQ ID NO: 38104 - protein, 456 aa, Homo sapiens; identical to SEQ ID NO: 38100
  Payload ID: 7569
  Gene Symbol: HNRNPL
  Gene Name: Heterogeneous nuclear ribonucleoprotein L
  ENSP ID: ENSP00000489244

SEQ ID NO: 38105 - protein, 198 aa, Homo sapiens; identical to SEQ ID NO: 38099
  Payload ID: 7569
  Gene Symbol: HNRNPL
  Gene Name: Heterogeneous nuclear ribonucleoprotein L
  ENSP ID: ENSP00000489437
  MOD_RES (1)..(1): Any amino acid

SEQ ID NO: 38106 - protein, 530 aa, Homo sapiens; identical to SEQ ID NO: 38098
  Payload ID: 7569
  Gene Symbol: HNRNPL
  Gene Name: Heterogeneous nuclear ribonucleoprotein L
  ENSP ID: ENSP00000489507
  MOD_RES (1)..(1): Any amino acid

SEQ ID NO: 38107 - protein, 179 aa, Homo sapiens; identical to SEQ ID NO: 38097
  Payload ID: 7569
  Gene Symbol: HNRNPL
  Gene Name: Heterogeneous nuclear ribonucleoprotein L
  ENSP ID: ENSP00000489603

SEQ ID NO: 38108 - protein, 217 aa, Homo sapiens
  Payload ID: 7570
  Gene Symbol: HNRNPLL
  Gene Name: heterogeneous nuclear ribonucleoprotein L-like
  ENSP ID: ENSP00000272249
  MOD_RES (1)..(1): Any amino acid
XGSHHKVSVSPVVHVRGLCESVVEADLVEALEKFGTICYVMMMPFKRQALVEFENIDSAKECVTFAADEPVYIAGQQAFFNYSTSKRITRPGNTDDPSGGNKVLLLSIQNPLYPITVDVLYTVCNPVGKVQRIVIFKRNGIQAMVEFESVLCAQKAKAALNGADIYAGCCTLKIEYARPTRLNVIRNDNDSWDYTKPYLGRRGCCWLMLKLLERSPL

SEQ ID NO: 38109 - protein, 537 aa, Homo sapiens
  Payload ID: 7570
  Gene Symbol: HNRNPLL
  Gene Name: heterogeneous nuclear ribonucleoprotein L-like
  ENSP ID: ENSP00000351136
MLARETYEEDREYESQAKRLKTEEGEIDYSAEEGENRREATPRGGGDGGGGGRSFSQPEAGGSHHKVSVSPVVHVRGLCESVVEADLVEALEKFGTICYVMMMPFKRQALVEFENIDSAKECVTFAADEPVYIAGQQAFFNYSTSKRITRPGNTDDPSGGNKVLLLSIQNPLYPITVDVLYTVCNPVGKVQRIVIFKRNGIQAMLMFESVLCAQKAKAALNGADIYAGCCTLKIEYARPTRLNVIRNDNDSWDYTKPYLGRRDRGKGRQRQAILGEHPSSFRHDGYGSHGPLLPLPSRYRMGSRDTPELVAYPLPQASSSYMHGGNPSGSVVMVSGLHQLKMNCSRVFNLFCLYGNIEKVKFMKTIPGTALVEMGDEYAVERAVTHLNNVKLFGKRLNVCVSKQHSVVPSQIFELEDGTSSYKDFAMSKNNRFTSAGQASKNIIQPPSCVLHYYNVPLCVTEETFTKLCNDHEVLTFIKYKVFDAKPSAKTLSGLLEWECKTDAVEALTALNHYQIRVPNGSNPYTLKLCFSTSSHL

SEQ ID NO: 38110 - protein, 508 aa, Homo sapiens
  Payload ID: 7570
  Gene Symbol: HNRNPLL
  Gene Name: heterogeneous nuclear ribonucleoprotein L-like
  ENSP ID: ENSP00000368195
MSSSSSSPRETYEEDREYESQAKRLKTEEGEIDYSAEEGENRREATPRGGGDGGGGGRSFSQPEAGGSHHKVSVSPVVHVRGLCESVVEADLVEALEKFGTICYVMMMPFKRQALVEFENIDSAKECVTFAADEPVYIAGQQAFFNYSTSKRITRPGNTDDPSGGNKVLLLSIQNPLYPITVDVLYTVCNPVGKVQRIVIFKRNGIQAMPTRLNVIRNDNDSWDYTKPYLGRRDRGKGRQRQAILGEHPSSFRHDGYGSHGPLLPLPSRYRMGSRDTPELVAYPLPQASSSYMHGGNPSGSVVMVSGLHQLKMNCSRVFNLFCLYGNIEKVKFMKTIPGTALVEMGDEYAVERAVTHLNNVKLFGKRLNVCVSKQHSVVPSQIFELEDGTSSYKDFAMSKNNRFTSAGQASKNIIQPPSCVLHYYNVPLCVTEETFTKLCNDHEVLTFIKYKVFDAKPSAKTLSGLLEWECKTDAVEALTALNHYQIRVPNGSNPYTLKLCFSTSSHL

SEQ ID NO: 38111 - protein, 508 aa, Homo sapiens
  Payload ID: 7570
  Gene Symbol: HNRNPLL
  Gene Name: heterogeneous nuclear ribonucleoprotein L-like
  Uniprot ID: Q8WVV9
  ENSP ID: ENSP00000386575
MSSSSSSPRETYEEDREYESQAKRLKTEEGEIDYSAEEGENRREATPRGGGDGGGGGRSFSQPEAGGSHHKVSVSPVVHVRGLCESVVEADLVEALEKFGTICYVMMMPFKRQALVEFENIDSAKECVTFAADEPVYIAGQQAFFNYSTSKRITRPGNTDDPSGGNKVLLLSIQNPLYPITVDVLYTVCNPVGKVQRIVIFKRNGIQAMVDRLNVIRNDNDSWDYTKPYLGRRDRGKGRQRQAILGEHPSSFRHDGYGSHGPLLPLPSRYRMGSRDTPELVAYPLPQASSSYMHGGNPSGSVVMVSGLHQLKMNCSRVFNLFCLYGNIEKVKFMKTIPGTALVEMGDEYAVERAVTHLNNVKLFGKRLNVCVSKQHSVVPSQIFELEDGTSSYKDFAMSKNNRFTSAGQASKNIIQPPSCVLHYYNVPLCVTEETFTKLCNDHEVLTFIKYKVFDAKPSAKTLSGLLEWECKTDAVEALTALNHYQIRVPNGSNPYTLKLCFSTSSHL

SEQ ID NO: 38112 - protein, 275 aa, Homo sapiens
  Payload ID: 7570
  Gene Symbol: HNRNPLL
  Gene Name: heterogeneous nuclear ribonucleoprotein L-like
  Uniprot ID: Q8WVV9
  ENSP ID: ENSP00000386695
MLARETYEEDREYESQAKRLKTEEGEIDYSAEEGENRREATPRGGGDGGGGGRSFSQPEAGGSHHKVSVSPVVHVRGLCESVVEADLVEALEKFGTICYVMMMPFKRQALVEFENIDSAKECVTFAADEPVYIAGQQAFFNYSTSKRITRPGNTDDPSGGNKVLLLSIQNPLYPITVDVLYTVCNPVGKVQRIVIFKRNGIQAMVEFESVLCAQKAKAALNGADIYAGCCTLKIEYARPTRLNVIRNDNDSWDYTKPYLGRRGRYFIHFRMYLIC

SEQ ID NO: 38113 - protein, 537 aa, Homo sapiens
  Payload ID: 7570
  Gene Symbol: HNRNPLL
  Gene Name: heterogeneous nuclear ribonucleoprotein L-like
  Uniprot ID: Q8WVV9
  ENSP ID: ENSP00000387088
MLARETYEEDREYESQAKRLKTEEGEIDYSAEEGENRREATPRGGGDGGGGGRSFSQPEAGGSHHKVSVSPVVHVRGLCESVVEADLVEALEKFGTICYVMMMPFKRQALVEFENIDSAKECVTFAADEPVYIAGQQAFFNYSTSKRITRPGNTDDPSGGNKVLLLSIQNPLYPITVDVLYTVCNPVGKVQRIVIFKRNGIQAMVEFESVLCAQKAKAALNGADIYAGCCTLKIEYARPTRLNVIRNDNDSWDYTKPYLGRRDRGKGRQRQAILGEHPSSFRHDGYGSHGPLLPLPSRYRMGSRDTPELVAYPLPQASSSYMHGGNPSGSVVMVSGLHQLKMNCSRVFNLFCLYGNIEKVKFMKTIPGTALVEMGDEYAVERAVTHLNNVKLFGKRLNVCVSKQHSVVPSQIFELEDGTSSYKDFAMSKNNRFTSAGQASKNIIQPPSCVLHYYNVPLCVTEETFTKLCNDHEVLTFIKYKVFDAKPSAKTLSGLLEWECKTDAVEALTALNHYQIRVPNGSNPYTLKLCFSTSSHL

SEQ ID NO: 38114 - protein, 542 aa, Homo sapiens
  Payload ID: 7570
  Gene Symbol: HNRNPLL
  Gene Name: heterogeneous nuclear ribonucleoprotein L-like
  Uniprot ID: Q8WVV9
  ENSP ID: ENSP00000390625
MSSSSSSPRETYEEDREYESQAKRLKTEEGEIDYSAEEGENRREATPRGGGDGGGGGRSFSQPEAGGSHHKVSVSPVVHVRGLCESVVEADLVEALEKFGTICYVMMMPFKRQALVEFENIDSAKECVTFAADEPVYIAGQQAFFNYSTSKRITRPGNTDDPSGGNKVLLLSIQNPLYPITVDVLYTVCNPVGKVQRIVIFKRNGIQAMVEFESVLCAQKAKAALNGADIYAGCCTLKIEYARPTRLNVIRNDNDSWDYTKPYLGRRDRGKGRQRQAILGEHPSSFRHDGYGSHGPLLPLPSRYRMGSRDTPELVAYPLPQASSSYMHGGNPSGSVVMVSGLHQLKMNCSRVFNLFCLYGNIEKVKFMKTIPGTALVEMGDEYAVERAVTHLNNVKLFGKRLNVCVSKQHSVVPSQIFELEDGTSSYKDFAMSKNNRFTSAGQASKNIIQPPSCVLHYYNVPLCVTEETFTKLCNDHEVLTFIKYKVFDAKPSAKTLSGLLEWECKTDAVEALTALNHYQIRVPNGSNPYTLKLCFSTSSHL

SEQ ID NO: 38115 - protein, 149 aa, Homo sapiens
  Payload ID: 7570
  Gene Symbol: HNRNPLL
  Gene Name: heterogeneous nuclear ribonucleoprotein L-like
  ENSP ID: ENSP00000396669
MQEAGGSHHKVSVSPVVHVRGLCESVVEADLVEALEKFGTICYVMMMPFKRQALVEFENIDSAKECVTFAADEPVYIAGQQAFFNYSTSKRITRPGNTDDPSGGNKVLLLSIQNPLYPITVDVLYTVCNPVGKVQRIVIFKRNGIQAMV

SEQ ID NO: 38116 - protein, 133 aa, Homo sapiens
  Payload ID: 7570
  Gene Symbol: HNRNPLL
  Gene Name: heterogeneous nuclear ribonucleoprotein L-like
  ENSP ID: ENSP00000415766
  MOD_RES (1)..(1): Any amino acid
XVKLFGKRLNVCVSKQHSVVPSQIFELEDGTSSYKDFAMSKNNRFTSAGQASKNIIQPPSCVLHYYNVPLCVTEETFTKLCNDHEVLTFIKYKVFDAKPSAKTLSGLLEWECKTDAVEALTALNHYQIRVPSK

SEQ ID NO: 38117 - protein, 542 aa, Homo sapiens
  Payload ID: 7570
  Gene Symbol: HNRNPLL
  Gene Name: heterogeneous nuclear ribonucleoprotein L-like
  ENSP ID: ENSP00000476852
MSSSSSSPRETYEEDREYESQAKRLKTEEGEIDYSAEEGENRREATPRGGGDGGGGGRSFSQPEAGGSHHKVSVSPVVHVRGLCESVVEADLVEALEKFGTICYVMMMPFKRQALVEFENIDSAKECVTFAADEPVYIAGQQAFFNYSTSKRITRPGNTDDPSGGNKVLLLSIQNPLYPITVDVLYTVCNPVGKVQRIVIFKRNGIQAMLMFESVLCAQKAKAALNGADIYAGCCTLKIEYARPTRLNVIRNDNDSWDYTKPYLGRRDRGKGRQRQAILGEHPSSFRHDGYGSHGPLLPLPSRYRMGSRDTPELVAYPLPQASSSYMHGGNPSGSVVMVSGLHQLKMNCSRVFNLFCLYGNIEKVKFMKTIPGTALVEMGDEYAVERAVTHLNNVKLFGKRLNVCVSKQHSVVPSQIFELEDGTSSYKDFAMSKNNRFTSAGQASKNIIQPPSCVLHYYNVPLCVTEETFTKLCNDHEVLTFIKYKVFDAKPSAKTLSGLLEWECKTDAVEALTALNHYQIRVPNGSNPYTLKLCFSTSSHL

SEQ ID NO: 38118 - protein, 730 aa, Homo sapiens
  Payload ID: 7571
  Gene Symbol: HNRNPM
  Gene Name: heterogeneous nuclear ribonucleoprotein M
  Uniprot ID: P52272
  ENSP ID: ENSP00000325376
MAAGVEAAAEVAATEIKMEEESGAPGVPSGNGAPGPKGEGERPAQNEKRKEKNIKRGGNRFEPYANPTKRYRAFITNIPFDVKWQSLKDLVKEKVGEVTYVELLMDAEGKSRGCAVVEFKMEESMKKAAEVLNKHSLSGRPLKVKEDPDGEHARRAMQKVMATTGGMGMGPGGPGMITIPPSILNNPNIPNEIIHALQAGRLGSTVFVANLDYKVGWKKLKEVFSMAGVVVRADILEDKDGKSRGIGTVTFEQSIEAVQAISMFNGQLLFDRPMHVKMDERALPKGDFFPPERPQQLPHGLGGIGMGLGPGGQPIDANHLNKGIGMGNIGPAGMGMEGIGFGINKMGGMEGPFGGGMENMGRFGSGMNMGRINEILSNALKRGEIIAKQGGGGGGGSVPGIERMGPGIDRLGGAGMERMGAGLGHGMDRVGSEIERMGLVMDRMGSVERMGSGIERMGPLGLDHMASSIERMGQTMERIGSGVERMGAGMGFGLERMAAPIDRVGQTIERMGSGVERMGPAIERMGLSMERMVPAGMGAGLERMGPVMDRMATGLERMGANNLERMGLERMGANSLERMGLERMGANSLERMGPAMGPALGAGIERMGLAMGGGGGASFDRAIEMERGNFGGSFAGSFGGAGGHAPGVARKACQIFVRNLPFDFTWKMLKDKFNECGHVLYADIKMENGKSKGCGVVKFESPEVAERACRMMNGMKLSGREIDVRIDRNA

SEQ ID NO: 38119 - protein, 691 aa, Homo sapiens
  Payload ID: 7571
  Gene Symbol: HNRNPM
  Gene Name: heterogeneous nuclear ribonucleoprotein M
  Uniprot ID: P52272
  ENSP ID: ENSP00000325732
MAAGVEAAAEVAATEIKMEEESGAPGVPSGNGAPGPKGEGERPAQNEKRKEKNIKRGGNRFEPYANPTKRYRAFITNIPFDVKWQSLKDLVKEKVGEVTYVELLMDAEGKSRGCAVVEFKMEESMKKAAEVLNKHSLSGRPLKVKEDPDGEHARRAMQKAGRLGSTVFVANLDYKVGWKKLKEVFSMAGVVVRADILEDKDGKSRGIGTVTFEQSIEAVQAISMFNGQLLFDRPMHVKMDERALPKGDFFPPERPQQLPHGLGGIGMGLGPGGQPIDANHLNKGIGMGNIGPAGMGMEGIGFGINKMGGMEGPFGGGMENMGRFGSGMNMGRINEILSNALKRGEIIAKQGGGGGGGSVPGIERMGPGIDRLGGAGMERMGAGLGHGMDRVGSEIERMGLVMDRMGSVERMGSGIERMGPLGLDHMASSIERMGQTMERIGSGVERMGAGMGFGLERMAAPIDRVGQTIERMGSGVERMGPAIERMGLSMERMVPAGMGAGLERMGPVMDRMATGLERMGANNLERMGLERMGANSLERMGLERMGANSLERMGPAMGPALGAGIERMGLAMGGGGGASFDRAIEMERGNFGGSFAGSFGGAGGHAPGVARKACQIFVRNLPFDFTWKMLKDKFNECGHVLYADIKMENGKSKGCGVVKFESPEVAERACRMMNGMKLSGREIDVRIDRNA

SEQ ID NO: 38120 - protein, 116 aa, Homo sapiens
  Payload ID: 7571
  Gene Symbol: HNRNPM
  Gene Name: heterogeneous nuclear ribonucleoprotein M
  ENSP ID: ENSP00000469681
  MOD_RES (1)..(1): Any amino acid
XRMGLERMGANSLERMGPAMGPALGAGIERMGLAMGGGGGASFDRAIEMERGNFGGSFAGSFGGAGGHAPGVARKACQIFVRNLPFDFTWKMLKDKFNECGKCWERLCRCFPRACW

SEQ ID NO: 38121 - protein, 99 aa, Homo sapiens
  Payload ID: 7571
  Gene Symbol: HNRNPM
  Gene Name: heterogeneous nuclear ribonucleoprotein M
  ENSP ID: ENSP00000469906
GCAVVEFKMEESMKKAAERPQQLPHGLGGIGMGLGPGGQPIDANHLNKGIGMGNIGPAGMGMEGIGFGINKMGGMEGPFGGGMENMGRFGSGMNMGRIN

SEQ ID NO: 38122 - protein, 219 aa, Homo sapiens
  Payload ID: 7571
  Gene Symbol: HNRNPM
  Gene Name: heterogeneous nuclear ribonucleoprotein M
  ENSP ID: ENSP00000470017
MAAGVEAAAEVAATEIKMEEESGAPGVPSGNGAPGPKGEGERPAQNEKRKEKNIKRGGNRFEPYANPTKRYRAFITNIPFDVKWQSLKDLVKEKGIVVEFKMEESMKKAAEVLNKHSLSGRPLKVKEDPDGEHARRAMQKAGRLGSTVFVANLDYKVGWKKLKEVFSMAGVVVRADILEDKDGKSRGIGTVTFEQSIEAVQAISMFNGQLLFDRPMHVK

SEQ ID NO: 38123 - protein, 383 aa, Homo sapiens
  Payload ID: 7571
  Gene Symbol: HNRNPM
  Gene Name: heterogeneous nuclear ribonucleoprotein M
  ENSP ID: ENSP00000470635
  MOD_RES (1)..(1): Any amino acid
XGWKKLKEVFSMAGVVVRADILEDKDGKSRGIGTVTFEQSIEAVQAISMFNGQLLFDRPMHVKMDERALPKGDFFPPERPQQLPHGLGGIGMGLGPGGQPIDANHLNKGIGMGNIGPAGMGMEGIGFGINKMGGMEGPFGGGMENMGRFGSGMNMGRINGGGGGSVPGIERMGPGIDRLGGAGMERMGAGLGHGMDRVGSEIERMGLVMDRMGSVERMGSGIERMGPLGLDHMASSIERMGQTMERIGSGVERMGAGMGFGLERMAAPIDRVGQTIERMGSGVERMGPAIERMGLSMERMVPAGMGAGLERMGPVMDRMATGLERMGANNLERMGLERMGANSLERMGLERMGANSLERMGPAMGPALGAGIERMGLAMGGGG

SEQ ID NO: 38124 - protein, 352 aa, Homo sapiens
  Payload ID: 7571
  Gene Symbol: HNRNPM
  Gene Name: heterogeneous nuclear ribonucleoprotein M
  ENSP ID: ENSP00000470932
MAAGVEAAAEVAATEIKMEEESGAPGVPSGNGAPGPKGEGERPAQNEKRKEKNIKRGGNRFEPYANPTKRYRAFITNIPFDVKWQSLKDLVKEKVGEVTYVELLMDAEGKSRGCAVVEFKMEESMKKAAEVLNKHSLSGRPLKVKEDPDGEHARRAMQKAGRLGSTVFVANLDYKVGWKKLKEVFSMAGVVVRADILEDKDGKSRGIGTVTFEQSIEAVQAISMFNGQLLFDRPMHVKMDERALPKGDFFPPERPQQLPHGLGGIGMGLGPGGQPIDANHLNKGIGMGNIGPAGMEGPFGGGMENMGRFGSGMNMGRINEILSNALKRGEIIAKQGGGGGGGSVPGIERMGP

SEQ ID NO: 38125 - protein, 275 aa, Homo sapiens
  Payload ID: 7571
  Gene Symbol: HNRNPM
  Gene Name: heterogeneous nuclear ribonucleoprotein M
  ENSP ID: ENSP00000471339
MAAGVEAAAEVAATEIKMEEESGAPGVPSGNGAPGPKGEGERPAQNEKRKEKNIKRGGNRFEPYANPTKRYRAFITNIPFDVKWQSLKDLVKEKVGEVTYVELLMDAEGKSRGCAVVEFKMEESMKKAAEVLNKHSLSGRPLKVKEDPDGEHARRAMQKLDYKVGWKKLKEVFSMAGVVVRADILEDKDGKSRGIGTVTFEQSIEAVQAISMFNGQLLFDRPMHVKMDERALPKGDFFPPERPQQLPHGLGGIGMGLGPGGQPIDANHLNKGIGM

SEQ ID NO: 38126 - protein, 99 aa, Homo sapiens
  Payload ID: 7571
  Gene Symbol: HNRNPM
  Gene Name: heterogeneous nuclear ribonucleoprotein M
  ENSP ID: ENSP00000471530
MAAGVEAAAEVAATEIKMEEESGAPGVPSGNGAPGPKGEGERPAQNEKRKEKNIKRGGNRFEPYANPTKRYRAFITNIPFDVKWQSLKDLVKEKGMCCC

SEQ ID NO: 38127 - protein, 214 aa, Homo sapiens
  Payload ID: 7571
  Gene Symbol: HNRNPM
  Gene Name: heterogeneous nuclear ribonucleoprotein M
  ENSP ID: ENSP00000472599
  MOD_RES (1)..(1): Any amino acid
XIGSGVERMGAGMGFGLERMAAPIDRVGQTIERMGSGVERMGPAIERMGLSMERMVPAGMGAGLERMGPVMDRMATGLERMGANNLERMGLERMGANSLERMGLERMGANSLERMGPAMGPALGAGIERMGLAMGGGGGASFDRAIEMERGNFGGSFAGSFGGAGGHAPGVARKACQIFVRNLPFDFTWKMLKDKFNECEPERQVLHVSRNALV

SEQ ID NO: 38128 - protein, 357 aa, Homo sapiens
  Payload ID: 7571
  Gene Symbol: HNRNPM
  Gene Name: heterogeneous nuclear ribonucleoprotein M
  ENSP ID: ENSP00000472789
MAAGVEAAAEVAATEIKMEEESGAPGVPSGNGAPGPKGEGERPAQNEKRKEKNIKRGGNRFEPYANPTKRYRAFITNIPFDVKWQSLKDLVKEKVGEVTYVELLMDAEGKSRGCAVVEFKMEESMKKAAEVLNKHSLSGRPLKVKEDPDGEHARRAMQKVMATTGGMGMGPGGPGMITIPPSILNNPNIPNEIIHALQAGRLGSTVFVANLDYKVGWKKLKEVFSMAGVVVRADILEDKDGKSRGIGTVTFEQSIEAVQAISMFNGQLLFDRPMHVKMDERALPKGDFFPPERPQQLPQILSNALKRGEIIAKQGGGGGGGSVPGIERMGPGIDRLGGAGMERMGAGLGHGMDRVGS

SEQ ID NO: 38129 - protein, 730 aa, Homo sapiens [sequence omitted]

SEQ ID NO: 38130 - protein, 633 aa, Homo sapiens
  Payload ID: 7572
  Gene Symbol: HNRNPR
  Gene Name: heterogeneous nuclear ribonucleoprotein R
  Uniprot ID: O43390
  ENSP ID: ENSP00000304405
MANQVNGNAVQLKEEEEPMDTSSVTHTEHYKTLIEAGLPQKVAERLDEIFQTGLVAYVDLDERAIDALREFNEEGALSVLQQFKESDLSHVQNKSAFLCGVMKTYRQREKQGSKVQESTKGPDEAKIKALLERTGYTLDVTTGQRKYGGPPPDSVYSGVQPGIGTEVFVGKIPRDLYEDELVPLFEKAGPIWDLRLMMDPLSGQNRGYAFITFCGKEAAQEAVKLCDSYEIRPGKHLGVCISVANNRLFVGSIPKNKTKENILEEFSKVTEGLVDVILYHQPDDKKKNRGFCFLEYEDHKSAAQARRRLMSGKVKVWGNVVTVEWADPVEEPDPEVMAKVKVLFVRNLATTVTEEILEKSFSEFGKLERVKKLKDYAFVHFEDRGAAVKAMDEMNGKEIEGEEIEIVLAKPPDKKRKERQAARQASRSTAYEDYYYHPPPRMPPPIRGRGRGGGRGGYGYPPDYYGYEDYYDDYYGYDYHDYRGGYEDPYYGYDDGYAVRGRGGGRGGRGAPPPPRGRGAPPPRGRAGYSQRGAPLGPPRGSRGGRGGPAQQQRGRGSRGSRGNRGGNVGGKRKADGYNQPDSKRRQTNNQQNWGSQPIAQQPLQQGGDYSGNYGYNNDNQEFYQDTYGQQWK

SEQ ID NO: 38131 - protein, 633 aa, Homo sapiens; identical to SEQ ID NO: 38130
  Payload ID: 7572
  Gene Symbol: HNRNPR
  Gene Name: heterogeneous nuclear ribonucleoprotein R
  Uniprot ID: O43390
  ENSP ID: ENSP00000363741

SEQ ID NO: 38132 - protein, 636 aa, Homo sapiens
  Payload ID: 7572
  Gene Symbol: HNRNPR
  Gene Name: heterogeneous nuclear ribonucleoprotein R
  Uniprot ID: O43390
  ENSP ID: ENSP00000363745
MANQVNGNAVQLKEEEEPMDTSSVTHTEHYKTLIEAGLPQKVAERLDEIFQTGLVAYVDLDERAIDALREFNEEGALSVLQQFKESDLSHVQNKSAFLCGVMKTYRQREKQGSKVQESTKGPDEAKIKALLERTGYTLDVTTGQRKYGGPPPDSVYSGVQPGIGTEVFVGKIPRDLYEDELVPLFEKAGPIWDLRLMMDPLSGQNRGYAFITFCGKEAAQEAVKLCDSYEIRPGKHLGVCISVANNRLFVGSIPKNKTKENILEEFSKVTGLTEGLVDVILYHQPDDKKKNRGFCFLEYEDHKSAAQARRRLMSGKVKVWGNVVTVEWADPVEEPDPEVMAKVKVLFVRNLATTVTEEILEKSFSEFGKLERVKKLKDYAFVHFEDRGAAVKAMDEMNGKEIEGEEIEIVLAKPPDKKRKERQAARQASRSTAYEDYYYHPPPRMPPPIRGRGRGGGRGGYGYPPDYYGYEDYYDDYYGYDYHDYRGGYEDPYYGYDDGYAVRGRGGGRGGRGAPPPPRGRGAPPPRGRAGYSQRGAPLGPPRGSRGGRGGPAQQQRGRGSRGSRGNRGGNVGGKRKADGYNQPDSKRRQTNNQQNWGSQPIAQQPLQQGGDYSGNYGYNNDNQEFYQDTYGQQWK

SEQ ID NO: 38133 - protein, 595 aa, Homo sapiens
  Payload ID: 7572
  Gene Symbol: HNRNPR
  Gene Name: heterogeneous nuclear ribonucleoprotein R
  Uniprot ID: O43390
  ENSP ID: ENSP00000392799
MANQVNGNAVQLKEEEEPMDTSSVTHTEHYKTLIEAGLPQKVAERLDEIFQTGLVAYVDLDERAIDALREFNEEGALSVLQQFKESDLSHVQNKSAFLCGVMKTYRQREKQGSKVQESTKGPDEAKIKVFVGKIPRDLYEDELVPLFEKAGPIWDLRLMMDPLSGQNRGYAFITFCGKEAAQEAVKLCDSYEIRPGKHLGVCISVANNRLFVGSIPKNKTKENILEEFSKVTEGLVDVILYHQPDDKKKNRGFCFLEYEDHKSAAQARRRLMSGKVKVWGNVVTVEWADPVEEPDPEVMAKVKVLFVRNLATTVTEEILEKSFSEFGKLERVKKLKDYAFVHFEDRGAAVKAMDEMNGKEIEGEEIEIVLAKPPDKKRKERQAARQASRSTAYEDYYYHPPPRMPPPIRGRGRGGGRGGYGYPPDYYGYEDYYDDYYGYDYHDYRGGYEDPYYGYDDGYAVRGRGGGRGGRGAPPPPRGRGAPPPRGRAGYSQRGAPLGPPRGSRGGRGGPAQQQRGRGSRGSRGNRGGNVGGKRKADGYNQPDSKRRQTNNQQNWGSQPIAQQPLQQGGDYSGNYGYNNDNQEFYQDTYGQQWK

SEQ ID NO: 38134 - protein, 535 aa, Homo sapiens
  Payload ID: 7572
  Gene Symbol: HNRNPR
  Gene Name: heterogeneous nuclear ribonucleoprotein R
  Uniprot ID: O43390
  ENSP ID: ENSP00000474437
MKTYRQREKQGSKVQESTKGPDEAKIKALLERTGYTLDVTTGQRKYGGPPPDSVYSGVQPGIGTEVFVGKIPRDLYEDELVPLFEKAGPIWDLRLMMDPLSGQNRGYAFITFCGKEAAQEAVKLCDSYEIRPGKHLGVCISVANNRLFVGSIPKNKTKENILEEFSKVTGLTEGLVDVILYHQPDDKKKNRGFCFLEYEDHKSAAQARRRLMSGKVKVWGNVVTVEWADPVEEPDPEVMAKVKVLFVRNLATTVTEEILEKSFSEFGKLERVKKLKDYAFVHFEDRGAAVKAMDEMNGKEIEGEEIEIVLAKPPDKKRKERQAARQASRSTAYEDYYYHPPPRMPPPIRGRGRGGGRGGYGYPPDYYGYEDYYDDYYGYDYHDYRGGYEDPYYGYDDGYAVRGRGGGRGGRGAPPPPRGRGAPPPRGRAGYSQRGAPLGPPRGSRGGRGGPAQQQRGRGSRGSRGNRGGNVGGKRKADGYNQPDSKRRQTNNQQNWGSQPIAQQPLQQGGDYSGNYGYNNDNQEFYQDTYGQQWK

SEQ ID NO: 38135 - protein, 494 aa, Homo sapiens
  Payload ID: 7572
  Gene Symbol: HNRNPR
  Gene Name: heterogeneous nuclear ribonucleoprotein R
  ENSP ID: ENSP00000475760
MKTYRQREKQGSKVQESTKGPDEAKIKVFVGKIPRDLYEDELVPLFEKAGPIWDLRLMMDPLSGQNRGYAFITFCGKEAAQEAVKLCDSYEIRPGKHLGVCISVANNRLFVGSIPKNKTKENILEEFSKVTEGLVDVILYHQPDDKKKNRGFCFLEYEDHKSAAQARRRLMSGKVKVWGNVVTVEWADPVEEPDPEVMAKVKVLFVRNLATTVTEEILEKSFSEFGKLERVKKLKDYAFVHFEDRGAAVKAMDEMNGKEIEGEEIEIVLAKPPDKKRKERQAARQASRSTAYEDYYYHPPPRMPPPIRGRGRGGGRGGYGYPPDYYGYEDYYDDYYGYDYHDYRGGYEDPYYGYDDGYAVRGRGGGRGGRGAPPPPRGRGAPPPRGRAGYSQRGAPLGPPRGSRGGRGGPAQQQRGRGSRGSRGNRGGNVGGKRKADGYNQPDSKRRQTNNQQNWGSQPIAQQPLQQGGDYSGNYGYNNDNQEFYQDTYGQQWK

SEQ ID NO: 38136 - protein, 595 aa, Homo sapiens; identical to SEQ ID NO: 38133
  Payload ID: 7572
  Gene Symbol: HNRNPR
  Gene Name: Heterogeneous nuclear ribonucleoprotein R
  ENSP ID: ENSP00000488941

SEQ ID NO: 38137 - protein, 636 aa, Homo sapiens; identical to SEQ ID NO: 38132
  Payload ID: 7572
  Gene Symbol: HNRNPR
  Gene Name: Heterogeneous nuclear ribonucleoprotein R
  ENSP ID: ENSP00000488945

SEQ ID NO: 38138 - protein, 633 aa, Homo sapiens; identical to SEQ ID NO: 38130
  Payload ID: 7572
  Gene Symbol: HNRNPR
  Gene Name: Heterogeneous nuclear ribonucleoprotein R
  ENSP ID: ENSP00000489252

SEQ ID NO: 38139 - protein, 535 aa, Homo sapiens; identical to SEQ ID NO: 38134
  Payload ID: 7572
  Gene Symbol: HNRNPR
  Gene Name: Heterogeneous nuclear ribonucleoprotein R
  ENSP ID: ENSP00000489275

SEQ ID NO: 38140 - protein, 633 aa, Homo sapiens; identical to SEQ ID NO: 38130
  Payload ID: 7572
  Gene Symbol: HNRNPR
  Gene Name: Heterogeneous nuclear ribonucleoprotein R
  ENSP ID: ENSP00000489371

SEQ ID NO: 38141 - protein, 494 aa, Homo sapiens; identical to SEQ ID NO: 38135
  Payload ID: 7572
  Gene Symbol: HNRNPR
  Gene Name: Heterogeneous nuclear ribonucleoprotein R
  ENSP ID: ENSP00000489386

SEQ ID NO: 38142 - protein, 825 aa, Homo sapiens
  Payload ID: 7573
  Gene Symbol: HNRNPU
  Gene Name: heterogeneous nuclear ribonucleoprotein U (scaffold attachment factor A)
  Uniprot ID: Q00839
  ENSP ID: ENSP00000283179
MSSSPVNVKKLKVSELKEELKKRRLSDKGLKAELMERLQAALDDEEAGGRPAMEPGNGSLDLGGDSAGRSGAGLEQEAAAGGDEEEEEEEEEEEGISALDGDQMELGEENGAAGAADSGPMEEEEAASEDENGDDQGFQEGEDELGDEEEGAGDENGHGEQQPQPPATQQQQPQQQRGAAKEAAGKSSGPTSLFAVTVAPPGARQGQQQAGGKKKAEGGGGGGRPGAPAAGDGKTEQKGGDKKRGVKRPREDHGRGYFEYIEENKYSRAKSPQPPVEEEDEHFDDTVVCLDTYNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVAGFKKQMADTGKLNTLLQRAPQCLGKFIEIAARKKRNFILDQTNVSAAAQRRKMCLFAGFQRKAVVVCPKDEDYKQRTQKKAEVEGKDLPEHAVLKMKGNFTLPEVAECFDEITYVELQKEEAQKLLEQYKEESKKALPPEKKQNTGSKKSNKNKSGKNQFNRGGGHRGRGGFNMRGGNFRGGAPGNRGGYNRRGNMPQRGGGGGGSGGIGYPYPRAPVFPGRGSYSNRGNYNRGGMPNRGNYNQNFRGRGNNRGYKNQSQGYNQWQQGQFWGQKPWSQHYHQGYY

SEQ ID NO: 38143 - protein, 806 aa, Homo sapiens
  Payload ID: 7573
  Gene Symbol: HNRNPU
  Gene Name: heterogeneous nuclear ribonucleoprotein U (scaffold attachment factor A)
  Uniprot ID: Q00839
  ENSP ID: ENSP00000393151
MSSSPVNVKKLKVSELKEELKKRRLSDKGLKAELMERLQAALDDEEAGGRPAMEPGNGSLDLGGDSAGRSGAGLEQEAAAGGDEEEEEEEEEEEGISALDGDQMELGEENGAAGAADSGPMEEEEAASEDENGDDQGFQEGEDELGDEEEGAGDENGHGEQQPQPPATQQQQPQQQRGAAKEAAGKSSGPTSLFAVTVAPPGARQGQQQAGGDGKTEQKGGDKKRGVKRPREDHGRGYFEYIEENKYSRAKSPQPPVEEEDEHFDDTVVCLDTYNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVAGFKKQMADTGKLNTLLQRAPQCLGKFIEIAARKKRNFILDQTNVSAAAQRRKMCLFAGFQRKAVVVCPKDEDYKQRTQKKAEVEGKDLPEHAVLKMKGNFTLPEVAECFDEITYVELQKEEAQKLLEQYKEESKKALPPEKKQNTGSKKSNKNKSGKNQFNRGGGHRGRGGFNMRGGNFRGGAPGNRGGYNRRGNMPQRGGGGGGSGGIGYPYPRAPVFPGRGSYSNRGNYNRGGMPNRGNYNQNFRGRGNNRGYKNQSQGYNQWQQGQFWGQKPWSQHYHQGYY

SEQ ID NO: 38144 - protein, 241 aa, Homo sapiens
  Payload ID: 7573
  Gene Symbol: HNRNPU
  Gene Name: heterogeneous nuclear ribonucleoprotein U (scaffold attachment factor A)
  ENSP ID: ENSP00000410728
MGLVCVLGDGKTEQKGGDKKRGVKRPREDHGRGYFEYIEENKYSRAKSPQPPVEEEDEHFDDTVVCLDTYNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEK

SEQ ID NO: 38145 - protein, 767 aa, Homo sapiens
  Payload ID: 7574
  Gene Symbol: HNRNPUL1
  Gene Name: heterogeneous nuclear ribonucleoprotein U-like 1
  ENSP ID: ENSP00000263367
MRSWAFSYLDAMDNITRQNQFYDTQVIKQENESGYERRPLEMEQQQAYRPEMKTEMKQGAPTSFLPPEASQLKPDRQQFQSRKRPYEENRGRGYFEHREDRRGRSPQPPAEEDEDDFDDTLVAIDTYNCDLHFKVARDRSSGYPLTIEGFAYLWSGARASYGVRRGRVCFEMKINEEISVKHLPSTEPDPHVVRIGWSLDSCSTQLGEEPFSYGYGGTGKKSTNSRFENYGDKFAENDVIGCFADFECGNDVELSFTKNGKWMGIAFRIQKEALGGQALYPHVLVKNCAVEFNFGQRAEPYCSVLPGFTFIQHLPLSERIRGTVGPKSKAECEILMMVGLPAAGKTTWAIKHAASNPSKKYNILGTNAIMDKMRVMGLRRQRNYAGRWDVLIQQATQCLNRLIQIAARKKRNYILDQTNVYGSAQRRKMRPFEGFQRKAIVICPTDEDLKDRTIKRTDEEGKDVPDHAVLEMKANFTLPDVGDFLDEVLFIELQREEADKLVRQYNEEGRKAGPPPEKRFDNRGGGGFRGRGGGGGFQRYENRGPPGGNRGGFQNRGGGSGGGGNYRGGFNRSGGGGYSQNRWGNNNRDNNNSNNRGSYNRAPQQQPPPQQPPPPQPPPQQPPPPPSYSPARNPPGASTYNKNSNIPGSSANTSTPTVSSYSPPQPSYSQPPYNQGGYSQGYTAPPPPPPPPPAYNYGSYGGYNPAPYTPPPPPTAQTYPQPSYNQYQQYAQQWNQYYQNQGQWPPYYGNYDYGSYSGNTQGGTSTQ

SEQ ID NO: 38146 - protein, 766 aa, Homo sapiens
  Payload ID: 7574
  Gene Symbol: HNRNPUL1
  Gene Name: heterogeneous nuclear ribonucleoprotein U-like 1
  ENSP ID: ENSP00000340857
MDNITRQNQFYDTQVIKQENESGYERRPLEMEQQQAYRPEMKTEMKQGAPTSFLPPEASQLKPDRQQFQSRKRPYEENRGRGYFEHREDRRGRSPQPPAEEDEDDFDDTLVAIDTYNCDLHFKVARDRSSGYPLTIEGFAYLWSGARASYGVRRGRVCFEMKINEEISVKHLPSTEPDPHVVRIGWSLDSCSTQLGEEPFSYGYGGTGKKSTNSRFENYGDKFAENDVIGCFADFECGNDVELSFTKNGKWMGIAFRIQKEALGGQALYPHVLVKNCAVEFNFGQRAEPYCSVLPGFTFIQHLPLSERIRGTVGPKSKAECEILMMVGLPAAGKTTWAIKHAASNPSKKYNILGTNAIMDKMRVMGLRRQRNYAGRWDVLIQQATQCLNRLIQIAARKKRNYILDQTNVYGSAQRRKMRPFEGFQRKAIVICPTDEDLKDRTIKRTDEEGKDVPDHAVLEMKANFTLPDVGDFLDEVLFIELQREEADKLVRQYNEEGRKAGPPPEKRFDNRGGGGFRGRGGGGGFQRYENRGPPGGNRGGFQNRGGGSGGGGNYRGGFNRSGGGGYSQNRWGNNNRDNNNSNNRGSYNRAPQQQPPPQQPPPPQPPPQQPPPPPSYSPARNPPGASTYNKNSNIPGSSANTSTPTVSSYSPPQSFGFFPSTFQPSYSQPPYNQGGYSQGYTAPPPPPPPPPAYNYGSYGGYNPAPYTPPPPPTAQTYPQPSYNQYQQYAQQWNQYYQNQGQWPPYYGNYDYGSYSGNTQGGTSTQ

SEQ ID NO: 38147 - protein, 752 aa, Homo sapiens
  Payload ID: 7574
  Gene Symbol: HNRNPUL1
  Gene Name: heterogeneous nuclear ribonucleoprotein U-like 1
  Uniprot ID: Q9BUJ2
  ENSP ID: ENSP00000367460
MDVRRLKVNELREELQRRGLDTRGLKAELAERLQPPPPGLQPHAEPGGYSGPDGHYAMDNITRQNQFYDTQVIKQENESGYERRPLEMEQQQAYRPEMKTEMKQGAPTSFLPPEASQLKPDRQQFQSRKRPYEENRGRGYFEHREDRRGRSPQPPAEEDEDDFDDTLVAIDTYNCDLHFKVARDRSSGYPLTIEGFAYLWSGARASYGVRRGRVCFEMKDFECGNDVELSFTKNGKWMGIAFRIQKEALGGQALYPHVLVKNCAVEFNFGQRAEPYCSVLPGFTFIQHLPLSERIRGTVGPKSKAECEILMMVGLPAAGKTTWAIKHAASNPSKKYNILGTNAIMDKMRVMGLRRQRNYAGRWDVLIQQATQCLNRLIQIAARKKRNYILDQTNVYGSAQRRKMRPFEGFQRKAIVICPTDEDLKDRTIKRTDEEGKDVPDHAVLEMKANFTLPDVGDFLDEVLFIELQREEADKLVRQYNEEGRKAGPPPEKRFDNRGGGGFRGRGGGGGFQRYENRGPPGGNRGGFQNRGGGSGGGGNYRGGFNRSGGGGYSQNRWGNNNRDNNNSNNRGSYNRAPQQQPPPQQPPPPQPPPQQPPPPPSYSPARNPPGASTYNKNSNIPGSSANTSTPTVSSYSPPQSFGFFPSTFQPSYSQPPYNQGGYSQGYTAPPPPPPPPPAYNYGSYGGYNPAPYTPPPPPTAQTYPQPSYNQYQQYAQQWNQYYQNQGQWPPYYGNYDYGSYSGNTQGGTSTQ

SEQ ID NO: 38148 - protein, 856 aa, Homo sapiens
  Payload ID: 7574
  Gene Symbol: HNRNPUL1
  Gene Name: heterogeneous nuclear ribonucleoprotein U-like 1
  Uniprot ID: Q9BUJ2
  ENSP ID: ENSP00000375863
MDVRRLKVNELREELQRRGLDTRGLKAELAERLQAALEAEEPDDERELDADDEPGRPGHINEEVETEGGSELEGTAQPPPPGLQPHAEPGGYSGPDGHYAMDNITRQNQFYDTQVIKQENESGYERRPLEMEQQQAYRPEMKTEMKQGAPTSFLPPEASQLKPDRQQFQSRKRPYEENRGRGYFEHREDRRGRSPQPPAEEDEDDFDDTLVAIDTYNCDLHFKVARDRSSGYPLTIEGFAYLWSGARASYGVRRGRVCFEMKINEEISVKHLPSTEPDPHVVRIGWSLDSCSTQLGEEPFSYGYGGTGKKSTNSRFENYGDKFAENDVIGCFADFECGNDVELSFTKNGKWMGIAFRIQKEALGGQALYPHVLVKNCAVEFNFGQRAEPYCSVLPGFTFIQHLPLSERIRGTVGPKSKAECEILMMVGLPAAGKTTWAIKHAASNPSKKYNILGTNAIMDKMRVMGLRRQRNYAGRWDVLIQQATQCLNRLIQIAARKKRNYILDQTNVYGSAQRRKMRPFEGFQRKAIVICPTDEDLKDRTIKRTDEEGKDVPDHAVLEMKANFTLPDVGDFLDEVLFIELQREEADKLVRQYNEEGRKAGPPPEKRFDNRGGGGFRGRGGGGGFQRYENRGPPGGNRGGFQNRGGGSGGGGNYRGGFNRSGGGGYSQNRWGNNNRDNNNSNNRGSYNRAPQQQPPPQQPPPPQPPPQQPPPPPSYSPARNPPGASTYNKNSNIPGSSANTSTPTVSSYSPPQPSYSQPPYNQGGYSQGYTAPPPPPPPPPAYNYGSYGGYNPAPYTPPPPPTAQTYPQPSYNQYQQYAQQWNQYYQNQGQWPPYYGNYDYGSYSGNTQGGTSTQ

SEQ ID NO: 38149 - protein, 26 aa, Homo sapiens
  Payload ID: 7574
  Gene Symbol: HNRNPUL1
  Gene Name: heterogeneous nuclear ribonucleoprotein U-like 1
  ENSP ID: ENSP00000469816
  MOD_RES (1)..(1): Any amino acid
XRGRVCFEMKVSRSKRRGRDREVHPL

SEQ ID NO: 38150 - protein, 172 aa, Homo sapiens
  Payload ID: 7574
  Gene Symbol: HNRNPUL1
  Gene Name: heterogeneous nuclear ribonucleoprotein U-like 1
  ENSP ID: ENSP00000469858
MKTEMKQGAPTSFLPPEASQLKPDRQQFQSRKRPYEENRGRGYFEHREDRRGRSPQPPAEEDEDDFDDTLVAIDTYNCDLHFKVARDRSSGYPLTIEGFAYLWSGARASYGVRRGRVCFEMKINEEISVKHLPSTEPDPHVVRIGWSLDSCSTQLGEEPFSYGYGGTGKKST

SEQ ID NO: 38151 - protein, 90 aa, Homo sapiens
  Payload ID: 7574
  Gene Symbol: HNRNPUL1
  Gene Name: heterogeneous nuclear ribonucleoprotein U-like 1
  ENSP ID: ENSP00000469934
  MOD_RES (1)..(1): Any amino acid
XTLVAIDTYNCDLHFKVARDRSSGYPLTIEGFAYLWSGARASYGVRRGRVCFEMKINEEISVKHLPSTEPDPHVVRIGWSLDSCSTQLGF

SEQ ID NO: 38152 - protein, 371 aa, Homo sapiens
  Payload ID: 7574
  Gene Symbol: HNRNPUL1
  Gene Name: heterogeneous nuclear ribonucleoprotein U-like 1
  ENSP ID: ENSP00000470172
MDNITRQNQFYDTQVIKQENESGYERRPLEMEQQQAYRPEMKTEMKQGAPTSFLPPEASQLKPDRQQFQSRKRPYEENRGRGYFEHREDRRGRSPQPPAEEDEDDFDDTLVAIDTYNCDLHFKVARDRSSGYPLTIEGFAYLWSGARASYGVRRGRVCFEMKINEEISVKHLPSTEPDPHVVRIGWSLDSCSTQLGEEPFSYGYGGTGKKSTNSRFENYGDKFAENDVIGCFADFECGNDVELSFTKNGKWMGIAFRIQKEALGGQALYPHVLVKNCAVEFNFGQRAEPYCSVLPGFTFIQHLPLSERIRGTVGPKSKAECEILMMVGLPAAGKTTWAIKHAASNPSKKYNILGTNAIMDKMRVMGLRRQR

SEQ ID NO: 38153 - protein, 804 aa, Homo sapiens
  Payload ID: 7574
  Gene Symbol: HNRNPUL1
  Gene Name: heterogeneous nuclear ribonucleoprotein U-like 1
  Uniprot ID: Q9BUJ2
  ENSP ID: ENSP00000470687
MDVRRLKVNELREELQRRGLDTRGLKAELAERLQAALEAEEPDDERELDADDEPGRPGHINEEVETEGGSELEGTAQPPPPGLQPHAEPGGYSGPDGHYAMDNITRQNQFYDTQVIKQENESGYERRPLEMEQQQAYRPEMKTEMKQGAPTSFLPPEASQLKPDRQQFQSRKRPYEENRGRGYFEHREDRRGRSPQPPAEEDEDDFDDTLVAIDTYNCDLHFKVARDRSSGYPLTIEGFAYLWSGARASYGVRRGRVCFEMKINEEISVKHLPSTEPDPHVVRIGWSLDSCSTQLGEEPFSYGYGGTGKKSTNSRFENYGDKFAENDVIGCFADFECGNDVELSFTKNGKWMGIAFRIQKEALGGQALYPHVLVKNCAVEFNFGQRAEPYCSVLPGFTFIQHLPLSERIRGTVGPKSKAECEILMMVGLPAAGKTTWAIKHAASNPSKKYNILGTNAIMDKMRVMGLRRQRNYAGRWDVLIQQATQCLNRLIQIAARKKRNYILDQTNVYGSAQRRKMRPFEGFQRKAIVICPTDEDLKDRTIKRTDEEGKDVPDHAVLEMKANFTLPDVGDFLDEVLFIELQREEADKLVRQYNEEGRKAGPPPEKRFDNRGGGGFRGRGGGGGFQRYENRGPPGGNRGGFQNRGGGSGGGGNYRGGFNRSGGGGYSQNRWGNNNRDNNNSNNRGSYNRAPQQQPPPQQPPPPQPPPQQPPPPPSYSPARNPPGASTYNKNSNIPGSSANTSTPTVSSYSPPQTYPQPSYNQYQQYAQQWNQYYQNQGQWPPYYGNYDYGSYSGNTQGGTSTQ

SEQ ID NO: 38154 - protein, 118 aa, Homo sapiens
  Payload ID: 7574
  Gene Symbol: HNRNPUL1
  Gene Name: heterogeneous nuclear ribonucleoprotein U-like 1
  ENSP ID: ENSP00000470793
MDNITRQNQFYDTQVIKQENESGYERRPLEMEQQQAYRPEMKTEMKQGAPTSFLPPEASQLKPDRQQFQSRKRPYEENRGRGYFEHREDRRGRSPQPPAEEDEDDFDDTLVAIDTYNC

SEQ ID NO: 38155 - protein, 158 aa, Homo sapiens
  Payload ID: 7574
  Gene Symbol: HNRNPUL1
  Gene Name: heterogeneous nuclear ribonucleoprotein U-like 1
  ENSP ID: ENSP00000471302
MDNITRQNQFYDTQVIKQENESGYERRPLEMEQQQAYRPEMKTEMKQGAPTSFLPPEASQLKPDRQQFQSRKRPYEENRGRGYFEHREDRRGRSPQPPAEEDEDDFDDTLVAIDTYNCDLHFKVARDRSSGYPLTIEGFAYLWSGARASYGVRRGRVC

SEQ ID NO: 38156 - protein, 81 aa, Homo sapiens
  Payload ID: 7574
  Gene Symbol: HNRNPUL1
  Gene Name: heterogeneous nuclear ribonucleoprotein U-like 1
  ENSP ID: ENSP00000472221
MDNITRQNQFYDTQVIKQENESGYERRPLEMEQQQAYRPEMKTEMKQGAPTSFLPPEASQLKPDRQQFQSRKRPYEENRGR

SEQ ID NO: 38157 - protein, 105 aa, Homo sapiens
  Payload ID: 7574
  Gene Symbol: HNRNPUL1
  Gene Name: heterogeneous nuclear ribonucleoprotein U-like 1
  ENSP ID: ENSP00000472315
MDVRRLKVNELREELQRRGLDTRGLKAELAERLQAALEAEEPDDERELDADDEPGRPGHINEEMPWTILPGRTNSTIPKSSNKKTSQATRGDHWKWSSSRPIVQK

SEQ ID NO: 38158 - protein, 756 aa, Homo sapiens
  Payload ID: 7574
  Gene Symbol: HNRNPUL1
  Gene Name: heterogeneous nuclear ribonucleoprotein U-like 1
  Uniprot ID: Q9BUJ2
  ENSP ID: ENSP00000472629
MDNITRQNQFYDTQVIKQENESGYERRPLEMEQQQAYRPEMKTEMKQGAPTSFLPPEASQLKPDRQQFQSRKRPYEENRGRGYFEHREDRRGRSPQPPAEEDEDDFDDTLVAIDTYNCDLHFKVARDRSSGYPLTIEGFAYLWSGARASYGVRRGRVCFEMKINEEISVKHLPSTEPDPHVVRIGWSLDSCSTQLGEEPFSYGYGGTGKKSTNSRFENYGDKFAENDVIGCFADFECGNDVELSFTKNGKWMGIAFRIQKEALGGQALYPHVLVKNCAVEFNFGQRAEPYCSVLPGFTFIQHLPLSERIRGTVGPKSKAECEILMMVGLPAAGKTTWAIKHAASNPSKKYNILGTNAIMDKMRVMGLRRQRNYAGRWDVLIQQATQCLNRLIQIAARKKRNYILDQTNVYGSAQRRKMRPFEGFQRKAIVICPTDEDLKDRTIKRTDEEGKDVPDHAVLEMKANFTLPDVGDFLDEVLFIELQREEADKLVRQYNEEGRKAGPPPEKRFDNRGGGGFRGRGGGGGFQRYENRGPPGGNRGGFQNRGGGSGGGGNYRGGFNRSGGGGYSQNRWGNNNRDNNNSNNRGSYNRAPQQQPPPQQPPPPQPPPQQPPPPPSYSPARNPPGASTYNKNSNIPGSSANTSTPTVSSYSPPQPSYSQPPYNQGGYSQGYTAPPPPPPPPPAYNYGSYGGYNPAPYTPPPPPTAQTYPQPSYNQYQQYAQQWNQYYQNQGQWPPYYGNYDYGSYSGNTQGGTSTQ

SEQ ID NO: 38159 - protein, 756 aa, Homo sapiens; identical to SEQ ID NO: 38158
  Payload ID: 7574
  Gene Symbol: HNRNPUL1
  Gene Name: heterogeneous nuclear ribonucleoprotein U-like 1
  Uniprot ID: Q9BUJ2
  ENSP ID: ENSP00000473132

SEQ ID NO: 38160 - protein, 641 aa, Homo sapiens
  Payload ID: 7574
  Gene Symbol: HNRNPUL1
  Gene Name: heterogeneous nuclear ribonucleoprotein U-like 1
  ENSP ID: ENSP00000473178
  MOD_RES (1)..(1): Any amino acid
XFLPPEASQLKPDRQQFQSRKRPYEENRGRGYFEHREDRRGRSPQPPAEEDEDDFDDTLVAIDTYNCDLHFKVARDRSSGYPLTIEGFAYLWSGARASYGVRRGRVCFEMKINEEISVKHLPSTEPDPHVVRIGWSLDSCSTQLGEEPFSYGYGGTGKKSTNSRFENYGDKFAENDVIGCFADFECGNDVELSFTKNGKWMGIAFRIQKEALGGQALYPHVLVKNCAVEFNFGQRAEPYCSVLPGFTFIQHLPLSERIRGTVGPKSKAECEILMMVGLPAAGKTTWAIKHAASNPSKKYNILGTNAIMDKMRVMGLRRQRNYAGRWDVLIQQATQCLNRLIQIAARKKRNYILDQTNVYGSAQRRKMRPFEGFQRKAIVICPTDEDLKDRTIKRTDEEGKDVPDHAVLEMKANFTLPDVGDFLDEVLFIELQREEADKLVRQYNEEGRKAGPPPEKRFDNRGGGGFRGRGGGGGFQRYENRGPPGGNRGGFQNRGGGSGGGGNYRGGFNRSGGGGYSQNRWGNNNRDNNNSNNRGSYNRAPQQQPPPQQPPPPQPPPQQPPPPPSYSPARNPPGASTYNKNSNIPGSSANTSTPTVSSYSPPQYAQQWNQYYQNQGQWPPYYGNYDYGSYSGNTQGGTSTQ

SEQ ID NO: 38161 - protein, 122 aa, Homo sapiens
  Payload ID: 7574
  Gene Symbol: HNRNPUL1
  Gene Name: heterogeneous nuclear ribonucleoprotein U-like 1
  ENSP ID: ENSP00000478946
MDVRRLKVNELREELQRRGLDTRGLKAELAERLQAALEAEEPDDERELDADDEPGRPGHINEEAELQPATLQPGRLQPGLHSPTASTSTTTCLQLWELRRLQPGPLYPTATPHCTDLPSAQL

SEQ ID NO: 38162 - protein, 122 aa, Homo sapiens; identical to SEQ ID NO: 38161
  Payload ID: 7574
  Gene Symbol: HNRNPUL1
  Gene Name: heterogeneous nuclear ribonucleoprotein U-like 1
  ENSP ID: ENSP00000484226

SEQ ID NO: 38163 - protein, 747 aa, Homo sapiens
  Payload ID: 7575
  Gene Symbol: HNRNPUL2
  Gene Name: heterogeneous nuclear ribonucleoprotein U-like 2
  Uniprot ID: Q1KMD3
  ENSP ID: ENSP00000301785
MEVKRLKVTELRSELQRRGLDSRGLKVDLAQRLQEALDAEMLEDEAGGGGAGPGGACKAEPRPVAASGGGPGGDEEEDEEEEEEDEEALLEDEDEEPPPAQALGQAAQPPPEPPEAAAMEAAAEPDASEKPAEATAGSGGVNGGEEQGLGKREEDEPEERSGDETPGSEVPGDKAAEEQGDDQDSEKSKPAGSDGERRGVKRQRDEKDEHGRAYYEFREEAYHSRSKSPLPPEEEAKDEEEDQTLVNLDTYTSDLHFQVSKDRYGGQPLFSEKFPTLWSGARSTYGVTKGKVCFEAKVTQNLPMKEGCTEVSLLRVGWSVDFSRPQLGEDEFSYGFDGRGLKAENGQFEEFGQTFGENDVIGCFANFETEEVELSFSKNGEDLGVAFWISKDSLADRALLPHVLCKNCVVELNFGQKEEPFFPPPEEFVFIHAVPVEERVRTAVPPKTIEECEVILMVGLPGSGKTQWALKYAKENPEKRYNVLGAETVLNQMRMKGLEEPEMDPKSRDLLVQQASQCLSKLVQIASRTKRNFILDQCNVYNSGQRRKLLLFKTFSRKVVVVVPNEEDWKKRLELRKEVEGDDVPESIMLEMKANFSLPEKCDYMDEVTYGELEKEEAQPIVTKYKEEARKLLPPSEKRTNRRNNRNKRNRQNRSRGQGYVGGQRRGYDNRAYGQQYWGQPGNRGGYRNFYDRYRGDYDRFYGRDYEYNRYRDYYRQYNRDWQSYYYHHPQDRDRYYRNYYGYQGYR

SEQ ID NO: 38164 - protein, 359 aa, Homo sapiens
  Payload ID: 7576
  Gene Symbol: HEXIM1
  Gene Name: hexamethylene bis-acetamide inducible 1
  Uniprot ID: O94992
  ENSP ID: ENSP00000328773
MAEPFLSEYQHQPQTSNCTGAAAVQEELNPERPPGAEERVPEEDSRWQSRAFPQLGGRPGPEGEGSLESQPPPLQTQACPESSCLREGEKGQNGDDSSAGGDFPPPAEVEPTPEAELLAQPCHDSEASKLGAPAAGGEEEWGQQQRQLGKKKHRRRPSKKKRHWKPYYKLTWEEKKKFDEKQSLRASRIRAEMFAKGQPVAPYNTTQFLMDDHDQEEPDLKTGLYSKRAAAKSDDTSDDDFMEEGGEEDGGSDGMGGDGSEFLQRDFSETYERYHTESLQNMSKQELIKEYLELEKCLSRMEDENNRLRLESKRLGGDDARVRELELELDRLRAENLQLLTENELHRQQERAPLSKFGD

SEQ ID NO: 38165 - protein, 286 aa, Homo sapiens
  Payload ID: 7577
  Gene Symbol: HEXIM2
  Gene Name: hexamethylene bis-acetamide inducible 2
  Uniprot ID: Q96MH2
  ENSP ID: ENSP00000302276
MMATPNQTACNAESPVALEEAKTSGAPGSPQTPPERHDSGGSLPLTPRMESHSEDEDLAGAVGGLGWNSRSPRTQSPGGCSAEAVLARKKHRRRPSKRKRHWRPYLELSWAEKQQRDERQSQRASRVREEMFAKGQPVAPYNTTQFLMNDRDPEEPNLDVPHGISHPGSSGESEAGDSDGRGRAHGEFQRKDFSETYERFHTESLQGRSKQELVRDYLELEKRLSQAEEETRRLQQLQACTGQQSCRQVEELAAEVQRLRTENQRLRQENQMWNREGCRCDEEPGT

SEQ ID NO: 38166 - protein, 79 aa, Homo sapiens
  Payload ID: 7577
  Gene Symbol: HEXIM2
  Gene Name: hexamethylene bis-acetamide inducible 2
  ENSP ID: ENSP00000464807
MMATPNQTACNAESPVALEEAKTSGAPGSPQTPPERHDSGGSLPLTPRMESHSEDEDLAGAVGGLGWNSRSPRTQSPGG

SEQ ID NO: 38167 - protein, 144 aa, Homo sapiens
  Payload ID: 7577
  Gene Symbol: HEXIM2
  Gene Name: hexamethylene bis-acetamide inducible 2
  ENSP ID: ENSP00000465086
MMATPNQTACNAESPVALEEAKTSGAPGSPQTPPERHDSGGSLPLTPRMESHSEDEDLAGAVGGLGWNSRSPRTQSPGGCSAEAVLARKKHRRRPSKRKRHWRPYLELSWAEKQQRDERQSQRASRVREEMFAKGQPVAPYNTT

SEQ ID NO: 38168 - protein, 286 aa, Homo sapiens; identical to SEQ ID NO: 38165
  Payload ID: 7577
  Gene Symbol: HEXIM2
  Gene Name: hexamethylene bis-acetamide inducible 2
  Uniprot ID: Q96MH2
  ENSP ID: ENSP00000465727

SEQ ID NO: 38169 - protein, 139 aa, Homo sapiens
  Payload ID: 7577
  Gene Symbol: HEXIM2
  Gene Name: hexamethylene bis-acetamide inducible 2
  ENSP ID: ENSP00000466200
MMATPNQTACNAESPVALEEAKTSGAPGSPQTPPERHDSGGSLPLTPRMESHSEDEDLAGAVGGLGWNSRSPRTQSPGGCSAEAVLARKKHRRRPSKRKRHWRPYLELSWAEKQQRDERQSQRASRVREEMFAKGQPVA

SEQ ID NO: 38170 - protein, 286 aa, Homo sapiens; identical to SEQ ID NO: 38165
  Payload ID: 7577
  Gene Symbol: HEXIM2
  Gene Name: hexamethylene bis-acetamide inducible 2
  Uniprot ID: Q96MH2
  ENSP ID: ENSP00000467517

SEQ ID NO: 38171 - protein, 203 aa, Homo sapiens
  Payload ID: 7577
  Gene Symbol: HEXIM2
  Gene Name: hexamethylene bis-acetamide inducible 2
  ENSP ID: ENSP00000468251
MALWCKRGVTSSRRLLKDLEQKMMATPNQTACNAESPVALEEAKTSGAPGSPQTPPERHDSGGSLPLTPRMESHSEDEDLAGAVGGLGWNSRSPRTQSPGGCSAEAVLARKKHRRRPSKRKRHWRPYLELSWAEKQQRDERQSQRASRVREEMFAKGQPVAPYNTTQFLMNDRDPEEPNLDVPHGISHPGSSGESEAGDSDGR

SEQ ID NO: 38172 - protein, 122 aa, Homo sapiens
  Payload ID: 7577
  Gene Symbol: HEXIM2
  Gene Name: hexamethylene bis-acetamide inducible 2
  ENSP ID: ENSP00000468773
MMATPNQTACNAESPVALEEAKTSGAPGSPQTPPERHDSGGSLPLTPRMESHSEDEDLAGAVGGLGWNSRSPRTQSPGGCSAEAVLARKKHRRRPSKRKRHWRPYLELSWAEKQQRDERQSQ

SEQ ID NO: 38173 - protein, 916 aa, Homo sapiens
  Payload ID: 7578
  Gene Symbol: HK1
  Gene Name: hexokinase 1
  Uniprot ID: P19367
  ENSP ID: ENSP00000298649
MDCEHSLSLPCRGAEAWEIGIDKYLYAMRLSDETLIDIMTRFRKEMKNGLSRDFNPTATVKMLPTFVRSIPDGSEKGDFIALDLGGSSFRILRVQVNHEKNQNVHMESEVYDTPENIVHGSGSQLFDHVAECLGDFMEKRKIKDKKLPVGFTFSFPCQQSKIDEAILITWTKRFKASGVEGADVVKLLNKAIKKRGDYDANIVAVVNDTVGTMMTCGYDDQHCEVGLIIGTGTNACYMEELRHIDLVEGDEGRMCINTEWGAFGDDGSLEDIRTEFDREIDRGSLNPGKQLFEKMVSGMYLGELVRLILVKMAKEGLLFEGRITPELLTRGKFNTSDVSAIEKNKEGLHNAKEILTRLGVEPSDDDCVSVQHVCTIVSFRSANLVAATLGAILNRLRDNKGTPRLRTTVGVDGSLYKTHPQYSRRFHKTLRRLVPDSDVRFLLSESGSGKGAAMVTAVAYRLAEQHRQIEETLAHFHLTKDMLLEVKKRMRAEMELGLRKQTHNNAVVKMLPSFVRRTPDGTENGDFLALDLGGTNFRVLLVKIRSGKKRTVEMHNKIYAIPIEIMQGTGEELFDHIVSCISDFLDYMGIKGPRMPLGFTFSFPCQQTSLDAGILITWTKGFKATDCVGHDVVTLLRDAIKRREEFDLDVVAVVNDTVGTMMTCAYEEPTCEVGLIVGTGSNACYMEEMKNVEMVEGDQGQMCINMEWGAFGDNGCLDDIRTHYDRLVDEYSLNAGKQRYEKMISGMYLGEIVRNILIDFTKKGFLFRGQISETLKTRGIFETKFLSQIESDRLALLQVRAILQQLGLNSTCDDSILVKTVCGVVSRRAAQLCGAGMAAVVDKIRENRGLDRLNVTVGVDGTLYKLHPHFSRIMHQTVKELSPKCNVSFLLSEDGSGKGAALITAVGVRLRTEASS

SEQ ID NO: 38174 - protein, 917 aa, Homo sapiens
  Payload ID: 7578
  Gene Symbol: HK1
  Gene Name: hexokinase 1
  Uniprot ID: P19367
  ENSP ID: ENSP00000352398
MIAAQLLAYYFTELKDDQVKKIDKYLYAMRLSDETLIDIMTRFRKEMKNGLSRDFNPTATVKMLPTFVRSIPDGSEKGDFIALDLGGSSFRILRVQVNHEKNQNVHMESEVYDTPENIVHGSGSQLFDHVAECLGDFMEKRKIKDKKLPVGFTFSFPCQQSKIDEAILITWTKRFKASGVEGADVVKLLNKAIKKRGDYDANIVAVVNDTVGTMMTCGYDDQHCEVGLIIGTGTNACYMEELRHIDLVEGDEGRMCINTEWGAFGDDGSLEDIRTEFDREIDRGSLNPGKQLFEKMVSGMYLGELVRLILVKMAKEGLLFEGRITPELLTRGKFNTSDVSAIEKNKEGLHNAKEILTRLGVEPSDDDCVSVQHVCTIVSFRSANLVAATLGAILNRLRDNKGTPRLRTTVGVDGSLYKTHPQYSRRFHKTLRRLVPDSDVRFLLSESGSGKGAAMVTAVAYRLAEQHRQIEETLAHFHLTKDMLLEVKKRMRAEMELGLRKQTHNNAVVKMLPSFVRRTPDGTENGDFLALDLGGTNFRVLLVKIRSGKKRTVEMHNKIYAIPIEIMQGTGEELFDHIVSCISDFLDYMGIKGPRMPLGFTFSFPCQQTSLDAGILITWTKGFKATDCVGHDVVTLLRDAIKRREEFDLDVVAVVNDTVGTMMTCAYEEPTCEVGLIVGTGSNACYMEEMKNVEMVEGDQGQMCINMEWGAFGDNGCLDDIRTHYDRLVDEYSLNAGKQRYEKMISGMYLGEIVRNILIDFTKKGFLFRGQISETLKTRGIFETKFLSQIESDRLALLQVRAILQQLGLNSTCDDSILVKTVCGVVSRRAAQLCGAGMAAVVDKIRENRGLDRLNVTVGVDGTLYKLHPHFSRIMHQTVKELSPKCNVSFLLSEDGSGKGAALITAVGVRLRTEASS

SEQ ID NO: 38175 - protein, 905 aa, Homo sapiens
  Payload ID: 7578
  Gene Symbol: HK1
  Gene Name: hexokinase 1
  Uniprot ID: P19367
  ENSP ID: ENSP00000353433
MAKRALHDFIDKYLYAMRLSDETLIDIMTRFRKEMKNGLSRDFNPTATVKMLPTFVRSIPDGSEKGDFIALDLGGSSFRILRVQVNHEKNQNVHMESEVYDTPENIVHGSGSQLFDHVAECLGDFMEKRKIKDKKLPVGFTFSFPCQQSKIDEAILITWTKRFKASGVEGADVVKLLNKAIKKRGDYDANIVAVVNDTVGTMMTCGYDDQHCEVGLIIGTGTNACYMEELRHIDLVEGDEGRMCINTEWGAFGDDGSLEDIRTEFDREIDRGSLNPGKQLFEKMVSGMYLGELVRLILVKMAKEGLLFEGRITPELLTRGKFNTSDVSAIEKNKEGLHNAKEILTRLGVEPSDDDCVSVQHVCTIVSFRSANLVAATLGAILNRLRDNKGTPRLRTTVGVDGSLYKTHPQYSRRFHKTLRRLVPDSDVRFLLSESGSGKGAAMVTAVAYRLAEQHRQIEETLAHFHLTKDMLLEVKKRMRAEMELGLRKQTHNNAVVKMLPSFVRRTPDGTENGDFLALDLGGTNFRVLLVKIRSGKKRTVEMHNKIYAIPIEIMQGTGEELFDHIVSCISDFLDYMGIKGPRMPLGFTFSFPCQQTSLDAGILITWTKGFKATDCVGHDVVTLLRDAIKRREEFDLDVVAVVNDTVGTMMTCAYEEPTCEVGLIVGTGSNACYMEEMKNVEMVEGDQGQMCINMEWGAFGDNGCLDDIRTHYDRLVDEYSLNAGKQRYEKMISGMYLGEIVRNILIDFTKKGFLFRGQISETLKTRGIFETKFLSQIESDRLALLQVRAILQQLGLNSTCDDSILVKTVCGVVSRRAAQLCGAGMAAVVDKIRENRGLDRLNVTVGVDGTLYKLHPHFSRIMHQTVKELSPKCNVSFLLSEDGSGKGAALITAVGVRLRTEASS

SEQ ID NO: 38176 - protein, 114 aa, Homo sapiens
  Payload ID: 7578
  Gene Symbol: HK1
  Gene Name: hexokinase 1
  ENSP ID: ENSP00000398316
MAKRALHDFIDKYLYAMRLSDETLIDIMTRFRKEMKNGLSRDFNPTATVKMLPTFVRSIPDGSEKGDFIALDLGGSSFRILRVQVNHEKNQNVHMESEVYDTPENIVHGSGSQL

SEQ ID NO: 38177 - protein, 921 aa, Homo sapiens
  Payload ID: 7578
  Gene Symbol: HK1
  Gene Name: hexokinase 1
  Uniprot ID: P19367
  ENSP ID: ENSP00000402103
MGQICQRESATAAEKPKLHLLAESEIDKYLYAMRLSDETLIDIMTRFRKEMKNGLSRDFNPTATVKMLPTFVRSIPDGSEKGDFIALDLGGSSFRILRVQVNHEKNQNVHMESEVYDTPENIVHGSGSQLFDHVAECLGDFMEKRKIKDKKLPVGFTFSFPCQQSKIDEAILITWTKRFKASGVEGADVVKLLNKAIKKRGDYDANIVAVVNDTVGTMMTCGYDDQHCEVGLIIGTGTNACYMEELRHIDLVEGDEGRMCINTEWGAFGDDGSLEDIRTEFDREIDRGSLNPGKQLFEKMVSGMYLGELVRLILVKMAKEGLLFEGRITPELLTRGKFNTSDVSAIEKNKEGLHNAKEILTRLGVEPSDDDCVSVQHVCTIVSFRSANLVAATLGAILNRLRDNKGTPRLRTTVGVDGSLYKTHPQYSRRFHKTLRRLVPDSDVRFLLSESGSGKGAAMVTAVAYRLAEQHRQIEETLAHFHLTKDMLLEVKKRMRAEMELGLRKQTHNNAVVKMLPSFVRRTPDGTENGDFLALDLGGTNFRVLLVKIRSGKKRTVEMHNKIYAIPIEIMQGTGEELFDHIVSCISDFLDYMGIKGPRMPLGFTFSFPCQQTSLDAGILITWTKGFKATDCVGHDVVTLLRDAIKRREEFDLDVVAVVNDTVGTMMTCAYEEPTCEVGLIVGTGSNACYMEEMKNVEMVEGDQGQMCINMEWGAFGDNGCLDDIRTHYDRLVDEYSLNAGKQRYEKMISGMYLGEIVRNILIDFTKKGFLFRGQISETLKTRGIFETKFLSQIESDRLALLQVRAILQQLGLNSTCDDSILVKTVCGVVSRRAAQLCGAGMAAVVDKIRENRGLDRLNVTVGVDGTLYKLHPHFSRIMHQTVKELSPKCNVSFLLSEDGSGKGAALITAVGVRLRTEASS

SEQ ID NO: 38178 - protein, 139 aa, Homo sapiens
  Payload ID: 7578
  Gene Symbol: HK1
  Gene Name: hexokinase 1
  ENSP ID: ENSP00000409761
MGQICQRESATAAEKPKLHLLAESEIDKYLYAMRLSDETLIDIMTRFRKEMKNGLSRDFNPTATVKMLPTFVRSIPDGSEKGDFIALDLGGSSFRILRVQVNHEKNQNVHMESEVYDTPENIVHGSGSQLFDHVAECLG

SEQ ID NO: 38179 - protein, 290 aa, Homo sapiens
  Payload ID: 7578
  Gene Symbol: HK1
  Gene Name: hexokinase 1
  ENSP ID: ENSP00000415949
MDCEHSLSLPCRGAEAWEIGIDKYLYAMRLSDETLIDIMTRFRKEMKNGLSRDFNPTATVKMLPTFVRSIPDGSEKGDFIALDLGGSSFRILRVQVNHEKNQNVHMESEVYDTPENIVHGSGSQLFDHVAECLGDFMEKRKIKDKKLPVGFTFSFPCQQSKIDEAILITWTKRFKASGVEGADVVKLLNKAIKKRGDYDANIVAVVNDTVGTMMTCGYDDQHCEVGLIIGTGTNACYMEELRHIDLVEGDEGRMCINTEWGAFGDDGSLEDIRTEFDREIDRGSLNPGKQ

SEQ ID NO: 38180 - protein, 917 aa, Homo sapiens
  Payload ID: 7579
  Gene Symbol: HK2
  Gene Name: hexokinase 2
  Uniprot ID: P52789
  ENSP ID: ENSP00000290573
MIASHLLAYFFTELNHDQVQKVDQYLYHMRLSDETLLEISKRFRKEMEKGLGATTHPTAAVKMLPTFVRSTPDGTEHGEFLALDLGGTNFRVLWVKVTDNGLQKVEMENQIYAIPEDIMRGSGTQLFDHIAECLANFMDKLQIKDKKLPLGFTFSFPCHQTKLDESFLVSWTKGFKSSGVEGRDVVALIRKAIQRRGDFDIDIVAVVNDTVGTMMTCGYDDHNCEIGLIVGTGSNACYMEEMRHIDMVEGDEGRMCINMEWGAFGDDGSLNDIRTEFDQEIDMGSLNPGKQLFEKMISGMYMGELVRLILVKMAKEELLFGGKLSPELLNTGRFETKDISDIEGEKDGIRKAREVLMRLGLDPTQEDCVATHRICQIVSTRSASLCAATLAAVLQRIKENKGEERLRSTIGVDGSVYKKHPHFAKRLHKTVRRLVPGCDVRFLRSEDGSGKGAAMVTAVAYRLADQHRARQKTLEHLQLSHDQLLEVKRRMKVEMERGLSKETHASAPVKMLPTYVCATPDGTEKGDFLALDLGGTNFRVLLVRVRNGKWGGVEMHNKIYAIPQEVMHGTGDELFDHIVQCIADFLEYMGMKGVSLPLGFTFSFPCQQNSLDESILLKWTKGFKASGCEGEDVVTLLKEAIHRREEFDLDVVAVVNDTVGTMMTCGFEDPHCEVGLIVGTGSNACYMEEMRNVELVEGEEGRMCVNMEWGAFGDNGCLDDFRTEFDVAVDELSLNPGKQRFEKMISGMYLGEIVRNILIDFTKRGLLFRGRISERLKTRGIFETKFLSQIESDCLALLQVRAILQHLGLESTCDDSIIVKEVCTVVARRAAQLCGAGMAAVVDRIRENRGLDALKVTVGVDGTLYKLHPHFAKVMHETVKDLAPKCDVSFLQSEDGSGKGAALITAVACRIREAGQR

SEQ ID NO: 38181 - protein, 889 aa, Homo sapiens
  Payload ID: 7579
  Gene Symbol: HK2
  Gene Name: hexokinase 2
  ENSP ID: ENSP00000387140
MRLSDETLLEISKRFRKEMEKGLGATTHPTAAVKMLPTFVRSTPDGTEHGEFLALDLGGTNFRVLWVKVTDNGLQKVEMENQIYAIPEDIMRGSGTQLFDHIAECLANFMDKLQIKDKKLPLGFTFSFPCHQTKLDESFLVSWTKGFKSSGVEGRDVVALIRKAIQRRGDFDIDIVAVVNDTVGTMMTCGYDDHNCEIGLIVGTGSNACYMEEMRHIDMVEGDEGRMCINMEWGAFGDDGSLNDIRTEFDQEIDMGSLNPGKQLFEKMISGMYMGELVRLILVKMAKEELLFGGKLSPELLNTGRFETKDISDIEGEKDGIRKAREVLMRLGLDPTQEDCVATHRICQIVSTRSASLCAATLAAVLQRIKENKGEERLRSTIGVDGSVYKKHPHFAKRLHKTVRRLVPGCDVRFLRSEDGSGKGAAMVTAVAYRLADQHRARQKTLEHLQLSHDQLLEVKRRMKVEMERGLSKETHASAPVKMLPTYVCATPDGTEKGDFLALDLGGTNFRVLLVRVRNGKWGGVEMHNKIYAIPQEVMHGTGDELFDHIVQCIADFLEYMGMKGVSLPLGFTFSFPCQQNSLDESILLKWTKGFKASGCEGEDVVTLLKEAIHRREEFDLDVVAVVNDTVGTMMTCGFEDPHCEVGLIVGTGSNACYMEEMRNVELVEGEEGRMCVNMEWGAFGDNGCLDDFRTEFDVAVDELSLNPGKQRFEKMISGMYLGEIVRNILIDFTKRGLLFRGRISERLKTRGIFETKFLSQIESDCLALLQVRAILQHLGLESTCDDSIIVKEVCTVVARRAAQLCGAGMAAVVDRIRENRGLDALKVTVGVDGTLYKLHPHFAKVMHETVKDLAPKCDVSFLQSEDGSGKGAALITAVACRIREAGQR

SEQ ID NO: 38182 - protein, 923 aa, Homo sapiens
  Payload ID: 7580
  Gene Symbol: HK3
  Gene Name: hexokinase 3 (white cell)
  Uniprot ID: P52790
  ENSP ID: ENSP00000292432
MDSIGSSGLRQGEETLSCSEEGLPGPSDSSELVQECLQQFKVTRAQLQQIQASLLGSMEQALRGQASPAPAVRMLPTYVGSTPHGTEQGDFVVLELGATGASLRVLWVTLTGIEGHRVEPRSQEFVIPQEVMLGAGQQLFDFAAHCLSEFLDAQPVNKQGLQLGFSFSFPCHQTGLDRSTLISWTKGFRCSGVEGQDVVQLLRDAIRRQGAYNIDVVAVVNDTVGTMMGCEPGVRPCEVGLVVDTGTNACYMEEARHVAVLDEDRGRVCVSVEWGSFSDDGALGPVLTTFDHTLDHESLNPGAQRFEKMIGGLYLGELVRLVLAHLARCGVLFGGCTSPALLSQGSILLEHVAEMEDPSTGAARVHAILQDLGLSPGASDVELVQHVCAAVCTRAAQLCAAALAAVLSCLQHSREQQTLQVAVATGGRVCERHPRFCSVLQGTVMLLAPECDVSLIPSVDGGGRGVAMVTAVAARLAAHRRLLEETLAPFRLNHDQLAAVQAQMRKAMAKGLRGEASSLRMLPTFVRATPDGSERGDFLALDLGGTNFRVLLVRVTTGVQITSEIYSIPETVAQGSGQQLFDHIVDCIVDFQQKQGLSGQSLPLGFTFSFPCRQLGLDQGILLNWTKGFKASDCEGQDVVSLLREAITRRQAVELNVVAIVNDTVGTMMSCGYEDPRCEIGLIVGTGTNACYMEELRNVAGVPGDSGRMCINMEWGAFGDDGSLAMLSTRFDASVDQASINPGKQRFEKMISGMYLGEIVRHILLHLTSLGVLFRGQQIQRLQTRDIFKTKFLSEIESDSLALRQVRAILEDLGLPLTSDDALMVLEVCQAVSQRAAQLCGAGVAAVVEKIRENRGLEELAVSVGVDGTLYKLHPRFSSLVAATVRELAPRCVVTFLQSEDGSGKGAALVTAVACRLAQLTRV

SEQ ID NO: 38183 - protein, 106 aa, Homo sapiens
  Payload ID: 7580
  Gene Symbol: HK3
  Gene Name: hexokinase 3 (white cell)
  ENSP ID: ENSP00000422169
LQQFKVTRAQLQQIQASLLGSMEQALRGQASPAPAVRMLPTYVGSTPHGTDFAGLRNLGSGQRALVLPAAWLSVTCLPSRARRLRGAGAGGHRGLTACFVGDSNWH

SEQ ID NO: 38184 - protein, 131 aa, Homo sapiens
  Payload ID: 7580
  Gene Symbol: HK3
  Gene Name: hexokinase 3 (white cell)
  ENSP ID: ENSP00000424632
GILLNWTKGFKASDCEGQDVVSLLREAITRRQAVELNVVAIVNDTVGTMMSCGYEDPRCEIGLIVASTLSGLSAGTGTNACYMEELRNVAGVPGDSGRMCINMEWGAFGDDGSLAMLSTRFDASVDQASIN

SEQ ID NO: 38185 - protein, 57 aa, Homo sapiens
  Payload ID: 7580
  Gene Symbol: HK3
  Gene Name: hexokinase 3 (white cell)
  ENSP ID: ENSP00000427000
TDFAGLRNLGSGQRALVLPAAWLSVTCLPSRARRLRGAGAGGHRGLTACFVGDSNWH

SEQ ID NO: 38186 - protein, 917 aa, Homo sapiens
  Payload ID: 7581
  Gene Symbol: HKDC1
  Gene Name: hexokinase domain containing 1
  Uniprot ID: Q2TB90
  ENSP ID: ENSP00000346643
MFAVHLMAFYFSKLKEDQIKKVDRFLYHMRLSDDTLLDIMRRFRAEMEKGLAKDTNPTAAVKMLPTFVRAIPDGSENGEFLSLDLGGSKFRVLKVQVAEEGKRHVQMESQFYPTPNEIIRGNGTELFEYVADCLADFMKTKDLKHKKLPLGLTFSFPCRQTKLEEGVLLSWTKKFKARGVQDTDVVSRLTKAMRRHKDMDVDILALVNDTVGTMMTCAYDDPYCEVGVIIGTGTNACYMEDMSNIDLVEGDEGRMCINTEWGAFGDDGALEDIRTEFDRELDLGSLNPGKQLFEKMISGLYLGELVRLILLKMAKAGLLFGGEKSSALHTKGKIETRHVAAMEKYKEGLANTREILVDLGLEPSEADCIAVQHVCTIVSFRSANLCAAALAAILTRLRENKKVERLRTTVGMDGTLYKIHPQYPKRLHKVVRKLVPSCDVRFLLSESGSTKGAAMVTAVASRVQAQRKQIDRVLALFQLTREQLVDVQAKMRAELEYGLKKKSHGLATVRMLPTYVCGLPDGTEKGKFLALDLGGTNFRVLLVKIRSGRRSVRMYNKIFAIPLEIMQGTGEELFDHIVQCIADFLDYMGLKGASLPLGFTFSFPCRQMSIDKGTLIGWTKGFKATDCEGEDVVDMLREAIKRRNEFDLDIVAVVNDTVGTMMTCGYEDPNCEIGLIAGTGSNMCYMEDMRNIEMVEGGEGKMCINTEWGGFGDNGCIDDIWTRYDTEVDEGSLNPGKQRYEKMTSGMYLGEIVRQILIDLTKQGLLFRGQISERLRTRGIFETKFLSQIESDRLALLQVRRILQQLGLDSTCEDSIVVKEVCGAVSRRAAQLCGAGLAAIVEKRREDQGLEHLRITVGVDGTLYKLHPHFSRILQETVKELAPRCDVTFMLSEDGSGKGAALITAVAKRLQQAQKEN

SEQ ID NO: 38187 - protein, 486 aa, Homo sapiens
  Payload ID: 7582
  Gene Symbol: HEXDC
  Gene Name: hexosaminidase (glycosyl hydrolase family 20, catalytic domain) containing
  Uniprot ID: Q8WVB3
  ENSP ID: ENSP00000332634
MSGSTPFQMRLVHLDLKGAPPKVSYLSEIFPLFRALGANGLLIEYEDMFPYEGPLRLLRAKYAYSPSEIKEILHLAGLNELEVIPLVQTFGHMEFVLKHTAFAHLREVGSFPCTLNPHEAESLALVGAMIDQVLELHPGAQRLHIGCDEVYYLGEGEASRRWLQQEQNSTGKLCLSHMRAVASGVKARRPSVTPLVWDDMLRDLPEDQLAASGVPQLVEPVLWDYTADLDVHGKVLLMQKYRRCGFPQLWAASAFKGATGPSQAVPPVEHHLRNHVQWLQVAGSGPTDSLQGIILTGWQRYDHYSVLCELLPAGVPSLAACLQLLLRGGFDEDVKAKVENLLGISSLEKTDPVREGAGSFPGSNILALVTQVSLHLRSSVDALLEGNRYVTGWFSPYHRQRKLIHPVMVQHIQPAALSLLAQWSTLVQELEAALQLAFYPDAVEEWLEENVHPSLQRLQALLQDLSEVSAPPLPPTSPGRDVAQDP

SEQ ID NO: 38188 - protein, 585 aa, Homo sapiens
  Payload ID: 7582
  Gene Symbol: HEXDC
  Gene Name: hexosaminidase (glycosyl hydrolase family 20, catalytic domain) containing
  Uniprot ID: Q8WVB3
  ENSP ID: ENSP00000337854
MSGSTPFQMRLVHLDLKGAPPKVSYLSEIFPLFRALGANGLLIEYEDMFPYEGPLRLLRAKYAYSPSEIKEILHLAGLNELEVIPLVQTFGHMEFVLKHTAFAHLREVGSFPCTLNPHEAESLALVGAMIDQVLELHPGAQRLHIGCDEVYYLGEGEASRRWLQQEQNSTGKLCLSHMRAVASGVKARRPSVTPLVWDDMLRDLPEDQLAASGVPQLVEPVLWDYTADLDVHGKVLLMQKYRRCGFPQLWAASAFKGATGPSQAVPPVEHHLRNHVQWLQVAGSGPTDSLQGIILTGWQRYDHYSVLCELLPAGVPSLAACLQLLLRGGFDEDVKAKVENLLGISSLEKTDPVRQAPCSPPCPLLPLPFPRPWRQLFSAGLSAGRGPAPSLAATSLPLSHKSASICAALWMRCWRATGMSLAGSAPTTASGSSSTRSWFSTSSPQRSASWHSGAPSCRSWRLPCSWLSTRMPWRSGWRKTCTPACSGCKLCCRTSARCLPPRCHPPALAGTLLRTPEGRAHARGLLLEAGGALHCQMAWAIRAHVGVVPSGPAVSCPHSVPEGPGQPLGERLENTEGSSTGRPAL

SEQ ID NO: 38189 - protein, 214 aa, Homo sapiens
  Payload ID: 7582
  Gene Symbol: HEXDC
  Gene Name: hexosaminidase (glycosyl hydrolase family 20, catalytic domain) containing
  ENSP ID: ENSP00000462000
HGKVLLMQKYRRCGFPQLWAASAFKGATGPSQAVPPVEHHLRNHVQWLQVAGSGPTDSLQGIILTGWQRYDHYSVLCELLPAGVPSLAACLQLLLRGGFDEDVKAKVENLLGISSLEKTDPVSPYHRQRKLIHPVMVQHIQPAALSLLAQWSTLVQELEAALQLAFYPDAVEEWLEENVHPSLQRLQALLQDLSEVSAPPLPPTSPGRDVAQDP

SEQ ID NO: 38190 - protein, 76 aa, Homo sapiens
  Payload ID: 7582
  Gene Symbol: HEXDC
  Gene Name: hexosaminidase (glycosyl hydrolase family 20, catalytic domain) containing
  ENSP ID: ENSP00000462303
GLLIEYEDMFPYEGPLRLLRAKYAYRLECSGAILAHRELCLPGSSDSPASASRVAGITAPLKSKRSCIWLDSMSWR

SEQ ID NO: 38191 - protein, 117 aa, Homo sapiens
  Payload ID: 7582
  Gene Symbol: HEXDC
  Gene Name: hexosaminidase (glycosyl hydrolase family 20, catalytic domain) containing
  ENSP ID: ENSP00000462856
MEFVLKHTAFAHLREVGSFPCTLNPHEAESLALVGAMIDQVLELHPGAQRLHIGCDEVYYLGEGEASRRWLQQEQNSTGKLCLSHMRAVASGVKARRPSVTPLVWDDMLRDLPEDQL

SEQ ID NO: 38192 - protein, 47 aa, Homo sapiens
  Payload ID: 7582
  Gene Symbol: HEXDC
  Gene Name: hexosaminidase (glycosyl hydrolase family 20, catalytic domain) containing
  ENSP ID: ENSP00000462923
MSGSTPFQMRLVHLDLKGAPPKVSYLSEAGVQWCDLGSPRTLPPGFK

SEQ ID NO: 38193 - protein, 544 aa, Homo sapiens
  Payload ID: 7582
  Gene Symbol: HEXDC
  Gene Name: hexosaminidase (glycosyl hydrolase family 20, catalytic domain) containing
  ENSP ID: ENSP00000463129
MSGSTPFQMRLVHLDLKGAPPKVSYLSEIFPLFRALGANGLLIEYEDMFPYEGPLRLLRAKYAYSPSEIKEILHLAGLNELEVIPLVQTFGHMEFVLKHTAFAHLREVGSFPCTLNPHEAESLALVGAMIDQVLELHPGAQRLHIGCDEVYYLGEGEASRRWLQQEQNSTGKLCLSHMRAVASGVKARRPSVTPLVWDDMLRDLPEDQLAASGVPQLVEPVLWDYTADLDVHGKVLLMQKYRRCGFPQLWAASAFKGATGPSQAVPPVEHHLRNHVQWLQVAGSGPTDSLQGIILTGWQRYDHYSVLCELLPAGVPSLAACLQLLLRGGFDEDVKAKVENLLGISSLEKTDPGSPQGGGRLLPWQQHPCPCHTSQPPSAQLCGCAAGGQQVCHWLVQPLPPPAEAHPPGHGSAHPARSAQPPGTVEHPRAGAGGCPAAGFLPGCRGGVAGGKRAPQPAAAASSAAGPQRGVCPPAATHQPWQGRCSGPLRGELMPGGSCWRLGGLCTAKWPGQYGPTWASCPLAQQCLAHTQFLRALGSPWGRD

SEQ ID NO: 38194 - protein, 88 aa, Homo sapiens
  Payload ID: 7582
  Gene Symbol: HEXDC
  Gene Name: hexosaminidase (glycosyl hydrolase family 20, catalytic domain) containing
  ENSP ID: ENSP00000463241
AASAFKGATGPSQAVPPVEHHLRNHVQWLQVAGSGPTDSLQGIILTGWQRYDHYSVLCELLPAGVPSLAACLQLLLRVSLAHGPIRHP

SEQ ID NO: 38195 - protein, 78 aa, Homo sapiens
  Payload ID: 7582
  Gene Symbol: HEXDC
  Gene Name: hexosaminidase (glycosyl hydrolase family 20, catalytic domain) containing
  ENSP ID: ENSP00000463625
MFPYEGPLRLLRAKYAYSPSEIKEILHLAGLNELEVIPLVQTFGHMEFVLKHTAFAHLREVGSFPCTLNPHEAESLAL

SEQ ID NO: 38196 - protein, 46 aa, Homo sapiens
  Payload ID: 7582
  Gene Symbol: HEXDC
  Gene Name: hexosaminidase (glycosyl hydrolase family 20, catalytic domain) containing
  ENSP ID: ENSP00000464497
MSGSTPFQMRLVHLDLKGAPPKVSYLSEVQTASSLSMKTCFPTRAL

SEQ ID NO: 38197 - protein, 361 aa, Homo sapiens
  Payload ID: 7582
  Gene Symbol: HEXDC
  Gene Name: hexosaminidase (glycosyl hydrolase family 20, catalytic domain) containing
  ENSP ID: ENSP00000464912
  MOD_RES (1)..(1): Any amino acid
XLHIGCDEVYYLGEGEASRRWLQQEQNSTGKLCLSHMRAVASGVKARRPSVTPLVWDDMLRDLPEDQLAASGVPQLVEPVLWDYTADLDVHGKVLLMQKYRRCGFPQLWAASAFKGATGPSQAVPPVEHHLRNHVQWLQVAGSGPTDSLQGIILTGWQRYDHYSVLCELLPAGVPSLAACLQLLLRGMSGLATPSPTGPSPKDPEGRRPSTQCSNHPAGLWWSSQSEDGLTAPAQPPTCPEVHPGWACVWVSRPKPKAGWRVTREAPLRHSESAEMHAGRRWGTAPPLLHTRPAHLAEQVWGSGARPWKAPHPGPSTHTSRSPEGAAGPMGRGRHRGTPWGRQGAWPEELCVWKLAGHTGN

SEQ ID NO: 38198 - protein, 80 aa, Homo sapiens
  Payload ID: 7582
  Gene Symbol: HEXDC
  Gene Name: hexosaminidase (glycosyl hydrolase family 20, catalytic domain) containing
  ENSP ID: ENSP00000465465
  MOD_RES (1)..(1): Any amino acid
XGTAPPLLHTRPAHLAEQVWGSGARPWKAPHPGPSTHTSRSPEGAAGPMGRGRHRGTPWGRQGAWPEELCVWKLAGHTGN

SEQ ID NO: 38199 - protein, 529 aa, Homo sapiens
  Payload ID: 7583
  Gene Symbol: HEXA
  Gene Name: hexosaminidase A (alpha polypeptide)
  Uniprot ID: P06865
  ENSP ID: ENSP00000268097
MTSSRLWFSLLLAAAFAGRATALWPWPQNFQTSDQRYVLYPNNFQFQYDVSSAAQPGCSVLDEAFQRYRDLLFGSGSWPRPYLTGKRHTLEKNVLVVSVVTPGCNQLPTLESVENYTLTINDDQCLLLSETVWGALRGLETFSQLVWKSAEGTFFINKTEIEDFPRFPHRGLLLDTSRHYLPLSSILDTLDVMAYNKLNVFHWHLVDDPSFPYESFTFPELMRKGSYNPVTHIYTAQDVKEVIEYARLRGIRVLAEFDTPGHTLSWGPGIPGLLTPCYSGSEPSGTFGPVNPSLNNTYEFMSTFFLEVSSVFPDFYLHLGGDEVDFTCWKSNPEIQDFMRKKGFGEDFKQLESFYIQTLLDIVSSYGKGYVVWQEVFDNKVKIQPDTIIQVWREDIPVNYMKELELVTKAGFRALLSAPWYLNRISYGPDWKDFYIVEPLAFEGTPEQKALVIGGEACMWGEYVDNTNLVPRLWPRAGAVAERLWSNKLTSDLTFAYERLSHFRCELLRRGVQAQPLNVGFCEQEFEQT

SEQ ID NO: 38200 - protein, 540 aa, Homo sapiens
  Payload ID: 7583
  Gene Symbol: HEXA
  Gene Name: hexosaminidase A (alpha polypeptide)
  ENSP ID: ENSP00000455114
MTSSRLWFSLLLAAAFAGRATALWPWPQNFQTSDQRYVLYPNNFQFQYDVSSAAQPGCSVLDEAFQRYRDLLFGSGSWPRPYLTGWPHQAYPVFLGKRHTLEKNVLVVSVVTPGCNQLPTLESVENYTLTINDDQCLLLSETVWGALRGLETFSQLVWKSAEGTFFINKTEIEDFPRFPHRGLLLDTSRHYLPLSSILDTLDVMAYNKLNVFHWHLVDDPSFPYESFTFPELMRKGSYNPVTHIYTAQDVKEVIEYARLRGIRVLAEFDTPGHTLSWGPGIPGLLTPCYSGSEPSGTFGPVNPSLNNTYEFMSTFFLEVSSVFPDFYLHLGGDEVDFTCWKSNPEIQDFMRKKGFGEDFKQLESFYIQTLLDIVSSYGKGYVVWQEVFDNKVKIQPDTIIQVWREDIPVNYMKELELVTKAGFRALLSAPWYLNRISYGPDWKDFYIVEPLAFEGTPEQKALVIGGEACMWGEYVDNTNLVPRLWPRAGAVAERLWSNKLTSDLTFAYERLSHFRCELLRRGVQAQPLNVGFCEQEFEQT

SEQ ID NO: 38201 - protein, 143 aa, Homo sapiens
  Payload ID: 7583
  Gene Symbol: HEXA
  Gene Name: hexosaminidase A (alpha polypeptide)
  ENSP ID: ENSP00000455545
MTSSRLWFSLLLAAAFAGRATALWPWPQNFQTSDQRYVLYPNNFQFQYDVSSAAQPGCSVLDEAFQRYRDLLFGSGSWPRPYLTGKRHTLEKNVLVVSVVTPGCNQLPTLESVENYTLTINDDQCLLLSETVWGALRVLYQQD

SEQ ID NO: 38202 - protein, 88 aa, Homo sapiens
  Payload ID: 7583
  Gene Symbol: HEXA
  Gene Name: hexosaminidase A (alpha polypeptide)
  ENSP ID: ENSP00000456346
MTSSRLWFSLLLAAAFAGRATALWPWPQNFQTSDQRYVLYPNNFQFQYDVSSAAQPGCSVLDEAFQRYRDLLFGSGSWPRPYLTANMY

SEQ ID NO: 38203 - protein, 509 aa, Homo sapiens
  Payload ID: 7583
  Gene Symbol: HEXA
  Gene Name: hexosaminidase A (alpha polypeptide)
  ENSP ID: ENSP00000456489
MTSSRLWFSLLLAAAFAGRATALWPWPQNFQTSDQRYVLYPNNFQFQYDVSSAAQPGCSVLDEAFQRYRDLLFGSGSWPRPYLTGKRHTLEKNVLVVSVVTPGCNQLPTLESVENYTLTINDDQCLLLSETVWGALRGLETFSQLVWKSAEGTFFINKTEIEDFPRFPHRGLLLDTSRHYLPLSSILDTLDVMAYNKLNVFHWHLVDDPSFPYESFTFPELMRKGSYNPVTHIYTAQDVKEVIEYARLRGIRVLAEFDTPGHTLSWGPGIPGLLTPCYSGSEPSGTFGPVNPSLNNTYEFMSTFFLEVSSVFPDFYLHLGGDEVDFTCWKSNPEIQDFMRKKGFGEDFKQLESFYIQTLLDIVSSYGKGYVVWQEVFDNKVKIQPDTIIQVWREDIPVNYMKELELVTKAGFRALLSAPWYLNRISYGPDWKDFYIVEPLAFEGTPEQKALVIGGEACMWGEYVDNTNLVPRLWPRAGAVAERLWSNKLTSDLTFAYERLSHFRCELLR

SEQ ID NO: 38204 - protein, 143 aa, Homo sapiens
  Payload ID: 7583
  Gene Symbol: HEXA
  Gene Name: hexosaminidase A (alpha polypeptide)
  ENSP ID: ENSP00000457037
MTSSRLWFSLLLAAAFAGRATALWPWPQNFQTSDQRYVLYPNNFQFQYDVSSAAQPGCSVLDEAFQRYRDLLFGSGSWPRPYLTGKRHTLEKNVLVVSVVTPGCNQLPTLESVENYTLTINDDQCLLLSETVWGALRGCHGVQ

SEQ ID NO: 38205 - protein, 373 aa, Homo sapiens
  Payload ID: 7583
  Gene Symbol: HEXA
  Gene Name: hexosaminidase A (alpha polypeptide)
  ENSP ID: ENSP00000457125
MTSSRLWFSLLLAAAFAGRATALWPWPQNFQTSDQRYVLYPNNFQFQYDVSSAAQPGCSVLDEAFQRYRDLLFGSGSWPRPYLTGKRHTLEKNVLVVSVVTPGCNQLPTLESVENYTLTINDDQCLLLSETVWGALRGLETFSQLVWKSAEGTFFINKTEIEDFPRFPHRGLLLDTSRHYLPLSSILDTLDVMAYNKLNVFHWHLVDDPSFPYESFTFPELMRKGSYNPVTHIYTAQDVKEVIEYARLRGIRVLAEFDTPGHTLSWGPGIPGLLTPCYSGSEPSGTFGPVNPSLNNTYEFMSTFFLEVSSVFPDFYLHLGGDEVDFTCWKSNPEIQDFMRKKGFGEDFKQLESFYIQTFSQTQSYRCGERIFQ

SEQ ID NO: 38206 - protein, 318 aa, Homo sapiens
  Payload ID: 7583
  Gene Symbol: HEXA
  Gene Name: hexosaminidase A (alpha polypeptide)
  ENSP ID: ENSP00000457521
  MOD_RES (1)..(1): Any amino acid
XFQFQYDVSSAAQPGCSVLDEAFQRYRDLLFGSGSWPRPYLTGKRHTLEKNVLVVSVVTPGCNQLPTLESVENYTLTINDDQCLLLSETVWGALRGLETFSQLVWKSAEGTFFINKTEIEDFPRFPHRGLLLDTSRHYLPLSSILDTLDVMAYNKLNVFHWHLVDDPSFPYESFTFPELMRKGSYNPVTHIYTAQDVKEVIEYARLRGIRVLAEFDTPGHTLSWGPGIPGLLTPCYSGSEPSGTFGPVNPSLNNTYEFMSTFFLEVSSVFPDFYLHLGGDEVDFTCWKSNPEIQDFMRKKGFGEDFKQLESFYIQTYP

SEQ ID NO: 38207 - protein, 128 aa, Homo sapiens
  Payload ID: 7583
  Gene Symbol: HEXA
  Gene Name: hexosaminidase A (alpha polypeptide)
  ENSP ID: ENSP00000458128
  MOD_RES (1)..(1): Any amino acid
XFSLLLAAAFAGRATALWPWPQNFQTSDQRYVLYPNNFQFQYDVSSAAQPGCSVLDEAFQRYRDLLFGSGSWPRPYLTGKRHTLEKNVLVVSVVTPGCNQLPTLESVENCIPVPFARRRLLSSFCCGN

SEQ ID NO: 38208 - protein, 119 aa, Homo sapiens
  Payload ID: 7583
  Gene Symbol: HEXA
  Gene Name: hexosaminidase A (alpha polypeptide)
  ENSP ID: ENSP00000478217
MTSSRLWFSLLLAAAFAGRATALWPWPQNFQTSDQRYVLYPNNFQFQYDVSSAAQPGCSVLDEAFQRYRDLLFGSGSWPRPYLTGLSLSFRLECSGVITAYSNLELQDSSSLPASLMSS

SEQ ID NO: 38209 - protein, 556 aa, Homo sapiens
  Payload ID: 7584
  Gene Symbol: HEXB
  Gene Name: hexosaminidase B (beta polypeptide)
  Uniprot ID: P07686
  ENSP ID: ENSP00000261416
MELCGLGLPRPPMLLALLLATLLAAMLALLTQVALVVQVAEAARAPSVSAKPGPALWPLPLLVKMTPNLLHLAPENFYISHSPNSTAGPSCTLLEEAFRRYHGYIFGFYKWHHEPAEFQAKTQVQQLLVSITLQSECDAFPNISSDESYTLLVKEPVAVLKANRVWGALRGLETFSQLVYQDSYGTFTINESTIIDSPRFSHRGILIDTSRHYLPVKIILKTLDAMAFNKFNVLHWHIVDDQSFPYQSITFPELSNKGSYSLSHVYTPNDVRMVIEYARLRGIRVLPEFDTPGHTLSWGKGQKDLLTPCYSRQNKLDSFGPINPTLNTTYSFLTTFFKEISEVFPDQFIHLGGDEVEFKCWESNPKIQDFMRQKGFGTDFKKLESFYIQKVLDIIATINKGSIVWQEVFDDKAKLAPGTIVEVWKDSAYPEELSRVTASGFPVILSAPWYLDLISYGQDWRKYYKVEPLDFGGTQKQKQLFIGGEACLWGEYVDATNLTPRLWPRASAVGERLWSSKDVRDMDDAYDRLTRHRCRMVERGIAAQPLYAGYCNHENM

SEQ ID NO: 38210 - protein, 202 aa, Homo sapiens
  Payload ID: 7584
  Gene Symbol: HEXB
  Gene Name: hexosaminidase B (beta polypeptide)
  ENSP ID: ENSP00000423713
  MOD_RES (1)..(1): Any amino acid
XNTTYSFLTTFFKEISEVFPDQFIHLGGDEVEFKCWVLDIIATINKGSIVWQEVFDDKAKLAPGTIVEVWKDSAYPEELSRVTASGFPVILSAPWYLDLISYGQDWRKYYKVEPLDFGGTQKQKQLFIGGEACLWGEYVDATNLTPRLWPRASAVGERLWSSKDVRDMDDAYDRLTRHRCRMVERGIAAQPLYAGYCNHENM

SEQ ID NO: 38211 - protein, 52 aa, Homo sapiens
  Payload ID: 7584
  Gene Symbol: HEXB
  Gene Name: hexosaminidase B (beta polypeptide)
  ENSP ID: ENSP00000424550
  MOD_RES (1)..(1): Any amino acid
XDATNLTPRLWPRASAVGERLWSSKDVRDMDDAYDRLTRHRCRMVEGLASFL

SEQ ID NO: 38212 - protein, 35 aa, Homo sapiens
  Payload ID: 7584
  Gene Symbol: HEXB
  Gene Name: hexosaminidase B (beta polypeptide)
  ENSP ID: ENSP00000424939
MDDAYDRLTRHRCRMVERGIAAQPLYAGYCNHENM

SEQ ID NO: 38213 - protein, 331 aa, Homo sapiens
  Payload ID: 7584
  Gene Symbol: HEXB
  Gene Name: hexosaminidase B (beta polypeptide)
  ENSP ID: ENSP00000426285
MAFNKFNVLHWHIVDDQSFPYQSITFPELSNKGSYSLSHVYTPNDVRMVIEYARLRGIRVLPEFDTPGHTLSWGKGQKDLLTPCYSRQNKLDSFGPINPTLNTTYSFLTTFFKEISEVFPDQFIHLGGDEVEFKCWESNPKIQDFMRQKGFGTDFKKLESFYIQKVLDIIATINKGSIVWQEVFDDKAKLAPGTIVEVWKDSAYPEELSRVTASGFPVILSAPWYLDLISYGQDWRKYYKVEPLDFGGTQKQKQLFIGGEACLWGEYVDATNLTPRLWPRASAVGERLWSSKDVRDMDDAYDRLTRHRCRMVERGIAAQPLYAGYCNHENM

SEQ ID NO: 38214 - protein, 170 aa, Homo sapiens
  Payload ID: 7584
  Gene Symbol: HEXB
  Gene Name: hexosaminidase B (beta polypeptide)
  ENSP ID: ENSP00000426384
  MOD_RES (1)..(1): Any amino acid
XFGTDFKKLESFYIQKVLDIIATINKGSIVWQEVFDDKAKLAPGTIVEVWKDSAYPEELSRVTASGFPVILSAPWYLDLISYGQDWRKYYKVEPLDFGGTQKQKQLFIGGEACLWGEYVDATNLTPRLWPRASAVGERLWSSKDVRDMDDAYDRLTRHRCRMVEGLASFL

SEQ ID NO: 38215 - protein, 791 aa, Homo sapiens
  Payload ID: 7585
  Gene Symbol: H6PD
  Gene Name: hexose-6-phosphate dehydrogenase (glucose 1-dehydrogenase)
  Uniprot ID: O95479
  ENSP ID: ENSP00000366620
MWNMLIVAMCLALLGCLQAQELQGHVSIILLGATGDLAKKYLWQGLFQLYLDEAGRGHSFSFHGAALTAPKQGQELMAKALESLSCPKDMAPSHCAEHKDQFLQLSQYRQLKTAEDYQALNKDIEAQLQHAGLREAGRIFYFSVPPFAYEDIARNINSSCRPGPGAWLRVVLEKPFGHDHFSAQQLATELGTFFQEEEMYRVDHYLGKQAVAQILPFRDQNRKALDGLWNRHHVERVEIIMKETVDAEGRTSFYEEYGVIRDVLQNHLTEVLTLVAMELPHNVSSAEAVLRHKLQVFQALRGLQRGSAVVGQYQSYSEQVRRELQKPDSFHSLTPTFAAVLVHIDNLRWEGVPFILMSGKALDERVGYARILFKNQACCVQSEKHWAAAQSQCLPRQLVFHIGHGDLGSPAVLVSRNLFRPSLPSSWKEMEGPPGLRLFGSPLSDYYAYSPVRERDAHSVLLSHIFHGRKNFFITTENLLASWNFWTPLLESLAHKAPRLYPGGAENGRLLDFEFSSGRLFFSQQQPEQLVPGPGPAPMPSDFQVLRAKYRESPLVSAWSEELISKLANDIEATAVRAVRRFGQFHLALSGGSSPVALFQQLATAHYGFPWAHTHLWLVDERCVPLSDPESNFQGLQAHLLQHVRIPYYNIHPMPVHLQQRLCAEEDQGAQIYAREISALVANSSFDLVLLGMGADGHTASLFPQSPTGLDGEQLVVLTTSPSQPHRRMSLSLPLINRAKKVAVLVMGRMKREITTLVSRVGHEPKKWPISGVLPHSGQLVWYMDYDAFLG

SEQ ID NO: 38216 - protein, 802 aa, Homo sapiens
  Payload ID: 7585
  Gene Symbol: H6PD
  Gene Name: hexose-6-phosphate dehydrogenase (glucose 1-dehydrogenase)
  ENSP ID: ENSP00000473348
MLAEPFNWHPGMWNMLIVAMCLALLGCLQAQELQGHVSIILLGATGDLAKKYLWQGLFQLYLDEAGRGHSFSFHGAALTAPKQGQELMAKALESLSCPKDMAPSHCAEHKDQFLQLSQYRQLKTAEDYQALNKDIEAQLQHAGLREAGRIFYFSVPPFAYEDIARNINSSCRPGPGAWLRVVLEKPFGHDHFSAQQLATELGTFFQEEEMYRVDHYLGKQAVAQILPFRDQNRKALDGLWNRHHVERVEIIMKETVDAEGRTSFYEEYGVIRDVLQNHLTEVLTLVAMELPHNVSSAEAVLRHKLQVFQALRGLQRGSAVVGQYQSYSEQVRRELQKPDSFHSLTPTFAAVLVHIDNLRWEGVPFILMSGKALDERVGYARILFKNQACCVQSEKHWAAAQSQCLPRQLVFHIGHGDLGSPAVLVSRNLFRPSLPSSWKEMEGPPGLRLFGSPLSDYYAYSPVRERDAHSVLLSHIFHGRKNFFITTENLLASWNFWTPLLESLAHKAPRLYPGGAENGRLLDFEFSSGRLFFSQQQPEQLVPGPGPAPMPSDFQVLRAKYRESPLVSAWSEELISKLANDIEATAVRAVRRFGQFHLALSGGSSPVALFQQLATAHYGFPWAHTHLWLVDERCVPLSDPESNFQGLQAHLLQHVRIPYYNIHPMPVHLQQRLCAEEDQGAQIYAREISALVANSSFDLVLLGMGADGHTASLFPQSPTGLDGEQLVVLTTSPSQPHRRMSLSLPLINRAKKVAVLVMGRMKREITTLVSRVGHEPKKWPISGVLPHSGQLVWYMDYDAFLG

SEQ ID NO: 38217 - protein, 1435 aa, Homo sapiens
  Payload ID: 7586
  Gene Symbol: HFM1
  Gene Name: HFM1, ATP-dependent DNA helicase homolog
  Uniprot ID: A2PYH4
  ENSP ID: ENSP00000359454
MLKSNDCLFSLENLFFEKPDEVENHPDNEKSLDWFLPPAPLISEIPDTQELEEELESHKLLGQEKRPKMLTSNLKITNEDTNYISLTQKFQFAFPSDKYEQDDLNLEGVGNNDLSHIAGKLTYASQKYKNHIGTEIAPEKSVPDDTKLVNFAEDKGESTSVFRKRLFKISDNIHGSAYSNDNELDSHIGSVKIVQTEMNKGKSRNYSNSKQKFQYSANVFTANNAFSASEIGEGMFKAPSFSVAFQPHDIQEVTENGLGSLKAVTEIPAKFRSIFKEFPYFNYIQSKAFDDLLYTDRNFVICAPTGSGKTVVFELAITRLLMEVPLPWLNIKIVYMAPIKALCSQRFDDWKEKFGPIGLNCKELTGDTVMDDLFEIQHAHIIMTTPEKWDSMTRKWRDNSLVQLVRLFLIDEVHIVKDENRGPTLEVVVSRMKTVQSVSQTLKNTSTAIPMRFVAVSATIPNAEDIAEWLSDGERPAVCLKMDESHRPVKLQKVVLGFPCSSNQTEFKFDLTLNYKIASVIQMYSDQKPTLVFCATRKGVQQAASVLVKDAKFIMTVEQKQRLQKYAYSVRDSKLRDILKDGAAYHHAGMELSDRKVVEGAFTVGDLPVLFTTSTLAMGVNLPAHLVVIKSTMHYAGGLFEEYSETDILQMIGRAGRPQFDTTATAVIMTRLSTRDKYIQMLACRDTVESSLHRHLIEHLNAEIVLHTITDVNIAVEWIRSTLLYIRALKNPSHYGFASGLNKDGIEAKLQELCLKNLNDLSSLDLIKMDEGVNFKPTEAGRLMAWYYITFETVKKFYTISGKETLSDLVTLIAGCKEFLDIQLRINEKKTLNTLNKDPNRITIRFPMEGRIKTREMKVNCLIQAQLGCIPIQDFALTQDTAKIFRHGSRITRWLSDFVAAQEKKFAVLLNSLILAKCFRCKLWENSLHVSKQLEKIGITLSNAIVNAGLTSFKKIEETDARELELILNRHPPFGTQIKETVMYLPKYELKVEQITRYSDTTAEILVTVILRNFEQLQTKRTASDSHYVTLIIGDADNQVVYLHKITDSVLLKAGSWAKKIAVKRALKSEDLSINLISSEFVGLDIQQKLTVFYLEPKRFGNQITMQRKSETQISHSKHSDISTIAGPNKGTTASKKPGNRECNHLCKSKHTCGHDCCKIGVAQKSEIKESTISSYLSDLRNRNAVSSVPPVKRLKIQMNKSQSVDLKEFGFTPKPSLPSISRSEYLNISELPIMEQWDQPEIYGKVRQEPSEYQDKEVLNVNFELGNEVWDDFDDENLEVTSFSTDTEKTKISGFGNTLSSSTRGSKLPLQESKSKFQREMSNSFVSSHEMSDISLSNSAMPKFSASSMTKLPQQAGNAVIVHFQERKPQNLSPEIEKQCFTFSEKNPNSSNYKKVDFFIRNSECKKEVDFSMYHPDDEADEMKSLLGIFDGIF

SEQ ID NO: 38218 - protein, 625 aa, Homo sapiens
  Payload ID: 7586
  Gene Symbol: HFM1
  Gene Name: HFM1, ATP-dependent DNA helicase homolog
  ENSP ID: ENSP00000387661
  MOD_RES (1)..(1): Any amino acid
XIEAKLQELCLKNLNDLSSLDLIKMDEGVNFKPTEAGRLMAWYYITFETVKKFYTISGKETLSDLVTLIAGCKEFLDIQLRINEKKTLNTLNKDPNRITIRFPMEGRIKTREMKVNCLIQAQLGCIPIQDFALTQDTAKIFRHGSRITRCITLSNAIVNAGLTSFKKIEETDARELELILNRHPPFGTQIKETVMYLPKYELKVEQITRYSDTTAEILVTVILRNFEQLQTKRTASDSHYVTLIIGDADNQVVYLHKITDSVLLKAGSWAKKIAVKRALKSEDLSINLISSEFVGLDIQQKLTVFYLEPKRFGNQITMQRKSETQISHSKHSDISTIAGPNKGTTASKKPGNRECNHLCKSKHTCGHDCCKIGVAQKSEIKESTISSYLSDLRNRNAVSSVPPVKRLKIQMNKSQSVDLKEFGFTPKPSLPSISRSEYLNISELPIMEQWDQPEIYGKVRQEPSEYQDKEVLNVNFELGNEVWDDFDDENLEVTSFSTDTEKTKISGFGNTLSSSTRGSKLPLQESKSKFQREMSNSFVSSHEMSDISLSNSAMPKFSASSMTKLPQQAGNAVIVHFQERKPQNLSPEIEKQCFTFSEKNPNSSNYKKVDFFIRNSECKKEVDFR

SEQ ID NO: 38219 - protein, 196 aa, Homo sapiens
  Payload ID: 7586
  Gene Symbol: HFM1
  Gene Name: HFM1, ATP-dependent DNA helicase homolog
  ENSP ID: ENSP00000388900
MIACFLWKICFLKNQMKLKSQEKRPKMLTSNLKITNEDTNYISLTQKFQFAFPSDKYEQDDLNLEGVGNNDLSHIAGKLTYASQKYKNHIGTEIAPEKSVPDDTKLVNFAEDKGESTSVFRKRLFKISDNIHGSAYSNDNELDSHIGSVKIVQTEMNKGKSRNYSNSKQKFQYSANVFTANNAFSASEIGEGMFKA

SEQ ID NO: 38220 - protein, 151 aa, Homo sapiens
  Payload ID: 7586
  Gene Symbol: HFM1
  Gene Name: HFM1, ATP-dependent DNA helicase homolog
  ENSP ID: ENSP00000397369
MLKSNDCLFSLENLFFEKPDEVEKLFKISDNIHGSAYSNDNELDSHIGSVKIVQTEMNKGKSRNYSNSKQKFQYSANVFTANNAFSASEIGEGMFKAPSFSVAFQPHDIQEVTENGLGSLKAVTEIPAKFRSIFKEFPYFNYIQSKAFDDL

SEQ ID NO: 38221 - protein, 138 aa, Homo sapiens
  Payload ID: 7586
  Gene Symbol: HFM1
  Gene Name: HFM1, ATP-dependent DNA helicase homolog
  ENSP ID: ENSP00000409827
MLKSNDCLFSLENLFFEKPDEVENHPDNEKSLDWFLPPAPLISEIPDTQELEEELESHKLLGQEKRPKMLTSNLKITNEDTNYISLTQKFQFAFPSDKYEQDDLNLEGVGNNDLSHIAGKLTYASQKYKNHIGTEIAP

SEQ ID NO: 38222 - protein, 655 aa, Homo sapiens
  Payload ID: 7587
  Gene Symbol: HGFAC
  Gene Name: HGF activator
  Uniprot ID: Q04756
  ENSP ID: ENSP00000372224
MGRWAWVPSPWPPPGLGPFLLLLLLLLLLPRGFQPQPGGNRTESPEPNATATPAIPTILVTSVTSETPATSAPEAEGPQSGGLPPPPRAVPSSSSPQAQALTEDGRPCRFPFRYGGRMLHACTSEGSAHRKWCATTHNYDRDRAWGYCVEATPPPGGPAALDPCASGPCLNGGSCSNTQDPQSYHCSCPRAFTGKDCGTEKCFDETRYEYLEGGDRWARVRQGHVEQCECFGGRTWCEGTRHTACLSSPCLNGGTCHLIVATGTTVCACPPGFAGRLCNIEPDERCFLGNGTGYRGVASTSASGLSCLAWNSDLLYQELHVDSVGAAALLGLGPHAYCRNPDNDERPWCYVVKDSALSWEYCRLEACESLTRVQLSPDLLATLPEPASPGRQACGRRHKKRTFLRPRIIGGSSSLPGSHPWLAAIYIGDSFCAGSLVHTCWVVSAAHCFSHSPPRDSVSVVLGQHFFNRTTDVTQTFGIEKYIPYTLYSVFNPSDHDLVLIRLKKKGDRCATRSQFVQPICLPEPGSTFPAGHKCQIAGWGHLDENVSGYSSSLREALVPLVADHKCSSPEVYGADISPNMLCAGYFDCKSDACQGDSGGPLACEKNGVAYLYGIISWGDGCGRLHKPGVYTRVANYVDWINDRIRPPRRLVAPS

SEQ ID NO: 38223 - protein, 662 aa, Homo sapiens
  Payload ID: 7587
  Gene Symbol: HGFAC
  Gene Name: HGF activator
  ENSP ID: ENSP00000421801
MGRWAWVPSPWPPPGLGPFLLLLLLLLLLPRGFQPQPGGNRTESPEPNATATPAIPTILVTSVTSETPATSAPEAEGPQSGGLPPPPRAVPSSSSPQAQALTEDGRPCRFPFRYGGRMLHACTSEGSAHRKWCATTHNYDRDRAWGYCVEATPPPGGPAALDPCASGPCLNGGSCSNTQDPQSYHCSCPRAFTGKDCGTEKCFDETRYEYLEGGDRWARVRQGHVEQCECFGGRTWCEGTRHTACLSSPCLNGGTCHLIVATGTTVCACPPGFAGRLCNIEPDERCFLGNGTGYRGVASTSASGLSCLAWNSDLLYQELHVDSVGAAALLGLGPHAYCRNPDNDERPWCYVVKDSALSWEYCRLEACDLETEGRESLTRVQLSPDLLATLPEPASPGRQACGRRHKKRTFLRPRIIGGSSSLPGSHPWLAAIYIGDSFCAGSLVHTCWVVSAAHCFSHSPPRDSVSVVLGQHFFNRTTDVTQTFGIEKYIPYTLYSVFNPSDHDLVLIRLKKKGDRCATRSQFVQPICLPEPGSTFPAGHKCQIAGWGHLDENVSGYSSSLREALVPLVADHKCSSPEVYGADISPNMLCAGYFDCKSDACQGDSGGPLACEKNGVAYLYGIISWGDGCGRLHKPGVYTRVANYVDWINDRIRPPRRLVAPS

SEQ ID NO: 38224 - protein, 390 aa, Homo sapiens
  Payload ID: 7588
  Gene Symbol: HGH1
  Gene Name: HGH1 homolog
  Uniprot ID: Q9BTY7
  ENSP ID: ENSP00000321320
MGEAGAGAGASGGPEASPEAEVVKLLPFLAPGARADLQAAAVRHVLALTGCGPGRALLAGQAALLQALMELAPASAPARDAARALVNLAADPGLHETLLAADPGLPARLMGRALDPQWPWAEEAAAALANLSREPAPCAALMAALAAAEPADSGLERLVRALCTPGYNARAPLHYLAPLLSNLSQRPAARAFLLDPDRCVVQRLLPLTQYPDSSVRRGGVVGTLRNCCFEHRHHEWLLGPEVDILPFLLLPLAGPEDFSEEEMERLPVDLQYLPPDKQREPDADIRKMLVEAIMLLTATAPGRQQVRDQGAYLILRELHSWEPEPDVRTACEKLIQVLIGDEPERGMENLLEVQVPEDVEQQLQQLDCREQEQLERELAPEPWVERATPT

SEQ ID NO: 38225 - protein, 85 aa, Homo sapiens
  Payload ID: 7588
  Gene Symbol: HGH1
  Gene Name: HGH1 homolog
  ENSP ID: ENSP00000431970
MGEAGAGAGASGGPEASPEAEVVKLLPFLAPGARADLQAAAVRHVLALTGCGPGRALLAGQTRAWSGWCARCARPATTPARPCTT

SEQ ID NO: 38226 - protein, 85 aa, Homo sapiens; identical to SEQ ID NO: 38225
  Payload ID: 7588
  Gene Symbol: HGH1
  Gene Name: HGH1 homolog
  ENSP ID: ENSP00000486087

SEQ ID NO: 38227 - protein, 782 aa, Homo sapiens
  Payload ID: 7589
  Gene Symbol: HHIPL1
  Gene Name: HHIP-like 1
  Uniprot ID: Q96JK4
  ENSP ID: ENSP00000330601
MARARAGALLALWVLGAAAHPQCLDFRPPFRPTQPLRLCAQYSDFGCCDEGRDAELTRRFWALASRVDAAEWAACAGYARDLLCQECSPYAAHLYDAEDPFTPLRTVPGLCQDYCLDMWHKCRGLFRHLSTDQELWALEGNLARFCRYLSLDDTDYCFPYLLVNKNLNSNLGHVVADAKGCLQLCLEEVANGLRNPVAMVHARDGTHRFFVAEQVGLVWAYLPDRSRLGKPFLNISRVVLTSPWEGDERGFLGIAFHPSFQHNRRLYVYYSVGIRSSEWIRISEFRVSEDDENAVDHSSERIILEVKEPASNHNGGQLLFGDDGYLYIFTGDGGMAGDPFGTFGNAQNKSALLGKVLRIDVDRKERGLPYGIPPDNPFVGDPAAQPEVYALGVRNMWRCSFDRGDPSSGTGRGRLFCGDVGQNKFEEVDVVERGGNYGWRAREGFECYDRSLCANTSLNDLLPIFAYPHTVGKSVTGGYVYRGCEYPNLNGLYIFGDFMSGRLMSLQENPGTGQWQYSEICMGHGQTCEFPGLINNYYPYIISFGEDEAGELYFMSTGEPSATAPRGVVYKIIDASRRAPPGKCQIQPAQVKIRSRLIPFVPKEKFIPKTRSTPRPTARAPTRAPRRGRPTAAPPAPTPRPARPTQQPGSRRGGGRRRGRLNSASRAFRDGEVRLVRPAGLSSGSGRVEVFVGGRWGTVCDDSWNISGAAVVCRQLGFAYAVRAVKRAEFGQGGSLPILLDDVRCAGWERNLLECQHNGVGTHNCEHDEDAGVVCSHQNPDL

SEQ ID NO: 38228 - protein, 608 aa, Homo sapiens
  Payload ID: 7589
  Gene Symbol: HHIPL1
  Gene Name: HHIP-like 1
  Uniprot ID: Q96JK4
  ENSP ID: ENSP00000349757
MARARAGALLALWVLGAAAHPQCLDFRPPFRPTQPLRLCAQYSDFGCCDEGRDAELTRRFWALASRVDAAEWAACAGYARDLLCQECSPYAAHLYDAEDPFTPLRTVPGLCQDYCLDMWHKCRGLFRHLSTDQELWALEGNLARFCRYLSLDDTDYCFPYLLVNKNLNSNLGHVVADAKGCLQLCLEEVANGLRNPVAMVHARDGTHRFFVAEQVGLVWAYLPDRSRLGKPFLNISRVVLTSPWEGDERGFLGIAFHPSFQHNRRLYVYYSVGIRSSEWIRISEFRVSEDDENAVDHSSERIILEVKEPASNHNGGQLLFGDDGYLYIFTGDGGMAGDPFGTFGNAQNKSALLGKVLRIDVDRKERGLPYGIPPDNPFVGDPAAQPEVYALGVRNMWRCSFDRGDPSSGTGRGRLFCGDVGQNKFEEVDVVERGGNYGWRAREGFECYDRSLCANTSLNDLLPIFAYPHTVGKSVTGGYVYRGCEYPNLNGLYIFGDFMSGRLMSLQENPGTGQWQYSEICMGHGQTCEFPGLINNYYPYIISFGEDEAGELYFMSTGEPSATAPRGVVYKIIDASSCKARSAMPGYVPAPSVCSSLTSQPFILQWWK

SEQ ID NO: 38229 - protein, 724 aa, Homo sapiens
  Payload ID: 7590
  Gene Symbol: HHIPL2
  Gene Name: HHIP-like 2
  Uniprot ID: Q6UWX4
  ENSP ID: ENSP00000342118
MLRTSTPNLCGGLHCRAPWLSSGILCLCLIFLLGQVGLLQGHPQCLDYGPPFQPPLHLEFCSDYESFGCCDQHKDRRIAARYWDIMEYFDLKRHELCGDYIKDILCQECSPYAAHLYDAENTQTPLRNLPGLCSDYCSAFHSNCHSAISLLTNDRGLQESHGRDGTRFCHLLDLPDKDYCFPNVLRNDYLNRHLGMVAQDPQGCLQLCLSEVANGLRNPVSMVHAGDGTHRFFVAEQVGVVWVYLPDGSRLEQPFLDLKNIVLTTPWIGDERGFLGLAFHPKFRHNRKFYIYYSCLDKKKVEKIRISEMKVSRADPNKADLKSERVILEIEEPASNHNGGQLLFGLDGYMYIFTGDGGQAGDPFGLFGNAQNKSSLLGKVLRIDVNRAGSHGKRYRVPSDNPFVSEPGAHPAIYAYGIRNMWRCAVDRGDPITRQGRGRIFCGDVGQNRFEEVDLILKGGNYGWRAKEGFACYDKKLCHNASLDDVLPIYAYGHAVGKSVTGGYVYRGCESPNLNGLYIFGDFMSGRLMALQEDRKNKKWKKQDLCLGSTTSCAFPGLISTHSKFIISFAEDEAGELYFLATSYPSAYAPRGSIYKFVDPSRRAPPGKCKYKPVPVRTKSKRIPFRPLAKTVLDLLKEQSEKAARKSSSATLASGPAQGLSEKGSSKKLASPTSSKNTLRGPGTKKKARVGPHVRQGKRRKSLKSHSGRMRPSAEQKRAGRSLP

SEQ ID NO: 38230 - protein, 249 aa, Homo sapiens
  Payload ID: 7591
  Gene Symbol: HID1
  Gene Name: HID1 domain containing
  ENSP ID: ENSP00000317795
  MOD_RES (1)..(1): Any amino acid
XDSASSASPTVDGTTTGTAMDDADPPGPENLFVNYLSRIHREEDFQFILKGIARLLSNPLLQTYLPNSTKKIQFHQELLVLFWKLCDFNKKFLFFVLKSSDVLDILVPILFFLNDARADQSRVGLMHIGVFILLLLSGERNFGVRLNKPYSIRVPMDIPVFTGTHADLLIVVFHKIITSGHQRLQPLFDCLLTIVVNGRGPELALPALTTRWCQATGQPATCSRFQAPPAHRKNASLCTLHSSHIKKKG

SEQ ID NO: 38231 - protein, 788 aa, Homo sapiens
  Payload ID: 7591
  Gene Symbol: HID1
  Gene Name: HID1 domain containing
  Uniprot ID: Q8IV36
  ENSP ID: ENSP00000413520
MGSTDSKLNFRKAVIQLTTKTQPVEATDDAFWDQFWADTATSVQDVFALVPAAEIRAVREESPSNLATLCYKAVEKLVQGAESGCHSEKEKQIVLNCSRLLTRVLPYIFEDPDWRGFFWSTVPGAGRGGQGEEDDEHARPLAESLLLAIADLLFCPDFTVQSHRRSTVDSAEDVHSLDSCEYIWEAGVGFAHSPQPNYIHDMNRMELLKLLLTCFSEAMYLPPAPESGSTNPWVQFFCSTENRHALPLFTSLLNTVCAYDPVGYGIPYNHLLFSDYREPLVEEAAQVLIVTLDHDSASSASPTVDGTTTGTAMDDADPPGPENLFVNYLSRIHREEDFQFILKGIARLLSNPLLQTYLPNSTKKIQFHQELLVLFWKLCDFNKKFLFFVLKSSDVLDILVPILFFLNDARADQSRVGLMHIGVFILLLLSGERNFGVRLNKPYSIRVPMDIPVFTGTHADLLIVVFHKIITSGHQRLQPLFDCLLTIVVNVSPYLKSLSMVTANKLLHLLEAFSTTWFLFSAAQNHHLVFFLLEVFNNIIQYQFDGNSNLVYAIIRKRSIFHQLANLPTDPPTIHKALQRRRRTPEPLSRTGSQEGTSMEGSRPAAPAEPGTLKTSLVATPGIDKLTEKSQVSEDGTLRSLEPEPQQSLEDGSPAKGEPSQAWREQRRPSTSSASGQWSPTPEWVLSWKSKLPLQTIMRLLQVLVPQVEKICIDKGLTDESEILRFLQHGTLVGLLPVPHPILIRKYQANSGTAMWFRTYMWGVIYLRNVDPPVWYDTDVKLFEIQRV

SEQ ID NO: 38232 - protein, 253 aa, Homo sapiens
  Payload ID: 7591
  Gene Symbol: HID1
  Gene Name: HID1 domain containing
  ENSP ID: ENSP00000431131
MGSTDSKLNFRKAVIQLTTKTQGEEDDEHARPLAESLLLAIADLLFCPDFTVQSHRRSTVDSAEDVHSLDSCEYIWEAGVGFAHSPQPNYIHDMNRMELLKLLLTCFSEAMYLPPAPESGSTNPWVQFFCSTENRHALPLFTSLLNTVCAYDPVGYGIPYNHLLFSDYREPLVEEAAQVLIVTLDHDSASSASPTVDGTTTGTAMDDADPPGPENLFVNYLSRIHREEDFQFILKGIARLLSNPLLQTYLPNS

SEQ ID NO: 38233 - protein, 191 aa, Homo sapiens
  Payload ID: 7591
  Gene Symbol: HID1
  Gene Name: HID1 domain containing
  ENSP ID: ENSP00000435751
MGSTDSKLNFRKAVIQLTTKTQPVEATDDAFWDQFWADTATSVQDVFALVPAAEIRAVREESPSNLATLCYKAVEKLVQGAESGCHSEKEKQIVLNCSRLLTRVLPYIFEDPDWRGFFCREKRMMSMPGPWPSPCSWPLLTCSSARTSRFRATGGALWTRQRTSTPWTAVNTSGRLVWASLTPPSLTTSTI

SEQ ID NO: 38234 - protein, 114 aa, Homo sapiens
  Payload ID: 7591
  Gene Symbol: HID1
  Gene Name: HID1 domain containing
  ENSP ID: ENSP00000462457
MGSTDSKLNFRKAVIQLTTKTQAVEKLVQGAESGCHSEKEKQIVLNCSRLLTRVLPYIFEDPDWRGFFWSTVPGAGRGGGEEDDEHARPLAESLLLAIADLLFCPDFTVQSHRR

SEQ ID NO: 38235 - protein, 93 aa, Homo sapiens [sequence omitted]

SEQ ID NO: 38236 - protein, 107 aa, Homo sapiens
  Payload ID: 7592
  Gene Symbol: HIGD1A
  Gene Name: HIG1 hypoxia inducible domain family, member 1A
  Uniprot ID: Q9Y241
  ENSP ID: ENSP00000398064
MEQKLVEEILQAITMSTDTGVSLPSYEEDQGSKLIRKAKEAPFVPVGIAGFAAIVAYGLYKLKSRGNTKMSIHLIHMRVAAQGFVVGAMTVGMGYSMYREFWAKPKP

SEQ ID NO: 38237 - protein, 93 aa, Homo sapiens [sequence omitted]

SEQ ID NO: 38238 - protein, 96 aa, Homo sapiens
  Payload ID: 7592
  Gene Symbol: HIGD1A
  Gene Name: HIG1 hypoxia inducible domain family, member 1A
  ENSP ID: ENSP00000408289
MSTDTGVSLPSYEEDQGSKLIRKAKEAPFVPVGIAGFAAIVAYGLYKLKSRGNTKMSIHLIHMRVAAQGFVVGAMTVAFFFFRYGLFHVSGILGKT

SEQ ID NO: 38239 - protein, 99 aa, Homo sapiens
  Payload ID: 7593
  Gene Symbol: HIGD1B
  Gene Name: HIG1 hypoxia inducible domain family, member 1B
  Uniprot ID: Q9P298
  ENSP ID: ENSP00000253410
MSANRRWWVPPDDEDCVSEKLLRKTRESPLVPIGLGGCLVVAAYRIYRLRSRGSTKMSIHLIHTRVAAQACAVGAIMLGAVYTMYSDYVKRMAQDAGEK

SEQ ID NO: 38240 - protein, 54 aa, Homo sapiens
  Payload ID: 7593
  Gene Symbol: HIGD1B
  Gene Name: HIG1 hypoxia inducible domain family, member 1B
  ENSP ID: ENSP00000464703
MSANRRWWVPPDDEDCVSEKLLRKTRESPLVPIGAVYTMYSDYVKRMAQDAGEK

SEQ ID NO: 38241 - protein, 40 aa, Homo sapiens
  Payload ID: 7593
  Gene Symbol: HIGD1B
  Gene Name: HIG1 hypoxia inducible domain family, member 1B
  ENSP ID: ENSP00000465657
  MOD_RES (1)..(1): Any amino acid
XLLRKTRESPLVPIGPPQRPPPATRCCIKPAVYPDAQPAW

SEQ ID NO: 38242 - protein, 99 aa, Homo sapiens; identical to SEQ ID NO: 38239
  Payload ID: 7593
  Gene Symbol: HIGD1B
  Gene Name: HIG1 hypoxia inducible domain family, member 1B
  Uniprot ID: Q9P298
  ENSP ID: ENSP00000468511

SEQ ID NO: 38243 - protein, 97 aa, Homo sapiens
  Payload ID: 7594
  Gene Symbol: HIGD1C
  Gene Name: HIG1 hypoxia inducible domain family, member 1C
  Uniprot ID: A8MV81
  ENSP ID: ENSP00000381473
MSSDNQWSADEDEGQLSRLIRKSRDSPFVPIGIAGFVTVVSCGLYKLKYRRDQKMSIHLIHMRVAAQGFVVGAVTLGVLYSMYKDYIRPRFFSESKK

SEQ ID NO: 38244 - protein, 106 aa, Homo sapiens
  Payload ID: 7595
  Gene Symbol: HIGD2A
  Gene Name: HIG1 hypoxia inducible domain family, member 2A
  Uniprot ID: Q9BW72
  ENSP ID: ENSP00000274787
MATPGPVIPEVPFEPSKPPVIEGLSPTVYRNPESFKEKFVRKTRENPVVPIGCLATAAALTYGLYSFHRGNSQRSQLMMRTRIAAQGFTVAAILLGLAVTAMKSRP

SEQ ID NO: 38245 - protein, 106 aa, Homo sapiens
  Payload ID: 7596
  Gene Symbol: HIGD2B
  Gene Name: HIG1 hypoxia inducible domain family, member 2B
  Uniprot ID: Q4VC39
  ENSP ID: ENSP00000307951
MATLGFVTPEAPFESSKPPIFEGLSPTVYSNPEGFKEKFLRKTRENPVVPIGFLCTAAVLTNGLYCFHQGNSQCSRLMMHTQIAAQGFTIAAILLGLAATAMKSPP

SEQ ID NO: 38246 - protein, 1268 aa, Homo sapiens
  Payload ID: 7597
  Gene Symbol: HDLBP
  Gene Name: high density lipoprotein binding protein
  ENSP ID: ENSP00000312042
MSSVAVLTQESFAEHRSGLVPQQIKVATLNSEEESDPPTYKDAFPPLPEKAACLESAQEPAGAWGNKIRPIKASVITQVFHVPLEERKYKDMNQFGEGEQAKICLEIMQRTGAHLELSLAKDQGLSIMVSGKLDAVMKARKDIVARLQTQASATVAIPKEHHRFVIGKNGEKLQDLELKTATKIQIPRPDDPSNQIKITGTKEGIEKARHEVLLISAEQDKRAVERLEVEKAFHPFIAGPYNRLVGEIMQETGTRINIPPPSVNRTEIVFTGEKEQLAQAVARIKKIYEEKKKKTTTIAVEVKKSQHKYVIGPKGNSLQEILERTGVSVEIPPSDSISETVILRGEPEKLGQALTEVYAKANSFTVSSVAAPSWLHRFIIGKKGQNLAKITQQMPKVHIEFTEGEDKITLEGPTEDVNVAQEQIEGMVKDLINRMDYVEINIDHKFHRHLIGKSGANINRIKDQYKVSVRIPPDSEKSNLIRIEGDPQGVQQAKRELLELASRMENERTKDLIIEQRFHRTIIGQKGERIREIRDKFPEVIINFPDPAQKSDIVQLRGPKNEVEKCTKYMQKMVADLVENSYSISVPIFKQFHKNIIGKGGANIKKIREESNTKIDLPAENSNSETIIITGKRANCEAARSRILSIQKDLANIAEVEVSIPAKLHNSLIGTKGRLIRSIMEECGGVHIHFPVEGSGSDTVVIRGPSSDVEKAKKQLLHLAEEKQTKSFTVDIRAKPEYHKFLIGKGGGKIRKVRDSTGARVIFPAAEDKDQDLITIIGKEDAVREAQKELEALIQNLDNVVEDSMLVDPKHHRHFVIRRGQVLREIAEEYGGVMVSFPRSGTQSDKVTLKGAKDCVEAAKKRIQEIIEDLEAQVTLECAIPQKFHRSVMGPKGSRIQQITRDFSVQIKFPDREENAVHSTEPVVQENGDEAGEGREAKDCDPGSPRRCDIIIISGRKEKCEAAKEALEALVPVTIEVEVPFDLHRYVIGQKGSGIRKMMDEFEVNIHVPAPELQSDIIAITGLAANLDRAKAGLLERVKELQAEQEDRALRSFKLSVTVDPKYHPKIIGRKGAVITQIRLEHDVNIQFPDKDDGNQPQDQITITGYEKNTEAARDAILRIVGELEQMVSEDVPLDHRVHARIIGARGKAIRKIMDEFKVDIRFPQSGAPDPNCVTVTGLPENVEEAIDHILNLEEEYLADVVDSEALQVYMKPPAHEEAKAPSRGFVVRDAPWTASSSEKAPDMSSSEEFPSFGAQVAPKTLPWGPKR

SEQ ID NO: 38247 - protein, 973 aa, Homo sapiens
  Payload ID: 7597
  Gene Symbol: HDLBP
  Gene Name: high density lipoprotein binding protein
  ENSP ID: ENSP00000362389
  MOD_RES (1)..(1): Any amino acid
XGLSIMVSGKLDAVMKARKDIVARLQTQASATVAIPKEHHRFVIGKNGEKLQDLELKTATKIQIPRPDDPSNQIKITGTKEGIEKARHEVLLISAEQDKRAVERLEVEKAFHPFIAGPYNRLVGEIMQETGTRINIPPPSVNRTEIVFTGEKEQLAQAVARIKKIYEEKANSFTVSSVAAPSWLHRFIIGKKGQNLAKITQQMPKVHIEFTEGEDKITLEGPTEDVNVAQEQIEGMVKDLINRMDYVEINIDHKFHRHLIGKSGANINRIKDQYKVSVRIPPDSEKSNLIRIEGDPQGVQQAKRELLELASRMENERTKDLIIEQRFHRTIIGQKGERIREIRDKFPEVIINFPDPAQKSDIVQLRGPKNEVEKCTKYMQKMVADLVENSYSISVPIFKQFHKNIIGKGGANIKKIREESNTKIDLPAENSNSETIIITGKRANCEAARSRILSIQKDLANIAEVEVSIPAKLHNSLIGTKGRLIRSIMEECGGVHIHFPVEGSGSDTVVIRGPSSDVEKAKKQLLHLAEEKQTKSFTVDIRAKPEYHKFLIGKGGGKIRKVRDSTGARVIFPAAEDKDQDLITIIGKEDAVREAQKELEALIQNLDNVVEDSMLVDPKHHRHFVIRRGQVLREIAEEYGGVMVSFPRSGTQSDKVTLKGAKDCVEAAKKRIQEIIEDLEAQVTLECAIPQKFHRSVMGPKGSRIQQITRDFSVQIKFPDREENAVHSTEPVVQENGDEAGEGREAKDCDPGSPRRCDIIIISGRKEKCEAAKEALEALVPVTIEVEVPFDLHRYVIGQKGSGIRKMMDEFEVNIHVPAPELQSDIIAITGLAANLDRAKAGLLERVKELQAEQEDRALRSFKLSVTVDPKYHPKIIGRKGAVITQIRLEHDVNILNLEEEYLADVVDSEALQVYMKPPAHEEAKAPSRGFVVRDAPWTASSSEKAPDMSSSEEFPSFGAQVAPKTLPWGPKR

SEQ ID NO: 38248 - protein, 1268 aa, Homo sapiens; identical to SEQ ID NO: 38246
  Payload ID: 7597
  Gene Symbol: HDLBP
  Gene Name: high density lipoprotein binding protein
  ENSP ID: ENSP00000375836

SEQ ID NO: 38249 - protein, 1268 aa, Homo sapiens; identical to SEQ ID NO: 38246
  Payload ID: 7597
  Gene Symbol: HDLBP
  Gene Name: high density lipoprotein binding protein
  ENSP ID: ENSP00000375837

SEQ ID NO: 38250 - protein, 164 aa, Homo sapiens
  Payload ID: 7597
  Gene Symbol: HDLBP
  Gene Name: high density lipoprotein binding protein
  ENSP ID: ENSP00000387782
MSSVAVLTQESFAEHRSGLVPQQIKVATLNSEEESDPPTYKDAFPPLPEKAACLESAQEPAGAWGNKIRPIKASVITQVFHVPLEERKYKDMNQFGEGEQAKICLEIMQRTGAHLELSLAKDQGLSIMVSGKLDAVMKARKDIVARLQTQASATVAIPKEHHRF

SEQ ID NO: 38251 - protein, 267 aa, Homo sapiens
  Payload ID: 7597
  Gene Symbol: HDLBP
  Gene Name: high density lipoprotein binding protein
  ENSP ID: ENSP00000388876
HTCLCQAVSTLASENERTKDLIIEQRFHRTIIGQKGERIREIRDKFPEVIINFPDPAQKSDIVQLRGPKNEVEKCTKYMQKMVADLVENSYSISVPIFKQFHKNIIGKGGANIKKIREESNTKIDLPAENSNSETIIITGKRANCEAARSRILSIQKDLANIAEVEVSIPAKLHNSLIGTKGRLIRSIMEECGGVHIHFPVEGSGSDTVVIRGPSSDVEKAKKQLLHLAEEKQTKSFTVDIRAKPEYHKFLIGKGGGKIRKVRDSTG

SEQ ID NO: 38252 - protein, 81 aa, Homo sapiens
  Payload ID: 7597
  Gene Symbol: HDLBP
  Gene Name: high density lipoprotein binding protein
  ENSP ID: ENSP00000390290
MSSVAVLTQESFAEHRSGLVPQQIKVATLNSEEESDPPTYKDAFPPLPEKAACLESAQEPAGAWGNKIRPIKASVITQVFH

SEQ ID NO: 38253 - protein, 79 aa, Homo sapiens
  Payload ID: 7597
  Gene Symbol: HDLBP
  Gene Name: high density lipoprotein binding protein
  ENSP ID: ENSP00000390942
MSSVAVLTQESFAEHRSGLVPQQIKVATLNSEEESDPPTYKDAFPPLPEKAACLESAQEPAGAWGNKIRPIKASVITQV

SEQ ID NO: 38254 - protein, 14 aa, Homo sapiens
  Payload ID: 7597
  Gene Symbol: HDLBP
  Gene Name: high density lipoprotein binding protein
  ENSP ID: ENSP00000391773
MSSVAVLTQESFAE

SEQ ID NO: 38255 - protein, 332 aa, Homo sapiens
  Payload ID: 7597
  Gene Symbol: HDLBP
  Gene Name: high density lipoprotein binding protein
  ENSP ID: ENSP00000393766
  MOD_RES (1)..(1): Any amino acid
XAKICLEIMQRTGAHLELSLAKDQGLSIMVSGKLDAVMKARKDIVARLQTQASATVAIPKEHHRFVIGKNGEKLQDLELKTATKIQIPRPDDPSNQIKITGTKEGIEKARHEVLLISAEQDKRAVERLEVEKAFHPFIAGPYNRLVGEIMQETGTRINIPPPSVNRTEIVFTGEKEQLAQAVARIKKIYEEKGNSLQEILERTGVSVEIPPSDSISETVILRGEPEKLGQALTEVYAKANSFTVSSVAAPSWLHRFIIGKKGQNLAKITQQMPKVHIEFTEGEDKITLEGPTEDVNVAQEQIEGMVKDLINRMDYVEINIDHKFHRHLIGKS

SEQ ID NO: 38256 - protein, 96 aa, Homo sapiens
  Payload ID: 7597
  Gene Symbol: HDLBP
  Gene Name: high density lipoprotein binding protein
  ENSP ID: ENSP00000394205
MSSVAVLTQESFAEHRSGLVPQQIKVATLNSEEESDPPTYKDAFPPLPEKAACLESAQEPAGAWGNKIRPIKASVITQVFHVPLEERKYKDMNQFG

SEQ ID NO: 38257 - protein, 36 aa, Homo sapiens
  Payload ID: 7597
  Gene Symbol: HDLBP
  Gene Name: high density lipoprotein binding protein
  ENSP ID: ENSP00000396202
MPSLHFLRKLLAWKVPRNPLEPGGTRSDPSRLLSSL

SEQ ID NO: 38258 - protein, 17 aa, Homo sapiens
  Payload ID: 7597
  Gene Symbol: HDLBP
  Gene Name: high density lipoprotein binding protein
  ENSP ID: ENSP00000396959
MSSVAVLTQESFAEHRS

SEQ ID NO: 38259 - protein, 126 aa, Homo sapiens
  Payload ID: 7597
  Gene Symbol: HDLBP
  Gene Name: high density lipoprotein binding protein
  ENSP ID: ENSP00000396964
MSSVAVLTQESFAEHRSGLVPQQIKVATLNSEEESDPPTYKDAFPPLPEKAACLESAQEPAGAWGNKIRPIKASVITQVFHVPLEERKYKDMNQFGEGEQAKICLEIMQRTGAHLELSLAKDQGLS

SEQ ID NO: 38260 - protein, 19 aa, Homo sapiens
  Payload ID: 7597
  Gene Symbol: HDLBP
  Gene Name: high density lipoprotein binding protein
  ENSP ID: ENSP00000397799
MSSVAVLTQESFAEHRSGL

SEQ ID NO: 38261 - protein, 1235 aa, Homo sapiens
  Payload ID: 7597
  Gene Symbol: HDLBP
  Gene Name: high density lipoprotein binding protein
  Uniprot ID: Q00341
  ENSP ID: ENSP00000399139
MHLAERDRWLFVATVMMHFVSIKSGFPGLCVGVRSTMSSVAVLTQESFAEHRSGLVPQQIKVATLNSEEESDPPTYKDAFPPLPEKAACLESAQEPAGAWGNKIRPIKASVITQVFHVPLEERKYKDMNQFGEGEQAKICLEIMQRTGAHLELSLAKDQGLSIMVSGKLDAVMKARKDIVARLQTQASATVAIPKEHHRFVIGKNGEKLQDLELKTATKIQIPRPDDPSNQIKITGTKEGIEKARHEVLLISAEQDKRAVERLEVEKAFHPFIAGPYNRLVGEIMQETGTRINIPPPSVNRTEIVFTGEKEQLAQAVARIKKIYEEKANSFTVSSVAAPSWLHRFIIGKKGQNLAKITQQMPKVHIEFTEGEDKITLEGPTEDVNVAQEQIEGMVKDLINRMDYVEINIDHKFHRHLIGKSGANINRIKDQYKVSVRIPPDSEKSNLIRIEGDPQGVQQAKRELLELASRMENERTKDLIIEQRFHRTIIGQKGERIREIRDKFPEVIINFPDPAQKSDIVQLRGPKNEVEKCTKYMQKMVADLVENSYSISVPIFKQFHKNIIGKGGANIKKIREESNTKIDLPAENSNSETIIITGKRANCEAARSRILSIQKDLANIAEVEVSIPAKLHNSLIGTKGRLIRSIMEECGGVHIHFPVEGSGSDTVVIRGPSSDVEKAKKQLLHLAEEKQTKSFTVDIRAKPEYHKFLIGKGGGKIRKVRDSTGARVIFPAAEDKDQDLITIIGKEDAVREAQKELEALIQNLDNVVEDSMLVDPKHHRHFVIRRGQVLREIAEEYGGVMVSFPRSGTQSDKVTLKGAKDCVEAAKKRIQEIIEDLEAQVTLECAIPQKFHRSVMGPKGSRIQQITRDFSVQIKFPDREENAVHSTEPVVQENGDEAGEGREAKDCDPGSPRRCDIIIISGRKEKCEAAKEALEALVPVTIEVEVPFDLHRYVIGQKGSGIRKMMDEFEVNIHVPAPELQSDIIAITGLAANLDRAKAGLLERVKELQAEQEDRALRSFKLSVTVDPKYHPKIIGRKGAVITQIRLEHDVNIQFPDKDDGNQPQDQITITGYEKNTEAARDAILRIVGELEQMVSEDVPLDHRVHARIIGARGKAIRKIMDEFKVDIRFPQSGAPDPNCVTVTGLPENVEEAIDHILNLEEEYLADVVDSEALQVYMKPPAHEEAKAPSRGFVVRDAPWTASSSEKAPDMSSSEEFPSFGAQVAPKTLPWGPKR

SEQ ID NO: 38262 - protein, 69 aa, Homo sapiens
  Payload ID: 7597
  Gene Symbol: HDLBP
  Gene Name: high density lipoprotein binding protein
  ENSP ID: ENSP00000403693
MSSVAVLTQESFAEHRSGLVPQQIKVATLNSEEESDPPTYKDAFPPLPEKAACLESAQEPAGAWGNKIR

SEQ ID NO: 38263 - protein, 224 aa, Homo sapiens
  Payload ID: 7597
  Gene Symbol: HDLBP
  Gene Name: high density lipoprotein binding protein
  ENSP ID: ENSP00000403807
MSSVAVLTQESFAEHRSGLVPQQIKVATLNSEEESDPPTYKDAFPPLPEKAACLESAQEPAGAWGNKIRPIKASVITQVFHVPLEERKYKDMNQFGEGEQAKICLEIMQRTGAHLELSLAKDQGLSIMVSGKLDAVMKARKDIVARLQTQASATVAIPKEHHRFVIGKNGEKLQDLELKTATKIQIPRPDDPSNQIKITGTKEGIEKARHEVLLISAEQDKRAV

SEQ ID NO: 38264 - protein, 141 aa, Homo sapiens
  Payload ID: 7597
  Gene Symbol: HDLBP
  Gene Name: high density lipoprotein binding protein
  ENSP ID: ENSP00000403913
MSSVAVLTQESFAEHRSGLVPQQIKVATLNSEEESDPPTYKDAFPPLPEKAACLESAQEPAGAWGNKIRPIKASVITQVFHVPLEERKYKDMNQFGEGEQAKICLEIMQRTGAHLELSLAKDQGLSIMVSGKLDAVMKARK

SEQ ID NO: 38265 - protein, 221 aa, Homo sapiens
  Payload ID: 7597
  Gene Symbol: HDLBP
  Gene Name: high density lipoprotein binding protein
  ENSP ID: ENSP00000405109
MSSVAVLTQESFAEHRSGLVPQQIKVATLNSEEESDPPTYKDAFPPLPEKAACLESAQEPAGAWGNKIRPIKASVITQVFHVPLEERKYKDMNQFGEGEQAKICLEIMQRTGAHLELSLAKDQGLSIMVSGKLDAVMKARKDIVARLQTQASATVAIPKEHHRFVIGKNGEKLQDLELKTATKIQIPRPDDPSNQIKITGTKEGIEKARHEVLLISAEQDK

SEQ ID NO: 38266 - protein, 308 aa, Homo sapiens
  Payload ID: 7597
  Gene Symbol: HDLBP
  Gene Name: high density lipoprotein binding protein
  ENSP ID: ENSP00000405180
  MOD_RES (1)..(1): Any amino acid
XKIDLPAENSNSETIIITGKRANCEAARSRILSIQKDLANIAEVEVSIPAKLHNSLIGTKGRLIRSIMEECGGVHIHFPVEGSGSDTVVIRGPSSDVEKAKKQLLHLAEEKARGVRLTQWDWFLQQTKSFTVDIRAKPEYHKFLIGKGGGKIRKVRDSTGARVIFPAAEDKDQDLITIIGKEDAVREAQKELEALIQNLDNVVEDSMLVDPKHHRHFVIRRGQVLREIAEEYGGVMVSFPRSGTQSDKVTLKGAKDCVEAAKKRIQEIIEDLEAQVTLECAIPQKFHRSVMGPKGSRIQQITRDFSVQ

SEQ ID NO: 38267 - protein, 46 aa, Homo sapiens
  Payload ID: 7597
  Gene Symbol: HDLBP
  Gene Name: high density lipoprotein binding protein
  ENSP ID: ENSP00000408582
MSSVAVLTQESFAEHRSGLVPQQIKVATLNSEEESDPPTYKDAFPP

SEQ ID NO: 38268 - protein, 53 aa, Homo sapiens
  Payload ID: 7597
  Gene Symbol: HDLBP
  Gene Name: high density lipoprotein binding protein
  ENSP ID: ENSP00000409868
MSSVAVLTQESFAEHRSGLVPQQIKVATLNSEEESDPPTYKDAFPPLPEKAAC

SEQ ID NO: 38269 - protein, 126 aa, Homo sapiens
  Payload ID: 7597
  Gene Symbol: HDLBP
  Gene Name: high density lipoprotein binding protein
  ENSP ID: ENSP00000411211
RVHARIIGARGKAIRKIMDEFKVDIRFPQSGAPDPNCVTVTGLPENVEEAIDHILNLEEEYLADVVDSEALQVYMKPPAHEEAKAPSRGFVVRDAPWTASSSEKVRCGLLPSWVPGRVGGQAGLVS

SEQ ID NO: 38270 - protein, 81 aa, Homo sapiens; identical to SEQ ID NO: 38252
  Payload ID: 7597
  Gene Symbol: HDLBP
  Gene Name: high density lipoprotein binding protein
  ENSP ID: ENSP00000413805

SEQ ID NO: 38271 - protein, 128 aa, Homo sapiens
  Payload ID: 7597
  Gene Symbol: HDLBP
  Gene Name: high density lipoprotein binding protein
  ENSP ID: ENSP00000413891
MSSVAVLTQESFAEHRSGLVPQQIKVATLNSEEESDPPTYKDAFPPLPEKAACLESAQEPAGAWGNKIRPIKASVITQVFHVPLEERKYKDMNQFGEGLSNCCHSQRTPSLCYWQKWRETARLGAKNC

SEQ ID NO: 38272 - protein, 147 aa, Homo sapiens
  Payload ID: 7597
  Gene Symbol: HDLBP
  Gene Name: high density lipoprotein binding protein
  ENSP ID: ENSP00000416559
MSSVAVLTQESFAEHRSGLVPQQIKVATLNSEEESDPPTYKDAFPPLPEKAACLESAQEPAGAWGNKIRPIKASVITQVFHVPLEERKYKDMNQFGEGEQAKICLEIMQRTGAHLELSLAKDQGLSIMVSGKLDAVMKARKDIVARL

SEQ ID NO: 38273 - protein, 347 aa, Homo sapiens
  Payload ID: 7598
  Gene Symbol: HMG20A
  Gene Name: high mobility group 20A
  Uniprot ID: Q9NP66
  ENSP ID: ENSP00000336856
MENLMTSSTLPPLFADEDGSKESNDLATTGLNHPEVPYSSGATSSTNNPEFVEDLSQGQLLQSESSNAAEGNEQRHEDEQRSKRGGWSKGRKRKKPLRDSNAPKSPLTGYVRFMNERREQLRAKRPEVPFPEITRMLGNEWSKLPPEEKQRYLDEADRDKERYMKELEQYQKTEAYKVFSRKTQDRQKGKSHRQDAARQATHDHEKETEVKERSVFDIPIFTEEFLNHSKAREAELRQLRKSNMEFEERNAALQKHVESMRTAVEKLEVDVIQERSRNTVLQQHLETLRQVLTSSFASMPLPGSGETPTVDTIDSYMNRLHSIILANPQDNENFIATVREVVNRLDR

SEQ ID NO: 38274 - protein, 347 aa, Homo sapiens; identical to SEQ ID NO: 38273
  Payload ID: 7598
  Gene Symbol: HMG20A
  Gene Name: high mobility group 20A
  Uniprot ID: Q9NP66
  ENSP ID: ENSP00000371133

SEQ ID NO: 38275 - protein, 26 aa, Homo sapiens
  Payload ID: 7598
  Gene Symbol: HMG20A
  Gene Name: high mobility group 20A
  ENSP ID: ENSP00000452665
MNERREQLRAKRPEVPFPEITRMLGN

SEQ ID NO: 38276 - protein, 118 aa, Homo sapiens
  Payload ID: 7598
  Gene Symbol: HMG20A
  Gene Name: high mobility group 20A
  ENSP ID: ENSP00000452847
  MOD_RES (1)..(1): Any amino acid
XAREAELRQLRKSNMEFEERNAALQKHVESMRTAVEKLEVDVIQERSRNTVLQQHLETLRQVLTSSFASMPLPGSGETPTVDTIDSYMNRLHSIILANPQDNENFIATVREVVNRLDR

SEQ ID NO: 38277 - protein, 162 aa, Homo sapiens
  Payload ID: 7598
  Gene Symbol: HMG20A
  Gene Name: high mobility group 20A
  ENSP ID: ENSP00000452864
MENLMTSSTLPPLFADEDGSKESNDLATTGLNHPEVPYSSGATSSTNNPEFVEDLSQGQLLQSESSNAAEGNEQRHEDEQRSKRGGWSKGRKRKKPLRDSNAPKSPLTGYVRFMNERREQLRAKRPEVPFPEITRMLGNEWSKLPPEEKQRYLDEADRDKER

SEQ ID NO: 38278 - protein, 100 aa, Homo sapiens
  Payload ID: 7598
  Gene Symbol: HMG20A
  Gene Name: high mobility group 20A
  ENSP ID: ENSP00000453498
MENLMTSSTLPPLFADEDGSKESNDLATTGLNHPEVPYSSGATSSTNNPEFVEDLSQGQLLQSESSNAAEGNEQRHEDEQRSKRGGWSKGRKRKKPLRDS

SEQ ID NO: 38279 - protein, 84 aa, Homo sapiens
  Payload ID: 7598
  Gene Symbol: HMG20A
  Gene Name: high mobility group 20A
  ENSP ID: ENSP00000453592
MENLMTSSTLPPLFADEDGSKESNDLATTGLNHPEVPYSSGATSSTNNPEFVEDLSQGQLLQSESSNAAEGNEQRHEDEDMFGS

SEQ ID NO: 38280 - protein, 29 aa, Homo sapiens
  Payload ID: 7598
  Gene Symbol: HMG20A
  Gene Name: high mobility group 20A
  ENSP ID: ENSP00000453727
MNERREQLRAKRPEVPFPEITRMLGNEWS

SEQ ID NO: 38281 - protein, 156 aa, Homo sapiens
  Payload ID: 7598
  Gene Symbol: HMG20A
  Gene Name: high mobility group 20A
  ENSP ID: ENSP00000454136
MENLMTSSTLPPLFADEDGSKESNDLATTGLNHPEVPYSSGATSSTNNPEFVEDLSQGQLLQSESSNAAEGNEQRHEDEQRSKRGGWSKGRKRKKPLRDSNAPKSPLTGYVRFMNERREQLRAKRPEVPFPEITRMLGNEWSKLPPEEKQRYLDEA

SEQ ID NO: 38282 - protein, 286 aa, Homo sapiens
  Payload ID: 7599
  Gene Symbol: HMG20B
  Gene Name: high mobility group 20B
  ENSP ID: ENSP00000262949
MSHGPKQPGAAAAPAGGKAPGQHGGFVVTVKQERGEGPRAGEKGSHEEEPGSAAGEETRLAQGQEAEEDSAEWAQGTGHGLRALPERAARADPHAPPGSALSRDHQDAGRRVEQAAANGKAGFPCFKPSGAAPQRYLDEAEREKQQYMKELRAYQQSEAYKMCTEKIQEKKIKKEDSSSGLMNTLLNGHKGGDCDGFSTFDVPIFTEEFLDQNKAREAELRRLRKMNVAFEEQNAVLQRHTQSMSSARERLEQELALEERRTLALQQQLQAVRQALTASFASLPVP

SEQ ID NO: 38283 - protein, 317 aa, Homo sapiens
  Payload ID: 7599
  Gene Symbol: HMG20B
  Gene Name: high mobility group 20B
  Uniprot ID: Q9P0W2
  ENSP ID: ENSP00000328269
MSHGPKQPGAAAAPAGGKAPGQHGGFVVTVKQERGEGPRAGEKGSHEEEPVKKRGWPKGKKRKKILPNGPKAPVTGYVRFLNERREQIRTRHPDLPFPEITKMLGAEWSKLQPTEKQRYLDEAEREKQQYMKELRAYQQSEAYKMCTEKIQEKKIKKEDSSSGLMNTLLNGHKGGDCDGFSTFDVPIFTEEFLDQNKAREAELRRLRKMNVAFEEQNAVLQRHTQSMSSARERLEQELALEERRTLALQQQLQAVRQALTASFASLPVPGTGETPTLGTLDFYMARLHGAIERDPAQHEKLIVRIKEILAQVASEHL

SEQ ID NO: 38284 - protein, 125 aa, Homo sapiens
  Payload ID: 7599
  Gene Symbol: HMG20B
  Gene Name: high mobility group 20B
  ENSP ID: ENSP00000393481
MSHGPKQPGAAAAPAGGKAPGQHGGFVVTVKQERGEGPRAGEKGSHEEEPGSAAGEETRLAQGQEAEEDSAEWAQGTGHGLRALPERAARADPHAPPGSALSRDHQDAGRRVEQAAANGKAAVPG

SEQ ID NO: 38285 - protein, 165 aa, Homo sapiens
  Payload ID: 7599
  Gene Symbol: HMG20B
  Gene Name: high mobility group 20B
  ENSP ID: ENSP00000393904
MSHGPKQPGAAAAPAGGKAPGQHGGFVVTVKQERGEGPRAGEKGSHEEEYARPPSQRRSPVLQPVKKRGWPKGKKRKKILPNGPKAPVTGYVRFLNERREQIRTRHPDLPFPEITKMLGAEWSKLQPTEKQRYLDEAEREKQQYMKELRAYQQSEAYKMCTEKIQ

SEQ ID NO: 38286 - protein, 142 aa, Homo sapiens
  Payload ID: 7599
  Gene Symbol: HMG20B
  Gene Name: high mobility group 20B
  ENSP ID: ENSP00000402877
MSHGPKQPGAAAAPAGGKAPGQHGGFVVTVKQERGEGPRAGEKGSHEEEPVKKRGWPKGKKRKKILPNGPKAPVTGYVRFLNERREQIRTRHPDLPFPEITKMLGAEWSKLQPTEKQRYLDEAEREKQQYMKELRAYQQSEA

SEQ ID NO: 38287 - protein, 215 aa, Homo sapiens
  Payload ID: 7599
  Gene Symbol: HMG20B
  Gene Name: high mobility group 20B
  ENSP ID: ENSP00000410924
MSHGPKQPGAAAAPAGGKAPGQHGGFVVTVKQERGEGPRAGEKGSHEEEPVKKRGWPKGKKRKKILPNGPKAPVTGYVRFLNERREQIRTRHPDLPFPEITKMLGAEWSKLQPTEKQRYLDEAEREKQQYMKELRAYQQSEAYKMCTEKIQEKKIKKEDSSSGLMNTLLNGHKGGDCDGFSTFDVPIFTEEFLDQNKAREAELRRLRKMNVAFEE

SEQ ID NO: 38288 - protein, 184 aa, Homo sapiens
  Payload ID: 7599
  Gene Symbol: HMG20B
  Gene Name: high mobility group 20B
  ENSP ID: ENSP00000465293
QNKAREAELRRLRKMNVAFEEQNAVLQRHTQSMSSARERLEQELALEERRTLALQQQLQAVRQALTASFASLPVPGTGETPTLGTLDFYMARLHGAIERDPAQHEKLIVRIKEILAQVASPLNPEKALAARYTQKNLTAEGAPPRRTATRYTGSPGHPQDTGQTKPTPSTRQDPPNYSLRGAVP

SEQ ID NO: 38289 - protein, 96 aa, Homo sapiens
  Payload ID: 7600
  Gene Symbol: HMGA1
  Gene Name: high mobility group AT-hook 1
  Uniprot ID: P17096
  ENSP ID: ENSP00000288245
MSESSSKSSQPLASKQEKDGTEKRGRGRPRKQPPKEPSEVPTPKRPRGRPKGSKNKGAAKTRKTTTTPGRKPRGRPKKLEKEEEEGISQESSEEEQ

SEQ ID NO: 38290 - protein, 107 aa, Homo sapiens
  Payload ID: 7600
  Gene Symbol: HMGA1
  Gene Name: high mobility group AT-hook 1
  Uniprot ID: P17096
  ENSP ID: ENSP00000308227
MSESSSKSSQPLASKQEKDGTEKRGRGRPRKQPPVSPGTALVGSQKEPSEVPTPKRPRGRPKGSKNKGAAKTRKTTTTPGRKPRGRPKKLEKEEEEGISQESSEEEQ

SEQ ID NO: 38291 - protein, 96 aa, Homo sapiens; identical to SEQ ID NO: 38289
  Payload ID: 7600
  Gene Symbol: HMGA1
  Gene Name: high mobility group AT-hook 1
  Uniprot ID: P17096
  ENSP ID: ENSP00000363230

SEQ ID NO: 38292 - protein, 96 aa, Homo sapiens; identical to SEQ ID NO: 38289
  Payload ID: 7600
  Gene Symbol: HMGA1
  Gene Name: high mobility group AT-hook 1
  Uniprot ID: P17096
  ENSP ID: ENSP00000385693

SEQ ID NO: 38293 - protein, 107 aa, Homo sapiens; identical to SEQ ID NO: 38290
  Payload ID: 7600
  Gene Symbol: HMGA1
  Gene Name: high mobility group AT-hook 1
  Uniprot ID: P17096
  ENSP ID: ENSP00000399888

SEQ ID NO: 38294 - protein, 106 aa, Homo sapiens
  Payload ID: 7601
  Gene Symbol: HMGA2
  Gene Name: high mobility group AT-hook 2
  Uniprot ID: P52926
  ENSP ID: ENSP00000346658
MSARGEGAGQPSTSAQGQPAAPAPQKRGRGRPRKQQQEPTGEPSPKRPRGRPKGSKNKSPSKAAQKKAEATGEKRPRGRPRKWDNLLPRTSSKKKTSLGNSTKRSH

SEQ ID NO: 38295 - protein, 118 aa, Homo sapiens
  Payload ID: 7601
  Gene Symbol: HMGA2
  Gene Name: high mobility group AT-hook 2
  ENSP ID: ENSP00000377205
MSARGEGAGQPSTSAQGQPAAPAPQKRGRGRPRKQQQEPTGEPSPKRPRGRPKGSKNKSPSKAAQKKAEATGEKRPRGRPRKWPQQVVQKKPAQVNVALPGKDHPGNLIYLLFSKNAT

SEQ ID NO: 38296 - protein, 90 aa, Homo sapiens
  Payload ID: 7601
  Gene Symbol: HMGA2
  Gene Name: high mobility group AT-hook 2
  Uniprot ID: P52926
  ENSP ID: ENSP00000377206
MSARGEGAGQPSTSAQGQPAAPAPQKRGRGRPRKQQQEPTGEPSPKRPRGRPKGSKNKSPSKAAQKKAEATGEKRPRGRPRKWEEFYIAA

SEQ ID NO: 38297 - protein, 109 aa, Homo sapiens
  Payload ID: 7601
  Gene Symbol: HMGA2
  Gene Name: high mobility group AT-hook 2
  Uniprot ID: P52926
  ENSP ID: ENSP00000384026
MSARGEGAGQPSTSAQGQPAAPAPQKRGRGRPRKQQQEPTGEPSPKRPRGRPKGSKNKSPSKAAQKKAEATGEKRPRGRPRKWPQQVVQKKPAQEETEETSSQESAEED

SEQ ID NO: 38298 - protein, 92 aa, Homo sapiens
  Payload ID: 7601
  Gene Symbol: HMGA2
  Gene Name: high mobility group AT-hook 2
  Uniprot ID: P52926
  ENSP ID: ENSP00000407306
MSARGEGAGQPSTSAQGQPAAPAPQKRGRGRPRKQQQEPTGEPSPKRPRGRPKGSKNKSPSKAAQKKAEATGEKRPRGRPRKWWLLMKSPCW

SEQ ID NO: 38299 - protein, 147 aa, Homo sapiens
  Payload ID: 7601
  Gene Symbol: HMGA2
  Gene Name: high mobility group AT-hook 2
  ENSP ID: ENSP00000437621
MSARGEGAGQPSTSAQGQPAAPAPQKRGRGRPRKQQQEPTGEPSPKRPRGRPKGSKNKSPSKAAQKKAEATGEKRPRGRPRKWAGVQWYNLGSLQPPPPRFKQFSCLRLLSSWDYRHPPPHPANFCIFSRDRVSPCWPGWSRTPDLR

SEQ ID NO: 38300 - protein, 103 aa, Homo sapiens
  Payload ID: 7601
  Gene Symbol: HMGA2
  Gene Name: high mobility group AT-hook 2
  Uniprot ID: P52926
  ENSP ID: ENSP00000437747
MSARGEGAGQPSTSAQGQPAAPAPQKRGRGRPRKQQQEPTGEPSPKRPRGRPKGSKNKSPSKAAQKKAEATGEKRPRGRPRKWLRAQALDSDGLGSNSGPSLS

SEQ ID NO: 38301 - protein, 99 aa, Homo sapiens
  Payload ID: 7601
  Gene Symbol: HMGA2
  Gene Name: high mobility group AT-hook 2
  ENSP ID: ENSP00000439317
MSARGEGAGQPSTSAQGQPAAPAPQKRGRGRPRKQQQEPTGEPSPKRPRGRPKGSKNKSPSKAAQKKAEATGEKRPRGRPRKWPQQVVQKKPAQVRHSH

SEQ ID NO: 38302 - protein, 55 aa, Homo sapiens
  Payload ID: 7601
  Gene Symbol: HMGA2
  Gene Name: high mobility group AT-hook 2
  ENSP ID: ENSP00000440919
EPTGEPSPKRPRGRPKGSKNKSPSKAAQKKAEATGEKRPRGRPRKWWLLMKSPCW

SEQ ID NO: 38303 - protein, 86 aa, Homo sapiens
  Payload ID: 7601
  Gene Symbol: HMGA2
  Gene Name: high mobility group AT-hook 2
  Uniprot ID: P52926
  ENSP ID: ENSP00000443372
MSARGEGAGQPSTSAQGQPAAPAPQKRGRGRPRKQQQEPTGEPSPKRPRGRPKGSKNKSPSKAAQKKAEATGEKRPRGRPRKWLQN

SEQ ID NO: 38304 - protein, 215 aa, Homo sapiens
  Payload ID: 7602
  Gene Symbol: HMGB1
  Gene Name: high mobility group box 1
  Uniprot ID: P09429
  ENSP ID: ENSP00000343040
MGKGDPKKPRGKMSSYAFFVQTCREEHKKKHPDASVNFSEFSKKCSERWKTMSAKEKGKFEDMAKADKARYEREMKTYIPPKGETKKKFKDPNAPKRPPSAFFLFCSEYRPKIKGEHPGLSIGDVAKKLGEMWNNTAADDKQPYEKKAAKLKEKYEKDIAAYRAKGKPDAAKKGVVKAEKSKKKKEEEEDEEDEEDEEEEEDEEDEDEEEDDDDE

SEQ ID NO: 38305 - protein, 215 aa, Homo sapiens; identical to SEQ ID NO: 38304
  Payload ID: 7602
  Gene Symbol: HMGB1
  Gene Name: high mobility group box 1
  Uniprot ID: P09429
  ENSP ID: ENSP00000345347

SEQ ID NO: 38306 - protein, 158 aa, Homo sapiens
  Payload ID: 7602
  Gene Symbol: HMGB1
  Gene Name: high mobility group box 1
  ENSP ID: ENSP00000369904
MGKGDPKKPRGKMSSYAFFVQTCREEHKKKHPDASVNFSEFSKKCSERWKTMSAKEKGKFEDMAKADKARYEREMKTYIPPKGETKKKFKDPNAPKRPPSAFFLFCSEYRPKIKGEHPGLSIGDVAKKLGEMWNNTAADDKQPYEKKAAKLKEKYEKF

SEQ ID NO: 38307 - protein, 158 aa, Homo sapiens; identical to SEQ ID NO: 38306
  Payload ID: 7602
  Gene Symbol: HMGB1
  Gene Name: high mobility group box 1
  ENSP ID: ENSP00000382412

SEQ ID NO: 38308 - protein, 215 aa, Homo sapiens; identical to SEQ ID NO: 38304
  Payload ID: 7602
  Gene Symbol: HMGB1
  Gene Name: high mobility group box 1
  Uniprot ID: P09429
  ENSP ID: ENSP00000382417

SEQ ID NO: 38309 - protein, 215 aa, Homo sapiens; identical to SEQ ID NO: 38304
  Payload ID: 7602
  Gene Symbol: HMGB1
  Gene Name: high mobility group box 1
  Uniprot ID: P09429
  ENSP ID: ENSP00000384678

SEQ ID NO: 38310 - protein, 209 aa, Homo sapiens
  Payload ID: 7603
  Gene Symbol: HMGB2
  Gene Name: high mobility group box 2
  Uniprot ID: P26583
  ENSP ID: ENSP00000296503
MGKGDPNKPRGKMSSYAFFVQTCREEHKKKHPDSSVNFAEFSKKCSERWKTMSAKEKSKFEDMAKSDKARYDREMKNYVPPKGDKKGKKKDPNAPKRPPSAFFLFCSEHRPKIKSEHPGLSIGDTAKKLGEMWSEQSAKDKQPYEQKAAKLKEKYEKDIAAYRAKGKSEAGKKGPGRPTGSKKKNEPEDEEEEEEEEDEDEEEEDEDEE

SEQ ID NO: 38311 - protein, 209 aa, Homo sapiens; identical to SEQ ID NO: 38310
  Payload ID: 7603
  Gene Symbol: HMGB2
  Gene Name: high mobility group box 2
  Uniprot ID: P26583
  ENSP ID: ENSP00000393448

SEQ ID NO: 38312 - protein, 209 aa, Homo sapiens; identical to SEQ ID NO: 38310
  Payload ID: 7603
  Gene Symbol: HMGB2
  Gene Name: high mobility group box 2
  Uniprot ID: P26583
  ENSP ID: ENSP00000404912

SEQ ID NO: 38313 - protein, 134 aa, Homo sapiens
  Payload ID: 7603
  Gene Symbol: HMGB2
  Gene Name: high mobility group box 2
  ENSP ID: ENSP00000423001
MGKGDPNKPRGKMSSYAFFVQTCREEHKKKHPDSSVNFAEFSKKCSERWKTMSAKEKSKFEDMAKSDKARYDREMKNYVPPKGDKKGKKKDPNAPKRPPSAFFLFCSEHRPKIKSEHPGLSIGDTAKKLGEMWS

SEQ ID NO: 38314 - protein, 200 aa, Homo sapiens
  Payload ID: 7604
  Gene Symbol: HMGB3
  Gene Name: high mobility group box 3
  Uniprot ID: O15347
  ENSP ID: ENSP00000359393
MAKGDPKKPKGKMSAYAFFVQTCREEHKKKNPEVPVNFAEFSKKCSERWKTMSGKEKSKFDEMAKADKVRYDREMKDYGPAKGGKKKKDPNAPKRPPSGFFLFCSEFRPKIKSTNPGISIGDVAKKLGEMWNNLNDSEKQPYITKAAKLKEKYEKDVADYKSKGKFDGAKGPAKVARKKVEEEDEEEEEEEEEEEEEEDE

SEQ ID NO: 38315 - protein, 193 aa, Homo sapiens
  Payload ID: 7604
  Gene Symbol: HMGB3
  Gene Name: high mobility group box 3
  ENSP ID: ENSP00000405601
MAKGDPKKPKGKMSAYAFFVQTCREEHKKKNPEVPVNFAEFSKKCSERWKTMSGKEKSKFDEMAKADKVRYDREMKDYGPAKGGKKKKDPNAPKRPPSGFFLFCSEFRPKIKSTNPGISIGDVAKKLGEMWNNLNDSEKQPYITKAAKLKEKYEKDVADYKSKGKFDGAKGPAKVARKKVEEEDEEEEEEEEE

SEQ ID NO: 38316 - protein, 188 aa, Homo sapiens
  Payload ID: 7604
  Gene Symbol: HMGB3
  Gene Name: high mobility group box 3
  ENSP ID: ENSP00000410354
MAKGDPKKPKGKMSAYAFFVQTCREEHKKKNPEVPVNFAEFSKKCSERWKTMSGKEKSKFDEMAKADKVRYDREMKDYGPAKGGKKKKDPNAPKRPPSGFFLFCSEFRPKIKSTNPGISIGDVAKKLGEMWNNLNDSEKQPYITKAAKLKEKYEKDVADYKSKGKFDGAKGPAKVARKKVEEEDEEEE

SEQ ID NO: 38317 - protein, 153 aa, Homo sapiens
  Payload ID: 7604
  Gene Symbol: HMGB3
  Gene Name: high mobility group box 3
  ENSP ID: ENSP00000417027
MAKGDPKKPKGKMSAYAFFVQTCREEHKKKNPEVPVNFAEFSKKCSERWKTMSGKEKSKFDEMAKADKVRYDREMKDYGPAKGGKKKKDPNAPKRPPSGFFLFCSEFRPKIKSTNPGISIGDVAKKLGEMWNNLNDSEKQPYITKAAKLKEKY

SEQ ID NO: 38318 - protein, 200 aa, Homo sapiens; identical to SEQ ID NO: 38314
  Payload ID: 7604
  Gene Symbol: HMGB3
  Gene Name: high mobility group box 3
  Uniprot ID: O15347
  ENSP ID: ENSP00000442758

SEQ ID NO: 38319 - protein, 186 aa, Homo sapiens
  Payload ID: 7605
  Gene Symbol: HMGB4
  Gene Name: high mobility group box 4
  Uniprot ID: Q8WW32
  ENSP ID: ENSP00000429214
MGKEIQLKPKANVSSYVHFLLNYRNKFKEQQPNTYVGFKEFSRKCSEKWRSISKHEKAKYEALAKLDKARYQEEMMNYVGKRKKRRKRDPQEPRRPPSSFLLFCQDHYAQLKRENPNWSVVQVAKATGKMWSTATDLEKHPYEQRVALLRAKYFEELELYRKQCNARKKYRMSARNRCRGKRVRQS

SEQ ID NO: 38320 - protein, 186 aa, Homo sapiens; identical to SEQ ID NO: 38319
  Payload ID: 7605
  Gene Symbol: HMGB4
  Gene Name: high mobility group box 4
  Uniprot ID: Q8WW32
  ENSP ID: ENSP00000430919

SEQ ID NO: 38321 - protein, 90 aa, Homo sapiens
  Payload ID: 7606
  Gene Symbol: HMGN2
  Gene Name: high mobility group nucleosomal binding domain 2
  Uniprot ID: P05204
  ENSP ID: ENSP00000355228
MPKRKAEGDAKGDKAKVKDEPQRRSARLSAKPAPPKPEPKPKKAPAKKGEKVPKGKKGKADAGKEGNNPAENGDAKTDQAQKAEGAGDAK

SEQ ID NO: 38322 - protein, 90 aa, Homo sapiens; identical to SEQ ID NO: 38321
  Payload ID: 7606
  Gene Symbol: HMGN2
  Gene Name: high mobility group nucleosomal binding domain 2
  Uniprot ID: P05204
  ENSP ID: ENSP00000481160

SEQ ID NO: 38323 - protein, 77 aa, Homo sapiens
  Payload ID: 7607
  Gene Symbol: HMGN3
  Gene Name: high mobility group nucleosomal binding domain 3
  Uniprot ID: Q15651
  ENSP ID: ENSP00000275036
MPKRKSPENTEGKDGSKVTKQEPTRRSARLSAKPAPPKPEPKPRKTSAKKEPGAKISRGAKGKKEEKQEAGKEGTEN

SEQ ID NO: 38324 - protein, 99 aa, Homo sapiens
  Payload ID: 7607
  Gene Symbol: HMGN3
  Gene Name: high mobility group nucleosomal binding domain 3
  Uniprot ID: Q15651
  ENSP ID: ENSP00000341267
MPKRKSPENTEGKDGSKVTKQEPTRRSARLSAKPAPPKPEPKPRKTSAKKEPGAKISRGAKGKKEEKQEAGKEGTAPSENGETKAEEAQKTESVDNEGE

SEQ ID NO: 38325 - protein, 130 aa, Homo sapiens
  Payload ID: 7607
  Gene Symbol: HMGN3
  Gene Name: high mobility group nucleosomal binding domain 3
  ENSP ID: ENSP00000482613
MPKRKSPENTEGKDGSKVTKQEPTRRSARLSAKPAPPKPEPKPRKTSAKKEPGAKISRGAKGKKEEKQEAGKEGTAPSENGETKAEEIHISRSTVNVSTSRGTPPSTLSVKGQIETVRAQKTESVDNEGE

SEQ ID NO: 38326 - protein, 90 aa, Homo sapiens
  Payload ID: 7608
  Gene Symbol: HMGN4
  Gene Name: high mobility group nucleosomal binding domain 4
  Uniprot ID: O00479
  ENSP ID: ENSP00000366798
MPKRKAKGDAKGDKAKVKDEPQRRSARLSAKPAPPKPEPRPKKASAKKGEKLPKGRKGKADAGKDGNNPAKNRDASTLQSQKAEGTGDAK

SEQ ID NO: 38327 - protein, 48 aa, Homo sapiens
  Payload ID: 7609
  Gene Symbol: HMGN1
  Gene Name: high mobility group nucleosome binding domain 1
  ENSP ID: ENSP00000288344
MPKRKVSSAEGAAKEEPKRRSARLSAKPPAKVEAKPKKAAAKILQTPK

SEQ ID NO: 38328 - protein, 116 aa, Homo sapiens
  Payload ID: 7609
  Gene Symbol: HMGN1
  Gene Name: high mobility group nucleosome binding domain 1
  ENSP ID: ENSP00000370123
MFEPNSPRRGGARYQWPEGAQVSSAEGAAKEEPKRRSARLSAKPPAKVEAKPKKAAAKDKSSDKKVQTKGKRGAKGKQAEVANQETKEDLPAENGETKTEESPASDEAGEKEAKSD

SEQ ID NO: 38329 - protein, 90 aa, Homo sapiens
  Payload ID: 7609
  Gene Symbol: HMGN1
  Gene Name: high mobility group nucleosome binding domain 1
  ENSP ID: ENSP00000370124
MPKRKVSSAEGAAKEEKPPAKVEAKPKKAAAKDKSSDKKVQTKGKRGAKGKQAEVANQETKEDLPAENGETKTEESPASDEAGEKEAKSD

SEQ ID NO: 38330 - protein, 100 aa, Homo sapiens
  Payload ID: 7609
  Gene Symbol: HMGN1
  Gene Name: high mobility group nucleosome binding domain 1
  Uniprot ID: P05114
  ENSP ID: ENSP00000370125
MPKRKVSSAEGAAKEEPKRRSARLSAKPPAKVEAKPKKAAAKDKSSDKKVQTKGKRGAKGKQAEVANQETKEDLPAENGETKTEESPASDEAGEKEAKSD

SEQ ID NO: 38331 - protein, 45 aa, Homo sapiens
  Payload ID: 7609
  Gene Symbol: HMGN1
  Gene Name: high mobility group nucleosome binding domain 1
  ENSP ID: ENSP00000395291
MPKRKVSSAEGAAKEEPKRRSARLSAKPPAKVEAKPKKAAAKVEV

SEQ ID NO: 38332 - protein, 44 aa, Homo sapiens
  Payload ID: 7609
  Gene Symbol: HMGN1
  Gene Name: high mobility group nucleosome binding domain 1
  ENSP ID: ENSP00000395787
MPKRKVSSAEGAAKEEPKRRSARLSAKPPAKVEAKPKKAAAKCR

SEQ ID NO: 38333 - protein, 45 aa, Homo sapiens; identical to SEQ ID NO: 38331
  Payload ID: 7609
  Gene Symbol: HMGN1
  Gene Name: high mobility group nucleosome binding domain 1
  ENSP ID: ENSP00000396693

SEQ ID NO: 38334 - protein, 44 aa, Homo sapiens; identical to SEQ ID NO: 38332
  Payload ID: 7609
  Gene Symbol: HMGN1
  Gene Name: high mobility group nucleosome binding domain 1
  ENSP ID: ENSP00000414421

SEQ ID NO: 38335 - protein, 282 aa, Homo sapiens
  Payload ID: 7610
  Gene Symbol: HMGN5
  Gene Name: high mobility group nucleosome binding domain 5
  Uniprot ID: P82970
  ENSP ID: ENSP00000350848
MPKRKAAGQGDMRQEPKRRSARLSAMLVPVTPEVKPKRTSSSRKMKTKSDMMEENIDTSAQAVAETKQEAVVEEDYNENAKNGEAKITEAPASEKEIVEVKEENIEDATEKGGEKKEAVAAEVKNEEEDQKEDEEDQNEEKGEAGKEDKDEKGEEDGKEDKNGNEKGEDAKEKEDGKKGEDGKGNGEDGKEKGEDEKEEEDRKETGDGKENEDGKEKGDKKEGKDVKVKEDEKEREDGKEDEGGNEEEAGKEKEDLKEEEEGKEEDEIKEDDGKKEEPQSIV

SEQ ID NO: 38336 - protein, 161 aa, Homo sapiens
  Payload ID: 7610
  Gene Symbol: HMGN5
  Gene Name: high mobility group nucleosome binding domain 5
  ENSP ID: ENSP00000362347
MPKRKPKRRSARLSAMLVPVTPEVKPKRTSSSRKMKTKSDMMEENIDTSAQAVAETKQEAVVEEDYNENAKNGEAKITEAPASEKEIVEVKEENIEDATEKGGEKKEAVAAEVKNEEEDQKEDEEDQNEEKGEAGKEDKDEKGEEDGKEDKNGNEKGEDAK

SEQ ID NO: 38337 - protein, 148 aa, Homo sapiens
  Payload ID: 7610
  Gene Symbol: HMGN5
  Gene Name: high mobility group nucleosome binding domain 5
  ENSP ID: ENSP00000399626
MPKRKAAGQGDMRQEPKRRSARLSAMLVPVTPEVKPKRTSSSRKMKTKSDMMEENIDTSAQAVAETKQEAVVEEDYNENAKNGEAKITEAPASEKEIVEVKEENIEDATEKGGEKKEAVAAEVKNEEEDQKEDEEDQNEEKGEAGKED

SEQ ID NO: 38338 - protein, 89 aa, Homo sapiens
  Payload ID: 7610
  Gene Symbol: HMGN5
  Gene Name: high mobility group nucleosome binding domain 5
  ENSP ID: ENSP00000404810
MPKRKAAGQGDMRQEPKRRSARLSAMLVPVTPEVKPKRTSSSRKMKTKSDMMEENIDTSAQAVAETKQEAVVEEDYNENAKNGEAKITE

SEQ ID NO: 38339 - protein, 201 aa, Homo sapiens
  Payload ID: 7610
  Gene Symbol: HMGN5
  Gene Name: high mobility group nucleosome binding domain 5
  ENSP ID: ENSP00000408060
MPKRKMLVPVTPEVKPKRTSSSRKMKTKSDMMEENIDTSAQAVAETKQEAVVEEDYNENAKNGEAKITEAPASEKEIVEVKEENIEDATEKGGEKKEAVAAEVKNEEEDQKEDEEDQNEEKGEAGKEDKDEKGEEDGKEDKNGNEKGEDAKEKEDGKKGEDGKGNGEDGKEKGEDEKEEEDRKETGDGKENEDGKEKGDKK

SEQ ID NO: 38340 - protein, 102 aa, Homo sapiens
  Payload ID: 7610
  Gene Symbol: HMGN5
  Gene Name: high mobility group nucleosome binding domain 5
  ENSP ID: ENSP00000413402
MPKRKAAGQGDMRQEPKRRSARLSAMLVPVTPEVKPKRTSSSRKMKTKSDMMEENIDTSAQAVAETKQEAVVEEDYNENAKNGEAKITEAPASEKEIVEVKE

SEQ ID NO: 38341 - protein, 690 aa, Homo sapiens
  Payload ID: 7611
  Gene Symbol: HDX
  Gene Name: highly divergent homeobox
  Uniprot ID: Q7Z353
  ENSP ID: ENSP00000297977
MNLRSVFTVEQQRILQRYYENGMTNQSKNCFQLILQCAQETKLDFSVVRTWVGNKRRKMSSKNSESGTATTGTSLSAPDITVRNVVNIARPSSQQSSWTSANNDVIVTGIYSPASSSSRQGTNKHTDTQITEAHKIPIQKTATKNDTEFQLHIPVQRQVAHCKNASLLLGEKTIILSRQTSVLNAGNSVFNHAKKNYGNSSVQASEMTVPQKPSVCHRPCKIEPVGIQRSYKPEHTGPALHNLCGQKPTIRDPYCRTQNLEIREVFSLAVSDYPQRILGGNAPQKPSSAEGNCLSIAMETGDAEDEYAREEELASMRAQIPSYSRFYESGSSLRAENQSTTLPGPGRNMPNSQMVNIRDMSDNVLYQNRNYHLTPRTSLHTASSTMYSNTNPLRSNFSPHFASSNQLRLSQNQNNYQISGNLTVPWITGCSRKRALQDRTQFSDRDLATLKKYWDNGMTSLGSVCREKIEAVATELNVDCEIVRTWIGNRRRKYRLMGIEVPPPRGGPADFSEQPESGSLSALTPGEEAGPEVGEDNDRNDEVSICLSEGSSQEEPNEVVPNDARAHKEEDHHAVTTDNVKIEIIDDEESDMISNSEVEQVNSFLDYKNEEVKFIENELEIQKQKYFKLQTFVRSLILAMKADDKEQQQALLSDLPPELEEMDFNHASLEPDDTSFSVSSLSEKNVSESL

SEQ ID NO: 38342 - protein, 690 aa, Homo sapiens; identical to SEQ ID NO: 38341
  Payload ID: 7611
  Gene Symbol: HDX
  Gene Name: highly divergent homeobox
  Uniprot ID: Q7Z353
  ENSP ID: ENSP00000362272

SEQ ID NO: 38343 - protein, 207 aa, Homo sapiens
  Payload ID: 7611
  Gene Symbol: HDX
  Gene Name: highly divergent homeobox
  ENSP ID: ENSP00000387790
MSSKNSESGTATTGTSLSAPDITVRNVVNIARPSSQQSSWTSANNDVIVTGIYSPASSSSRQGTNKHTDTQITEAHKIPIQKTATKNDTEFQLHIPVQRQVAHCKNASLLLGEKTIILSRQTSVLNAGNSVFNHAKKNYGNSSVQASEMTVPQKPSVCHRPCKIEPVGIQRSYKPEHTGPALHNLCGQKPTIRDPYCRTQNLEIREV

SEQ ID NO: 38344 - protein, 632 aa, Homo sapiens
  Payload ID: 7611
  Gene Symbol: HDX
  Gene Name: highly divergent homeobox
  Uniprot ID: Q7Z353
  ENSP ID: ENSP00000423670
MSSKNSESGTATTGTSLSAPDITVRNVVNIARPSSQQSSWTSANNDVIVTGIYSPASSSSRQGTNKHTDTQITEAHKIPIQKTATKNDTEFQLHIPVQRQVAHCKNASLLLGEKTIILSRQTSVLNAGNSVFNHAKKNYGNSSVQASEMTVPQKPSVCHRPCKIEPVGIQRSYKPEHTGPALHNLCGQKPTIRDPYCRTQNLEIREVFSLAVSDYPQRILGGNAPQKPSSAEGNCLSIAMETGDAEDEYAREEELASMRAQIPSYSRFYESGSSLRAENQSTTLPGPGRNMPNSQMVNIRDMSDNVLYQNRNYHLTPRTSLHTASSTMYSNTNPLRSNFSPHFASSNQLRLSQNQNNYQISGNLTVPWITGCSRKRALQDRTQFSDRDLATLKKYWDNGMTSLGSVCREKIEAVATELNVDCEIVRTWIGNRRRKYRLMGIEVPPPRGGPADFSEQPESGSLSALTPGEEAGPEVGEDNDRNDEVSICLSEGSSQEEPNEVVPNDARAHKEEDHHAVTTDNVKIEIIDDEESDMISNSEVEQVNSFLDYKNEEVKFIENELEIQKQKYFKLQTFVRSLILAMKADDKEQQQALLSDLPPELEEMDFNHASLEPDDTSFSVSSLSEKNVSESL

SEQ ID NO: 38345 - protein, 193 aa, Homo sapiens
  Payload ID: 7612
  Gene Symbol: HPCA
  Gene Name: hippocalcin
  Uniprot ID: P84074
  ENSP ID: ENSP00000362566
MGKQNSKLRPEMLQDLRENTEFSELELQEWYKGFLKDCPTGILNVDEFKKIYANFFPYGDASKFAEHVFRTFDTNSDGTIDFREFIIALSVTSRGRLEQKLMWAFSMYDLDGNGYISREEMLEIVQAIYKMVSSVMKMPEDESTPEKRTEKIFRQMDTNNDGKLSLEEFIRGAKSDPSIVRLLQCDPSSASQF

SEQ ID NO: 38346 - protein, 191 aa, Homo sapiens
  Payload ID: 7613
  Gene Symbol: HPCAL4
  Gene Name: hippocalcin like 4
  Uniprot ID: Q9UM19
  ENSP ID: ENSP00000361935
MGKTNSKLAPEVLEDLVQNTEFSEQELKQWYKGFLKDCPSGILNLEEFQQLYIKFFPYGDASKFAQHAFRTFDKNGDGTIDFREFICALSVTSRGSFEQKLNWAFEMYDLDGDGRITRLEMLEIIEAIYKMVGTVIMMRMNQDGLTPQQRVDKIFKKMDQDKDDQITLEEFKEAAKSDPSIVLLLQCDMQK

SEQ ID NO: 38347 - protein, 191 aa, Homo sapiens; identical to SEQ ID NO: 38346
  Payload ID: 7613
  Gene Symbol: HPCAL4
  Gene Name: hippocalcin like 4
  Uniprot ID: Q9UM19
  ENSP ID: ENSP00000481834

SEQ ID NO: 38348 - protein, 119 aa, Homo sapiens
  Payload ID: 7613
  Gene Symbol: HPCAL4
  Gene Name: hippocalcin like 4
  ENSP ID: ENSP00000484070
MGKTNSKLAPEVLEDLVQNTEFSEQELKQWYKGFLKDCPSGILNLEEFQQLYIKAIYKMVGTVIMMRMNQDGLTPQQRVDKIFKKMDQDKDDQITLEEFKEAAKSDPSIVLLLQCDMQK

SEQ ID NO: 38349 - protein, 193 aa, Homo sapiens
  Payload ID: 7614
  Gene Symbol: HPCAL1
  Gene Name: hippocalcin-like 1
  Uniprot ID: P37235
  ENSP ID: ENSP00000310749
MGKQNSKLRPEVLQDLRENTEFTDHELQEWYKGFLKDCPTGHLTVDEFKKIYANFFPYGDASKFAEHVFRTFDTNGDGTIDFREFIIALSVTSRGKLEQKLKWAFSMYDLDGNGYISRSEMLEIVQAIYKMVSSVMKMPEDESTPEKRTDKIFRQMDTNNDGKLSLEEFIRGAKSDPSIVRLLQCDPSSASQF

SEQ ID NO: 38350 - protein, 193 aa, Homo sapiens; identical to SEQ ID NO: 38349
  Payload ID: 7614
  Gene Symbol: HPCAL1
  Gene Name: hippocalcin-like 1
  Uniprot ID: P37235
  ENSP ID: ENSP00000371184

SEQ ID NO: 38351 - protein, 103 aa, Homo sapiens
  Payload ID: 7614
  Gene Symbol: HPCAL1
  Gene Name: hippocalcin-like 1
  ENSP ID: ENSP00000388856
  MOD_RES (1)..(1): Any amino acid
XLSVTSRGKLEQKLKWAFSMYDLDGNGYISRSEMLEIVQAIYKMVSSVMKMPEDESTPEKRTDKIFRQMDTNNDVSLGKPPMVTRCPNLPPGLALPTSSEGIF

SEQ ID NO: 38352 - protein, 30 aa, Homo sapiens
  Payload ID: 7614
  Gene Symbol: HPCAL1
  Gene Name: hippocalcin-like 1
  ENSP ID: ENSP00000413689
MGKQNSKLRPEVLQDLRENTEFTDHELQEW

SEQ ID NO: 38353 - protein, 175 aa, Homo sapiens
  Payload ID: 7614
  Gene Symbol: HPCAL1
  Gene Name: hippocalcin-like 1
  ENSP ID: ENSP00000416359
MGKQNSKLRPEVLQDLRENTEFTDHELQEWYKGFLKDCPTGHLTVDEFKKIYANFFPYGDASKFAEHVFRTFDTNGDGTIDFREFIIALSVTSRGKLEQKLKWAFSMYDLDGNGYISRSEMLEIVQAIYKMVSSVMKMPEDESTPEKRTDKIFRQMDTNNDGSAGWGRGCMCTPR

SEQ ID NO: 38354 - protein, 193 aa, Homo sapiens; identical to SEQ ID NO: 38349
  Payload ID: 7614
  Gene Symbol: HPCAL1
  Gene Name: hippocalcin-like 1
  Uniprot ID: P37235
  ENSP ID: ENSP00000478231

SEQ ID NO: 38355 - protein, 193 aa, Homo sapiens; identical to SEQ ID NO: 38349
  Payload ID: 7614
  Gene Symbol: HPCAL1
  Gene Name: hippocalcin-like 1
  Uniprot ID: P37235
  ENSP ID: ENSP00000482993

SEQ ID NO: 38356 - protein, 193 aa, Homo sapiens; identical to SEQ ID NO: 38349
  Payload ID: 7614
  Gene Symbol: HPCAL1
  Gene Name: hippocalcin-like 1
  Uniprot ID: P37235
  ENSP ID: ENSP00000483786

SEQ ID NO: 38357 - protein, 490 aa, Homo sapiens
  Payload ID: 7615
  Gene Symbol: HIAT1
  Gene Name: hippocampus abundant transcript 1
  Uniprot ID: Q96MC6
  ENSP ID: ENSP00000359171
MTQGKKKKRAANRSIMLAKKIIIKDGGTPQGIGSPSVYHAVIVIFLEFFAWGLLTAPTLVVLHETFPKHTFLMNGLIQGVKGLLSFLSAPLIGALSDVWGRKSFLLLTVFFTCAPIPLMKISPWWYFAVISVSGVFAVTFSVVFAYVADITQEHERSMAYGLVSATFAASLVTSPAIGAYLGRVYGDSLVVVLATAIALLDICFILVAVPESLPEKMRPASWGAPISWEQADPFASLKKVGQDSIVLLICITVFLSYLPEAGQYSSFFLYLRQIMKFSPESVAAFIAVLGILSIIAQTIVLSLLMRSIGNKNTILLGLGFQILQLAWYGFGSEPWMMWAAGAVAAMSSITFPAVSALVSRTADADQQGVVQGMITGIRGLCNGLGPALYGFIFYIFHVELKELPITGTDLGTNTSPQHHFEQNSIIPGPPFLFGACSVLLALLVALFIPEHTNLSLRSSSWRKHCGSHSHPHNTQAPGEAKEPLLQDTNV

SEQ ID NO: 38358 - protein, 120 aa, Homo sapiens
  Payload ID: 7615
  Gene Symbol: HIAT1
  Gene Name: hippocampus abundant transcript 1
  ENSP ID: ENSP00000411185
  MOD_RES (1)..(1): Any amino acid
XHETFPKHTFLMNGLIQGVKGLLSFLSAPLIGALSDVWGRKSFLLLTVFFTCAPIPLMKISPWWYFAVISVSGVFAVTFSVVFAYVADITQEHERSMAYGLVCMFILYLLYLLRNALFLR

SEQ ID NO: 38359 - protein, 506 aa, Homo sapiens
  Payload ID: 7616
  Gene Symbol: HIATL1
  Gene Name: hippocampus abundant transcript-like 1
  Uniprot ID: Q5SR56
  ENSP ID: ENSP00000364493
MSVEPPPELEEKAASEPEAGAMPEKRAGAQAAGSTWLQGFGRPSVYHAAIVIFLEFFAWGLLTTPMLTVLHETFSQHTFLMNGLIQGVKGLLSFLSAPLIGALSDVWGRKPFLLGTVFFTCFPIPLMRISPWWYFAMISVSGVFSVTFSVIFAYVADVTQEHERSTAYGWVSATFAASLVSSPAIGAYLSASYGDSLVVLVATVVALLDICFILVAVPESLPEKMRPVSWGAQISWKQADPFASLKKVGKDSTVLLICITVFLSYLPEAGQYSSFFLYLRQVIGFGSVKIAAFIAMVGILSIVAQTAFLSILMRSLGNKNTVLLGLGFQMLQLAWYGFGSQAWMMWAAGTVAAMSSITFPAISALVSRNAESDQQGVAQGIITGIRGLCNGLGPALYGFIFYMFHVELTELGPKLNSNNVPLQGAVIPGPPFLFGACIVLMSFLVALFIPEYSKASGVQKHSNSSSGSLTNTPERGSDEDIEPLLQDSSIWELSSFEEPGNQCTEL

SEQ ID NO: 38360 - protein, 157 aa, Homo sapiens
  Payload ID: 7616
  Gene Symbol: HIATL1
  Gene Name: hippocampus abundant transcript-like 1
  ENSP ID: ENSP00000405909
MVGILSIVAQTAFLSILMRSLGNKNTVLLGLGFQMLQLAWYGFGSQAWMMWAAGTVAAMSSITFPAISALVSRNAESDQQGFRSCPGDHNWNKRTMQWPGPALYGFIFYMFHVELTELGPKLNSNNVPLQGSCHPRPAVFIWGMYSPYVFSGCLIHS

SEQ ID NO: 38361 - protein, 134 aa, Homo sapiens
  Payload ID: 7617
  Gene Symbol: HIATL2
  Gene Name: hippocampus abundant transcript-like 2
  Uniprot ID: Q5VZR4
  ENSP ID: ENSP00000364371
MSVEPPPELEEKAASEPEAGAMPEKRAGAQAAGSTWLQGFGPPSVYHAAIVIFLEFFAWGLLTTPMLTVLHETFSQHTFLMNGLIQGVKGLLSFLSAPLIGALSDVWGRKPFLLGTVFFTCFPIPLMRISPCQA

SEQ ID NO: 38362 - protein, 150 aa, Homo sapiens
  Payload ID: 7617
  Gene Symbol: HIATL2
  Gene Name: hippocampus abundant transcript-like 2
  ENSP ID: ENSP00000473444
MSVEPPPELEEKAASEPEAGAMPEKRAGAQAAGSTWLQGFGPPSVYHAAIVIFLEFFAWGLLTTPMLTVLHETFSQHTFLMNGLIQGVKGLLSFLSAPLIGALSDVWGRKPFLLGTVFFTCFPIPLMRISPCRVWWRAPVVPATCGRRMA

SEQ ID NO: 38363 - protein, 556 aa, Homo sapiens
  Payload ID: 7618
  Gene Symbol: HIRIP3
  Gene Name: HIRA interacting protein 3
  Uniprot ID: Q9BW71
  ENSP ID: ENSP00000279392
MAREKEMQEFTRSFFRGRPDLSTLTHSIVRRRYLAHSGRSHLEPEEKQALKRLVEEELLKMQVDEAASREDKLDLTKKGKRPPTPCSDPERKRFRFNSESESGSEASSPDYFGPPAKNGVAAEVSPAKEENPRRASKAVEESSDEERQRDLPAQRGEESSEEEEKGYKGKTRKKPVVKKQAPGKASVSRKQAREESEESEAEPVQRTAKKVEGNKGTKSLKESEQESEEEILAQKKEQREEEVEEEEKEEDEEKGDWKPRTRSNGRRKSAREERSCKQKSQAKRLLGDSDSEEEQKEAASSGDDSGRDREPPVQRKSEDRTQLKGGKRLSGSSEDEEDSGKGEPTAKGSRKMARLGSTSGEESDLEREVSDSEAGGGPQGERKNRSSKKSSRKGRTRSSSSSSDGSPEAKGGKAGSGRRGEDHPAVMRLKRYIRACGAHRNYKKLLGSCCSHKERLSILRAELEALGMKGTPSLGKCRALKEQREEAAEVASLDVANIISGSGRPRRRTAWNPLGEAAPPGELYRRTLDSDEERPRPAPPDWSHMRGIISSDGESN

SEQ ID NO: 38364 - protein, 175 aa, Homo sapiens
  Payload ID: 7618
  Gene Symbol: HIRIP3
  Gene Name: HIRA interacting protein 3
  Uniprot ID: Q9BW71
  ENSP ID: ENSP00000456824
MAREKEMQEFTRSFFRGRPDLSTLTHSIVRRRYLAHSGRSHLEPEEKQALKRLVEEELLKMQVDEAASREDKLDLTKKGKRPPTPCSDPERKRFRFNSESGWLRSPWRGPPGCDEAEALHSGLWCPSKLQEAVGLLLLTQGAPEYPPGRTGSARHEGYPFPREVSGPEGAEGGGS

SEQ ID NO: 38365 - protein, 51 aa, Homo sapiens
  Payload ID: 7619
  Gene Symbol: HNMT
  Gene Name: histamine N-methyltransferase
  Uniprot ID: P50135
  ENSP ID: ENSP00000280096
MASSMRSLFSDHGKYVESFRRFLNHSTEHQCMQEFMDKKLPGIIGRYQNCC

SEQ ID NO: 38366 - protein, 292 aa, Homo sapiens
  Payload ID: 7619
  Gene Symbol: HNMT
  Gene Name: histamine N-methyltransferase
  Uniprot ID: P50135
  ENSP ID: ENSP00000280097
MASSMRSLFSDHGKYVESFRRFLNHSTEHQCMQEFMDKKLPGIIGRIGDTKSEIKILSIGGGAGEIDLQILSKVQAQYPGVCINNEVVEPSAEQIAKYKELVAKTSNLENVKFAWHKETSSEYQSRMLEKKELQKWDFIHMIQMLYYVKDIPATLKFFHSLLGTNAKMLIIVVSGSSGWDKLWKKYGSRFPQDDLCQYITSDDLTQMLDNLGLKYECYDLLSTMDISDCFIDGNENGDLLWDFLTETCNFNATAPPDLRAELGKDLQEPEFSAKKEGKVLFNNTLSFIVIEA

SEQ ID NO: 38367 - protein, 126 aa, Homo sapiens
  Payload ID: 7619
  Gene Symbol: HNMT
  Gene Name: histamine N-methyltransferase
  Uniprot ID: P50135
  ENSP ID: ENSP00000333259
MASSMRSLFSDHGKYVESFRRFLNHSTEHQCMQEFMDKKLPGIIGRIGDTKSEIKILSIGGGADCLIRGSSRVLKRNSCFILCSTRQKDKPGMRIHDERSSELPFGAARLESKSAFPSFLVSFILF

SEQ ID NO: 38368 - protein, 292 aa, Homo sapiens; identical to SEQ ID NO: 38366
  Payload ID: 7619
  Gene Symbol: HNMT
  Gene Name: histamine N-methyltransferase
  Uniprot ID: P50135
  ENSP ID: ENSP00000386940

SEQ ID NO: 38369 - protein, 51 aa, Homo sapiens; identical to SEQ ID NO: 38365
  Payload ID: 7619
  Gene Symbol: HNMT
  Gene Name: histamine N-methyltransferase
  Uniprot ID: P50135
  ENSP ID: ENSP00000419415

SEQ ID NO: 38370 - protein, 487 aa, Homo sapiens
  Payload ID: 7620
  Gene Symbol: HRH1
  Gene Name: histamine receptor H1
  Uniprot ID: P35367
  ENSP ID: ENSP00000380247
MSLPNSSCLLEDKMCEGNKTTMASPQLMPLVVVLSTICLVTVGLNLLVLYAVRSERKLHTVGNLYIVSLSVADLIVGAVVMPMNILYLLMSKWSLGRPLCLFWLSMDYVASTASIFSVFILCIDRYRSVQQPLRYLKYRTKTRASATILGAWFLSFLWVIPILGWNHFMQQTSVRREDKCETDFYDVTWFKVMTAIINFYLPTLLMLWFYAKIYKAVRQHCQHRELINRSLPSFSEIKLRPENPKGDAKKPGKESPWEVLKRKPKDAGGGSVLKSPSQTPKEMKSPVVFSQEDDREVDKLYCFPLDIVHMQAAAEGSSRDYVAVNRSHGQLKTDEQGLNTHGASEISEDQMLGDSQSFSRTDSDTTTETAPGKGKLRSGSNTGLDYIKFTWKRLRSHSRQYVSGLHMNRERKAAKQLGFIMAAFILCWIPYFIFFMVIAFCKNCCNEHLHMFTIWLGYINSTLNPLIYPLCNENFKKTFKRILHIRS

SEQ ID NO: 38371 - protein, 12 aa, Homo sapiens
  Payload ID: 7620
  Gene Symbol: HRH1
  Gene Name: histamine receptor H1
  ENSP ID: ENSP00000392383
MSLPNSSCLLED

SEQ ID NO: 38372 - protein, 487 aa, Homo sapiens; identical to SEQ ID NO: 38370
  Payload ID: 7620
  Gene Symbol: HRH1
  Gene Name: histamine receptor H1
  Uniprot ID: P35367
  ENSP ID: ENSP00000397028

SEQ ID NO: 38373 - protein, 487 aa, Homo sapiens; identical to SEQ ID NO: 38370
  Payload ID: 7620
  Gene Symbol: HRH1
  Gene Name: histamine receptor H1
  Uniprot ID: P35367
  ENSP ID: ENSP00000406705

SEQ ID NO: 38374 - protein, 359 aa, Homo sapiens
  Payload ID: 7621
  Gene Symbol: HRH2
  Gene Name: histamine receptor H2
  Uniprot ID: P25021
  ENSP ID: ENSP00000231683
MAPNGTASSFCLDSTACKITITVVLAVLILITVAGNVVVCLAVGLNRRLRNLTNCFIVSLAITDLLLGLLVLPFSAIYQLSCKWSFGKVFCNIYTSLDVMLCTASILNLFMISLDRYCAVMDPLRYPVLVTPVRVAISLVLIWVISITLSFLSIHLGWNSRNETSKGNHTTSKCKVQVNEVYGLVDGLVTFYLPLLIMCITYYRIFKVARDQAKRINHISSWKAATIREHKATVTLAAVMGAFIICWFPYFTAFVYRGLRGDDAINEVLEAIVLWLGYANSALNPILYAALNRDFRTGYQQLFCCRLANRNSHKTSLRSNASQLSRTQSREPRQQEEKPLKLQVWSGTEVTAPQGATDR

SEQ ID NO: 38375 - protein, 397 aa, Homo sapiens
  Payload ID: 7621
  Gene Symbol: HRH2
  Gene Name: histamine receptor H2
  Uniprot ID: P25021
  ENSP ID: ENSP00000366506
MAPNGTASSFCLDSTACKITITVVLAVLILITVAGNVVVCLAVGLNRRLRNLTNCFIVSLAITDLLLGLLVLPFSAIYQLSCKWSFGKVFCNIYTSLDVMLCTASILNLFMISLDRYCAVMDPLRYPVLVTPVRVAISLVLIWVISITLSFLSIHLGWNSRNETSKGNHTTSKCKVQVNEVYGLVDGLVTFYLPLLIMCITYYRIFKVARDQAKRINHISSWKAATIREHKATVTLAAVMGAFIICWFPYFTAFVYRGLRGDDAINEVLEAIVLWLGYANSALNPILYAALNRDFRTGYQQLFCCRLANRNSHKTSLRSNASQLSRTQSREPRQQEEKPLKLQVWSGTEVTAPQGATDRPWLCLPECWSVELTHSFIHLFIHSFANIHPIPTTCQEL

SEQ ID NO: 38376 - protein, 373 aa, Homo sapiens
  Payload ID: 7622
  Gene Symbol: HRH3
  Gene Name: histamine receptor H3
  ENSP ID: ENSP00000321482
MERAPPDGPLNASGALAGEAAAAGGARGFSAAWTAVLAALMALLIVATVLGNALVMLAFVADSSLRTQNNFFLLNLAISDFLVGAFCIPLYVPYVLTGRWTFGRGLCKLWLVVDYLLCTSSAFNIVLISYDRFLSVTRAVSYRAQQGDTRRAVRKMLLVWVLAFLLYGPAILSWEYLSGGSSIPEGHCYAEFFYNWYFLITASTLEFFTPFLSVTFFNLSIYLNIQRRTRLRLDGAREAAGPEPPPEAQPSPPPPPGCWGCWQKGHGEAMPLHRKVAKSLAVIVSIFGLCWAPYTLLMIIRAACHGHCVPDYWYETSFWLLWANSAVNPVLYPLCHHSFRRAFTKLLCPQKLKIQPHSSLEHCWKKMKKKTCL

SEQ ID NO: 38377 - protein, 445 aa, Homo sapiens
  Payload ID: 7622
  Gene Symbol: HRH3
  Gene Name: histamine receptor H3
  Uniprot ID: Q9Y5N1
  ENSP ID: ENSP00000342560
MERAPPDGPLNASGALAGEAAAAGGARGFSAAWTAVLAALMALLIVATVLGNALVMLAFVADSSLRTQNNFFLLNLAISDFLVGAFCIPLYVPYVLTGRWTFGRGLCKLWLVVDYLLCTSSAFNIVLISYDRFLSVTRAVSYRAQQGDTRRAVRKMLLVWVLAFLLYGPAILSWEYLSGGSSIPEGHCYAEFFYNWYFLITASTLEFFTPFLSVTFFNLSIYLNIQRRTRLRLDGAREAAGPEPPPEAQPSPPPPPGCWGCWQKGHGEAMPLHRYGVGEAAVGAEAGEATLGGGGGGGSVASPTSSSGSSSRGTERPRSLKRGSKPSASSASLEKRMKMVSQSFTQRFRLSRDRKVAKSLAVIVSIFGLCWAPYTLLMIIRAACHGHCVPDYWYETSFWLLWANSAVNPVLYPLCHHSFRRAFTKLLCPQKLKIQPHSSLEHCWK

SEQ ID NO: 38378 - protein, 200 aa, Homo sapiens
  Payload ID: 7622
  Gene Symbol: HRH3
  Gene Name: histamine receptor H3
  ENSP ID: ENSP00000482567
MERAPPDGPLNASGALAGEAAAAGGARGFSAAWTAVLAALMALLIVATVLGNALVMLAFVADSSLRTQNNFFLLNLAISDFLVGAFCIPLYVPYVLTGRWTFGRGLCKLWLVVDYLLCTSSAFNIVLISYDRFLSVTRAVSYRAQQGDTRRAVRKMLLVWVLAFLLYGPAPAAPRGALRGRAHSRGAPSRRRPRPRWRSA

SEQ ID NO: 38379 - protein, 390 aa, Homo sapiens
  Payload ID: 7623
  Gene Symbol: HRH4
  Gene Name: histamine receptor H4
  Uniprot ID: Q9H3N8
  ENSP ID: ENSP00000256906
MPDTNSTINLSLSTRVTLAFFMSLVAFAIMLGNALVILAFVVDKNLRHRSSYFFLNLAISDFFVGVISIPLYIPHTLFEWDFGKEICVFWLTTDYLLCTASVYNIVLISYDRYLSVSNAVSYRTQHTGVLKIVTLMVAVWVLAFLVNGPMILVSESWKDEGSECEPGFFSEWYILAITSFLEFVIPVILVAYFNMNIYWSLWKRDHLSRCQSHPGLTAVSSNICGHSFRGRLSSRRSLSASTEVPASFHSERQRRKSSLMFSSRTKMNSNTIASKMGSFSQSDSVALHQREHVELLRARRLAKSLAILLGVFAVCWAPYSLFTIVLSFYSSATGPKSVWYRIAFWLQWFNSFVNPLLYPLCHKRFQKAFLKIFCIKKQPLPSQHSRSVSS

SEQ ID NO: 38380 - protein, 302 aa, Homo sapiens
  Payload ID: 7623
  Gene Symbol: HRH4
  Gene Name: histamine receptor H4
  Uniprot ID: Q9H3N8
  ENSP ID: ENSP00000402526
MPDTNSTINLSLSTRVTLAFFMSLVAFAIMLGNALVILAFVVDKNLRHRSSYFFLNLAISDFFVVSESWKDEGSECEPGFFSEWYILAITSFLEFVIPVILVAYFNMNIYWSLWKRDHLSRCQSHPGLTAVSSNICGHSFRGRLSSRRSLSASTEVPASFHSERQRRKSSLMFSSRTKMNSNTIASKMGSFSQSDSVALHQREHVELLRARRLAKSLAILLGVFAVCWAPYSLFTIVLSFYSSATGPKSVWYRIAFWLQWFNSFVNPLLYPLCHKRFQKAFLKIFCIKKQPLPSQHSRSVSS

SEQ ID NO: 38381 - protein, 57 aa, Homo sapiens
  Payload ID: 7624
  Gene Symbol: HTN1
  Gene Name: histatin 1
  Uniprot ID: P15515
  ENSP ID: ENSP00000246896
MKFFVFALVLALMISMISADSHEKRHHGYRRKFHEKHHSHREFPFYGDYGSNYLYDN

SEQ ID NO: 38382 - protein, 57 aa, Homo sapiens; identical to SEQ ID NO: 38381
  Payload ID: 7624
  Gene Symbol: HTN1
  Gene Name: histatin 1
  Uniprot ID: P15515
  ENSP ID: ENSP00000424501

SEQ ID NO: 38383 - protein, 57 aa, Homo sapiens; identical to SEQ ID NO: 38381
  Payload ID: 7624
  Gene Symbol: HTN1
  Gene Name: histatin 1
  Uniprot ID: P15515
  ENSP ID: ENSP00000482787

SEQ ID NO: 38384 - protein, 57 aa, Homo sapiens; identical to SEQ ID NO: 38381
  Payload ID: 7624
  Gene Symbol: HTN1
  Gene Name: histatin 1
  ENSP ID: ENSP00000489198

SEQ ID NO: 38385 - protein, 57 aa, Homo sapiens; identical to SEQ ID NO: 38381
  Payload ID: 7624
  Gene Symbol: HTN1
  Gene Name: histatin 1
  ENSP ID: ENSP00000489349

SEQ ID NO: 38386 - protein, 57 aa, Homo sapiens; identical to SEQ ID NO: 38381
  Payload ID: 7624
  Gene Symbol: HTN1
  Gene Name: histatin 1
  ENSP ID: ENSP00000489510

SEQ ID NO: 38387 - protein, 41 aa, Homo sapiens
  Payload ID: 7625
  Gene Symbol: HTN3
  Gene Name: histatin 3
  ENSP ID: ENSP00000370445
MKFFVFALILALMLSMTGADSHAKEKHHSHRGYRSNYLYDN

SEQ ID NO: 38388 - protein, 51 aa, Homo sapiens
  Payload ID: 7625
  Gene Symbol: HTN3
  Gene Name: histatin 3
  Uniprot ID: P15516
  ENSP ID: ENSP00000432561
MKFFVFALILALMLSMTGADSHAKRHHGYKRKFHEKHHSHRGYRSNYLYDN

SEQ ID NO: 38389 - protein, 51 aa, Homo sapiens; identical to SEQ ID NO: 38388
  Payload ID: 7625
  Gene Symbol: HTN3
  Gene Name: histatin 3
  Uniprot ID: P15516
  ENSP ID: ENSP00000437158

SEQ ID NO: 38390 - protein, 51 aa, Homo sapiens; identical to SEQ ID NO: 38388
  Payload ID: 7625
  Gene Symbol: HTN3
  Gene Name: histatin 3
  ENSP ID: ENSP00000489290

SEQ ID NO: 38391 - protein, 51 aa, Homo sapiens; identical to SEQ ID NO: 38388
  Payload ID: 7625
  Gene Symbol: HTN3
  Gene Name: histatin 3
  ENSP ID: ENSP00000489520

SEQ ID NO: 38392 - protein, 41 aa, Homo sapiens; identical to SEQ ID NO: 38387
  Payload ID: 7625
  Gene Symbol: HTN3
  Gene Name: histatin 3
  ENSP ID: ENSP00000489537

SEQ ID NO: 38393 - protein, 657 aa, Homo sapiens
  Payload ID: 7626
  Gene Symbol: HAL
  Gene Name: histidine ammonia-lyase
  Uniprot ID: P42357
  ENSP ID: ENSP00000261208
MPRYTVHVRGEWLAVPCQDAQLTVGWLGREAVRRYIKNKPDNGGFTSVDDAHFLVRRCKGLGLLDNEDRLEVALENNEFVEVVIEGDAMSPDFIPSQPEGVYLYSKYREPEKYIELDGDRLTTEDLVNLGKGRYKIKLTPTAEKRVQKSREVIDSIIKEKTVVYGITTGFGKFARTVIPINKLQELQVNLVRSHSSGVGKPLSPERCRMLLALRINVLAKGYSGISLETLKQVIEMFNASCLPYVPEKGTVGASGDLAPLSHLALGLVGEGKMWSPKSGWADAKYVLEAHGLKPVILKPKEGLALINGTQMITSLGCEAVERASAIARQADIVAALTLEVLKGTTKAFDTDIHALRPHRGQIEVAFRFRSLLDSDHHPSEIAESHRFCDRVQDAYTLRCCPQVHGVVNDTIAFVKNIITTELNSATDNPMVFANRGETVSGGNFHGEYPAKALDYLAIGIHELAAISERRIERLCNPSLSELPAFLVAEGGLNSGFMIAHCTAAALVSENKALCHPSSVDSLSTSAATEDHVSMGGWAARKALRVIEHVEQVLAIELLAACQGIEFLRPLKTTTPLEKVYDLVRSVVRPWIKDRFMAPDIEAAHRLLLEQKVWEVAAPYIEKYRMEHIPESRPLSPTAFSLQFLHKKSTKIPESEDL

SEQ ID NO: 38394 - protein, 167 aa, Homo sapiens
  Payload ID: 7626
  Gene Symbol: HAL
  Gene Name: histidine ammonia-lyase
  ENSP ID: ENSP00000439385
MPRYTVHVRGEWLAVPCQDAQLTVGWLGREAVRRYIKNKPDNGGFTSVDDAHFLVRRCKGLGLLDNEDRLEVALENNEFVEVVIEGDAMSPDFIPSQPEGVYLYSKYREPEKYIELDGDRLTTEDLVNLGKGRYKIKLTPTAEKRVQKSREVIDSIIKEKTGSFRST

SEQ ID NO: 38395 - protein, 591 aa, Homo sapiens
  Payload ID: 7626
  Gene Symbol: HAL
  Gene Name: histidine ammonia-lyase
  Uniprot ID: P42357
  ENSP ID: ENSP00000440861
MPRYTVHVRGEWLAVPCQDAQLTVGWLGREAVRRYIKNKPDNGGFTSVDDAHFLVRRCKGLGLLDNEDRLEVALENNEFVEVVIEGDAMSPDFIPSQPEGVYLYSKYREPEKYIELDGDRLTTEDLVNLGKGRYKIKLTPTAEKRVQKSREVIDSIIKEKTVVYGITTGFGKFARTVIPINKLQELQVNLVRSHSSGVGKPLSPERCRMLLALRINVLAKGYSGISLETLKQVIEMFNASCLPYVPEKGTVGASGDLAPLSHLALGLVGEGKMWSPKSGWADAKYVLEAHGLKPVILKPKEGLALINGTQMITSLGCEAVERASAIARQADIVAALTLEVLKGTTKAFDTDIHALRPHRGQIEVAFRFRSLLDSDHHPSEIAESHRFCDRVQDAYTLRCCPQVHGVVNDTIAFVKNIITTELNSATDNPMVFANRGETVSGGNFHGEYPAKALDYLAIGIHELAAISERRIERLCNPSLSELPAFLVAEGGLNSGFMIAHCTAAALVSENKALCHPSSVDSLSTSAATEDHVSMGGWAARKALRVIEHVEQVLAIELLAACQGIEFLRPLKTTTPLEKVYDLVRSVVRFGK

SEQ ID NO: 38396 - protein, 449 aa, Homo sapiens
  Payload ID: 7626
  Gene Symbol: HAL
  Gene Name: histidine ammonia-lyase
  Uniprot ID: P42357
  ENSP ID: ENSP00000446364
MLLALRINVLAKGYSGISLETLKQVIEMFNASCLPYVPEKGTVGASGDLAPLSHLALGLVGEGKMWSPKSGWADAKYVLEAHGLKPVILKPKEGLALINGTQMITSLGCEAVERASAIARQADIVAALTLEVLKGTTKAFDTDIHALRPHRGQIEVAFRFRSLLDSDHHPSEIAESHRFCDRVQDAYTLRCCPQVHGVVNDTIAFVKNIITTELNSATDNPMVFANRGETVSGGNFHGEYPAKALDYLAIGIHELAAISERRIERLCNPSLSELPAFLVAEGGLNSGFMIAHCTAAALVSENKALCHPSSVDSLSTSAATEDHVSMGGWAARKALRVIEHVEQVLAIELLAACQGIEFLRPLKTTTPLEKVYDLVRSVVRPWIKDRFMAPDIEAAHRLLLEQKVWEVAAPYIEKYRMEHIPESRPLSPTAFSLQFLHKKSTKIPESEDL

SEQ ID NO: 38397 - protein, 154 aa, Homo sapiens
  Payload ID: 7626
  Gene Symbol: HAL
  Gene Name: histidine ammonia-lyase
  ENSP ID: ENSP00000446678
  MOD_RES (1)..(1): Any amino acid
XRIERLCNPSLSELPAFLVAEGGLNSGFMIAHCTAAALVSENKALCHPSSVDSLSTSAATEDHVSMGGWAARKALRVIEHVEQVLAIELLAACQGIEFLRPLKTTTPLEKVYDLVRSVVRPWIKDRFMAPDIEAAHRLLLEQKASWLLGLFLNF

SEQ ID NO: 38398 - protein, 157 aa, Homo sapiens
  Payload ID: 7626
  Gene Symbol: HAL
  Gene Name: histidine ammonia-lyase
  ENSP ID: ENSP00000447543
MSPDFIPSQPEGVYLKYREPEKYIELDGDRLTTEDLVNLGKGRYKIKLTPTAEKRVQKSREVIDSIIKEKTVVYGITTGFGKFARTVIPINKLQELQVNLVRSHSSGVGKPLSPERCRMLLALRINVLAKGYSGISLETLKQVIEMFNASCLPYVPE

SEQ ID NO: 38399 - protein, 167 aa, Homo sapiens; identical to SEQ ID NO: 38394
  Payload ID: 7626
  Gene Symbol: HAL
  Gene Name: histidine ammonia-lyase
  ENSP ID: ENSP00000447675

SEQ ID NO: 38400 - protein, 336 aa, Homo sapiens
  Payload ID: 7626
  Gene Symbol: HAL
  Gene Name: histidine ammonia-lyase
  ENSP ID: ENSP00000450372
MPRYTVHVRGEWLAVPCQDAQLTVGWLGREAVRRYIKNKPDNGGFTSVDDAHFLVRRCKGLGLLDNEDRLEVALENNEFVEVVIEGDAMSPDFIPSQPEGVYLYSKYREPEKYIELDGDRLTTEDLVNLGKGRYKIKLTPTAEKRVQKSREVIDSIIKEKTDQRMRLGLPCMELQVNLVRSHSSGVGKPLSPERCRMLLALRINVLAKGYSGISLETLKQVIEMFNASCLPYVPEKGTVGASGDLAPLSHLALGLVGEGKMWSPKSGWADAKYVLEAHGLKPVILKPKEGLALINGTQMITSLGCEAVERASAIARQADIVAALTLEVLKGTTKAF

SEQ ID NO: 38401 - protein, 662 aa, Homo sapiens
  Payload ID: 7627
  Gene Symbol: HDC
  Gene Name: histidine decarboxylase
  Uniprot ID: P19113
  ENSP ID: ENSP00000267845
MMEPEEYRERGREMVDYICQYLSTVRERRVTPDVQPGYLRAQLPESAPEDPDSWDSIFGDIERIIMPGVVHWQSPHMHAYYPALTSWPSLLGDMLADAINCLGFTWASSPACTELEMNVMDWLAKMLGLPEHFLHHHPSSQGGGVLQSTVSESTLIALLAARKNKILEMKTSEPDADESCLNARLVAYASDQAHSSVEKAGLISLVKMKFLPVDDNFSLRGEALQKAIEEDKQRGLVPVFVCATLGTTGVCAFDCLSELGPICAREGLWLHIDAAYAGTAFLCPEFRGFLKGIEYADSFTFNPSKWMMVHFDCTGFWVKDKYKLQQTFSVNPIYLRHANSGVATDFMHWQIPLSRRFRSVKLWFVIRSFGVKNLQAHVRHGTEMAKYFESLVRNDPSFEIPAKRHLGLVVFRLKGPNCLTENVLKEIAKAGRLFLIPATIQDKLIIRFTVTSQFTTRDDILRDWNLIRDAATLILSQHCTSQPSPRVGNLISQIRGARAWACGTSLQSVSGAGDDPVQARKIIKQPQRVGAGPMKRENGLHLETLLDPVDDCFSEEAPDATKHKLSSFLFSYLSVQTKKKTVRSLSCNSVPVSAQKPLPTEASVKNGGSSRVRIFSRFPEDMMMLKKSAFKKLIKFYSVPSFPECSSQCGLQLPCCPLQAMV

SEQ ID NO: 38402 - protein, 629 aa, Homo sapiens
  Payload ID: 7627
  Gene Symbol: HDC
  Gene Name: histidine decarboxylase
  Uniprot ID: P19113
  ENSP ID: ENSP00000440252
MMEPEEYRERGREMVDYICQYLSTVRERRVTPDVQPGYLRAQLPESAPEDPDSWDSIFGDIERIIMPGVVHWQSPHMHAYYPALTSWPSLLGDMLADAINCLGFTWASSPACTELEMNVMDWLAKMLGLPEHFLHHHPSSQGGGVLQSTVSESTLIALLAARKNKILEMKTSEPDADESCLNARLVAYASDQAHSSVEKAGLISLVKMKFLPVDDNFSLRGEALQKAIEEDKQRGLVPVFVCATLGTTGVCAFDCLSELGPICAREGLWLHIDAAYAGTAFLCPEFRGFLKGIEYADSFTFNPSKWMMVHFDCTGFWVKDKYKLQQTFSVNPIYLRHANSGVATDFMGTEMAKYFESLVRNDPSFEIPAKRHLGLVVFRLKGPNCLTENVLKEIAKAGRLFLIPATIQDKLIIRFTVTSQFTTRDDILRDWNLIRDAATLILSQHCTSQPSPRVGNLISQIRGARAWACGTSLQSVSGAGDDPVQARKIIKQPQRVGAGPMKRENGLHLETLLDPVDDCFSEEAPDATKHKLSSFLFSYLSVQTKKKTVRSLSCNSVPVSAQKPLPTEASVKNGGSSRVRIFSRFPEDMMMLKKSAFKKLIKFYSVPSFPECSSQCGLQLPCCPLQAMV

SEQ ID NO: 38403 - protein, 178 aa, Homo sapiens
  Payload ID: 7627
  Gene Symbol: HDC
  Gene Name: histidine decarboxylase
  ENSP ID: ENSP00000453183
MSLLGREMVDYICQYLSTVRERRVTPDVQPGYLRAQLPESAPEDPDSWDSIFGDIERIIMPGVVHWQSPHMHAYYPALTSWPSLLGDMLADAINCLGFTWASSPACTELEMNVMDWLAKMLGLPEHFLHHHPSSQGGGVLQSTVSESTLIALLAARKNKILEMKTSEPDADESCLNAR

SEQ ID NO: 38404 - protein, 699 aa, Homo sapiens
  Payload ID: 7628
  Gene Symbol: HRC
  Gene Name: histidine rich calcium binding protein
  Uniprot ID: P23327
  ENSP ID: ENSP00000252825
MGHHRPWLHASVLWAGVASLLLPPAMTQQLRGDGLGFRNRNNSTGVAGLSEEASAELRHHLHSPRDHPDENKDVSTENGHHFWSHPDREKEDEDVSKEYGHLLPGHRSQDHKVGDEGVSGEEVFAEHGGQARGHRGHGSEDTEDSAEHRHHLPSHRSHSHQDEDEDEVVSSEHHHHILRHGHRGHDGEDDEGEEEEEEEEEEEEASTEYGHQAHRHRGHGSEEDEDVSDGHHHHGPSHRHQGHEEDDDDDDDDDDDDDDDDVSIEYRHQAHRHQGHGIEEDEDVSDGHHHRDPSHRHRSHEEDDNDDDDVSTEYGHQAHRHQDHRKEEVEAVSGEHHHHVPDHRHQGHRDEEEDEDVSTERWHQGPQHVHHGLVDEEEEEEEITVQFGHYVASHQPRGHKSDEEDFQDEYKTEVPHHHHHRVPREEDEEVSAELGHQAPSHRQSHQDEETGHGQRGSIKEMSHHPPGHTVVKDRSHLRKDDSEEEKEKEEDPGSHEEDDESSEQGEKGTHHGSRDQEDEEDEEEGHGLSLNQEEEEEEDKEEEEEEEDEERREERAEVGAPLSPDHSEEEEEEEEGLEEDEPRFTIIPNPLDRREEAGGASSEEESGEDTGPQDAQEYGNYQPGSLCGYCSFCNRCTECESCHCDEENMGEHCDQCQHCQFCYLCPLVCETVCAPGSYVDYFSSSLYQALADMLETPEP

SEQ ID NO: 38405 - protein, 96 aa, Homo sapiens
  Payload ID: 7628
  Gene Symbol: HRC
  Gene Name: histidine rich calcium binding protein
  ENSP ID: ENSP00000469659
  MOD_RES (1)..(1): Any amino acid
XSEEESGEDTGPQDAQEYGNYQPGSLCGYCSFCNRCTECESCHCDEENMGEHCDQCQGPGRHAGNAGTLTQSLDCDAGVPPPAFQPLSTSYIYFSE

SEQ ID NO: 38406 - protein, 676 aa, Homo sapiens
  Payload ID: 7628
  Gene Symbol: HRC
  Gene Name: histidine rich calcium binding protein
  ENSP ID: ENSP00000470288
MGHHRPWLHASVLWAGVASLLLPPAMTQQLRGDGLGFRNRNNSTGVAGLSEEASAELRHHLHSPRDHPDENKDVSTENGHHFWSHPDREKEDEDVSKEYGHLLPGHRSQDHKVGDEGVSGEEVFAEHGGQARGHRGHGSEDTEDSAEHRHHLPSHRSHSHQDEDEDEVVSSEHHHHILRHGHRGHDGEDDEGEEEEEEEEEEEEASTEYGHQAHRHRGHGSEEDEDVSDGHHHHGPSHRHQGHEEDDDDDDDDDDDDDDDDVSIEYRHQAHRHQGHGIEEDEDVSDGHHHRDPSHRHRSHEEDDNDDDDVSTEYGHQAHRHQDHRKEEVEAVSGEHHHHVPDHRHQGHRDEEEDEDVSTERWHQGPQHVHHGLVDEEEEEEEITVQFGHYVASHQPRGHKSDEEDFQDEYKTEVPHHHHHRVPREEDEEVSAELGHQAPSHRQSHQDEETGHGQRGSIKEMSHHPPGHTVVKDRSHLRKDDSEEEKEKEEDPGSHEEDDESSEQGEKGTHHGSRDQEDEEDEEEGHGLSLNQEEEEEEDKEEEEEEEDEERREERAEVGAPLSPDHSEEEEEEEEGLEEDEPRFTIIPNPLDRREEAGGASSEEESGEDTGPQDAQEYGNYQPGSLCGYCSFCNHCQFCYLCPLVCETVCAPGSYVDYFSSSLYQALADMLETPEP

SEQ ID NO: 38407 - protein, 115 aa, Homo sapiens
  Payload ID: 7629
  Gene Symbol: HRCT1
  Gene Name: histidine rich carboxyl terminus 1
  Uniprot ID: Q6UXD1
  ENSP ID: ENSP00000346283
MLGLLGSTALVGWITGAAVAVLLLLLLLATCLFHGRQDCDVERNRTAAGGNRVRRAQPWPFRRRGHLGIFHHHRHPGHVSHVPNVGLHHHHHPRHTPHHLHHHHHPHRHHPRHAR

SEQ ID NO: 38408 - protein, 126 aa, Homo sapiens
  Payload ID: 7630
  Gene Symbol: HINT1
  Gene Name: histidine triad nucleotide binding protein 1
  Uniprot ID: P49773
  ENSP ID: ENSP00000304229
MADEIAKAQVARPGGDTIFGKIIRKEIPAKIIFEDDRCLAFHDISPQAPTHFLVIPKKHISQISVAEDDDESLLGHLMIVGKKCAADLGLNKGYRMVVNEGSDGGQSVYHVHLHVLGGRQMHWPPG

SEQ ID NO: 38409 - protein, 65 aa, Homo sapiens
  Payload ID: 7630
  Gene Symbol: HINT1
  Gene Name: histidine triad nucleotide binding protein 1
  ENSP ID: ENSP00000421608
MADEIAKAQVARPGGDTIFGKIIRKEIPAKIIFEDDRVGTGHHLSRLLSALLSMTFPLKHQHIFW

SEQ ID NO: 38410 - protein, 65 aa, Homo sapiens; identical to SEQ ID NO: 38409
  Payload ID: 7630
  Gene Symbol: HINT1
  Gene Name: histidine triad nucleotide binding protein 1
  ENSP ID: ENSP00000422444

SEQ ID NO: 38411 - protein, 78 aa, Homo sapiens
  Payload ID: 7630
  Gene Symbol: HINT1
  Gene Name: histidine triad nucleotide binding protein 1
  ENSP ID: ENSP00000424974
MADEIAKAQVARPGGDTIFGKIIRKEIPAKIIFEDDRCLAFHDISPQAPTHFLVIPKKHISQISVAEDDDESSVEYLM

SEQ ID NO: 38412 - protein, 65 aa, Homo sapiens; identical to SEQ ID NO: 38409
  Payload ID: 7630
  Gene Symbol: HINT1
  Gene Name: histidine triad nucleotide binding protein 1
  ENSP ID: ENSP00000425260

SEQ ID NO: 38413 - protein, 78 aa, Homo sapiens
  Payload ID: 7630
  Gene Symbol: HINT1
  Gene Name: histidine triad nucleotide binding protein 1
  ENSP ID: ENSP00000426860
MADEIAKAQVARPGGDTIFGKIIRKEIPAKIIFEDDRCLAFHDISPQAPTHFLVIPKKHISQISVAEDDDESVSTFLT

SEQ ID NO: 38414 - protein, 103 aa, Homo sapiens
  Payload ID: 7630
  Gene Symbol: HINT1
  Gene Name: histidine triad nucleotide binding protein 1
  ENSP ID: ENSP00000427008
MADEIAKAQVARPGGDTIFGKIIRKEIPAKIIFEDDRCLAFHDISPQAPTHFLVIPKKHISQISVAEDDDESVITKEKPEKPLGLQLPSCFPKLLHHFVSHQQ

SEQ ID NO: 38415 - protein, 103 aa, Homo sapiens; identical to SEQ ID NO: 38414
  Payload ID: 7630
  Gene Symbol: HINT1
  Gene Name: histidine triad nucleotide binding protein 1
  ENSP ID: ENSP00000427499

SEQ ID NO: 38416 - protein, 27 aa, Homo sapiens
  Payload ID: 7630
  Gene Symbol: HINT1
  Gene Name: histidine triad nucleotide binding protein 1
  ENSP ID: ENSP00000430909
  MOD_RES (1)..(1): Any amino acid
XIPKKHISQISVAEDDDESCCHIFIFL

SEQ ID NO: 38417 - protein, 163 aa, Homo sapiens
  Payload ID: 7631
  Gene Symbol: HINT2
  Gene Name: histidine triad nucleotide binding protein 2
  Uniprot ID: Q9BX68
  ENSP ID: ENSP00000259667
MAAAVVLAAGLRAARRAVAATGVRGGQVRGAAGVTDGNEVAKAQQATPGGAAPTIFSRILDKSLPADILYEDQQCLVFRDVAPQAPVHFLVIPKKPIPRISQAEEEDQQLLGHLLLVAKQTAKAEGLGDGYRLVINDGKLGAQSVYHLHIHVLGGRQLQWPPG

SEQ ID NO: 38418 - protein, 182 aa, Homo sapiens
  Payload ID: 7632
  Gene Symbol: HINT3
  Gene Name: histidine triad nucleotide binding protein 3
  Uniprot ID: Q9NQE9
  ENSP ID: ENSP00000229633
MAEEQVNRSAGLAPDCEASATAETTVSSVGTCEAAGKSPEPKDYDSTCVFCRIAGRQDPGTELLHCENEDLICFKDIKPAATHHYLVVPKKHIGNCRTLRKDQVELVENMVTVGKTILERNNFTDFTNVRMGFHMPPFCSISHLHLHVLAPVDQLGFLSKLVYRVNSYWFITADHLIEKLRT

SEQ ID NO: 38419 - protein, 525 aa, Homo sapiens
  Payload ID: 7633
  Gene Symbol: HRG
  Gene Name: histidine-rich glycoprotein
  Uniprot ID: P04196
  ENSP ID: ENSP00000232003
MKALIAALLLITLQYSCAVSPTDCSAVEPEAEKALDLINKRRRDGYLFQLLRIADAHLDRVENTTVYYLVLDVQESDCSVLSRKYWNDCEPPDSRRPSEIVIGQCKVIATRHSHESQDLRVIDFNCTTSSVSSALANTKDSPVLIDFFEDTERYRKQANKALEKYKEENDDFASFRVDRIERVARVRGGEGTGYFVDFSVRNCPRHHFPRHPNVFGFCRADLFYDVEALDLESPKNLVINCEVFDPQEHENINGVPPHLGHPFHWGGHERSSTTKPPFKPHGSRDHHHPHKPHEHGPPPPPDERDHSHGPPLPQGPPPLLPMSCSSCQHATFGTNGAQRHSHNNNSSDLHPHKHHSHEQHPHGHHPHAHHPHEHDTHRQHPHGHHPHGHHPHGHHPHGHHPHGHHPHCHDFQDYGPCDPPPHNQGHCCHGHGPPPGHLRRRGPGKGPRPFHCRQIGSVYRLPPLRKGEVLPLPEANFPSFPLPHHKHPLKPDNQPFPQSVSESCPGKFKSGFPQVSMFFTHTFPK

SEQ ID NO: 38420 - protein, 449 aa, Homo sapiens
  Payload ID: 7634
  Gene Symbol: HARS
  Gene Name: histidyl-tRNA synthetase
  Uniprot ID: P12081
  ENSP ID: ENSP00000304668
MAERAALEELVKLQGERVRGLKQQKASAELIEEEVAKLLKLKAQLGPDESKQKFVLKTPKETLMGKYGEDSKLIYDLKDQGGELLSLRYDLTVPFARYLAMNKLTNIKRYHIAKDFDIAGNFDPMIPDAECLKIMCEILSSLQIGDFLVKVNDRRILDGMFAICGVSDSKFRTICSSVDKLDKVSWEEVKNEMVGEKGLAPEVADRIGDYVQQHGGVSLVEQLLQDPKLSQNKQALEGLGDLKLLFEYLTLFGIDDKISFDLSLARGLDYYTGVIYEAVLLQTPAQAGEEPLGVGSVAAGGRYDGLVGMFDPKGRKVPCVGLSIGVERIFSIVEQRLEALEEKIRTTETQVLVASAQKKLLEERLKLVSELWDAGIKAELLYKKNPKLLNQLQYCEEAGIPLVAIIGEQELKDGVIKLRSVTSREEVDVRREDLVEEIKRRTGQPLCIC

SEQ ID NO: 38421 - protein, 489 aa, Homo sapiens
  Payload ID: 7634
  Gene Symbol: HARS
  Gene Name: histidyl-tRNA synthetase
  Uniprot ID: P12081
  ENSP ID: ENSP00000387893
MAERAALEELVKLQGERVRGLKQQKASAELIEEEVAKLLKLKAQLGPDESKQKFVLKTPKGTRDYSPRQMAVREKVFDVIIRCFKRHGAEVIDTPVFELKETLMGKYGEDSKLIYDLKDQGGELLSLRYDLTVPFARYLAMNKLTNIKRYHIAKDFDIAGNFDPMIPDAECLKIMCEILSSLQIGDFLVKVNDRRILDGMFAICGVSDSKFRTICSSVDKLDKVSWEEVKNEMVGEKGLAPEVADRIGDYVQQHGGVSLVEQLLQDPKLSQNKQALEGLGDLKLLFEYLTLFGIDDKISFDLSLARGLDYYTGVIYEAVLLQTPAQAGEEPLGVGSVAAGGRYDGLVGMFDPKGRKVPCVGLSIGVERIFSIVEQRLEALEEKIRTTETQVLVASAQKKLLEERLKLVSELWDAGIKAELLYKKNPKLLNQLQYCEEAGIPLVAIIGEQELKDGVIKLRSVTSREEVDVRREDLVEEIKRRTGQPLCIC

SEQ ID NO: 38422 - protein, 395 aa, Homo sapiens
  Payload ID: 7634
  Gene Symbol: HARS
  Gene Name: histidyl-tRNA synthetase
  ENSP ID: ENSP00000393244
MAERAALEELVKLQGERVRGLKQQKASAELIEEEVAKLLKLKAQLGPDESKQKFVLKTPKDFDIAGNFDPMIPDAECLKIMCEILSSLQIGDFLVKVNDRRILDGMFAICGVSDSKFRTICSSVDKLDKVSWEEVKNEMVGEKGLAPEVADRIGDYVQQHGGVSLVEQLLQDPKLSQNKQALEGLGDLKLLFEYLTLFGIDDKISFDLSLARGLDYYTGVIYEAVLLQTPAQAGEEPLGVGSVAAGGRYDGLVGMFDPKGRKVPCVGLSIGVERIFSIVEQRLEALEEKIRTTETQVLVASAQKKLLEERLKLVSELWDAGIKAELLYKKNPKLLNQLQYCEEAGIPLVAIIGEQELKDGVIKLRSVTSREEVDVRREDLVEEIKRRTGQPLCIC

SEQ ID NO: 38423 - protein, 435 aa, Homo sapiens
  Payload ID: 7634
  Gene Symbol: HARS
  Gene Name: histidyl-tRNA synthetase
  ENSP ID: ENSP00000411085
MAERAALEELVKLQGERVRGLKQQKASAELIEEEVAKLLKLKAQLGPDESKQKFVLKTPKGTRDYSPRQMAVREKVFDVIIRCFKRHGAEVIDTPVFELKDFDIAGNFDPMIPDAECLKIMCEILSSLQIGDFLVKVNDRRILDGMFAICGVSDSKFRTICSSVDKLDKVSWEEVKNEMVGEKGLAPEVADRIGDYVQQHGGVSLVEQLLQDPKLSQNKQALEGLGDLKLLFEYLTLFGIDDKISFDLSLARGLDYYTGVIYEAVLLQTPAQAGEEPLGVGSVAAGGRYDGLVGMFDPKGRKVPCVGLSIGVERIFSIVEQRLEALEEKIRTTETQVLVASAQKKLLEERLKLVSELWDAGIKAELLYKKNPKLLNQLQYCEEAGIPLVAIIGEQELKDGVIKLRSVTSREEVDVRREDLVEEIKRRTGQPLCIC

SEQ ID NO: 38424 - protein, 469 aa, Homo sapiens
  Payload ID: 7634
  Gene Symbol: HARS
  Gene Name: histidyl-tRNA synthetase
  Uniprot ID: P12081
  ENSP ID: ENSP00000411511
MAERAALEELVKLQGERVRGLKQQKASAELIEEEVAKLLKLKAQLGPDESKQKFVLKTPKETLMGKYGEDSKLIYDLKDQGGELLSLRYDLTVPFARYLAMNKLTNIKRYHIAKVYRRDNPAMTRGRYREFYQCDFDIAGNFDPMIPDAECLKIMCEILSSLQIGDFLVKVNDRRILDGMFAICGVSDSKFRTICSSVDKLDKVSWEEVKNEMVGEKGLAPEVADRIGDYVQQHGGVSLVEQLLQDPKLSQNKQALEGLGDLKLLFEYLTLFGIDDKISFDLSLARGLDYYTGVIYEAVLLQTPAQAGEEPLGVGSVAAGGRYDGLVGMFDPKGRKVPCVGLSIGVERIFSIVEQRLEALEEKIRTTETQVLVASAQKKLLEERLKLVSELWDAGIKAELLYKKNPKLLNQLQYCEEAGIPLVAIIGEQELKDGVIKLRSVTSREEVDVRREDLVEEIKRRTGQPLCIC

SEQ ID NO: 38425 - protein, 60 aa, Homo sapiens
  Payload ID: 7634
  Gene Symbol: HARS
  Gene Name: histidyl-tRNA synthetase
  ENSP ID: ENSP00000421576
MAERAALEELVKLQGERVRGLKQQKASAELIEEEVAKLLKLKAQLGPDESKQKFVLKTPK

SEQ ID NO: 38426 - protein, 509 aa, Homo sapiens
  Payload ID: 7634
  Gene Symbol: HARS
  Gene Name: histidyl-tRNA synthetase
  Uniprot ID: P12081
  ENSP ID: ENSP00000425634
MAERAALEELVKLQGERVRGLKQQKASAELIEEEVAKLLKLKAQLGPDESKQKFVLKTPKGTRDYSPRQMAVREKVFDVIIRCFKRHGAEVIDTPVFELKETLMGKYGEDSKLIYDLKDQGGELLSLRYDLTVPFARYLAMNKLTNIKRYHIAKVYRRDNPAMTRGRYREFYQCDFDIAGNFDPMIPDAECLKIMCEILSSLQIGDFLVKVNDRRILDGMFAICGVSDSKFRTICSSVDKLDKVSWEEVKNEMVGEKGLAPEVADRIGDYVQQHGGVSLVEQLLQDPKLSQNKQALEGLGDLKLLFEYLTLFGIDDKISFDLSLARGLDYYTGVIYEAVLLQTPAQAGEEPLGVGSVAAGGRYDGLVGMFDPKGRKVPCVGLSIGVERIFSIVEQRLEALEEKIRTTETQVLVASAQKKLLEERLKLVSELWDAGIKAELLYKKNPKLLNQLQYCEEAGIPLVAIIGEQELKDGVIKLRSVTSREEVDVRREDLVEEIKRRTGQPLCIC

SEQ ID NO: 38427 - protein, 288 aa, Homo sapiens
  Payload ID: 7634
  Gene Symbol: HARS
  Gene Name: histidyl-tRNA synthetase
  ENSP ID: ENSP00000425889
MAERAALEELVKLQGERVRGLKQQKASAELIEEEVAKLLKLKAQLGPDESKQKFVLKTPKGTRDYSPRQMAVREKVFDVIIRCFKRHGAEVIDTPVFELKVNDRRILDGMFAICGVSDSKFRTICSSVDKLDKVSWEEVKNEMVGEKGLAPEVADRIGDYVQQHGGVSLVEQLLQDPKLSQNKQALEGLGDLKLLFEYLTLFGIDDKISFDLSLARGLDYYTGVIYEAVLLQTPAQAGEEPLGVGSVAAGGRYDGLVGMFDPKGRKVPCVGLSIGVERIFSIVEQRLE

SEQ ID NO: 38428 - protein, 440 aa, Homo sapiens
  Payload ID: 7634
  Gene Symbol: HARS
  Gene Name: histidyl-tRNA synthetase
  ENSP ID: ENSP00000430063
MAVREKVFDVIIRCFKRHGAEVIDTPVFELKETLMGKYGEDSKLIYDLKDQGGELLSLRYDLTVPFARYLAMNKLTNIKRYHIAKVYRRDNPAMTRGRYREFYQCDFDIAGNFDPMIPDAECLKIMCEILSSLQIGDFLVKVNDRRILDGMFAICGVSDSKFRTICSSVDKLDKVSWEEVKNEMVGEKGLAPEVADRIGDYVQQHGGVSLVEQLLQDPKLSQNKQALEGLGDLKLLFEYLTLFGIDDKISFDLSLARGLDYYTGVIYEAVLLQTPAQAGEEPLGVGSVAAGGRYDGLVGMFDPKGRKVPCVGLSIGVERIFSIVEQRLEALEEKIRTTETQVLVASAQKKLLEERLKLVSELWDAGIKAELLYKKNPKLLNQLQYCEEAGIPLVAIIGEQELKDGVIKLRSVTSREEVDVRREDLVEEIKRRTGQPLCIC

SEQ ID NO: 38429 - protein, 506 aa, Homo sapiens
  Payload ID: 7635
  Gene Symbol: HARS2
  Gene Name: histidyl-tRNA synthetase 2, mitochondrial
  Uniprot ID: P49590
  ENSP ID: ENSP00000230771
MPLLGLLPRRAWASLLSQLLRPPCASCTGAVRCQSQVAEAVLTSQLKAHQEKPNFIIKTPKGTRDLSPQHMVVREKILDLVISCFKRHGAKGMDTPAFELKETLTEKYGEDSGLMYDLKDQGGELLSLRYDLTVPFARYLAMNKVKKMKRYHVGKVWRRESPTIVQGRYREFCQCDFDIAGQFDPMIPDAECLKIMCEILSGLQLGDFLIKVNDRRIVDGMFAVCGVPESKFRAICSSIDKLDKMAWKDVRHEMVVKKGLAPEVADRIGDYVQCHGGVSLVEQMFQDPRLSQNKQALEGLGDLKLLFEYLTLFGIADKISFDLSLARGLDYYTGVIYEAVLLQTPTQAGEEPLNVGSVAAGGRYDGLVGMFDPKGHKVPCVGLSIGVERIFYIVEQRMKTKGEKVRTTETQVFVATPQKNFLQERLKLIAELWDSGIKAEMLYKNNPKLLTQLHYCESTGIPLVVIIGEQELKEGVIKIRSVASREEVAIKRENFVAEIQKRLSES

SEQ ID NO: 38430 - protein, 334 aa, Homo sapiens
  Payload ID: 7635
  Gene Symbol: HARS2
  Gene Name: histidyl-tRNA synthetase 2, mitochondrial
  ENSP ID: ENSP00000407105
MPLLGLLPRRAWASLLSQLLRPPCASCTGAVRCQSQDFDIAGQFDPMIPDAECLKIMCEILSGLQLGDFLIKMAWKDVRHEMVVKKGLAPEVADRIGDYVQCHGGVSLVEQMFQDPRLSQNKQALEGLGDLKLLFEYLTLFGIADKISFDLSLARGLDYYTGVIYEAVLLQTPTQAGEEPLNVGSVAAGGRYDGLVGMFDPKGHKVPCVGLSIGVERIFYIVEQRMKTKGEKVRTTETQVFVATPQKNFLQERLKLIAELWDSGIKAEMLYKNNPKLLTQLHYCESTGIPLVVIIGEQELKEGVIKIRSVASREEVAIKRENFVAEIQKRLSES

SEQ ID NO: 38431 - protein, 99 aa, Homo sapiens
  Payload ID: 7635
  Gene Symbol: HARS2
  Gene Name: histidyl-tRNA synthetase 2, mitochondrial
  ENSP ID: ENSP00000423530
MPLLGLLPRRAWASLLSQLLRPPCASCTGAVRCQSQGEESLQVGGQQGQRCHRSGQCPEKPHLTFILLPGCRGSVNIPTESTSRETKFYYQDPKGYQGS

SEQ ID NO: 38432 - protein, 481 aa, Homo sapiens
  Payload ID: 7635
  Gene Symbol: HARS2
  Gene Name: histidyl-tRNA synthetase 2, mitochondrial
  Uniprot ID: P49590
  ENSP ID: ENSP00000423616
MPLLGLLPRRAWASLLSQLLRPPCASCTGAVRCQSQGTRDLSPQHMVVREKILDLVISCFKRHGAKGMDTPAFELKETLTEKYGEDSGLMYDLKDQGGELLSLRYDLTVPFARYLAMNKVKKMKRYHVGKVWRRESPTIVQGRYREFCQCDFDIAGQFDPMIPDAECLKIMCEILSGLQLGDFLIKVNDRRIVDGMFAVCGVPESKFRAICSSIDKLDKMAWKDVRHEMVVKKGLAPEVADRIGDYVQCHGGVSLVEQMFQDPRLSQNKQALEGLGDLKLLFEYLTLFGIADKISFDLSLARGLDYYTGVIYEAVLLQTPTQAGEEPLNVGSVAAGGRYDGLVGMFDPKGHKVPCVGLSIGVERIFYIVEQRMKTKGEKVRTTETQVFVATPQKNFLQERLKLIAELWDSGIKAEMLYKNNPKLLTQLHYCESTGIPLVVIIGEQELKEGVIKIRSVASREEVAIKRENFVAEIQKRLSES

SEQ ID NO: 38433 - protein, 116 aa, Homo sapiens
  Payload ID: 7635
  Gene Symbol: HARS2
  Gene Name: histidyl-tRNA synthetase 2, mitochondrial
  ENSP ID: ENSP00000424516
MPLLGLLPRRAWASLLSQLLRPPCASCTGAVRCQSQGEESLQVAEAVLTSQLKAHQEKPNFIIKTPKGTRDLSPQHMVVREKILDLVISCFKRHGAKGMDTPAFELKETLTEKYGE

SEQ ID NO: 38434 - protein, 181 aa, Homo sapiens
  Payload ID: 7635
  Gene Symbol: HARS2
  Gene Name: histidyl-tRNA synthetase 2, mitochondrial
  ENSP ID: ENSP00000425695
MPLLGLLPRRAWASLLSQLLRPPCASCTGAVRCQSQGEESLQVAEAVLTSQLKAHQEKPNFIIKTPKGTRDLSPQHMVVREKILDLVISCFKRHGAKGMDTPAFELKETLTEKYGEDSGLMYDLKDQGGELLSLRYDLTVPFARYLAMNKVKKMKRYHVGKVWRRESPTIVQGRYREFCQC

SEQ ID NO: 38435 - protein, 99 aa, Homo sapiens; identical to SEQ ID NO: 38431
  Payload ID: 7635
  Gene Symbol: HARS2
  Gene Name: histidyl-tRNA synthetase 2, mitochondrial
  ENSP ID: ENSP00000429220

SEQ ID NO: 38436 - protein, 394 aa, Homo sapiens
  Payload ID: 7636
  Gene Symbol: HM13
  Gene Name: histocompatibility (minor) 13
  Uniprot ID: Q8TCT9
  ENSP ID: ENSP00000335294
MDSALSDPHNGSAEAGGPTNSTTRPPSTPEGIALAYGSLLLMALLPIFFGALRSVRCARGKNASDMPETITSRDAARFPIIASCTLLGLYLFFKIFSQEYINLLLSMYFFVLGILALSHTISPFMNKFFPASFPNRQYQLLFTQGSGENKEEIINYEFDTKDLVCLGLSSIVGVWYLLRKHWIANNLFGLAFSLNGVELLHLNNVSTGCILLGGLFIYDVFWVFGTNVMVTVAKSFEAPIKLVFPQDLLEKGLEANNFAMLGLGDVVIPGIFIALLLRFDISLKKNTHTYFYTSFAAYIFGLGLTIFIMHIFKHAQPALLYLVPACIGFPVLVALAKGEVTEMFSYESSAEILPHTPRLTHFPTVSGSPASLADSMQQKLAGPRRRRPQNPSAM

SEQ ID NO: 38437 - protein, 272 aa, Homo sapiens
  Payload ID: 7636
  Gene Symbol: HM13
  Gene Name: histocompatibility (minor) 13
  ENSP ID: ENSP00000341347
MDSALSDPHNGSAEAGGPTNSTTRPPSTPEGIALAYGSLLLMALLPIFFGALRSVRCARGKNASDMPETITSRDAARFPIIASCTLLGLYLFFKIFSQEYINLLLSMYFFVLGILALSHTISPFMNKFFPASFPNRQYQLLFTQGSGENKEEIINYEFDTKDLVCLGLSSIVGVWYLLRKVFGTNVMVTVAKSFEAPIKLVFPQDLLEKGLEANNFAMLGLGDVVIPGIFIALLLRFDISLKKNTHTYFYTSFAAYIFGLGLTIFIMHIFKH

SEQ ID NO: 38438 - protein, 377 aa, Homo sapiens
  Payload ID: 7636
  Gene Symbol: HM13
  Gene Name: histocompatibility (minor) 13
  Uniprot ID: Q8TCT9
  ENSP ID: ENSP00000343032
MDSALSDPHNGSAEAGGPTNSTTRPPSTPEGIALAYGSLLLMALLPIFFGALRSVRCARGKNASDMPETITSRDAARFPIIASCTLLGLYLFFKIFSQEYINLLLSMYFFVLGILALSHTISPFMNKFFPASFPNRQYQLLFTQGSGENKEEIINYEFDTKDLVCLGLSSIVGVWYLLRKHWIANNLFGLAFSLNGVELLHLNNVSTGCILLGGLFIYDVFWVFGTNVMVTVAKSFEAPIKLVFPQDLLEKGLEANNFAMLGLGDVVIPGIFIALLLRFDISLKKNTHTYFYTSFAAYIFGLGLTIFIMHIFKHAQPALLYLVPACIGFPVLVALAKGEVTEMFSYEESNPKDPAAVTESKEGTEASASKGLEKKEK

SEQ ID NO: 38439 - protein, 426 aa, Homo sapiens
  Payload ID: 7636
  Gene Symbol: HM13
  Gene Name: histocompatibility (minor) 13
  Uniprot ID: Q8TCT9
  ENSP ID: ENSP00000381237
MDSALSDPHNGSAEAGGPTNSTTRPPSTPEGIALAYGSLLLMALLPIFFGALRSVRCARGKNASDMPETITSRDAARFPIIASCTLLGLYLFFKIFSQEYINLLLSMYFFVLGILALSHTISPFMNKFFPASFPNRQYQLLFTQGSGENKEEIINYEFDTKDLVCLGLSSIVGVWYLLRKHWIANNLFGLAFSLNGVELLHLNNVSTGCILLGGLFIYDVFWVFGTNVMVTVAKSFEAPIKLVFPQDLLEKGLEANNFAMLGLGDVVIPGIFIALLLRFDISLKKNTHTYFYTSFAAYIFGLGLTIFIMHIFKHAQPALLYLVPACIGFPVLVALAKGEVTEMFSYESSAEILPHTPRLTHFPTVSGSPASLADSMQQKLAGPRRRRPQNPSAIYEESNPKDPAAVTESKEGTEASASKGLEKKEK

SEQ ID NO: 38440 - protein, 143 aa, Homo sapiens
  Payload ID: 7636
  Gene Symbol: HM13
  Gene Name: histocompatibility (minor) 13
  ENSP ID: ENSP00000479020
MDSALSDPHNGSAEAGGPTNSTTRPPSTPEGIALAYGSLLLMALLPIFFGALRSVRCARGKNASDMPETITSRDAARFPIIASCTLLGLYLFFKIFSQEYINLLLSMYFFVLGILALSHTIRSEGISLQHLKQLSREPVQGLG

SEQ ID NO: 38441 - protein, 50 aa, Homo sapiens
  Payload ID: 7636
  Gene Symbol: HM13
  Gene Name: histocompatibility (minor) 13
  ENSP ID: ENSP00000479443
FIALLLRFDISLKKNTHTYFYTSFAAYIFGLGLTIFIMHIFKHAQVLGLH

SEQ ID NO: 38442 - protein, 1136 aa, Homo sapiens
  Payload ID: 7637
  Gene Symbol: HMHA1
  Gene Name: histocompatibility (minor) HA-1
  Uniprot ID: Q92619
  ENSP ID: ENSP00000316772
MFSRKKRELMKTPSISKKNRAGSPSPQPSGELPRKDGADAVFPGPSLEPPAGSSGVKATGTLKRPTSLSRHASAAGFPLSGAASWTLGRSHRSPLTAASPGELPTEGAGPDVVEDISHLLADVARFAEGLEKLKECVLRDDLLEARRPRAHECLGEALRVMHQIISKYPLLNTVETLTAAGTLIAKVKAFHYESNNDLEKQEFEKALETIAVAFSSTVSEFLMGEVDSSTLLAVPPGDSSQSMESLYGPGSEGTPPSLEDCDAGCLPAEEVDVLLQRCEGGVDAALLYAKNMAKYMKDLISYLEKRTTLEMEFAKGLQKIAHNCRQSVMQEPHMPLLSIYSLALEQDLEFGHSMVQAVGTLQTQTFMQPLTLRRLEHEKRRKEIKEAWHRAQRKLQEAESNLRKAKQGYVQRCEDHDKARFLVAKAEEEQAGSAPGAGSTATKTLDKRRRLEEEAKNKAEEAMATYRTCVADAKTQKQELEDTKVTALRQIQEVIRQSDQTIKSATISYYQMMHMQTAPLPVHFQMLCESSKLYDPGQQYASHVRQLQRDQEPDVHYDFEPHVSANAWSPVMRARKSSFNVSDVARPEAAGSPPEEGGCTEGTPAKDHRAGRGHQVHKSWPLSISDSDSGLDPGPGAGDFKKFERTSSSGTMSSTEELVDPDGGAGASAFEQADLNGMTPELPVAVPSGPFRHEGLSKAARTHRLRKLRTPAKCRECNSYVYFQGAECEECCLACHKKCLETLAIQCGHKKLQGRLQLFGQDFSHAARSAPDGVPFIVKKCVCEIERRALRTKGIYRVNGVKTRVEKLCQAFENGKELVELSQASPHDISNVLKLYLRQLPEPLISFRLYHELVGLAKDSLKAEAEAKAASRGRQDGSESEAVAVALAGRLRELLRDLPPENRASLQYLLRHLRRIVEVEQDNKMTPGNLGIVFGPTLLRPRPTEATVSLSSLVDYPHQARVIETLIVHYGLVFEEEPEETPGGQDESSNQRAEVVVQVPYLEAGEAVVYPLQEAAADGCRESRVVSNDSDSDLEEASELLSSSEASALGHLSFLEQQQSEASLEVASGSHSGSEEQLEATAREDGDGDEDGPAQQLSGFNTNQSNNVLQAPLPPMRLRGGRMTLGSCRERQPEFV

SEQ ID NO: 38443 - protein, 1019 aa, Homo sapiens
  Payload ID: 7637
  Gene Symbol: HMHA1
  Gene Name: histocompatibility (minor) HA-1
  ENSP ID: ENSP00000438979
MCICGTAHPVLDEGPVRCRAGPRDLLEARRPRAHECLGEALRVMHQIISKYPLLNTVETLTAAGTLIAKVKAFHYESNNDLEKQEFEKALETIAVAFSSTVSEFLMGEVDSSTLLAVPPGDSSQSMESLYGPGSEGTPPSLEDCDAGCLPAEEVDVLLQRCEGGVDAALLYAKNMAKYMKDLISYLEKRTTLEMEFAKGLQKIAHNCRQSVMQEPHMPLLSIYSLALEQDLEFGHSMVQAVGTLQTQTFMQPLTLRRLEHEKRRKEIKEAWHRAQRKLQEAESNLRKAKQGYVQRCEDHDKARFLVAKAEEEQAGSAPGAGSTATKTLDKRRRLEEEAKNKAEEAMATYRTCVADAKTQKQELEDTKVTALRQIQEVIRQSDQTIKSATISYYQMMHMQTAPLPVHFQMLCESSKLYDPGQQYASHVRQLQRDQEPDVHYDFEPHVSANAWSPVMRARKSSFNVSDVARPEAAGSPPEEGGCTEGTPAKDHRAGRGHQVHKSWPLSISDSDSGLDPGPGAGDFKKFERTSSSGTMSSTEELVDPDGGAGASAFEQADLNGMTPELPVAVPSGPFRHEGLSKAARTHRLRKLRTPAKCRECNSYVYFQGAECEECCLACHKKCLETLAIQCGHKKLQGRLQLFGQDFSHAARSAPDGVPFIVKKCVCEIERRALRTKGIYRVNGVKTRVEKLCQAFENGKELVELSQASPHDISNVLKLYLRQLPEPLISFRLYHELVGLAKDSLKAEAEAKAASRGRQDGSESEAVAVALAGRLRELLRDLPPENRASLQYLLRHLRRIVEVEQDNKMTPGNLGIVFGPTLLRPRPTEATVSLSSLVDYPHQARVIETLIVHYGLVFEEEPEETPGGQDESSNQRAEVVVQVPYLEAGEAVVYPLQEAAADGCRESRVVSNDSDSDLEEASELLSSSEASALGHLSFLEQQQSEASLEVASGSHSGSEEQLEATAREDGDGDEDGPAQQLSGFNTNQSNNVLQAPLPPMRLRGGRMTLGSCRERQPEFV

SEQ ID NO: 38444 - protein, 1152 aa, Homo sapiens
  Payload ID: 7637
  Gene Symbol: HMHA1
  Gene Name: histocompatibility (minor) HA-1
  Uniprot ID: Q92619
  ENSP ID: ENSP00000439601
MSRGQRVLKGLLGWVCTWTWAWRARLGARGCGLHVLCPRDLPLPPEELPRKDGADAVFPGPSLEPPAGSSGVKATGTLKRPTSLSRHASAAGFPLSGAASWTLGRSHRSPLTAASPGELPTEGAGPDVVEDISHLLADVARFAEGLEKLKECVLRDDLLEARRPRAHECLGEALRVMHQIISKYPLLNTVETLTAAGTLIAKVKAFHYESNNDLEKQEFEKALETIAVAFSSTVSEFLMGEVDSSTLLAVPPGDSSQSMESLYGPGSEGTPPSLEDCDAGCLPAEEVDVLLQRCEGGVDAALLYAKNMAKYMKDLISYLEKRTTLEMEFAKGLQKIAHNCRQSVMQEPHMPLLSIYSLALEQDLEFGHSMVQAVGTLQTQTFMQPLTLRRLEHEKRRKEIKEAWHRAQRKLQEAESNLRKAKQGYVQRCEDHDKARFLVAKAEEEQAGSAPGAGSTATKTLDKRRRLEEEAKNKAEEAMATYRTCVADAKTQKQELEDTKVTALRQIQEVIRQSDQTIKSATISYYQMMHMQTAPLPVHFQMLCESSKLYDPGQQYASHVRQLQRDQEPDVHYDFEPHVSANAWSPVMRARKSSFNVSDVARPEAAGSPPEEGGCTEGTPAKDHRAGRGHQVHKSWPLSISDSDSGLDPGPGAGDFKKFERTSSSGTMSSTEELVDPDGGAGASAFEQADLNGMTPELPVAVPSGPFRHEGLSKAARTHRLRKLRTPAKCRECNSYVYFQGAECEECCLACHKKCLETLAIQCGHKKLQGRLQLFGQDFSHAARSAPDGVPFIVKKCVCEIERRALRTKGIYRVNGVKTRVEKLCQAFENGKELVELSQASPHDISNVLKLYLRQLPEPLISFRLYHELVGLAKDSLKAEAEAKAASRGRQDGSESEAVAVALAGRLRELLRDLPPENRASLQYLLRHLRRIVEVEQDNKMTPGNLGIVFGPTLLRPRPTEATVSLSSLVDYPHQARVIETLIVHYGLVFEEEPEETPGGQDESSNQRAEVVVQVPYLEAGEAVVYPLQEAAADGCRESRVVSNDSDSDLEEASELLSSSEASALGHLSFLEQQQSEASLEVASGSHSGSEEQLEATAREDGDGDEDGPAQQLSGFNTNQSNNVLQAPLPPMRLRGGRMTLGSCRERQPEFV

SEQ ID NO: 38445 - protein, 60 aa, Homo sapiens
  Payload ID: 7637
  Gene Symbol: HMHA1
  Gene Name: histocompatibility (minor) HA-1
  ENSP ID: ENSP00000466365
MFSRKKRELMKTPSISKKNRAGSPSPQPSGTSLRPAARGPTSAWVRLCVSCIRSSPSTRC

SEQ ID NO: 38446 - protein, 1163 aa, Homo sapiens
  Payload ID: 7637
  Gene Symbol: HMHA1
  Gene Name: histocompatibility (minor) HA-1
  ENSP ID: ENSP00000466401
MFSRKKRELMKTPSISKKNRAGSPSPQPSGPHFISGETEAVSRPENPFNELPSDLPKELPRKDGADAVFPGPSLEPPAGSSGVKATGTLKRPTSLSRHASAAGFPLSGAASWTLGRSHRSPLTAASPGELPTEGAGPDVVEDISHLLADVARFAEGLEKLKECVLRDDLLEARRPRAHECLGEALRVMHQIISKYPLLNTVETLTAAGTLIAKVKAFHYESNNDLEKQEFEKALETIAVAFSSTVSEFLMGEVDSSTLLAVPPGDSSQSMESLYGPGSEGTPPSLEDCDAGCLPAEEVDVLLQRCEGGVDAALLYAKNMAKYMKDLISYLEKRTTLEMEFAKGLQKIAHNCRQSVMQEPHMPLLSIYSLALEQDLEFGHSMVQAVGTLQTQTFMQPLTLRRLEHEKRRKEIKEAWHRAQRKLQEAESNLRKAKQGYVQRCEDHDKARFLVAKAEEEQAGSAPGAGSTATKTLDKRRRLEEEAKNKAEEAMATYRTCVADAKTQKQELEDTKVTALRQIQEVIRQSDQTIKSATISYYQMMHMQTAPLPVHFQMLCESSKLYDPGQQYASHVRQLQRDQEPDVHYDFEPHVSANAWSPVMRARKSSFNVSDVARPEAAGSPPEEGGCTEGTPAKDHRAGRGHQVHKSWPLSISDSDSGLDPGPGAGDFKKFERTSSSGTMSSTEELVDPDGGAGASAFEQADLNGMTPELPVAVPSGPFRHEGLSKAARTHRLRKLRTPAKCRECNSYVYFQGAECEECCLACHKKCLETLAIQCGHKKLQGRLQLFGQDFSHAARSAPDGVPFIVKKCVCEIERRALRTKGIYRVNGVKTRVEKLCQAFENGKELVELSQASPHDISNVLKLYLRQLPEPLISFRLYHELVGLAKDSLKAEAEAKAASRGRQDGSESEAVAVALAGRLRELLRDLPPENRASLQYLLRHLRRIVEVEQDNKMTPGNLGIVFGPTLLRPRPTEATVSLSSLVDYPHQARVIETLIVHYGLVFEEEPEETPGGQDESSNQRAEVVVQVPYLEAGEAVVYPLQEAAADGCRESRVVSNDSDSDLEEASELLSSSEASALGHLSFLEQQQSEASLEVASGSHSGSEEQLEATAREDGDGDEDGPAQQLSGFNTNQSNNVLQAPLPPMRLRGGRMTLGSCRERQPEFV

SEQ ID NO: 38447 - protein, 170 aa, Homo sapiens
  Payload ID: 7637
  Gene Symbol: HMHA1
  Gene Name: histocompatibility (minor) HA-1
  ENSP ID: ENSP00000467741
MVGSTPHFGDPCAGSPGPGGRGDPDGRGDPDGQGPELPRKDGADAVFPGPSLEPPAGSSGVKATGTLKRPTSLSRHASAAGFPLSGAASWTLGRSHRSPLTAASPGELPTEGAGPDVVEDISHLLADVARFAEGLEKLKECVLRDDLLEARRPRAHECLGEALRVMHQII

SEQ ID NO: 38448 - protein, 771 aa, Homo sapiens
  Payload ID: 7637
  Gene Symbol: HMHA1
  Gene Name: histocompatibility (minor) HA-1
  ENSP ID: ENSP00000468607
MGVGRKGGAGETESHPRIGLELASWLPHPQQEAESNLRKAKQGYVQRCEDHDKARFLVAKAEEEQAGSAPGAGSTATKTLDKRRRLEEEAKNKAEEAMATYRTCVADAKTQKQELEDTKVTALRQIQEVIRQSDQTIKSATISYYQMMHMQTAPLPVHFQMLCESSKLYDPGQQYASHVRQLQRDQEPDVHYDFEPHVSANAWSPVMRARKSSFNVSDVARPEAAGSPPEEGGCTEGTPAKDHRAGRGHQVHKSWPLSISDSDSGLDPGPGAGDFKKFERTSSSGTMSSTEELVDPDGGAGASAFEQADLNGMTPELPVAVPSGPFRHEGLSKAARTHRLRKLRTPAKCRECNSYVYFQGAECEECCLACHKKCLETLAIQCGHKKLQGRLQLFGQDFSHAARSAPDGVPFIVKKCVCEIERRALRTKGIYRVNGVKTRVEKLCQAFENGKELVELSQASPHDISNVLKLYLRQLPEPLISFRLYHELVGLAKDSLKAEAEAKAASRGRQDGSESEAVAVALAGRLRELLRDLPPENRASLQYLLRHLRRIVEVEQDNKMTPGNLGIVFGPTLLRPRPTEATVSLSSLVDYPHQARVIETLIVHYGLVFEEEPEETPGGQDESSNQRAEVVVQVPYLEAGEAVVYPLQEAAADGCRESRVVSNDSDSDLEEASELLSSSEASALGHLSFLEQQQSEASLEVASGSHSGSEEQLEATAREDGDGDEDGPAQQLSGFNTNQSNNVLQAPLPPMRLRGGRMTLGSCRERQPEFV

SEQ ID NO: 38449 - protein, 1140 aa, Homo sapiens
  Payload ID: 7637
  Gene Symbol: HMHA1
  Gene Name: histocompatibility (minor) HA-1
  ENSP ID: ENSP00000468615
MLGRRLGARASYSPYRAGRQGPQQRGRDPGIQLTELPRKDGADAVFPGPSLEPPAGSSGVKATGTLKRPTSLSRHASAAGFPLSGAASWTLGRSHRSPLTAASPGELPTEGAGPDVVEDISHLLADVARFAEGLEKLKECVLRDDLLEARRPRAHECLGEALRVMHQIISKYPLLNTVETLTAAGTLIAKVKAFHYESNNDLEKQEFEKALETIAVAFSSTVSEFLMGEVDSSTLLAVPPGDSSQSMESLYGPGSEGTPPSLEDCDAGCLPAEEVDVLLQRCEGGVDAALLYAKNMAKYMKDLISYLEKRTTLEMEFAKGLQKIAHNCRQSVMQEPHMPLLSIYSLALEQDLEFGHSMVQAVGTLQTQTFMQPLTLRRLEHEKRRKEIKEAWHRAQRKLQEAESNLRKAKQGYVQRCEDHDKARFLVAKAEEEQAGSAPGAGSTATKTLDKRRRLEEEAKNKAEEAMATYRTCVADAKTQKQELEDTKVTALRQIQEVIRQSDQTIKSATISYYQMMHMQTAPLPVHFQMLCESSKLYDPGQQYASHVRQLQRDQEPDVHYDFEPHVSANAWSPVMRARKSSFNVSDVARPEAAGSPPEEGGCTEGTPAKDHRAGRGHQVHKSWPLSISDSDSGLDPGPGAGDFKKFERTSSSGTMSSTEELVDPDGGAGASAFEQADLNGMTPELPVAVPSGPFRHEGLSKAARTHRLRKLRTPAKCRECNSYVYFQGAECEECCLACHKKCLETLAIQCGHKKLQGRLQLFGQDFSHAARSAPDGVPFIVKKCVCEIERRALRTKGIYRVNGVKTRVEKLCQAFENGKELVELSQASPHDISNVLKLYLRQLPEPLISFRLYHELVGLAKDSLKAEAEAKAASRGRQDGSESEAVAVALAGRLRELLRDLPPENRASLQYLLRHLRRIVEVEQDNKMTPGNLGIVFGPTLLRPRPTEATVSLSSLVDYPHQARVIETLIVHYGLVFEEEPEETPGGQDESSNQRAEVVVQVPYLEAGEAVVYPLQEAAADGCRESRVVSNDSDSDLEEASELLSSSEASALGHLSFLEQQQSEASLEVASGSHSGSEEQLEATAREDGDGDEDGPAQQLSGFNTNQSNNVLQAPLPPMRLRGGRMTLGSCRERQPEFV

SEQ ID NO: 38450 - protein, 78 aa, Homo sapiens
  Payload ID: 7637
  Gene Symbol: HMHA1
  Gene Name: histocompatibility (minor) HA-1
  ENSP ID: ENSP00000484008
GRQDGSESEAVAVALAGRLRELLRDLPPENRASLQYLLRHLRRPASSRLSSSTTAWSSRRSRRRPPGARTSHPTSELR

SEQ ID NO: 38451 - protein, 41 aa, Homo sapiens
  Payload ID: 7638
  Gene Symbol: HMHB1
  Gene Name: histocompatibility (minor) HB-1
  Uniprot ID: O97980
  ENSP ID: ENSP00000289448
LEEQPECREEKRGSLHVWKSELVEVEDDVYLRHSSSLTYRL

SEQ ID NO: 38452 - protein, 139 aa, Homo sapiens
  Payload ID: 7639
  Gene Symbol: HMSD
  Gene Name: histocompatibility (minor) serpin domain containing
  Uniprot ID: A8MTL9
  ENSP ID: ENSP00000386207
MSISSALAMVFMGAKGNTAAQMSQALCFSKIGGEDGDIHRGFQSLLVAINRTDTEYVLRTANGLFGEKSYDFLTGFTDSCGKFYQATIKQLDFVNDTEKSTTRVNSWVADKTKGENILLFYFDNILNSFIVSSLQNCQI

SEQ ID NO: 38453 - protein, 53 aa, Homo sapiens
  Payload ID: 7639
  Gene Symbol: HMSD
  Gene Name: histocompatibility (minor) serpin domain containing
  Uniprot ID: P0C7T4
  ENSP ID: ENSP00000431632
MEIFIEVFSHFLLQLTELTLNMCLELPTGSLEKSLMISSQVLQIPVANSTKQR

SEQ ID NO: 38454 - protein, 419 aa, Homo sapiens
  Payload ID: 7640
  Gene Symbol: HAT1
  Gene Name: histone acetyltransferase 1
  Uniprot ID: O14929
  ENSP ID: ENSP00000264108
MAGFGAMEKFLVEYKSAVEKKLAEYKCNTNTAIELKLVRFPEDLENDIRTFFPEYTHQLFGDDETAFGYKGLKILLYYIAGSLSTMFRVEYASKVDENFDCVEADDVEGKIRQIIPPGFCTNTNDFLSLLEKEVDFKPFGTLLHTYSVLSPTGGENFTFQIYKADMTCRGFREYHERLQTFLMWFIETASFIDVDDERWHYFLVFEKYNKDGATLFATVGYMTVYNYYVYPDKTRPRVSQMLILTPFQGQGHGAQLLETVHRYYTEFPTVLDITAEDPSKSYVKLRDFVLVKLCQDLPCFSREKLMQGFNEDMVIEAQQKFKINKQHARRVYEILRLLVTDMSDAEQYRSYRLDIKRRLISPYKKKQRDLAKMRKCLRPEELTNQMNQIEISMQHEQLEESFQELVEDYRRVIERLAQE

SEQ ID NO: 38455 - protein, 125 aa, Homo sapiens
  Payload ID: 7640
  Gene Symbol: HAT1
  Gene Name: histone acetyltransferase 1
  ENSP ID: ENSP00000403466
MAGFGAMEKFLVEYKSAVEKKLAEYKCNTNTAIELKLVRFPEDLENDIRTFFPEYTHQLFGDEQMMLRAKLDKSFHLDFAQTRMISFLYWKRKLISSHSEPYFIPTQFSVQQEEKTLPFRYIRLT

SEQ ID NO: 38456 - protein, 46 aa, Homo sapiens
  Payload ID: 7640
  Gene Symbol: HAT1
  Gene Name: histone acetyltransferase 1
  ENSP ID: ENSP00000407921
MAGFGAMEKFLVEYKSAVEKKLAEYKCNTNTAIELKLVKLLLVTRV

SEQ ID NO: 38457 - protein, 1017 aa, Homo sapiens
  Payload ID: 7641
  Gene Symbol: HIRA
  Gene Name: histone cell cycle regulator
  Uniprot ID: P54198
  ENSP ID: ENSP00000263208
MKLLKPTWVNHNGKPIFSVDIHPDGTKFATGGQGQDSGKVVIWNMSPVLQEDDEKDENIPKMLCQMDNHLACVNCVRWSNSGMYLASGGDDKLIMVWKRATYIGPSTVFGSSGKLANVEQWRCVSILRNHSGDVMDVAWSPHDAWLASCSVDNTVVIWNAVKFPEILATLRGHSGLVKGLTWDPVGKYIASQADDRSLKVWRTLDWQLETSITKPFDECGGTTHVLRLSWSPDGHYLVSAHAMNNSGPTAQIIEREGWKTNMDFVGHRKAVTVVKFNPKIFKKKQKNGSSAKPSCPYCCCAVGSKDRSLSVWLTCLKRPLVVIHELFDKSIMDISWTLNGLGILVCSMDGSVAFLDFSQDELGDPLSEEEKSRIHQSTYGKSLAIMTEAQLSTAVIENPEMLKYQRRQQQQQLDQKSAATREMGSATSVAGVVNGESLEDIRKNLLKKQVETRTADGRRRITPLCIAQLDTGDFSTAFFNSIPLSGSLAGTMLSSHSSPQLLPLDSSTPNSFGASKPCTEPVVAASARPAGDSVNKDSMNATSTPAALSPSVLTTPSKIEPMKAFDSRFTERSKATPGAPALTSMTPTAVERLKEQNLVKELRPRDLLESSSDSDEKVPLAKASSLSKRKLELEVETVEKKKKGRPRKDSRLMPVSLSVQSPAALTAEKEAMCLSAPALALKLPIPSPQRAFTLQVSSDPSMYIEVENEVTVVGGVKLSRLKCNREGKEWETVLTSRILTAAGSCDVVCVACEKRMLSVFSTCGRRLLSPILLPSPISTLHCTGSYVMALTAAATLSVWDVHRQVVVVKEESLHSILAGSDMTVSQILLTQHGIPVMNLSDGKAYCFNPSLSTWNLVSDKQDSLAQCADFRSSLPSQDAMLCSGPLAIIQGRTSNSGRQAARLFSVPHVVQQETTLAYLENQVAAALTLQSSHEYRHWLLVYARYLVNEGFEYRLREICKDLLGPVHYSTGSQWESTVVGLRKRELLKELLPVIGQNLRFQRLFTECQEQLDILRDK

SEQ ID NO: 38458 - protein, 810 aa, Homo sapiens
  Payload ID: 7641
  Gene Symbol: HIRA
  Gene Name: histone cell cycle regulator
  Uniprot ID: P54198
  ENSP ID: ENSP00000345350
MKLLKPTWVNHNGKPIFSVDIHPDGTKFATGGQGQDSGKVVIWNMSPVLQEDDEKDENIPKMLCQMDNHLACVNCVRWSNSGMYLASGGDDKLIMVWKRATYIGPSTVFGSSGKLANVEQWRCVSILRNHSGDVMDVAWSPHDAWLASCSVDNTVVIWNAVKFPEILATLRGHSGLVKGLTWDPVGKYIASQADDRSLKVWRTLDWQLETSITKPFDECGGTTHVLRLSWSPDGHYLVSAHAMNNSGPTAQIIEREGWKTNMDFVGHRKAVTVVKFNPKIFKKKQKNGSSAKPSCPYCCCAVGSKDRSLSVWLTCLKRPLVVIHELFDKSIMDISWTLNGLGILVCSMDGSVAFLDFSQDELGDPLSEEEKSRIHQSTYGKSLAIMTEAQLSTAVIENPEMLKYQRRQQQQQLDQKSAATREMGSATSVAGVVNGESLEDIRKNLLKKQVETRTADGRRRITPLCIAQLDTGDFSTAFFNSIPLSGSLAGTMLSSHSSPQLLPLDSSTPNSFGASKPCTEPVVAASARPAGDSVNKDSMNATSTPAALSPSVLTTPSKIEPMKAFDSRFTERSKATPGAPALTSMTPTAVERDVHRQVVVVKEESLHSILAGSDMTVSQILLTQHGIPVMNLSDGKAYCFNPSLSTWNLVSDKQDSLAQCADFRSSLPSQDAMLCSGPLAIIQGRTSNSGRQAARLFSVPHVVQQETTLAYLENQVAAALTLQSSHEYRHWLLVYARYLVNEGFEYRLREICKDLLGPVHYSTGSQWESTVVGLRKRELLKELLPVIGQNLRFQRLFTECQEQLDILRDK

SEQ ID NO: 38459 - protein, 53 aa, Homo sapiens
  Payload ID: 7641
  Gene Symbol: HIRA
  Gene Name: histone cell cycle regulator
  ENSP ID: ENSP00000404792
  MOD_RES (1)..(1): Any amino acid
XACEQWQRDLASCRDWEERRNAEAQASRFFQLIFTLTGPSSQLEDKGRILGRL

SEQ ID NO: 38460 - protein, 215 aa, Homo sapiens
  Payload ID: 7642
  Gene Symbol: HIST1H1A
  Gene Name: histone cluster 1, H1a
  Uniprot ID: Q02539
  ENSP ID: ENSP00000244573
MSETVPPAPAASAAPEKPLAGKKAKKPAKAAAASKKKPAGPSVSELIVQAASSSKERGGVSLAALKKALAAAGYDVEKNNSRIKLGIKSLVSKGTLVQTKGTGASGSFKLNKKASSVETKPGASKVATKTKATGASKKLKKATGASKKSVKTPKKAKKPAATRKSSKNPKKPKTVKPKKVAKSPAKAKAVKPKAAKARVTKPKTAKPKKAAPKKK

SEQ ID NO: 38461 - protein, 226 aa, Homo sapiens
  Payload ID: 7643
  Gene Symbol: HIST1H1B
  Gene Name: histone cluster 1, H1b
  Uniprot ID: P16401
  ENSP ID: ENSP00000330074
MSETAPAETATPAPVEKSPAKKKATKKAAGAGAAKRKATGPPVSELITKAVAASKERNGLSLAALKKALAAGGYDVEKNNSRIKLGLKSLVSKGTLVQTKGTGASGSFKLNKKAASGEAKPKAKKAGAAKAKKPAGATPKKAKKAAGAKKAVKKTPKKAKKPAAAGVKKVAKSPKKAKAAAKPKKATKSPAKPKAVKPKAAKPKAAKPKAAKPKAAKAKKAAAKKK

SEQ ID NO: 38462 - protein, 213 aa, Homo sapiens [sequence omitted]

SEQ ID NO: 38463 - protein, 221 aa, Homo sapiens
  Payload ID: 7645
  Gene Symbol: HIST1H1D
  Gene Name: histone cluster 1, H1d
  Uniprot ID: P16402
  ENSP ID: ENSP00000244534
MSETAPLAPTIPAPAEKTPVKKKAKKAGATAGKRKASGPPVSELITKAVAASKERSGVSLAALKKALAAAGYDVEKNNSRIKLGLKSLVSKGTLVQTKGTGASGSFKLNKKAASGEGKPKAKKAGAAKPRKPAGAAKKPKKVAGAATPKKSIKKTPKKVKKPATAAGTKKVAKSAKKVKTPQPKKAAKSPAKAKAPKPKAAKPKSGKPKVTKAKKAAPKKK

SEQ ID NO: 38464 - protein, 219 aa, Homo sapiens
  Payload ID: 7646
  Gene Symbol: HIST1H1E
  Gene Name: histone cluster 1, H1e
  Uniprot ID: P10412
  ENSP ID: ENSP00000307705
MSETAPAAPAAPAPAEKTPVKKKARKSAGAAKRKASGPPVSELITKAVAASKERSGVSLAALKKALAAAGYDVEKNNSRIKLGLKSLVSKGTLVQTKGTGASGSFKLNKKAASGEAKPKAKKAGAAKAKKPAGAAKKPKKATGAATPKKSAKKTPKKAKKPAAAAGAKKAKSPKKAKAAKPKKAPKSPAKAKAVKPKAAKPKTAKPKAAKPKKAAAKKK

SEQ ID NO: 38465 - protein, 207 aa, Homo sapiens
  Payload ID: 7647
  Gene Symbol: HIST1H1T
  Gene Name: histone cluster 1, H1t
  Uniprot ID: P22492
  ENSP ID: ENSP00000341214
MSETVPAASASAGVAAMEKLPTKKRGRKPAGLISASRKVPNLSVSKLITEALSVSQERVGMSLVALKKALAAAGYDVEKNNSRIKLSLKSLVNKGILVQTRGTGASGSFKLSKKVIPKSTRSKAKKSVSAKTKKLVLSRDSKSPKTAKTNKRAKKPRATTPKTVRSGRKAKGAKGKQQQKSPVKARASKSKLTQHHEVNVRKATSKK

SEQ ID NO: 38466 - protein, 131 aa, Homo sapiens
  Payload ID: 7648
  Gene Symbol: HIST1H2AA
  Gene Name: histone cluster 1, H2aa
  Uniprot ID: Q96QV6
  ENSP ID: ENSP00000297012
MSGRGKQGGKARAKSKSRSSRAGLQFPVGRIHRLLRKGNYAERIGAGAPVYLAAVLEYLTAEILELAGNASRDNKKTRIIPRHLQLAIRNDEELNKLLGGVTIAQGGVLPNIQAVLLPKKTESHHHKAQSK

SEQ ID NO: 38467 - protein, 130 aa, Homo sapiens
  Payload ID: 7649
  Gene Symbol: HIST1H2AB
  Gene Name: histone cluster 1, H2ab
  Uniprot ID: P04908
  ENSP ID: ENSP00000483842
MSGRGKQGGKARAKAKTRSSRAGLQFPVGRVHRLLRKGNYSERVGAGAPVYLAAVLEYLTAEILELAGNAARDNKKTRIIPRHLQLAIRNDEELNKLLGRVTIAQGGVLPNIQAVLLPKKTESHHKAKGK

SEQ ID NO: 38468 - protein, 130 aa, Homo sapiens
  Payload ID: 7650
  Gene Symbol: HIST1H2AC
  Gene Name: histone cluster 1, H2ac
  Uniprot ID: Q93077
  ENSP ID: ENSP00000321389
MSGRGKQGGKARAKAKSRSSRAGLQFPVGRVHRLLRKGNYAERVGAGAPVYLAAVLEYLTAEILELAGNAARDNKKTRIIPRHLQLAIRNDEELNKLLGRVTIAQGGVLPNIQAVLLPKKTESHHKAKGK

SEQ ID NO: 38469 - protein, 130 aa, Homo sapiens; identical to SEQ ID NO: 38468
  Payload ID: 7650
  Gene Symbol: HIST1H2AC
  Gene Name: histone cluster 1, H2ac
  Uniprot ID: Q93077
  ENSP ID: ENSP00000367022

SEQ ID NO: 38470 - protein, 130 aa, Homo sapiens; identical to SEQ ID NO: 38468
  Payload ID: 7650
  Gene Symbol: HIST1H2AC
  Gene Name: histone cluster 1, H2ac
  Uniprot ID: Q93077
  ENSP ID: ENSP00000473534

SEQ ID NO: 38471 - protein, 130 aa, Homo sapiens
  Payload ID: 7651
  Gene Symbol: HIST1H2AD
  Gene Name: histone cluster 1, H2ad
  Uniprot ID: P20671
  ENSP ID: ENSP00000341094
MSGRGKQGGKARAKAKTRSSRAGLQFPVGRVHRLLRKGNYSERVGAGAPVYLAAVLEYLTAEILELAGNAARDNKKTRIIPRHLQLAIRNDEELNKLLGKVTIAQGGVLPNIQAVLLPKKTESHHKAKGK

SEQ ID NO: 38472 - protein, 130 aa, Homo sapiens; identical to SEQ ID NO: 38467
  Payload ID: 7652
  Gene Symbol: HIST1H2AE
  Gene Name: histone cluster 1, H2ae
  Uniprot ID: P04908
  ENSP ID: ENSP00000303373

SEQ ID NO: 38473 - protein, 130 aa, Homo sapiens
  Payload ID: 7653
  Gene Symbol: HIST1H2AG
  Gene Name: histone cluster 1, H2ag
  Uniprot ID: P0C0S8
  ENSP ID: ENSP00000352119
MSGRGKQGGKARAKAKTRSSRAGLQFPVGRVHRLLRKGNYAERVGAGAPVYLAAVLEYLTAEILELAGNAARDNKKTRIIPRHLQLAIRNDEELNKLLGKVTIAQGGVLPNIQAVLLPKKTESHHKAKGK

SEQ ID NO: 38474 - protein, 128 aa, Homo sapiens
  Payload ID: 7654
  Gene Symbol: HIST1H2AH
  Gene Name: histone cluster 1, H2ah
  Uniprot ID: Q96KK5
  ENSP ID: ENSP00000366679
MSGRGKQGGKARAKAKTRSSRAGLQFPVGRVHRLLRKGNYAERVGAGAPVYLAAVLEYLTAEILELAGNAARDNKKTRIIPRHLQLAIRNDEELNKLLGKVTIAQGGVLPNIQAVLLPKKTESHHKAK

SEQ ID NO: 38475 - protein, 130 aa, Homo sapiens; identical to SEQ ID NO: 38473
  Payload ID: 7655
  Gene Symbol: HIST1H2AI
  Gene Name: histone cluster 1, H2ai
  Uniprot ID: P0C0S8
  ENSP ID: ENSP00000351589

SEQ ID NO: 38476 - protein, 128 aa, Homo sapiens
  Payload ID: 7656
  Gene Symbol: HIST1H2AJ
  Gene Name: histone cluster 1, H2aj
  Uniprot ID: Q99878
  ENSP ID: ENSP00000328484
MSGRGKQGGKARAKAKTRSSRAGLQFPVGRVHRLLRKGNYAERVGAGAPVYLAAVLEYLTAEILELAGNAARDNKKTRIIPRHLQLAIRNDEELNKLLGKVTIAQGGVLPNIQAVLLPKKTESHHKTK

SEQ ID NO: 38477 - protein, 130 aa, Homo sapiens; identical to SEQ ID NO: 38473
  Payload ID: 7657
  Gene Symbol: HIST1H2AK
  Gene Name: histone cluster 1, H2ak
  Uniprot ID: P0C0S8
  ENSP ID: ENSP00000482431

SEQ ID NO: 38478 - protein, 130 aa, Homo sapiens; identical to SEQ ID NO: 38473
  Payload ID: 7658
  Gene Symbol: HIST1H2AL
  Gene Name: histone cluster 1, H2al
  Uniprot ID: P0C0S8
  ENSP ID: ENSP00000482538

SEQ ID NO: 38479 - protein, 130 aa, Homo sapiens; identical to SEQ ID NO: 38473
  Payload ID: 7659
  Gene Symbol: HIST1H2AM
  Gene Name: histone cluster 1, H2am
  Uniprot ID: P0C0S8
  ENSP ID: ENSP00000352627

SEQ ID NO: 38480 - protein, 127 aa, Homo sapiens
  Payload ID: 7660
  Gene Symbol: HIST1H2BA
  Gene Name: histone cluster 1, H2ba
  Uniprot ID: Q96A08
  ENSP ID: ENSP00000274764
MPEVSSKGATISKKGFKKAVVKTQKKEGKKRKRTRKESYSIYIYKVLKQVHPDTGISSKAMSIMNSFVTDIFERIASEASRLAHYSKRSTISSREIQTAVRLLLPGELAKHAVSEGTKAVTKYTSSK

SEQ ID NO: 38481 - protein, 126 aa, Homo sapiens
  Payload ID: 7661
  Gene Symbol: HIST1H2BB
  Gene Name: histone cluster 1, H2bb
  Uniprot ID: P33778
  ENSP ID: ENSP00000482674
MPEPSKSAPAPKKGSKKAITKAQKKDGKKRKRSRKESYSIYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 38482 - protein, 126 aa, Homo sapiens
  Payload ID: 7661
  Gene Symbol: HIST1H2BB
  Gene Name: histone cluster 1, H2bb
  ENSP ID: ENSP00000486472
MPEPAKSAPAPKKGSKKAVTKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 38483 - protein, 126 aa, Homo sapiens; identical to SEQ ID NO: 38482
  Payload ID: 7662
  Gene Symbol: HIST1H2BC
  Gene Name: histone cluster 1, H2bc
  Uniprot ID: P62807
  ENSP ID: ENSP00000321744

SEQ ID NO: 38484 - protein, 126 aa, Homo sapiens; identical to SEQ ID NO: 38482
  Payload ID: 7662
  Gene Symbol: HIST1H2BC
  Gene Name: histone cluster 1, H2bc
  Uniprot ID: P62807
  ENSP ID: ENSP00000380180

SEQ ID NO: 38485 - protein, 126 aa, Homo sapiens
  Payload ID: 7663
  Gene Symbol: HIST1H2BD
  Gene Name: histone cluster 1, H2bd
  Uniprot ID: P58876
  ENSP ID: ENSP00000289316
MPEPTKSAPAPKKGSKKAVTKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 38486 - protein, 126 aa, Homo sapiens; identical to SEQ ID NO: 38485
  Payload ID: 7663
  Gene Symbol: HIST1H2BD
  Gene Name: histone cluster 1, H2bd
  Uniprot ID: P58876
  ENSP ID: ENSP00000367008

SEQ ID NO: 38487 - protein, 126 aa, Homo sapiens; identical to SEQ ID NO: 38482
  Payload ID: 7664
  Gene Symbol: HIST1H2BE
  Gene Name: histone cluster 1, H2be
  Uniprot ID: P62807
  ENSP ID: ENSP00000483237

SEQ ID NO: 38488 - protein, 126 aa, Homo sapiens; identical to SEQ ID NO: 38482
  Payload ID: 7664
  Gene Symbol: HIST1H2BE
  Gene Name: histone cluster 1, H2be
  ENSP ID: ENSP00000489317

SEQ ID NO: 38489 - protein, 126 aa, Homo sapiens; identical to SEQ ID NO: 38482
  Payload ID: 7665
  Gene Symbol: HIST1H2BF
  Gene Name: histone cluster 1, H2bf
  Uniprot ID: P62807
  ENSP ID: ENSP00000348924

SEQ ID NO: 38490 - protein, 126 aa, Homo sapiens; identical to SEQ ID NO: 38482
  Payload ID: 7666
  Gene Symbol: HIST1H2BG
  Gene Name: histone cluster 1, H2bg
  Uniprot ID: P62807
  ENSP ID: ENSP00000445633

SEQ ID NO: 38491 - protein, 126 aa, Homo sapiens
  Payload ID: 7667
  Gene Symbol: HIST1H2BH
  Gene Name: histone cluster 1, H2bh
  Uniprot ID: Q93079
  ENSP ID: ENSP00000479169
MPDPAKSAPAPKKGSKKAVTKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 38492 - protein, 126 aa, Homo sapiens; identical to SEQ ID NO: 38482
  Payload ID: 7668
  Gene Symbol: HIST1H2BI
  Gene Name: histone cluster 1, H2bi
  Uniprot ID: P62807
  ENSP ID: ENSP00000366962

SEQ ID NO: 38493 - protein, 126 aa, Homo sapiens [sequence omitted]

SEQ ID NO: 38494 - protein, 21 aa, Homo sapiens
  Payload ID: 7669
  Gene Symbol: HIST1H2BJ
  Gene Name: histone cluster 1, H2bj
  ENSP ID: ENSP00000475213
  MOD_RES (1)..(1): Any amino acid
XDIFERIAGGVAETSQQAHLH

SEQ ID NO: 38495 - protein, 126 aa, Homo sapiens [sequence omitted]

SEQ ID NO: 38496 - protein, 126 aa, Homo sapiens
  Payload ID: 7670
  Gene Symbol: HIST1H2BK
  Gene Name: histone cluster 1, H2bk
  Uniprot ID: O60814
  ENSP ID: ENSP00000349430
MPEPAKSAPAPKKGSKKAVTKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSAK

SEQ ID NO: 38497 - protein, 126 aa, Homo sapiens
  Payload ID: 7671
  Gene Symbol: HIST1H2BL
  Gene Name: histone cluster 1, H2bl
  Uniprot ID: Q99880
  ENSP ID: ENSP00000366618
MPELAKSAPAPKKGSKKAVTKAQKKDGKKRKRSRKESYSVYVYKVLKQVHPDTGISSKAMGIMNSFVNDIFERIASEASRLAHYNKRSTITSREIQTAVRLLLPGELAKHAVSEGTKAVTKYTSSK

SEQ ID NO: 38498 - protein, 126 aa, Homo sapiens
  Payload ID: 7672
  Gene Symbol: HIST1H2BM
  Gene Name: histone cluster 1, H2bm
  Uniprot ID: Q99879
  ENSP ID: ENSP00000477907
MPEPVKSAPVPKKGSKKAINKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 38499 - protein, 126 aa, Homo sapiens
  Payload ID: 7673
  Gene Symbol: HIST1H2BN
  Gene Name: histone cluster 1, H2bn
  Uniprot ID: Q99877
  ENSP ID: ENSP00000380177
MPEPSKSAPAPKKGSKKAVTKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 38500 - protein, 126 aa, Homo sapiens; identical to SEQ ID NO: 38499
  Payload ID: 7673
  Gene Symbol: HIST1H2BN
  Gene Name: histone cluster 1, H2bn
  Uniprot ID: Q99877
  ENSP ID: ENSP00000446031

SEQ ID NO: 38501 - protein, 166 aa, Homo sapiens
  Payload ID: 7673
  Gene Symbol: HIST1H2BN
  Gene Name: histone cluster 1, H2bn
  ENSP ID: ENSP00000475942
MPEPSKSAPAPKKGSKKAVTKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSKKRKRRFTESIKKAHGFRKLKIWLKLRVSNQSPDDIYIARD

SEQ ID NO: 38502 - protein, 126 aa, Homo sapiens; identical to SEQ ID NO: 38499
  Payload ID: 7673
  Gene Symbol: HIST1H2BN
  Gene Name: histone cluster 1, H2bn
  Uniprot ID: Q99877
  ENSP ID: ENSP00000483903

SEQ ID NO: 38503 - protein, 126 aa, Homo sapiens
  Payload ID: 7674
  Gene Symbol: HIST1H2BO
  Gene Name: histone cluster 1, H2bo
  Uniprot ID: P23527
  ENSP ID: ENSP00000477527
MPDPAKSAPAPKKGSKKAVTKAQKKDGKKRKRSRKESYSIYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 38504 - protein, 136 aa, Homo sapiens
  Payload ID: 7675
  Gene Symbol: HIST1H3A
  Gene Name: histone cluster 1, H3a
  Uniprot ID: P68431
  ENSP ID: ENSP00000480826
MARTKQTARKSTGGKAPRKQLATKAARKSAPATGGVKKPHRYRPGTVALREIRRYQKSTELLIRKLPFQRLVREIAQDFKTDLRFQSSAVMALQEACEAYLVGLFEDTNLCAIHAKRVTIMPKDIQLARRIRGERA

SEQ ID NO: 38505 - protein, 136 aa, Homo sapiens; identical to SEQ ID NO: 38504
  Payload ID: 7676
  Gene Symbol: HIST1H3B
  Gene Name: histone cluster 1, H3b
  Uniprot ID: P68431
  ENSP ID: ENSP00000484841

SEQ ID NO: 38506 - protein, 136 aa, Homo sapiens; identical to SEQ ID NO: 38504
  Payload ID: 7677
  Gene Symbol: HIST1H3C
  Gene Name: histone cluster 1, H3c
  Uniprot ID: P68431
  ENSP ID: ENSP00000484658

SEQ ID NO: 38507 - protein, 136 aa, Homo sapiens; identical to SEQ ID NO: 38504
  Payload ID: 7678
  Gene Symbol: HIST1H3D
  Gene Name: histone cluster 1, H3d
  Uniprot ID: P68431
  ENSP ID: ENSP00000366999

SEQ ID NO: 38508 - protein, 136 aa, Homo sapiens; identical to SEQ ID NO: 38504
  Payload ID: 7679
  Gene Symbol: HIST1H3E
  Gene Name: histone cluster 1, H3e
  Uniprot ID: P68431
  ENSP ID: ENSP00000482271

SEQ ID NO: 38509 - protein, 136 aa, Homo sapiens; identical to SEQ ID NO: 38504
  Payload ID: 7679
  Gene Symbol: HIST1H3E
  Gene Name: histone cluster 1, H3e
  ENSP ID: ENSP00000489282

SEQ ID NO: 38510 - protein, 136 aa, Homo sapiens; identical to SEQ ID NO: 38504
  Payload ID: 7680
  Gene Symbol: HIST1H3F
  Gene Name: histone cluster 1, H3f
  Uniprot ID: P68431
  ENSP ID: ENSP00000484095

SEQ ID NO: 38511 - protein, 136 aa, Homo sapiens; identical to SEQ ID NO: 38504
  Payload ID: 7681
  Gene Symbol: HIST1H3G
  Gene Name: histone cluster 1, H3g
  Uniprot ID: P68431
  ENSP ID: ENSP00000484638

SEQ ID NO: 38512 - protein, 136 aa, Homo sapiens; identical to SEQ ID NO: 38504
  Payload ID: 7682
  Gene Symbol: HIST1H3H
  Gene Name: histone cluster 1, H3h
  Uniprot ID: P68431
  ENSP ID: ENSP00000358160

SEQ ID NO: 38513 - protein, 136 aa, Homo sapiens; identical to SEQ ID NO: 38504
  Payload ID: 7683
  Gene Symbol: HIST1H3I
  Gene Name: histone cluster 1, H3i
  Uniprot ID: P68431
  ENSP ID: ENSP00000483283

SEQ ID NO: 38514 - protein, 136 aa, Homo sapiens; identical to SEQ ID NO: 38504
  Payload ID: 7684
  Gene Symbol: HIST1H3J
  Gene Name: histone cluster 1, H3j
  Uniprot ID: P68431
  ENSP ID: ENSP00000352252

SEQ ID NO: 38515 - protein, 103 aa, Homo sapiens [sequence omitted]

SEQ ID NO: 38516 - protein, 103 aa, Homo sapiens [sequence omitted]

SEQ ID NO: 38517 - protein, 103 aa, Homo sapiens [sequence omitted]

SEQ ID NO: 38518 - protein, 103 aa, Homo sapiens [sequence omitted]

SEQ ID NO: 38519 - protein, 103 aa, Homo sapiens [sequence omitted]

SEQ ID NO: 38520 - protein, 103 aa, Homo sapiens [sequence omitted]

SEQ ID NO: 38521 - protein, 98 aa, Homo sapiens
  Payload ID: 7691
  Gene Symbol: HIST1H4G
  Gene Name: histone cluster 1, H4g
  Uniprot ID: Q99525
  ENSP ID: ENSP00000477870
MSVRGKAGKGLGKGGAKCHRKVLSDNIQGITKCTIRRLARHGGVKRILGLIYEETRRVFKVFLENVIWYAVTNTEHAKRKTVTAMAVVYVLKRQGRTL

SEQ ID NO: 38522 - protein, 103 aa, Homo sapiens [sequence omitted]

SEQ ID NO: 38523 - protein, 103 aa, Homo sapiens [sequence omitted]

SEQ ID NO: 38524 - protein, 103 aa, Homo sapiens [sequence omitted]

SEQ ID NO: 38525 - protein, 103 aa, Homo sapiens [sequence omitted]

SEQ ID NO: 38526 - protein, 103 aa, Homo sapiens [sequence omitted]

SEQ ID NO: 38527 - protein, 103 aa, Homo sapiens [sequence omitted]

SEQ ID NO: 38528 - protein, 103 aa, Homo sapiens [sequence omitted]

SEQ ID NO: 38529 - protein, 103 aa, Homo sapiens [sequence omitted]

SEQ ID NO: 38530 - protein, 130 aa, Homo sapiens
  Payload ID: 7697
  Gene Symbol: HIST2H2AA3
  Gene Name: histone cluster 2, H2aa3
  Uniprot ID: Q6FI13
  ENSP ID: ENSP00000358155
MSGRGKQGGKARAKAKSRSSRAGLQFPVGRVHRLLRKGNYAERVGAGAPVYMAAVLEYLTAEILELAGNAARDNKKTRIIPRHLQLAIRNDEELNKLLGKVTIAQGGVLPNIQAVLLPKKTESHHKAKGK

SEQ ID NO: 38531 - protein, 130 aa, Homo sapiens; identical to SEQ ID NO: 38530
  Payload ID: 7698
  Gene Symbol: HIST2H2AA4
  Gene Name: histone cluster 2, H2aa4
  Uniprot ID: Q6FI13
  ENSP ID: ENSP00000475814

SEQ ID NO: 38532 - protein, 130 aa, Homo sapiens
  Payload ID: 7699
  Gene Symbol: HIST2H2AB
  Gene Name: histone cluster 2, H2ab
  Uniprot ID: Q8IUE6
  ENSP ID: ENSP00000332790
MSGRGKQGGKARAKAKSRSSRAGLQFPVGRVHRLLRKGNYAERVGAGAPVYLAAVLEYLTAEILELAGNAARDNKKTRIIPRHLQLAVRNDEELNKLLGGVTIAQGGVLPNIQAVLLPKKTESHKPGKNK

SEQ ID NO: 38533 - protein, 129 aa, Homo sapiens
  Payload ID: 7700
  Gene Symbol: HIST2H2AC
  Gene Name: histone cluster 2, H2ac
  Uniprot ID: Q16777
  ENSP ID: ENSP00000332194
MSGRGKQGGKARAKAKSRSSRAGLQFPVGRVHRLLRKGNYAERVGAGAPVYMAAVLEYLTAEILELAGNAARDNKKTRIIPRHLQLAIRNDEELNKLLGKVTIAQGGVLPNIQAVLLPKKTESHKAKSK

SEQ ID NO: 38534 - protein, 126 aa, Homo sapiens
  Payload ID: 7701
  Gene Symbol: HIST2H2BE
  Gene Name: histone cluster 2, H2be
  Uniprot ID: Q16778
  ENSP ID: ENSP00000358151
MPEPAKSAPAPKKGSKKAVTKAQKKDGKKRKRSRKESYSIYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 38535 - protein, 126 aa, Homo sapiens; identical to SEQ ID NO: 38534
  Payload ID: 7701
  Gene Symbol: HIST2H2BE
  Gene Name: histone cluster 2, H2be
  Uniprot ID: Q16778
  ENSP ID: ENSP00000375736

SEQ ID NO: 38536 - protein, 126 aa, Homo sapiens
  Payload ID: 7702
  Gene Symbol: HIST2H2BF
  Gene Name: histone cluster 2, H2bf
  Uniprot ID: Q5QNW6
  ENSP ID: ENSP00000358164
MPDPAKSAPAPKKGSKKAVTKVQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 38537 - protein, 134 aa, Homo sapiens
  Payload ID: 7702
  Gene Symbol: HIST2H2BF
  Gene Name: histone cluster 2, H2bf
  Uniprot ID: Q5QNW6
  ENSP ID: ENSP00000445831
MPDPAKSAPAPKKGSKKAVTKVQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSKLIGPILWK

SEQ ID NO: 38538 - protein, 136 aa, Homo sapiens
  Payload ID: 7703
  Gene Symbol: HIST2H3PS2
  Gene Name: histone cluster 2, H3, pseudogene 2
  ENSP ID: ENSP00000476960
MARTKQTARKSTGGKAPRKQLATKAARKSAPATGGVKKPHRYRPGTVALREIRRYQKSTELLIRKLPFQRLVREIAQEFKTDLRFQSSAVMALQEAREAYLVGLFEDTNLCAIHAKRVTIMPKDIQLVSRIRGERA

SEQ ID NO: 38539 - protein, 136 aa, Homo sapiens [sequence omitted]

SEQ ID NO: 38540 - protein, 136 aa, Homo sapiens [sequence omitted]

SEQ ID NO: 38541 - protein, 136 aa, Homo sapiens [sequence omitted]

SEQ ID NO: 38542 - protein, 103 aa, Homo sapiens [sequence omitted]

SEQ ID NO: 38543 - protein, 103 aa, Homo sapiens [sequence omitted]

SEQ ID NO: 38544 - protein, 103 aa, Homo sapiens [sequence omitted]

SEQ ID NO: 38545 - protein, 103 aa, Homo sapiens [sequence omitted]

SEQ ID NO: 38546 - protein, 103 aa, Homo sapiens [sequence omitted]

SEQ ID NO: 38547 - protein, 103 aa, Homo sapiens [sequence omitted]

SEQ ID NO: 38548 - protein, 103 aa, Homo sapiens [sequence omitted]

SEQ ID NO: 38549 - protein, 130 aa, Homo sapiens
  Payload ID: 7709
  Gene Symbol: HIST3H2A
  Gene Name: histone cluster 3, H2a
  Uniprot ID: Q7L7L0
  ENSP ID: ENSP00000355656
MSGRGKQGGKARAKAKSRSSRAGLQFPVGRVHRLLRKGNYSERVGAGAPVYLAAVLEYLTAEILELAGNAARDNKKTRIIPRHLQLAIRNDEELNKLLGRVTIAQGGVLPNIQAVLLPKKTESHHKAKGK

SEQ ID NO: 38550 - protein, 126 aa, Homo sapiens
  Payload ID: 7710
  Gene Symbol: HIST3H2BB
  Gene Name: histone cluster 3, H2bb
  Uniprot ID: Q8N257
  ENSP ID: ENSP00000479284
MPDPSKSAPAPKKGSKKAVTKAQKKDGKKRKRGRKESYSIYVYKVLKQVHPDTGISSKAMGIMNSFVNDIFERIASEASRLAHYNKRSTITSREVQTAVRLLLPGELAKHAVSEGTKAVTKYTSSK

SEQ ID NO: 38551 - protein, 136 aa, Homo sapiens
  Payload ID: 7711
  Gene Symbol: HIST3H3
  Gene Name: histone cluster 3, H3
  Uniprot ID: Q16695
  ENSP ID: ENSP00000355657
MARTKQTARKSTGGKAPRKQLATKVARKSAPATGGVKKPHRYRPGTVALREIRRYQKSTELLIRKLPFQRLMREIAQDFKTDLRFQSSAVMALQEACESYLVGLFEDTNLCVIHAKRVTIMPKDIQLARRIRGERA

SEQ ID NO: 38552 - protein, 103 aa, Homo sapiens [sequence omitted]

SEQ ID NO: 38553 - protein, 103 aa, Homo sapiens [sequence omitted]

SEQ ID NO: 38554 - protein, 482 aa, Homo sapiens
  Payload ID: 7713
  Gene Symbol: HDAC1
  Gene Name: histone deacetylase 1
  Uniprot ID: Q13547
  ENSP ID: ENSP00000362649
MAQTQGTRRKVCYYYDGDVGNYYYGQGHPMKPHRIRMTHNLLLNYGLYRKMEIYRPHKANAEEMTKYHSDDYIKFLRSIRPDNMSEYSKQMQRFNVGEDCPVFDGLFEFCQLSTGGSVASAVKLNKQQTDIAVNWAGGLHHAKKSEASGFCYVNDIVLAILELLKYHQRVLYIDIDIHHGDGVEEAFYTTDRVMTVSFHKYGEYFPGTGDLRDIGAGKGKYYAVNYPLRDGIDDESYEAIFKPVMSKVMEMFQPSAVVLQCGSDSLSGDRLGCFNLTIKGHAKCVEFVKSFNLPMLMLGGGGYTIRNVARCWTYETAVALDTEIPNELPYNDYFEYFGPDFKLHISPSNMTNQNTNEYLEKIKQRLFENLRMLPHAPGVQMQAIPEDAIPEESGDEDEDDPDKRISICSSDKRIACEEEFSDSEEEGEGGRKNSSNFKKAKRVKTEDEKEKDPEEKKEVTEEEKTKEEKPEAKGVKEEVKLA

SEQ ID NO: 38555 - protein, 211 aa, Homo sapiens
  Payload ID: 7713
  Gene Symbol: HDAC1
  Gene Name: histone deacetylase 1
  ENSP ID: ENSP00000407859
MAQTQGTRRKVCYYYDGDVGNYYYGQGHPMKPHRIRMTHNLLLNYGLYRKMEIYRPHKANAEEMTKYHSDDYIKFLRSIRPDNMSEYSKQMQRSSAVKLNKQQTDIAVNWAGGLHHAKKSEASGFCYVNDIVLAILELLKYHQRVLYIDIDIHHGDGVEEAFYTTDRVMTVSFHKYGEYFPGTGDLRDIGAGKGKYYAVNYPLRDGIDDES

SEQ ID NO: 38556 - protein, 669 aa, Homo sapiens
  Payload ID: 7714
  Gene Symbol: HDAC10
  Gene Name: histone deacetylase 10
  Uniprot ID: Q969S8
  ENSP ID: ENSP00000216271
MGTALVYHEDMTATRLLWDDPECEIERPERLTAALDRLRQRGLEQRCLRLSAREASEEELGLVHSPEYVSLVRETQVLGKEELQALSGQFDAIYFHPSTFHCARLAAGAGLQLVDAVLTGAVQNGLALVRPPGHHGQRAAANGFCVFNNVAIAAAHAKQKHGLHRILVVDWDVHHGQGIQYLFEDDPSVLYFSWHRYEHGRFWPFLRESDADAVGRGQGLGFTVNLPWNQVGMGNADYVAAFLHLLLPLAFEFDPELVLVSAGFDSAIGDPEGQMQATPECFAHLTQLLQVLAGGRVCAVLEGGYHLESLAESVCMTVQTLLGDPAPPLSGPMAPCQSALESIQSARAAQAPHWKSLQQQDVTAVPMSPSSHSPEGRPPPLLPGGPVCKAAASAPSSLLDQPCLCPAPSVRTAVALTTPDITLVLPPDVIQQEASALREETEAWARPHESLAREEALTALGKLLYLLDGMLDGQVNSGIAATPASAAAATLDVAVRRGLSHGAQRLLCVALGQLDRPPDLAHDGRSLWLNIRGKEAAALSMFHVSTPLPVMTGGFLSCILGLVLPLAYGFQPDLVLVALGPGHGLQGPHAALLAAMLRGLAGGRVLALLEENSTPQLAGILARVLNGEAPPSLGPSSVASPEDVQALMYLRGQLEPQWKMLQCHPHLVA

SEQ ID NO: 38557 - protein, 649 aa, Homo sapiens
  Payload ID: 7714
  Gene Symbol: HDAC10
  Gene Name: histone deacetylase 10
  Uniprot ID: Q969S8
  ENSP ID: ENSP00000343540
MGTALVYHEDMTATRLLWDDPECEIERPERLTAALDRLRQRGLEQRCLRLSAREASEEELGLVHSPEYVSLVRETQVLGKEELQALSGQFDAIYFHPSTFHCARLAAGAGLQLVDAVLTGAVQNGLALVRPPGHHGQRAAANGFCVFNNVAIAAAHAKQKHGLHRILVVDWDVHHGQGIQYLFEDDPSVLYFSWHRYEHGRFWPFLRESDADAVGRGQGLGFTVNLPWNQVGMGNADYVAAFLHLLLPLAFEGQMQATPECFAHLTQLLQVLAGGRVCAVLEGGYHLESLAESVCMTVQTLLGDPAPPLSGPMAPCQSALESIQSARAAQAPHWKSLQQQDVTAVPMSPSSHSPEGRPPPLLPGGPVCKAAASAPSSLLDQPCLCPAPSVRTAVALTTPDITLVLPPDVIQQEASALREETEAWARPHESLAREEALTALGKLLYLLDGMLDGQVNSGIAATPASAAAATLDVAVRRGLSHGAQRLLCVALGQLDRPPDLAHDGRSLWLNIRGKEAAALSMFHVSTPLPVMTGGFLSCILGLVLPLAYGFQPDLVLVALGPGHGLQGPHAALLAAMLRGLAGGRVLALLEENSTPQLAGILARVLNGEAPPSLGPSSVASPEDVQALMYLRGQLEPQWKMLQCHPHLVA

SEQ ID NO: 38558 - protein, 96 aa, Homo sapiens
  Payload ID: 7714
  Gene Symbol: HDAC10
  Gene Name: histone deacetylase 10
  ENSP ID: ENSP00000397517
MGTALVYHEDMTATRLLWDDPECEIERPERLTAALDRLRQRGLEQRCLRLSAREASEEELGLVHRVPFTARGWPQGLDCSWWTLCSLELCKMGLPW

SEQ ID NO: 38559 - protein, 619 aa, Homo sapiens
  Payload ID: 7714
  Gene Symbol: HDAC10
  Gene Name: histone deacetylase 10
  ENSP ID: ENSP00000397542
MGTALVYHEDMTATRLLWDDPECEIERPERLTAALDRLRQRGLEQRCLRLSAREASEEELGLVHSPEYVSLVRETQVLGKEELQALSGQFDAIYFHPSTFHCARLAAGAGLQLVDAVLTGAVQNGLALVRPPGHHGQRAAANGFCVFNNVAIAAAHAKQKHGLHRILVVDWDVHHGQGIQYLFEDDPSVLYFSWHRYEHGRFWPFLRESDADAVGRGQGLGFTVNLPWNQVGMGNADYVAAFLHLLLPLAFEGGYHLESLAESVCMTVQTLLGDPAPPLSGPMAPCQSALESIQSARAAQAPHWKSLQQQDVTAVPMSPSSHSPEGRPPPLLPGGPVCKAAASAPSSLLDQPCLCPAPSVRTAVALTTPDITLVLPPDVIQQEASALREETEAWARPHESLAREEALTALGKLLYLLDGMLDGQVNSGIAATPASAAAATLDVAVRRGLSHGAQRLLCVALGQLDRPPDLAHDGRSLWLNIRGKEAAALSMFHVSTPLPVMTGGFLSCILGLVLPLAYGFQPDLVLVALGPGHGLQGPHAALLAAMLRGLAGGRVLALLEENSTPQLAGILARVLNGEAPPSLGPSSVASPEDVQALMYLRGQLEPQWKMLQCHPHLVA

SEQ ID NO: 38560 - protein, 396 aa, Homo sapiens
  Payload ID: 7714
  Gene Symbol: HDAC10
  Gene Name: histone deacetylase 10
  Uniprot ID: Q969S8
  ENSP ID: ENSP00000406150
MGTALVYHEDMTATRLLWDDPECEIERPERLTAALDRLRQRGLEQRCLRLSAREASEEELGLVHSPEYVSLVRETQVLGKEELQALSGQFDAIYFHPSTFHCARLAAGAGLQLVDAVLTGAVQNGLALVRPPGHHGQRAAANGFCVFNNVAIAAAHAKQKHGLHRILVVDWDVHHGQGIQYLFEDDPSVLYFSWHRYEHGRFWPFLRESDADAVGRGQGLGFTVNLPWNQVGMGNADYVAAFLHLLLPLAFEGGYHLESLAESVCMTVQTLLGDPAPPLSGPMAPCQSALESIQSARAAQAPHWKSLQQQDVTAVPMSPSSHSPEGRPPPLLPGGPVCKAAASAPSSLLDQPCLCPAPSVRTAVALTTPDITLVLPPDVIQQEASALREETEAWAR

SEQ ID NO: 38561 - protein, 96 aa, Homo sapiens; identical to SEQ ID NO: 38558
  Payload ID: 7714
  Gene Symbol: HDAC10
  Gene Name: histone deacetylase 10
  ENSP ID: ENSP00000407640

SEQ ID NO: 38562 - protein, 96 aa, Homo sapiens; identical to SEQ ID NO: 38558
  Payload ID: 7714
  Gene Symbol: HDAC10
  Gene Name: histone deacetylase 10
  ENSP ID: ENSP00000486864

SEQ ID NO: 38563 - protein, 347 aa, Homo sapiens
  Payload ID: 7715
  Gene Symbol: HDAC11
  Gene Name: histone deacetylase 11
  Uniprot ID: Q96DB2
  ENSP ID: ENSP00000295757
MLHTTQLYQHVPETRWPIVYSPRYNITFMGLEKLHPFDAGKWGKVINFLKEEKLLSDSMLVEAREASEEDLLVVHTRRYLNELKWSFAVATITEIPPVIFLPNFLVQRKVLRPLRTQTGGTIMAGKLAVERGWAINVGGGFHHCSSDRGGGFCAYADITLAIKFLFERVEGISRATIIDLDAHQGNGHERDFMDDKRVYIMDVYNRHIYPGDRFAKQAIRRKVELEWGTEDDEYLDKVERNIKKSLQEHLPDVVVYNAGTDILEGDRLGGLSISPAGIVKRDELVFRMVRGRRVPILMVTSGGYQKRTARIIADSILNLFGLGLIGPESPSVSAQNSDTPLLPPAVP

SEQ ID NO: 38564 - protein, 118 aa, Homo sapiens
  Payload ID: 7715
  Gene Symbol: HDAC11
  Gene Name: histone deacetylase 11
  ENSP ID: ENSP00000384019
MGLEKLHPFDAGKWGKVINFLKEEKLLSDSMLVEAREASEEDLLVVHTRRYLNELKRPSGGRWSWSGAQRMMSTWIRWRGTSRNPSRSTCPTWWYTMQAPTSSRGTALGGCPSAQRAS

SEQ ID NO: 38565 - protein, 268 aa, Homo sapiens
  Payload ID: 7715
  Gene Symbol: HDAC11
  Gene Name: histone deacetylase 11
  ENSP ID: ENSP00000384123
MLHTTQLYQHVPETRWPIVYSPRYNITFMGLEKLHPFDAGKWGKVINFLKEEKLLSDSMLVEAREASEEDLLVVHTRRYLNELKFLFERVEGISRATIIDLDAHQGNGHERDFMDDKRVYIMDVYNRHIYPGDRFAKQAIRRKVELEWGTEDDEYLDKVERNIKKSLQEHLPDVVVYNAGTDILEGDRLGGLSISPAGIVKRDELVFRMVRGRRVPILMVTSGGYQKRTARIIADSILNLFGLGLIGPESPSVSAQNSDTPLLPPAVP

SEQ ID NO: 38566 - protein, 181 aa, Homo sapiens
  Payload ID: 7715
  Gene Symbol: HDAC11
  Gene Name: histone deacetylase 11
  ENSP ID: ENSP00000384706
MLHTTQLYQHVPETRWPIVYSPRYNITFMGLEKLHPFDAGKWGKVINFLKEAIRRKVELEWGTEDDEYLDKVERNIKKSLQEHLPDVVVYNAGTDILEGDRLGGLSISPAGIVKRDELVFRMVRGRRVPILMVTSGGYQKRTARIIADSILNLFGLGLIGPESPSVSAQNSDTPLLPPAVP

SEQ ID NO: 38567 - protein, 204 aa, Homo sapiens
  Payload ID: 7715
  Gene Symbol: HDAC11
  Gene Name: histone deacetylase 11
  ENSP ID: ENSP00000385252
MGLEKLHPFDAGKWGKVINFLKEEKLLSDSMLVEAREASEEDLLVVHTRRYLNELKWSFAVATITEIPPVIFLPNFLVQRKVLRPLRTQTGGTIMAGKLAVERGWAINVGGGFHHCSSDRGGGFCAYADITLAIKFLFERVEGISRATIIDLDAHQGNGHERDFMDDKRVYIMDVYNRHIYPGDRFAKQAIRRKVELEWGTEDD

SEQ ID NO: 38568 - protein, 247 aa, Homo sapiens
  Payload ID: 7715
  Gene Symbol: HDAC11
  Gene Name: histone deacetylase 11
  ENSP ID: ENSP00000385475
MLHTTQLYQHVPETRWPIVYSPRYNITFMGLEKLHPFDAGKWGKVINFLKEEKLLSDSMLVEAREASEEDLLVVHTRRYLNELKGNGHERDFMDDKRVYIMDVYNRHIYPGDRFAKQAIRRKVELEWGTEDDEYLDKVERNIKKSLQEHLPDVVVYNAGTDILEGDRLGGLSISPAGIVKRDELVFRMVRGRRVPILMVTSGGYQKRTARIIADSILNLFGLGLIGPESPSVSAQNSDTPLLPPAVP

SEQ ID NO: 38569 - protein, 146 aa, Homo sapiens
  Payload ID: 7715
  Gene Symbol: HDAC11
  Gene Name: histone deacetylase 11
  ENSP ID: ENSP00000385528
MLHTTQLYQHVPETRWPIVYSPRYNITFMGLEKLHPFDAGKWGKVINFLKEEKLLSDSMLVEAREASEEDLLVVHTRRYLNELKRPSGGRWSWSGAQRMMSTWIRWRGTSRNPSRSTCPTWWYTMQAPTSSRGTALGGCPSAQRAS

SEQ ID NO: 38570 - protein, 319 aa, Homo sapiens
  Payload ID: 7715
  Gene Symbol: HDAC11
  Gene Name: histone deacetylase 11
  ENSP ID: ENSP00000395188
MGLEKLHPFDAGKWGKVINFLKEEKLLSDSMLVEAREASEEDLLVVHTRRYLNELKWSFAVATITEIPPVIFLPNFLVQRKVLRPLRTQTGGTIMAGKLAVERGWAINVGGGFHHCSSDRGGGFCAYADITLAIKFLFERVEGISRATIIDLDAHQGNGHERDFMDDKRVYIMDVYNRHIYPGDRFAKQAIRRKVELEWGTEDDEYLDKVERNIKKSLQEHLPDVVVYNAGTDILEGDRLGGLSISPAGIVKRDELVFRMVRGRRVPILMVTSGGYQKRTARIIADSILNLFGLGLIGPESPSVSAQNSDTPLLPPAVP

SEQ ID NO: 38571 - protein, 166 aa, Homo sapiens
  Payload ID: 7715
  Gene Symbol: HDAC11
  Gene Name: histone deacetylase 11
  ENSP ID: ENSP00000396122
MGLEKLHPFDAGKWGKVINFLKEEKLLSDSMLVEAREASEEDLLVVHTRRYLNELKWSFAVATITEIPPVIFLPNFLVQRKVLRPLRTQTGGTIMAGKLAVERGWAINVGGGFHHCSSDRGGGFCAYADITLAIKFLFERVEGISRATIIDLDAHQGNGHERDFMD

SEQ ID NO: 38572 - protein, 168 aa, Homo sapiens
  Payload ID: 7715
  Gene Symbol: HDAC11
  Gene Name: histone deacetylase 11
  ENSP ID: ENSP00000398651
MGRVSSAAGSGDPRPPPWLRLHTTQLYQHVPETRWPIVYSPRYNITFMGLEKLHPFDAGKWGKVINFLKEEKLLSDSMLVEAREASEEDLLVVHTRRYLNELKGVASTTAPATVAGASVPMRTSRSPSSFCLSVWRASPGLPSLILMPIRAMGMSETSWTTSVCTSWM

SEQ ID NO: 38573 - protein, 53 aa, Homo sapiens
  Payload ID: 7715
  Gene Symbol: HDAC11
  Gene Name: histone deacetylase 11
  ENSP ID: ENSP00000399792
MLHTTQLYQHVPETRWPIVYSPRYNITFMGLEKLHPFDAGKWGKVINFLKVSV

SEQ ID NO: 38574 - protein, 236 aa, Homo sapiens
  Payload ID: 7715
  Gene Symbol: HDAC11
  Gene Name: histone deacetylase 11
  ENSP ID: ENSP00000401487
MGLEKLHPFDAGKWGKVINFLKEEKLLSDSMLVEAREASEEDLLVVHTRRYLNELKWSFAVATITEIPPVIFLPNFLVQRKVLRPLRTQTGGTIMGVASTTAPATVAGASVPMRTSRSPSSFCLSVWRASPGLPSLILMPIRAMGMSETSWTTSVCTSWMSTTATSTQGTALPSRPSGGRWSWSGAQRMMSTWIRWRGTSRNPSRSTCPTWWYTMQAPTSSRGTALGGCPSAQRAS

SEQ ID NO: 38575 - protein, 91 aa, Homo sapiens
  Payload ID: 7715
  Gene Symbol: HDAC11
  Gene Name: histone deacetylase 11
  ENSP ID: ENSP00000402298
MGLEKLHPFDAGKWGKVINFLKEEKLLSDSMLVEAREASEEDLLVVHTRRYLNELKWSFAVATITEIPPVIFLPNFLVQRKVLRPLRTQTG

SEQ ID NO: 38576 - protein, 107 aa, Homo sapiens
  Payload ID: 7715
  Gene Symbol: HDAC11
  Gene Name: histone deacetylase 11
  ENSP ID: ENSP00000411792
MGRVSSAAGSGDPRPPPWLRLHTTQLYQHVPETRWPIVYSPRYNITFMGLEKLHPFDAGKWGKVINFLKEEKLLSDSMLVEAREASEEDLLVVHTRRYLNELKWSFA

SEQ ID NO: 38577 - protein, 236 aa, Homo sapiens; identical to SEQ ID NO: 38574
  Payload ID: 7715
  Gene Symbol: HDAC11
  Gene Name: histone deacetylase 11
  ENSP ID: ENSP00000412514

SEQ ID NO: 38578 - protein, 296 aa, Homo sapiens
  Payload ID: 7715
  Gene Symbol: HDAC11
  Gene Name: histone deacetylase 11
  Uniprot ID: Q96DB2
  ENSP ID: ENSP00000429794
MGLEKLHPFDAGKWGKVINFLKEEKLLSDSMLVEAREASEEDLLVVHTRRYLNELKRKVLRPLRTQTGGTIMAGKLAVERGWAINVGGGFHHCSSDRGGGFCAYADITLAIKFLFERVEGISRATIIDLDAHQGNGHERDFMDDKRVYIMDVYNRHIYPGDRFAKQAIRRKVELEWGTEDDEYLDKVERNIKKSLQEHLPDVVVYNAGTDILEGDRLGGLSISPAGIVKRDELVFRMVRGRRVPILMVTSGGYQKRTARIIADSILNLFGLGLIGPESPSVSAQNSDTPLLPPAVP

SEQ ID NO: 38579 - protein, 458 aa, Homo sapiens
  Payload ID: 7716
  Gene Symbol: HDAC2
  Gene Name: histone deacetylase 2
  Uniprot ID: Q92769
  ENSP ID: ENSP00000357621
MKPHRIRMTHNLLLNYGLYRKMEIYRPHKATAEEMTKYHSDEYIKFLRSIRPDNMSEYSKQMQRFNVGEDCPVFDGLFEFCQLSTGGSVAGAVKLNRQQTDMAVNWAGGLHHAKKSEASGFCYVNDIVLAILELLKYHQRVLYIDIDIHHGDGVEEAFYTTDRVMTVSFHKYGEYFPGTGDLRDIGAGKGKYYAVNFPMRDGIDDESYGQIFKPIISKVMEMYQPSAVVLQCGADSLSGDRLGCFNLTVKGHAKCVEVVKTFNLPLLMLGGGGYTIRNVARCWTYETAVALDCEIPNELPYNDYFEYFGPDFKLHISPSNMTNQNTPEYMEKIKQRLFENLRMLPHAPGVQMQAIPEDAVHEDSGDEDGEDPDKRISIRASDKRIACDEEFSDSEDEGEGGRRNVADHKKGAKKARIEEDKKETEDKKTDVKEEDKSKDNSGEKTDTKGTKSEQLSNP

SEQ ID NO: 38580 - protein, 161 aa, Homo sapiens
  Payload ID: 7716
  Gene Symbol: HDAC2
  Gene Name: histone deacetylase 2
  ENSP ID: ENSP00000417026
KVCYYYDGDIGNYYYGQGHPMKPHRIRMTHNLLLNYGLYRKMEIYRPHKATAEEMTKYHSDEYIKFLRSIRPDNMSEYSKQMQRFNVGEDCPVFDGLFEFCQLSTGGSVAGAVKLNRQQTDMAVNWAGGLHHAKKSEASGFCYVNDIVLAILELLKYVNLY

SEQ ID NO: 38581 - protein, 103 aa, Homo sapiens
  Payload ID: 7716
  Gene Symbol: HDAC2
  Gene Name: histone deacetylase 2
  ENSP ID: ENSP00000427861
MKPHRIRMTHNLLLNYGLYRKMEIYRPHKATAEEMTKYHSDEYIKFLRSIRPDNMSEYSKQMQRFNVGEDCPVFDGLFEFCQLSTGGSVAGAVKLNRQQTDMA

SEQ ID NO: 38582 - protein, 109 aa, Homo sapiens
  Payload ID: 7716
  Gene Symbol: HDAC2
  Gene Name: histone deacetylase 2
  ENSP ID: ENSP00000428024
MAYSQGGGKKKVCYYYDVCVFSILGDIGNYYYGQGHPMKPHRIRMTHNLLLNYGLYRKMEIYRPHKATAEEMTKYHSDEYIKFLRSIRPDNMSEYSKQMQRFNVGEDCP

SEQ ID NO: 38583 - protein, 86 aa, Homo sapiens
  Payload ID: 7716
  Gene Symbol: HDAC2
  Gene Name: histone deacetylase 2
  ENSP ID: ENSP00000428599
MKPHRIRMTHNLLLNYGLYRKMEIYRPHKATAEEMTKYHSDEYIKFLRSIRPDNMSEYSKQMQRFNVGEDCPVFDGLFEFCQLSTG

SEQ ID NO: 38584 - protein, 71 aa, Homo sapiens
  Payload ID: 7716
  Gene Symbol: HDAC2
  Gene Name: histone deacetylase 2
  ENSP ID: ENSP00000428653
MKPHRIRMTHNLLLNYGLYRKMEIYRPHKATAEEMTKYHSDEYIKFLRSIRPDNMSEYSKQMQRFNVGEDC

SEQ ID NO: 38585 - protein, 60 aa, Homo sapiens
  Payload ID: 7716
  Gene Symbol: HDAC2
  Gene Name: histone deacetylase 2
  ENSP ID: ENSP00000428861
MKPHRIRMTHNLLLNYGLYRKMEIYRPHKATAEEMTKYHSDEYIKFLRSIRPDNMSEYSK

SEQ ID NO: 38586 - protein, 52 aa, Homo sapiens
  Payload ID: 7716
  Gene Symbol: HDAC2
  Gene Name: histone deacetylase 2
  ENSP ID: ENSP00000428989
MKPHRIRMTHNLLLNYGLYRKMEIYRPHKATAEEMTKYHSDEYIKFLRSIRP

SEQ ID NO: 38587 - protein, 65 aa, Homo sapiens
  Payload ID: 7716
  Gene Symbol: HDAC2
  Gene Name: histone deacetylase 2
  ENSP ID: ENSP00000429236
MKPHRIRMTHNLLLNYGLYRKMEIYRPHKATAEEMTKYHSDEYIKFLRSIRPDNMSEYSKQMQRF

SEQ ID NO: 38588 - protein, 100 aa, Homo sapiens
  Payload ID: 7716
  Gene Symbol: HDAC2
  Gene Name: histone deacetylase 2
  ENSP ID: ENSP00000429901
MKPHRIRMTHNLLLNYGLYRKMEIYRPHKATAEEMTKYHSDEYIKFLRSIRPDNMSEYSKQMQRFNVGEDCPVFDGLFEFCQLSTGGSVAGAVKLNRQQT

SEQ ID NO: 38589 - protein, 458 aa, Homo sapiens; identical to SEQ ID NO: 38579
  Payload ID: 7716
  Gene Symbol: HDAC2
  Gene Name: histone deacetylase 2
  Uniprot ID: Q92769
  ENSP ID: ENSP00000430008

SEQ ID NO: 38590 - protein, 488 aa, Homo sapiens
  Payload ID: 7716
  Gene Symbol: HDAC2
  Gene Name: histone deacetylase 2
  Uniprot ID: Q92769
  ENSP ID: ENSP00000430432
MAYSQGGGKKKVCYYYDGDIGNYYYGQGHPMKPHRIRMTHNLLLNYGLYRKMEIYRPHKATAEEMTKYHSDEYIKFLRSIRPDNMSEYSKQMQRFNVGEDCPVFDGLFEFCQLSTGGSVAGAVKLNRQQTDMAVNWAGGLHHAKKSEASGFCYVNDIVLAILELLKYHQRVLYIDIDIHHGDGVEEAFYTTDRVMTVSFHKYGEYFPGTGDLRDIGAGKGKYYAVNFPMRDGIDDESYGQIFKPIISKVMEMYQPSAVVLQCGADSLSGDRLGCFNLTVKGHAKCVEVVKTFNLPLLMLGGGGYTIRNVARCWTYETAVALDCEIPNELPYNDYFEYFGPDFKLHISPSNMTNQNTPEYMEKIKQRLFENLRMLPHAPGVQMQAIPEDAVHEDSGDEDGEDPDKRISIRASDKRIACDEEFSDSEDEGEGGRRNVADHKKGAKKARIEEDKKETEDKKTDVKEEDKSKDNSGEKTDTKGTKSEQLSNP

SEQ ID NO: 38591 - protein, 428 aa, Homo sapiens
  Payload ID: 7717
  Gene Symbol: HDAC3
  Gene Name: histone deacetylase 3
  Uniprot ID: O15379
  ENSP ID: ENSP00000302967
MAKTVAYFYDPDVGNFHYGAGHPMKPHRLALTHSLVLHYGLYKKMIVFKPYQASQHDMCRFHSEDYIDFLQRVSPTNMQGFTKSLNAFNVGDDCPVFPGLFEFCSRYTGASLQGATQLNNKICDIAINWAGGLHHAKKFEASGFCYVNDIVIGILELLKYHPRVLYIDIDIHHGDGVQEAFYLTDRVMTVSFHKYGNYFFPGTGDMYEVGAESGRYYCLNVPLRDGIDDQSYKHLFQPVINQVVDFYQPTCIVLQCGADSLGCDRLGCFNLSIRGHGECVEYVKSFNIPLLVLGGGGYTVRNVARCWTYETSLLVEEAISEELPYSEYFEYFAPDFTLHPDVSTRIENQNSRQYLDQIRQTIFENLKMLNHAPSVQIHDVPADLLTYDRTDEADAEERGPEENYSRPEAPNEFYDGDHDNDKESDVEI

SEQ ID NO: 38592 - protein, 218 aa, Homo sapiens
  Payload ID: 7717
  Gene Symbol: HDAC3
  Gene Name: histone deacetylase 3
  ENSP ID: ENSP00000429099
MAKTVAYFYDPDVGNFHYGAGHPMKPHRLALTHSLVLHYGLYKKMIICDIAINWAGGLHHAKKFEASGFCYVNDIVIGILELLKYHPRVLYIDIDIHHGDGVQEAFYLTDRVMTVSFHKYGNYFFPGTGDMYEVGAESGRYYCLNVPLRDGIDDQSYKHLFQPVINQVVDFYQPTCIVLQCGADSLGCDRLGCFNLSIRGHGECVEYVKSFNIPLLVL

SEQ ID NO: 38593 - protein, 53 aa, Homo sapiens
  Payload ID: 7717
  Gene Symbol: HDAC3
  Gene Name: histone deacetylase 3
  ENSP ID: ENSP00000430782
MAKTVAYFYDPDVGNFHYGAGHPMKPHRLALTHSLVLHYGLYKKMIPSVSRAL

SEQ ID NO: 38594 - protein, 1084 aa, Homo sapiens
  Payload ID: 7718
  Gene Symbol: HDAC4
  Gene Name: histone deacetylase 4
  Uniprot ID: P56524
  ENSP ID: ENSP00000264606
MSSQSHPDGLSGRDQPVELLNPARVNHMPSTVDVATALPLQVAPSAVPMDLRLDHQFSLPVAEPALREQQLQQELLALKQKQQIQRQILIAEFQRQHEQLSRQHEAQLHEHIKQQQEMLAMKHQQELLEHQRKLERHRQEQELEKQHREQKLQQLKNKEKGKESAVASTEVKMKLQEFVLNKKKALAHRNLNHCISSDPRYWYGKTQHSSLDQSSPPQSGVSTSYNHPVLGMYDAKDDFPLRKTASEPNLKLRSRLKQKVAERRSSPLLRRKDGPVVTALKKRPLDVTDSACSSAPGSGPSSPNNSSGSVSAENGIAPAVPSIPAETSLAHRLVAREGSAAPLPLYTSPSLPNITLGLPATGPSAGTAGQQDAERLTLPALQQRLSLFPGTHLTPYLSTSPLERDGGAAHSPLLQHMVLLEQPPAQAPLVTGLGALPLHAQSLVGADRVSPSIHKLRQHRPLGRTQSAPLPQNAQALQHLVIQQQHQQFLEKHKQQFQQQQLQMNKIIPKPSEPARQPESHPEETEEELREHQALLDEPYLDRLPGQKEAHAQAGVQVKQEPIESDEEEAEPPREVEPGQRQPSEQELLFRQQALLLEQQRIHQLRNYQASMEAAGIPVSFGGHRPLSRAQSSPASATFPVSVQEPPTKPRFTTGLVYDTLMLKHQCTCGSSSSHPEHAGRIQSIWSRLQETGLRGKCECIRGRKATLEELQTVHSEAHTLLYGTNPLNRQKLDSKKLLGSLASVFVRLPCGGVGVDSDTIWNEVHSAGAARLAVGCVVELVFKVATGELKNGFAVVRPPGHHAEESTPMGFCYFNSVAVAAKLLQQRLSVSKILIVDWDVHHGNGTQQAFYSDPSVLYMSLHRYDDGNFFPGSGAPDEVGTGPGVGFNVNMAFTGGLDPPMGDAEYLAAFRTVVMPIASEFAPDVVLVSSGFDAVEGHPTPLGGYNLSARCFGYLTKQLMGLAGGRIVLALEGGHDLTAICDASEACVSALLGNELDPLPEKVLQQRPNANAVRSMEKVMEIHSKYWRCLQRTTSTAGRSLIEAQTCENEEAETVTAMASLSVGVKPAEKRPDEEPMEEEPPL

SEQ ID NO: 38595 - protein, 148 aa, Homo sapiens
  Payload ID: 7718
  Gene Symbol: HDAC4
  Gene Name: histone deacetylase 4
  ENSP ID: ENSP00000391226
  MOD_RES (1)..(1): Any amino acid
XWLYLFPHPPHPPHCGSGLYLQSHHLQQAWIPHSACSSAPGSGPSSPNNSSGSVSAENGIAPAVPSIPAETSLAHRLVAREGSAAPLPLYTSPSLPNITLGLPATGPSAGTAGQQDAERLTLPALQQRLSLFPGTHLTPYLSTSPLER

SEQ ID NO: 38596 - protein, 123 aa, Homo sapiens
  Payload ID: 7718
  Gene Symbol: HDAC4
  Gene Name: histone deacetylase 4
  ENSP ID: ENSP00000392912
MPSTVDVATALPLQVAPSAVPMDLRLDHQFSLPVAEPALREQQLQQELLALKQKQQIQRQILIAEFQRQHEQLSRQHEAQLHEHIKQQQEMLAMKHQQELLEHQRKLERHRQEQELEKQHREQ

SEQ ID NO: 38597 - protein, 162 aa, Homo sapiens
  Payload ID: 7718
  Gene Symbol: HDAC4
  Gene Name: histone deacetylase 4
  ENSP ID: ENSP00000405226
MDVATALPLQVAPSAVPMDLRLDHQFSLPVAEPALREQQLQQELLALKQKQQIQRQILIAEFQRQHEQLSRQHEAQLHEHIKQQQEMLAMKHQQELLEHQRKLERHRQEQELEKQHREQKLQQLKNKEKGKESAVASTEVKMKLQEFVLNKKKALAHRNLNH

SEQ ID NO: 38598 - protein, 175 aa, Homo sapiens
  Payload ID: 7718
  Gene Symbol: HDAC4
  Gene Name: histone deacetylase 4
  ENSP ID: ENSP00000410551
  MOD_RES (1)..(1): Any amino acid
XAWPCVSTPQPPVFLRCHETRFWAVLAAVLPRSHCSLPFPVAGFGYLTKQLMGLAGGRIVLALEGGHDLTAICDASEACVSALLGNELDPLPEKVLQQRPNANAVRSMEKVMEIHSKYWRCLQRTTSTAGRSLIEAQTCENEEAETVTAMASLSVGVKPAEKRPDEEPMEEEPPL

SEQ ID NO: 38599 - protein, 29 aa, Homo sapiens
  Payload ID: 7718
  Gene Symbol: HDAC4
  Gene Name: histone deacetylase 4
  ENSP ID: ENSP00000438111
MSSQSHPDGLSGRDQPVELLNPARVNHMP

SEQ ID NO: 38600 - protein, 972 aa, Homo sapiens
  Payload ID: 7718
  Gene Symbol: HDAC4
  Gene Name: histone deacetylase 4
  Uniprot ID: P56524
  ENSP ID: ENSP00000440481
MLAMKHQQELLEHQRKLERHRQEQELEKQHREQKLQQLKNKEKGKESAVASTEVKMKLQEFVLNKKKALAHRNLNHCISSDPRYWYGKTQHSSLDQSSPPQSGVSTSYNHPVLGMYDAKDDFPLRKTASEPNLKLRSRLKQKVAERRSSPLLRRKDGPVVTALKKRPLDVTDSACSSAPGSGPSSPNNSSGSVSAENGIAPAVPSIPAETSLAHRLVAREGSAAPLPLYTSPSLPNITLGLPATGPSAGTAGQQDAERLTLPALQQRLSLFPGTHLTPYLSTSPLERDGGAAHSPLLQHMVLLEQPPAQAPLVTDWYLSGLGALPLHAQSLVGADRVSPSIHKLRQHRPLGRTQSAPLPQNAQALQHLVIQQQHQQFLEKHKQQFQQQQLQMNKIIPKPSEPARQPESHPEETEEELREHQALLDEPYLDRLPGQKEAHAQAGVQVKQEPIESDEEEAEPPREVEPGQRQPSEQELLFRQQALLLEQQRIHQLRNYQASMEAAGIPVSFGGHRPLSRAQSSPASATFPVSVQEPPTKPRFTTGLVYDTLMLKHQCTCGSSSSHPEHAGRIQSIWSRLQETGLRGKCECIRGRKATLEELQTVHSEAHTLLYGTNPLNRQKLDSKKLLGSLASVFVRLPCGGVGVDSDTIWNEVHSAGAARLAVGCVVELVFKVATGELKNGFAVVRPPGHHAEESTPMGFCYFNSVAVAAKLLQQRLSVSKILIVDWDVHHGNGTQQAFYSDPSVLYMSLHRYDDGNFFPGSGAPDEVGTGPGVGFNVNMAFTGGLDPPMGDAEYLAAFRTVVMPIASEFAPDVVLVSSGFDAVEGHPTPLGGYNLSARCFGYLTKQLMGLAGGRIVLALEGGHDLTAICDASEACVSALLGNELDPLPEKVLQQRPNANAVRSMEKVMEIHSKYWRCLQRTTSTAGRSLIEAQTCENEEAETVTAMASLSVGVKPAEKRPDEEPMEEEPPL

SEQ ID NO: 38601 - protein, 1123 aa, Homo sapiens
  Payload ID: 7719
  Gene Symbol: HDAC5
  Gene Name: histone deacetylase 5
  Uniprot ID: Q9UQL6
  ENSP ID: ENSP00000225983
MNSPNESADGMSGREPSLEILPRTSLHSIPVTVEVKPVLPRAMPSSMGGGGGGSPSPVELRGALVGSVDPTLREQQLQQELLALKQQQQLQKQLLFAEFQKQHDHLTRQHEVQLQKHLKQQQEMLAAKQQQEMLAAKRQQELEQQRQREQQRQEELEKQRLEQQLLILRNKEKSKESAIASTEVKLRLQEFLLSKSKEPTPGGLNHSLPQHPKCWGAHHASLDQSSPPQSGPPGTPPSYKLPLPGPYDSRDDFPLRKTASEPNLKVRSRLKQKVAERRSSPLLRRKDGTVISTFKKRAVEITGAGPGASSVCNSAPGSGPSSPNSSHSTIAENGFTGSVPNIPTEMLPQHRALPLDSSPNQFSLYTSPSLPNISLGLQATVTVTNSHLTASPKLSTQQEAERQALQSLRQGGTLTGKFMSTSSIPGCLLGVALEGDGSPHGHASLLQHVLLLEQARQQSTLIAVPLHGQSPLVTGERVATSMRTVGKLPRHRPLSRTQSSPLPQSPQALQQLVMQQQHQQFLEKQKQQQLQLGKILTKTGELPRQPTTHPEETEEELTEQQEVLLGEGALTMPREGSTESESTQEDLEEEDEEDDGEEEEDCIQVKDEEGESGAEEGPDLEEPGAGYKKLFSDAQPLQPLQVYQAPLSLATVPHQALGRTQSSPAAPGGMKSPPDQPVKHLFTTGVVYDTFMLKHQCMCGNTHVHPEHAGRIQSIWSRLQETGLLSKCERIRGRKATLDEIQTVHSEYHTLLYGTSPLNRQKLDSKKLLGPISQKMYAVLPCGGIGVDSDTVWNEMHSSSAVRMAVGCLLELAFKVAAGELKNGFAIIRPPGHHAEESTAMGFCFFNSVAITAKLLQQKLNVGKVLIVDWDIHHGNGTQQAFYNDPSVLYISLHRYDNGNFFPGSGAPEEVGGGPGVGYNVNVAWTGGVDPPIGDVEYLTAFRTVVMPIAHEFSPDVVLVSAGFDAVEGHLSPLGGYSVTARCFGHLTRQLMTLAGGRVVLALEGGHDLTAICDASEACVSALLSVELQPLDEAVLQQKPNINAVATLEKVIEIQSKHWSCVQKFAAGLGRSLREAQAGETEEAETVSAMALLSVGAEQAQAAAAREHSPRPAEEPMEQEPAL

SEQ ID NO: 38602 - protein, 1037 aa, Homo sapiens
  Payload ID: 7719
  Gene Symbol: HDAC5
  Gene Name: histone deacetylase 5
  Uniprot ID: Q9UQL6
  ENSP ID: ENSP00000337290
MNSPNESDGMSGREPSLEILPRTSLHSIPVTVEVKPVLPRAMPSSMGGGGGGSPSPVELRGALVGSVDPTLREQQLQQELLALKQQQQLQKQLLFAEFQKQHDHLTRQHEVQLQKHLKQQQEMLAAKQQQEMLAAKRQQELEQQRQREQQRQEELEKQRLEQQLLILRNKEKSKESAIASTEVKLRLQEFLLSKSKEPTPGGLNHSLPQHPKCWGAHHASLDQSSPPQSGPPGTPPSYKLPLPGPYDSRDDFPLRKTASEPNLKVRSRLKQKVAERRSSPLLRRKDGTVISTFKKRAVEITGAGPGASSVCNSAPGSGPSSPNSSHSTIAENGFTGSVPNIPTEMLPQHRALPLDSSPNQFSLYTSPSLPNISLGLQATVTVTNSHLTASPKLSTQQEAERQALQSLRQGGTLTGKFMSTSSIPGCLLGVALEGDGSPHGHASLLQHVLLLEQARQQSTLIAVPLHGQSPLVTGERVATSMRTVGKLPRHRPLSRTQSSPLPQSPQALQQLVMQQQHQQFLEKQKQQQLQLGKILTKTGELPRQPTTHPEETEEELTEQQEVLLGEGALTMPREGSTESESTQEDLEEEDEEDDGEEEEDCIQVKDEEGESGAEEGPDLEEPGAGYKKLFSDAQPLQPLQVYQAPLSLATVPHQALGRTQSSPAAPGGMKSPPDQPVKHLFTTGPISQKMYAVLPCGGIGVDSDTVWNEMHSSSAVRMAVGCLLELAFKVAAGELKNGFAIIRPPGHHAEESTAMGFCFFNSVAITAKLLQQKLNVGKVLIVDWDIHHGNGTQQAFYNDPSVLYISLHRYDNGNFFPGSGAPEEVGGGPGVGYNVNVAWTGGVDPPIGDVEYLTAFRTVVMPIAHEFSPDVVLVSAGFDAVEGHLSPLGGYSVTARCFGHLTRQLMTLAGGRVVLALEGGHDLTAICDASEACVSALLSVELQPLDEAVLQQKPNINAVATLEKVIEIQSKHWSCVQKFAAGLGRSLREAQAGETEEAETVSAMALLSVGAEQAQAAAAREHSPRPAEEPMEQEPAL

SEQ ID NO: 38603 - protein, 282 aa, Homo sapiens
  Payload ID: 7719
  Gene Symbol: HDAC5
  Gene Name: histone deacetylase 5
  ENSP ID: ENSP00000465227
  MOD_RES (1)..(1): Any amino acid
XVKLRLQEFLLSKSKEPTPGGLNHSLPQHPKCWGAHHASLDQSSPPQSGPPGTPPSYKLPLPGPYDSRDDFPLRKTASSVCNSAPGSGPSSPNSSHSTIAENGFTGSVPNIPTEMLPQHRALPLDSSPNQFSLYTSPSLPNISLGLQATVTVTNSHLTASPKLSTQQEAERQALQSLRQGGTLTGKFMSTSSIPGCLLGVALEGDGSPHGHASLLQHVLLLEQARQQSTLIAVPLHGQSPLVTGERVATSMRTVGKLPRHRPLSRTQSSPLPQSPQALQQLV

SEQ ID NO: 38604 - protein, 79 aa, Homo sapiens
  Payload ID: 7719
  Gene Symbol: HDAC5
  Gene Name: histone deacetylase 5
  ENSP ID: ENSP00000465229
MSGREPSLEILPRTSLHSIPVTVEVKPVLPRAMPSSMGGGGGGSPSPVELRGALVGSVDPTLREQQLQQELLALKQQQQ

SEQ ID NO: 38605 - protein, 40 aa, Homo sapiens
  Payload ID: 7719
  Gene Symbol: HDAC5
  Gene Name: histone deacetylase 5
  ENSP ID: ENSP00000465393
MSGREPSLEILPRTSLHSIPVTVEVKPVLPRAMPSSMGGG

SEQ ID NO: 38606 - protein, 1122 aa, Homo sapiens
  Payload ID: 7719
  Gene Symbol: HDAC5
  Gene Name: histone deacetylase 5
  Uniprot ID: Q9UQL6
  ENSP ID: ENSP00000468004
MNSPNESDGMSGREPSLEILPRTSLHSIPVTVEVKPVLPRAMPSSMGGGGGGSPSPVELRGALVGSVDPTLREQQLQQELLALKQQQQLQKQLLFAEFQKQHDHLTRQHEVQLQKHLKQQQEMLAAKQQQEMLAAKRQQELEQQRQREQQRQEELEKQRLEQQLLILRNKEKSKESAIASTEVKLRLQEFLLSKSKEPTPGGLNHSLPQHPKCWGAHHASLDQSSPPQSGPPGTPPSYKLPLPGPYDSRDDFPLRKTASEPNLKVRSRLKQKVAERRSSPLLRRKDGTVISTFKKRAVEITGAGPGASSVCNSAPGSGPSSPNSSHSTIAENGFTGSVPNIPTEMLPQHRALPLDSSPNQFSLYTSPSLPNISLGLQATVTVTNSHLTASPKLSTQQEAERQALQSLRQGGTLTGKFMSTSSIPGCLLGVALEGDGSPHGHASLLQHVLLLEQARQQSTLIAVPLHGQSPLVTGERVATSMRTVGKLPRHRPLSRTQSSPLPQSPQALQQLVMQQQHQQFLEKQKQQQLQLGKILTKTGELPRQPTTHPEETEEELTEQQEVLLGEGALTMPREGSTESESTQEDLEEEDEEDDGEEEEDCIQVKDEEGESGAEEGPDLEEPGAGYKKLFSDAQPLQPLQVYQAPLSLATVPHQALGRTQSSPAAPGGMKSPPDQPVKHLFTTGVVYDTFMLKHQCMCGNTHVHPEHAGRIQSIWSRLQETGLLSKCERIRGRKATLDEIQTVHSEYHTLLYGTSPLNRQKLDSKKLLGPISQKMYAVLPCGGIGVDSDTVWNEMHSSSAVRMAVGCLLELAFKVAAGELKNGFAIIRPPGHHAEESTAMGFCFFNSVAITAKLLQQKLNVGKVLIVDWDIHHGNGTQQAFYNDPSVLYISLHRYDNGNFFPGSGAPEEVGGGPGVGYNVNVAWTGGVDPPIGDVEYLTAFRTVVMPIAHEFSPDVVLVSAGFDAVEGHLSPLGGYSVTARCFGHLTRQLMTLAGGRVVLALEGGHDLTAICDASEACVSALLSVELQPLDEAVLQQKPNINAVATLEKVIEIQSKHWSCVQKFAAGLGRSLREAQAGETEEAETVSAMALLSVGAEQAQAAAAREHSPRPAEEPMEQEPAL

SEQ ID NO: 38607 - protein, 68 aa, Homo sapiens
  Payload ID: 7719
  Gene Symbol: HDAC5
  Gene Name: histone deacetylase 5
  ENSP ID: ENSP00000468485
MLLVPKAQGLVEMLQTIYETESCFSADGMSGREPSLEILPRTSLHSIPVTVEVKPVLPRAMPSSMGGG

SEQ ID NO: 38608 - protein, 1215 aa, Homo sapiens
  Payload ID: 7720
  Gene Symbol: HDAC6
  Gene Name: histone deacetylase 6
  Uniprot ID: Q9UBN7
  ENSP ID: ENSP00000334061
MTSTGQDSTTTRQRRSRQNPQSPPQDSSVTSKRNIKKGAVPRSIPNLAEVKKKGKMKKLGQAMEEDLIVGLQGMDLNLEAEALAGTGLVLDEQLNEFHCLWDDSFPEGPERLHAIKEQLIQEGLLDRCVSFQARFAEKEELMLVHSLEYIDLMETTQYMNEGELRVLADTYDSVYLHPNSYSCACLASGSVLRLVDAVLGAEIRNGMAIIRPPGHHAQHSLMDGYCMFNHVAVAARYAQQKHRIRRVLIVDWDVHHGQGTQFTFDQDPSVLYFSIHRYEQGRFWPHLKASNWSTTGFGQGQGYTINVPWNQVGMRDADYIAAFLHVLLPVALEFQPQLVLVAAGFDALQGDPKGEMAATPAGFAQLTHLLMGLAGGKLILSLEGGYNLRALAEGVSASLHTLLGDPCPMLESPGAPCRSAQASVSCALEALEPFWEVLVRSTETVERDNMEEDNVEESEEEGPWEPPVLPILTWPVLQSRTGLVYDQNMMNHCNLWDSHHPEVPQRILRIMCRLEELGLAGRCLTLTPRPATEAELLTCHSAEYVGHLRATEKMKTRELHRESSNFDSIYICPSTFACAQLATGAACRLVEAVLSGEVLNGAAVVRPPGHHAEQDAACGFCFFNSVAVAARHAQTISGHALRILIVDWDVHHGNGTQHMFEDDPSVLYVSLHRYDHGTFFPMGDEGASSQIGRAAGTGFTVNVAWNGPRMGDADYLAAWHRLVLPIAYEFNPELVLVSAGFDAARGDPLGGCQVSPEGYAHLTHLLMGLASGRIILILEGGYNLTSISESMAACTRSLLGDPPPLLTLPRPPLSGALASITETIQVHRRYWRSLRVMKVEDREGPSSSKLVTKKAPQPAKPRLAERMTTREKKVLEAGMGKVTSASFGEESTPGQTNSETAVVALTQDQPSEAATGGATLAQTISEAAIGGAMLGQTTSEEAVGGATPDQTTSEETVGGAILDQTTSEDAVGGATLGQTTSEEAVGGATLAQTTSEAAMEGATLDQTTSEEAPGGTELIQTPLASSTDHQTPPTSPVQGTTPQISPSTLIGSLRTLELGSESQGASESQAPGEENLLGEAAGGQDMADSMLMQGSRGLTDQAIFYAVTPLPWCPHLVAVCPIPAAGLDVTQPCGDCGTIQENWVCLSCYQVYCGRYINGHMLQHHGNSGHPLVLSYIDLSAWCYYCQAYVHHQALLDVKNIAHQNKFGEDMPHPH

SEQ ID NO: 38609 - protein, 210 aa, Homo sapiens
  Payload ID: 7720
  Gene Symbol: HDAC6
  Gene Name: histone deacetylase 6
  ENSP ID: ENSP00000365795
MTSTGQDSTTTRQRRSRQNPQSPPQDSSVTSKRNIKKGAVPRSIPNLAEVKKKGKMKKLGQAMEEDLIVGLQGMDLNLEAEALAGTGLVLDEQLNEFHCLWDDSFPEGPERLHAIKEQLIQEGLLDRCVSFQARFAEKEELMLVHSLEYIDLMETTQYMNEGELRVLADTYDSVYLHPNSYSCACLASGSVLRLVDAVLGAEIRNGMAII

SEQ ID NO: 38610 - protein, 1215 aa, Homo sapiens; identical to SEQ ID NO: 38608
  Payload ID: 7720
  Gene Symbol: HDAC6
  Gene Name: histone deacetylase 6
  Uniprot ID: Q9UBN7
  ENSP ID: ENSP00000365804

SEQ ID NO: 38611 - protein, 210 aa, Homo sapiens; identical to SEQ ID NO: 38609
  Payload ID: 7720
  Gene Symbol: HDAC6
  Gene Name: histone deacetylase 6
  ENSP ID: ENSP00000365831

SEQ ID NO: 38612 - protein, 142 aa, Homo sapiens
  Payload ID: 7720
  Gene Symbol: HDAC6
  Gene Name: histone deacetylase 6
  ENSP ID: ENSP00000392815
MTSTGQDSTTTRQRRSRQNPQSPPQDSSVTSKRNIKKGAVPRSIPNLAEVKKKGKMKKLGQAMEEDLIVGLQGMDLNLEAEALAGTGLVLDEQLNEFHCLWDDSFPEGPERLHAIKEQLIQEGLLDRCVSFQARFAEKEELM

SEQ ID NO: 38613 - protein, 161 aa, Homo sapiens
  Payload ID: 7720
  Gene Symbol: HDAC6
  Gene Name: histone deacetylase 6
  ENSP ID: ENSP00000393916
MTSTGQDSTTTRQRRSRQNPQSPPQDSSVTSKRNIKKGAVPRSIPNLAEVKKKGKMKKLGQAMEEDLIVGLQGMDLNLEAEALAGTGLVLDEQLNEFHCLWDDSFPEGPERLHAIKEQLIQEGLLDRCVSFQARFAEKEELMLVHSLEYIDLMETTQYMNE

SEQ ID NO: 38614 - protein, 171 aa, Homo sapiens
  Payload ID: 7720
  Gene Symbol: HDAC6
  Gene Name: histone deacetylase 6
  ENSP ID: ENSP00000394377
MTSTGQDSTTTRQRRSRQNPQSPPQDSSVTSKRNIKKGAVPRSIPNLAEVKKKGKMKKLGQAMEEDLIVGLQGMDLNLEAEALAGTGLVLDEQLNEFHCLWDDSFPEGPERLHAIKEQLIQEGLLDRCVSFQARFAEKEELMLVHSLEYIDLMETTQYMNEGELRVLADTY

SEQ ID NO: 38615 - protein, 84 aa, Homo sapiens
  Payload ID: 7720
  Gene Symbol: HDAC6
  Gene Name: histone deacetylase 6
  ENSP ID: ENSP00000397697
  MOD_RES (1)..(1): Any amino acid
XTPQISPSTLIGSLRTLELGSESQGASESQAPGEENLLGEAAGGQDMADSMLMQGSRGLTDQALLDVKNIAHQNKFGEDMPHPH

SEQ ID NO: 38616 - protein, 269 aa, Homo sapiens
  Payload ID: 7720
  Gene Symbol: HDAC6
  Gene Name: histone deacetylase 6
  ENSP ID: ENSP00000402189
MTSTGQDSTTTRQRRSRQNPQSPPQDSSVTSKRNIKKGAVPRSIPNLAEVKKKGKMKKLGQAMEEDLIVGLQGMDLNLEAEALAGTGLVLDEQLNEFHCLWDDSFPEGPERLHAIKEQLIQEGLLDRCVSFQARFAEKEELMLVHSLEYIDLMETTQYMNEGELRVLADTYDSVYLHPNSYSCACLASGSVLRLVDAVLGAEIRNGMAIIRPPGHHAQHSLMDGYCMFNHVAVAARYAQQKHRIRRVLIVDWDVHHGQGTQFTFDQDPR

SEQ ID NO: 38617 - protein, 167 aa, Homo sapiens
  Payload ID: 7720
  Gene Symbol: HDAC6
  Gene Name: histone deacetylase 6
  ENSP ID: ENSP00000402751
MTSTGQDSTTTRQRRSRQNPQSPPQDSSVTSKRNIKKGAVPRSIPNLAEVKKKGKMKKLGQAMEEDLIVGLQGMDLNLEAEALAGTGLVLDEQLNEFHCLWDDSFPEGPERLHAIKEQLIQEGLLDRCVSFQARFAEKEELMLVHSLEYIDLMETTQYMNEGELRVL

SEQ ID NO: 38618 - protein, 51 aa, Homo sapiens
  Payload ID: 7720
  Gene Symbol: HDAC6
  Gene Name: histone deacetylase 6
  ENSP ID: ENSP00000403370
MTSTGQDSTTTRQRRSRQNPQSPPQDSSVTSKRNIKKGAVPRSIPNLAEVK

SEQ ID NO: 38619 - protein, 991 aa, Homo sapiens
  Payload ID: 7721
  Gene Symbol: HDAC7
  Gene Name: histone deacetylase 7
  Uniprot ID: Q8WUI4
  ENSP ID: ENSP00000080059
MHSPGADGTQVSPGAHYCSPTGAGCPRPCADTPGPQPQPMDLRVGQRPPVEPPPEPTLLALQRPQRLHHHLFLAGLQQQRSVEPMRLSMDTPMPELQVGPQEQELRQLLHKDKSKRSAVASSVVKQKLAEVILKKQQAALERTVHPNSPGIPYRTLEPLETEGATRSMLSSFLPPVPSLPSDPPEHFPLRKTVSEPNLKLRYKPKKSLERRKNPLLRKESAPPSLRRRPAETLGDSSPSSSSTPASGCSSPNDSEHGPNPILGSEALLGQRLRLQETSVAPFALPTVSLLPAITLGLPAPARADSDRRTHPTLGPRGPILGSPHTPLFLPHGLEPEAGGTLPSRLQPILLLDPSGSHAPLLTVPGLGPLPFHFAQSLMTTERLSGSGLHWPLSRTRSEPLPPSATAPPPPGPMQPRLEQLKTHVQVIKRSAKPSEKPRLRQIPSAEDLETDGGGPGQVVDDGLEHRELGHGQPEARGPAPLQQHPQVLLWEQQRLAGRLPRGSTGDTVLLPLAQGGHRPLSRAQSSPAAPASLSAPEPASQARVLSSSETPARTLPFTTGLIYDSVMLKHQCSCGDNSRHPEHAGRIQSIWSRLQERGLRSQCECLRGRKASLEELQSVHSERHVLLYGTNPLSRLKLDNGKLAGLLAQRMFVMLPCGGVGVDTDTIWNELHSSNAARWAAGSVTDLAFKVASRELKNGFAVVRPPGHHADHSTAMGFCFFNSVAIACRQLQQQSKASKILIVDWDVHHGNGTQQTFYQDPSVLYISLHRHDDGNFFPGSGAVDEVGAGSGEGFNVNVAWAGGLDPPMGDPEYLAAFRIVVMPIAREFSPDLVLVSAGFDAAEGHPAPLGGYHVSAKCFGYMTQQLMNLAGGAVVLALEGGHDLTAICDASEACVAALLGNRVDPLSEEGWKQKPNLNAIRSLEAVIRVHSKYWGCMQRLASCPDSWVPRVPGADKEEVEAVTALASLSVGILAEDRPSEQLVEEEEPMNL

SEQ ID NO: 38620 - protein, 954 aa, Homo sapiens
  Payload ID: 7721
  Gene Symbol: HDAC7
  Gene Name: histone deacetylase 7
  Uniprot ID: Q8WUI4
  ENSP ID: ENSP00000351326
MHSPGADGTQVSPGAHYCSPTGAGCPRPCADTPGPQPQPMDLRVGQRPPVEPPPEPTLLALQRPQRLHHHLFLAGLQQQRSVEPMRLSMDTPMPELQVGPQEQELRQLLHKDKSKRSAVASSVVKQKLAEVILKKQQAALERTVHPNSPGIPYRTLEPLETEGATRSMLSSFLPPVPSLPSDPPEHFPLRKTVSEPNLKLRYKPKKSLERRKNPLLRKESAPPSLRRRPAETLGDSSPSSSSTPASGCSSPNDSEHGPNPILGSEADSDRRTHPTLGPRGPILGSPHTPLFLPHGLEPEAGGTLPSRLQPILLLDPSGSHAPLLTVPGLGPLPFHFAQSLMTTERLSGSGLHWPLSRTRSEPLPPSATAPPPPGPMQPRLEQLKTHVQVIKRSAKPSEKPRLRQIPSAEDLETDGGGPGQVVDDGLEHRELGHGQPEARGPAPLQQHPQVLLWEQQRLAGRLPRGSTGDTVLLPLAQGGHRPLSRAQSSPAAPASLSAPEPASQARVLSSSETPARTLPFTTGLIYDSVMLKHQCSCGDNSRHPEHAGRIQSIWSRLQERGLRSQCECLRGRKASLEELQSVHSERHVLLYGTNPLSRLKLDNGKLAGLLAQRMFVMLPCGGVGVDTDTIWNELHSSNAARWAAGSVTDLAFKVASRELKNGFAVVRPPGHHADHSTAMGFCFFNSVAIACRQLQQQSKASKILIVDWDVHHGNGTQQTFYQDPSVLYISLHRHDDGNFFPGSGAVDEVGAGSGEGFNVNVAWAGGLDPPMGDPEYLAAFRIVVMPIAREFSPDLVLVSAGFDAAEGHPAPLGGYHVSAKCFGYMTQQLMNLAGGAVVLALEGGHDLTAICDASEACVAALLGNRVDPLSEEGWKQKPNLNAIRSLEAVIRVHSKYWGCMQRLASCPDSWVPRVPGADKEEVEAVTALASLSVGILAEDRPSEQLVEEEEPMNL

SEQ ID NO: 38621 - protein, 1014 aa, Homo sapiens
  Payload ID: 7721
  Gene Symbol: HDAC7
  Gene Name: histone deacetylase 7
  ENSP ID: ENSP00000369984
MSDLRKRELGALFTSRGTGGVEWDGTQVSPGAHYCSPTGAGCPRPCADTPGPQPQPMDLRVGQRPPVEPPPEPTLLALQRPQRLHHHLFLAGLQQQRSVEPMRLSMDTPMPELQVGPQEQELRQLLHKDKSKRSAVASSVVKQKLAEVILKKQQAALERTVHPNSPGIPYRTLEPLETEGATRSMLSSFLPPVPSLPSDPPEHFPLRKTVSEPNLKLRYKPKKSLERRKNPLLRKESAPPSLRRRPAETLGDSSPSSSSTPASGCSSPNDSEHGPNPILGSEALLGQRLRLQETSVAPFALPTVSLLPAITLGLPAPARADSDRRTHPTLGPRGPILGSPHTPLFLPHGLEPEAGGTLPSRLQPILLLDPSGSHAPLLTVPGLGPLPFHFAQSLMTTERLSGSGLHWPLSRTRSEPLPPSATAPPPPGPMQPRLEQLKTHVQVIKRSAKPSEKPRLRQIPSAEDLETDGGGPGQVVDDGLEHRELGHGQPEARGPAPLQQHPQVLLWEQQRLAGRLPRGSTGDTVLLPLAQGGHRPLSRAQSSPAAPASLSAPEPASQARVLSSSETPARTLPFTTGLIYDSVMLKHQCSCGDNSRHPEHAGRIQSIWSRLQERGLRSQCECLRGRKASLEELQSVHSERHVLLYGTNPLSRLKLDNGKLAGLLAQRMFVMLPCGGVGVDTDTIWNELHSSNAARWAAGSVTDLAFKVASRELKNGFAVVRPPGHHADHSTAMGFCFFNSVAIACRQLQQQSKASKILIVDWDVHHGNGTQQTFYQDPSVLYISLHRHDDGNFFPGSGAVDEVGAGSGEGFNVNVAWAGGLDPPMGDPEYLAAFRIVVMPIAREFSPDLVLVSAGFDAAEGHPAPLGGYHVSAKCFGYMTQQLMNLAGGAVVLALEGGHDLTAICDASEACVAALLGNRVDPLSEEGWKQKPNLNAIRSLEAVIRVHMGALTLSQIPGHGSSQQQAGGAFSWPGHPCRAAVVMVNTGAACSAWPPVQTPGCLECQGLTKKKWRQ

SEQ ID NO: 38622 - protein, 78 aa, Homo sapiens
  Payload ID: 7721
  Gene Symbol: HDAC7
  Gene Name: histone deacetylase 7
  ENSP ID: ENSP00000387792
MDLRVGQRPPVEPPPEPTLLALQRPQRLHHHLFLAGLQQQRSVEPMRLSMDTPMPELQVGPQEQELRQLLHKDKSKRS

SEQ ID NO: 38623 - protein, 153 aa, Homo sapiens
  Payload ID: 7721
  Gene Symbol: HDAC7
  Gene Name: histone deacetylase 7
  ENSP ID: ENSP00000388561
MDLRVGQRPPVEPPPEPTLLALQRPQRLHHHLFLAGLQQQRSVEPMRLSMDTPMPELQVGPQEQELRQLLHKDKSKRSAVASSVVKQKLAEVILKKQQAALERTVHPNSPGIPYRTLEPLETEGATRSMLSSFLPPVPSLPSDPPEHFPLRKT

SEQ ID NO: 38624 - protein, 153 aa, Homo sapiens; identical to SEQ ID NO: 38623
  Payload ID: 7721
  Gene Symbol: HDAC7
  Gene Name: histone deacetylase 7
  ENSP ID: ENSP00000389501

SEQ ID NO: 38625 - protein, 51 aa, Homo sapiens
  Payload ID: 7721
  Gene Symbol: HDAC7
  Gene Name: histone deacetylase 7
  ENSP ID: ENSP00000390415
MDLRVGQRPPVEPPPEPTLLALQRPQRLHHHLFLAGLQQQRSVEPMRLSMD

SEQ ID NO: 38626 - protein, 274 aa, Homo sapiens
  Payload ID: 7721
  Gene Symbol: HDAC7
  Gene Name: histone deacetylase 7
  ENSP ID: ENSP00000396159
MHSPGADGTQVSPGAHYCSPTGAGCPRPCADTPGPQPQPMDLRVGQRPPVEPPPEPTLLALQRPQRLHHHLFLAGLQQQRSVEPMRLSMDTPMPELQVGPQEQELRQLLHKDKSKRSAVASSVVKQKLAEVILKKQQAALERTVHPNSPGIPYSLPSDPPEHFPLRKTVSEPNLKLRYKPKKSLERRKNPLLRKESAPPSLRRRPAETLGDSSPSSSSTPASGCSSPNDSEHGPNPILGSEADSDRRTHPTLGPRGPILGSPHTPLFLPHGLEP

SEQ ID NO: 38627 - protein, 112 aa, Homo sapiens
  Payload ID: 7721
  Gene Symbol: HDAC7
  Gene Name: histone deacetylase 7
  ENSP ID: ENSP00000397236
MDLRVGQRPPVEPPPEPTLLALQRPQRLHHHLFLAGLQQQRSVEPMRLSMDTPMPELQVGPQEQELRQLLHKDKSKRSAVASSVVKQKLAEVILKKQQAALERTVHPNSPGI

SEQ ID NO: 38628 - protein, 133 aa, Homo sapiens
  Payload ID: 7721
  Gene Symbol: HDAC7
  Gene Name: histone deacetylase 7
  ENSP ID: ENSP00000400811
MHSPGAGCPRPCADTPGPQPQPMDLRVGQRPPVEPPPEPTLLALQRPQRLHHHLFLAGLQQQRSVEPMRLSMDTPMPELQVGPQEQELRQLLHKDKSKRSAVASSVVKQKLAEVILKKQQAALERTVHPNSPG

SEQ ID NO: 38629 - protein, 101 aa, Homo sapiens
  Payload ID: 7721
  Gene Symbol: HDAC7
  Gene Name: histone deacetylase 7
  ENSP ID: ENSP00000401872
MHSPGAALHGHADARVAGGTPGTRAAAASPQGQEQAKCCSQQRGQAEASGGDSEKTAGGPRKNSPSQQPRHSLQNPGAPGDGRSHPLHAQQLFASCSQPAQ

SEQ ID NO: 38630 - protein, 88 aa, Homo sapiens
  Payload ID: 7721
  Gene Symbol: HDAC7
  Gene Name: histone deacetylase 7
  ENSP ID: ENSP00000403149
MDLRVGQRPPVEPPPEPTLLALQRPQRLHHHLFLAGLQQQRSVEPMRLSMDTPMPELQVGPQEQELRQLLHKDKSKRSAVASSVVKQK

SEQ ID NO: 38631 - protein, 952 aa, Homo sapiens
  Payload ID: 7721
  Gene Symbol: HDAC7
  Gene Name: histone deacetylase 7
  Uniprot ID: Q8WUI4
  ENSP ID: ENSP00000404394
MDLRVGQRPPVEPPPEPTLLALQRPQRLHHHLFLAGLQQQRSVEPMRLSMDTPMPELQVGPQEQELRQLLHKDKSKRSAVASSVVKQKLAEVILKKQQAALERTVHPNSPGIPYRTLEPLETEGATRSMLSSFLPPVPSLPSDPPEHFPLRKTVSEPNLKLRYKPKKSLERRKNPLLRKESAPPSLRRRPAETLGDSSPSSSSTPASGCSSPNDSEHGPNPILGSEALLGQRLRLQETSVAPFALPTVSLLPAITLGLPAPARADSDRRTHPTLGPRGPILGSPHTPLFLPHGLEPEAGGTLPSRLQPILLLDPSGSHAPLLTVPGLGPLPFHFAQSLMTTERLSGSGLHWPLSRTRSEPLPPSATAPPPPGPMQPRLEQLKTHVQVIKRSAKPSEKPRLRQIPSAEDLETDGGGPGQVVDDGLEHRELGHGQPEARGPAPLQQHPQVLLWEQQRLAGRLPRGSTGDTVLLPLAQGGHRPLSRAQSSPAAPASLSAPEPASQARVLSSSETPARTLPFTTGLIYDSVMLKHQCSCGDNSRHPEHAGRIQSIWSRLQERGLRSQCECLRGRKASLEELQSVHSERHVLLYGTNPLSRLKLDNGKLAGLLAQRMFVMLPCGGVGVDTDTIWNELHSSNAARWAAGSVTDLAFKVASRELKNGFAVVRPPGHHADHSTAMGFCFFNSVAIACRQLQQQSKASKILIVDWDVHHGNGTQQTFYQDPSVLYISLHRHDDGNFFPGSGAVDEVGAGSGEGFNVNVAWAGGLDPPMGDPEYLAAFRIVVMPIAREFSPDLVLVSAGFDAAEGHPAPLGGYHVSAKCFGYMTQQLMNLAGGAVVLALEGGHDLTAICDASEACVAALLGNRVDPLSEEGWKQKPNLNAIRSLEAVIRVHSKYWGCMQRLASCPDSWVPRVPGADKEEVEAVTALASLSVGILAEDRPSEQLVEEEEPMNL

SEQ ID NO: 38632 - protein, 141 aa, Homo sapiens
  Payload ID: 7721
  Gene Symbol: HDAC7
  Gene Name: histone deacetylase 7
  ENSP ID: ENSP00000410068
MDLRVGQRPPVEPPPEPTLLALQRPQRLHHHLFLAGLQQQRSVEPMRLSMDTPMPELQVGPQEQELRQLLHKDKSKRSAVASSVVKQKLAEVILKKQQAALERTVHPNSPGIPYSLPSDPPEHFPLRKTVSEPNLKLRYKP

SEQ ID NO: 38633 - protein, 159 aa, Homo sapiens
  Payload ID: 7721
  Gene Symbol: HDAC7
  Gene Name: histone deacetylase 7
  ENSP ID: ENSP00000411058
MHSPGAGCPRPCADTPGPQPQPMDLRVGQRPPVEPPPEPTLLALQRPQRLHHHLFLAGLQQQRSVEPMRLSMDTPMPELQVGPQEQELRQLLHKDKSKRSAVASSVVKQKLAEVILKKQQAALERTVHPNSPGIPYSLPSDPPEHFPLRKTVSEPNLKL

SEQ ID NO: 38634 - protein, 138 aa, Homo sapiens
  Payload ID: 7721
  Gene Symbol: HDAC7
  Gene Name: histone deacetylase 7
  ENSP ID: ENSP00000412155
MDLRVGQRPPVEPPPEPTLLALQRPQRLHHHLFLAGLQQQRSVEPMRLSMDTPMPELQVGPQEQELRQLLHKDKSKRSAVASSVVKQKLAEVILKKQQAALERTVHPNSPGIPYRTLEPLETEGATRSMLSSFLPPVP

SEQ ID NO: 38635 - protein, 384 aa, Homo sapiens
  Payload ID: 7721
  Gene Symbol: HDAC7
  Gene Name: histone deacetylase 7
  ENSP ID: ENSP00000446538
  MOD_RES (1)..(1): Any amino acid
XLIYDSVMLKHQCSCGDNSRHPEHAGRIQSIWSRLQERGLRSQCECLRGRKASLEELQSVHSERHVLLYGTNPLSRLKLDNGKLAGLLAQRMFVMLPCGGVGVDTDTIWNELHSSNAARWAAGSVTDLAFKVASRELKDVHHGNGTQQTFYQDPSVLYISLHRHDDGNFFPGSGAVDEVGAGSGEGFNVNVAWAGGLDPPMGDPEYLAAFRIVVMPIAREFSPDLVLVSAGFDAAEGHPAPLGGYHVSAKCFGYMTQQLMNLAGGAVVLALEGGHDLTAICDASEACVAALLGNRVDPLSEEGWKQKPNLNAIRSLEAVIRVHSKYWGCMQRLASCPDSWVPRVPGADKEEVEAVTALASLSVGILAEDRPSEQLVEEEEPMNL

SEQ ID NO: 38636 - protein, 110 aa, Homo sapiens
  Payload ID: 7721
  Gene Symbol: HDAC7
  Gene Name: histone deacetylase 7
  ENSP ID: ENSP00000447191
  MOD_RES (1)..(1): Any amino acid
XDLVLVSAGFDAAEGHPAPLGGYHVSAKCFGYMTQQLMNLAGGAVVLALEGGHDLTAICDASEACVAALLGNRVSRLPPPSMLLSGRWIPFQKKAGNRNPTSMPSALWRP

SEQ ID NO: 38637 - protein, 61 aa, Homo sapiens
  Payload ID: 7721
  Gene Symbol: HDAC7
  Gene Name: histone deacetylase 7
  ENSP ID: ENSP00000448305
  MOD_RES (1)..(1): Any amino acid
XSTGDTVLLPLAQGGHRPLSRAQSSPAAPASLSAPEPASQARVLSSSETPARTLPFTTGSL

SEQ ID NO: 38638 - protein, 152 aa, Homo sapiens
  Payload ID: 7721
  Gene Symbol: HDAC7
  Gene Name: histone deacetylase 7
  ENSP ID: ENSP00000448448
EPLETEGATRSMLSSFLPPVPSLPSDPPEHFPLRKTVSEPNLKLRYKPKKSLERRKNPLLRKESAPPSLRRRPAETLGDSSPSSSSTPASGCSSPNDSEHGPNPILGSEALLGQRLRLQETSVAPFALPTVSLLPAITLGLPAPARALMPRC

SEQ ID NO: 38639 - protein, 974 aa, Homo sapiens
  Payload ID: 7721
  Gene Symbol: HDAC7
  Gene Name: histone deacetylase 7
  Uniprot ID: Q8WUI4
  ENSP ID: ENSP00000448532
MHSPGAGCPRPCADTPGPQPQPMDLRVGQRPPVEPPPEPTLLALQRPQRLHHHLFLAGLQQQRSVEPMRLSMDTPMPELQVGPQEQELRQLLHKDKSKRSAVASSVVKQKLAEVILKKQQAALERTVHPNSPGIPYRTLEPLETEGATRSMLSSFLPPVPSLPSDPPEHFPLRKTVSEPNLKLRYKPKKSLERRKNPLLRKESAPPSLRRRPAETLGDSSPSSSSTPASGCSSPNDSEHGPNPILGSEALLGQRLRLQETSVAPFALPTVSLLPAITLGLPAPARADSDRRTHPTLGPRGPILGSPHTPLFLPHGLEPEAGGTLPSRLQPILLLDPSGSHAPLLTVPGLGPLPFHFAQSLMTTERLSGSGLHWPLSRTRSEPLPPSATAPPPPGPMQPRLEQLKTHVQVIKRSAKPSEKPRLRQIPSAEDLETDGGGPGQVVDDGLEHRELGHGQPEARGPAPLQQHPQVLLWEQQRLAGRLPRGSTGDTVLLPLAQGGHRPLSRAQSSPAAPASLSAPEPASQARVLSSSETPARTLPFTTGLIYDSVMLKHQCSCGDNSRHPEHAGRIQSIWSRLQERGLRSQCECLRGRKASLEELQSVHSERHVLLYGTNPLSRLKLDNGKLAGLLAQRMFVMLPCGGVGVDTDTIWNELHSSNAARWAAGSVTDLAFKVASRELKNGFAVVRPPGHHADHSTAMGFCFFNSVAIACRQLQQQSKASKILIVDWDVHHGNGTQQTFYQDPSVLYISLHRHDDGNFFPGSGAVDEVGAGSGEGFNVNVAWAGGLDPPMGDPEYLAAFRIVVMPIAREFSPDLVLVSAGFDAAEGHPAPLGGYHVSAKCFGYMTQQLMNLAGGAVVLALEGGHDLTAICDASEACVAALLGNRVDPLSEEGWKQKPNLNAIRSLEAVIRVHSKYWGCMQRLASCPDSWVPRVPGADKEEVEAVTALASLSVGILAEDRPSEQLVEEEEPMNL

SEQ ID NO: 38640 - protein, 224 aa, Homo sapiens
  Payload ID: 7721
  Gene Symbol: HDAC7
  Gene Name: histone deacetylase 7
  ENSP ID: ENSP00000449171
MDLRVGQRPPVEPPPEPTLLALQRPQRLHHHLFLAGLQQQRSVEPMRLSMDTPMPELQVGPQEQELRQLLHKDKSKRSAVASSVVKQKLAEVILKKQQAALERTVHPNSPGIPYRTLEPLETEGATRSMLSSFLPPVPSLPSDPPEHFPLRKTVSEPNLKLRYKPKKSLERRKNPLLRKESAPPSLRRRPAETLGDSSPSSSSTPASGCSSPNDSEHGPNPILG

SEQ ID NO: 38641 - protein, 205 aa, Homo sapiens
  Payload ID: 7721
  Gene Symbol: HDAC7
  Gene Name: histone deacetylase 7
  ENSP ID: ENSP00000482003
  MOD_RES (1)..(1): Any amino acid
XIYDSVMLKHQCSCGDNSRHPEHAGRIQSIWSRLQERGLRSQCECLRGRKASLEELQSVHSERHVLLYGTNPLSRLKLDNGKLAGLLAQRMFVMLPCGGVGVDTDTIWNELHSSNAARWAAGSVTDLAFKVASRELKNGFAVVRPPGHHADHSTAMGFCFFNSVAIACRQLQQQSKASKILIVDWVVMIRIIADNISTPLITSRH

SEQ ID NO: 38642 - protein, 146 aa, Homo sapiens
  Payload ID: 7722
  Gene Symbol: HDAC8
  Gene Name: histone deacetylase 8
  Uniprot ID: Q9BY41
  ENSP ID: ENSP00000362655
MEEPEEPADSGQSLVPVYIYSPEYVSMCDSLAKIPKRASMVHSLIEAYALHKQMRIVKPKVASMEEMATFHTDAYLQHLQKVSQEGDDDHPDSIEYGLGYDCPATEGIFDYAAAIGGATITAAQCLIDGMCKVAINWSGGWHHAKK

SEQ ID NO: 38643 - protein, 158 aa, Homo sapiens
  Payload ID: 7722
  Gene Symbol: HDAC8
  Gene Name: histone deacetylase 8
  Uniprot ID: Q9BY41
  ENSP ID: ENSP00000362657
MEEPEEPADSGQSLVPVYIYSPEYVSMCDSLAKIPKRASMVHSLIEAYALHKQMRIVKPKVASMEEMATFHTDAYLQHLQKVSQEGDDDHPDSIEYGLGYDCPATEGIFDYAAAIGGATITAAQCLIDGMCKVAINWSGGWHHAKKETCVYVALYKAF

SEQ ID NO: 38644 - protein, 139 aa, Homo sapiens
  Payload ID: 7722
  Gene Symbol: HDAC8
  Gene Name: histone deacetylase 8
  Uniprot ID: Q9BY41
  ENSP ID: ENSP00000362660
MEEPEEPADSGQSLVPVYIYSPEYVSMCDSLAKIPKRASMVHSLIEAYALHKQMRDEASGFCYLNDAVLGILRLRRKFERILYVDLDLHHGDGTGDVSDVGLGKGRYYSVNVPIQDGIQDEKYYQICERYEPPAPNPGL

SEQ ID NO: 38645 - protein, 156 aa, Homo sapiens
  Payload ID: 7722
  Gene Symbol: HDAC8
  Gene Name: histone deacetylase 8
  ENSP ID: ENSP00000362661
MEEPEEPADSGQSLVPVYIYSPEYVSMCDSLAKIPKRASMVHSLIEAYALHKQMRIVKPKVASMEEMATFHTDAYLQHLQKVSQEGDDDHPDSIEYGLGYDCPATEGIFDYAAAIGGATITAAQCLIDGMCKVAINWSGGWHHAKKYEPPAPNPGL

SEQ ID NO: 38646 - protein, 248 aa, Homo sapiens
  Payload ID: 7722
  Gene Symbol: HDAC8
  Gene Name: histone deacetylase 8
  ENSP ID: ENSP00000362669
MEEPEEPADSGQSLVPVYIYSPEYVSMCDSLAKIPKRASMVHSLIEAYALHKQMRDEASGFCYLNDAVLGILRLRRKFERILYVDLDLHHGDGVEDAFSFTSKVMTVSLHKFSPGFFPGTGDVSDVGLGKGRYYSVNVPIQDGIQDEKYYQICESVLKEVYQAFNPKAVVLQLGADTIAGDPMCSFNMTPVGIGKCLKYILQWQLATLILGGGGYNLANTARCWTYLTGVILGKTLSSEIPDHEFFTA

SEQ ID NO: 38647 - protein, 253 aa, Homo sapiens
  Payload ID: 7722
  Gene Symbol: HDAC8
  Gene Name: histone deacetylase 8
  ENSP ID: ENSP00000362672
MEEPEEPADSGQSLVPVYIYSPEYVSMCDSLAKIPKRASMVHSLIEAYALHKQMRIVKPKVASMEEMATFHTDAYLQHLQKVSQEGDDDHPDSIEYGLGYDCPATEGIFDYAAAIGGATITAAQCLIDGMCKVAINWSGGWHHAKKDEASGFCYLNDAVLGILRLRRKFERILYVDLDLHHGDGVEDAFSFTSKVMTVSLHKFSPGFFPGTGDVSDVGLGKGRYYSVNVPIQDGIQDEKYYQICERALFIRTP

SEQ ID NO: 38648 - protein, 377 aa, Homo sapiens
  Payload ID: 7722
  Gene Symbol: HDAC8
  Gene Name: histone deacetylase 8
  Uniprot ID: Q9BY41
  ENSP ID: ENSP00000362674
MEEPEEPADSGQSLVPVYIYSPEYVSMCDSLAKIPKRASMVHSLIEAYALHKQMRIVKPKVASMEEMATFHTDAYLQHLQKVSQEGDDDHPDSIEYGLGYDCPATEGIFDYAAAIGGATITAAQCLIDGMCKVAINWSGGWHHAKKDEASGFCYLNDAVLGILRLRRKFERILYVDLDLHHGDGVEDAFSFTSKVMTVSLHKFSPGFFPGTGDVSDVGLGKGRYYSVNVPIQDGIQDEKYYQICESVLKEVYQAFNPKAVVLQLGADTIAGDPMCSFNMTPVGIGKCLKYILQWQLATLILGGGGYNLANTARCWTYLTGVILGKTLSSEIPDHEFFTAYGPDYVLEITPSCRPDRNEPHRIQQILNYIKGNLKHVV

SEQ ID NO: 38649 - protein, 64 aa, Homo sapiens
  Payload ID: 7722
  Gene Symbol: HDAC8
  Gene Name: histone deacetylase 8
  ENSP ID: ENSP00000362685
MEEPEEPADSGQSLVPVYIYSPEYVSMCDSLAKIPKRASMVHSLIEAYALHKQMRSWMRAVTSL

SEQ ID NO: 38650 - protein, 286 aa, Homo sapiens
  Payload ID: 7722
  Gene Symbol: HDAC8
  Gene Name: histone deacetylase 8
  Uniprot ID: Q9BY41
  ENSP ID: ENSP00000362691
MEEPEEPADSGQSLVPVYIYSPEYVSMCDSLAKIPKRASMVHSLIEAYALHKQMRDEASGFCYLNDAVLGILRLRRKFERILYVDLDLHHGDGVEDAFSFTSKVMTVSLHKFSPGFFPGTGDVSDVGLGKGRYYSVNVPIQDGIQDEKYYQICESVLKEVYQAFNPKAVVLQLGADTIAGDPMCSFNMTPVGIGKCLKYILQWQLATLILGGGGYNLANTARCWTYLTGVILGKTLSSEIPDHEFFTAYGPDYVLEITPSCRPDRNEPHRIQQILNYIKGNLKHVV

SEQ ID NO: 38651 - protein, 299 aa, Homo sapiens
  Payload ID: 7722
  Gene Symbol: HDAC8
  Gene Name: histone deacetylase 8
  ENSP ID: ENSP00000396424
MEEPEEPADSGQSLVPVYIYSPEYVSMCDSLAKIPKRASMVHSLIEAYALHKQMRIVKPKVASMEEMATFHTDAYLQHLQKVSQEGDDDHPDSIEYGLGYDCPATEGIFDYAAAIGGATITAAQCLIDGMCKVAINWSGGWHHAKKDEASGFCYLNDAVLGILRLRRKFERILYVDLDLHHGDGTGDVSDVGLGKGRYYSVNVPIQDGIQDEKYYQICESVLKEVYQAFNPKAVVLQLGADTIAGDPMCSFNMTPVGIGKCLKYILQWQLATLILGGGGYNLANTARCWTYLTGVILGK

SEQ ID NO: 38652 - protein, 131 aa, Homo sapiens
  Payload ID: 7722
  Gene Symbol: HDAC8
  Gene Name: histone deacetylase 8
  ENSP ID: ENSP00000398997
MVHSLIEAYALHKQMRIVKPKVASMEEMATFHTDAYLQHLQKVSQEGDDDHPDSIEYGLGYDCPATEGIFDYAAAIGGATITAAQCLIDGMCKVAINWSGGWHHAKKDEASGFCYLNDAVLGILRLRRKFE

SEQ ID NO: 38653 - protein, 56 aa, Homo sapiens
  Payload ID: 7722
  Gene Symbol: HDAC8
  Gene Name: histone deacetylase 8
  ENSP ID: ENSP00000400180
MEEPEEPADSGQSLVPVYIYSPEYVSMCDSLAKIPKRASMVHSLIEAYALHKQMRL

SEQ ID NO: 38654 - protein, 55 aa, Homo sapiens
  Payload ID: 7722
  Gene Symbol: HDAC8
  Gene Name: histone deacetylase 8
  ENSP ID: ENSP00000409778
MEEPEEPADSGQSLVPVYIYSPEYVSMCDSLAKIPKRASMVHSLIEAYALHKQMS

SEQ ID NO: 38655 - protein, 256 aa, Homo sapiens
  Payload ID: 7722
  Gene Symbol: HDAC8
  Gene Name: histone deacetylase 8
  Uniprot ID: Q9BY41
  ENSP ID: ENSP00000414486
MEEPEEPADSGQSLVPVYIYSPEYVSMCDSLAKIPKRASMVHSLIEAYALHKQMRIVKPKVASMEEMATFHTDAYLQHLQKVSQEGDDDHPDSIEYGLGYDCPATEGIFDYAAAIGGATITAAQCLIDGMCKVAINWSGGWHHAKKDEASGFCYLNDAVLGILRLRRKFERILYVDLDLHHGDGVEDAFSFTSKVMTVSLHKFSPGFFPGTGDVSDVGLGKGRYYSVNVPIQDGIQDEKYYQICERYEPPAPNPGL

SEQ ID NO: 38656 - protein, 185 aa, Homo sapiens
  Payload ID: 7722
  Gene Symbol: HDAC8
  Gene Name: histone deacetylase 8
  ENSP ID: ENSP00000416489
MEEPEEPADSGQSLVPVYIYSPEYVSMCDSLAKIPKRASMVHSLIEAYALHKQMRIVKPKVASMEEMATFHTDAYLQHLQKVSQEGDDDHPDSIEYGLGYDCPATEGIFDYAAAIGGATITAAQCLIDGMCKVAINWSGGWHHAKKDEASGFCYLNDAVLGILRLRRKFERILYVDLDLHHGDVY

SEQ ID NO: 38657 - protein, 1025 aa, Homo sapiens
  Payload ID: 7723
  Gene Symbol: HDAC9
  Gene Name: histone deacetylase 9
  Uniprot ID: Q9UKV0
  ENSP ID: ENSP00000383912
MHSMISSVDVKSEVPVGLEPISPLDLRTDLRMMMPVVDPVVREKQLQQELLLIQQQQQIQKQLLIAEFQKQHENLTRQHQAQLQEHIKLQQELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQPFLEPTHTRALSVRQAPLAAVGMDGLEKHRLVSRTHSSPAASVLPHPAMDRPLQPGSATGIAYDPLMLKHQCVCGNSTTHPEHAGRIQSIWSRLQETGLLNKCERIQGRKASLEEIQLVHSEHHSLLYGTNPLDGQKLDPRILLGDDSQKFFSSLPCGGLGVDSDTIWNELHSSGAARMAVGCVIELASKVASGELKNGFAVVRPPGHHAEESTAMGFCFFNSVAITAKYLRDQLNISKILIVDLDVHHGNGTQQAFYADPSILYISLHRYDEGNFFPGSGAPNEVGTGLGEGYNINIAWTGGLDPPMGDVEYLEAFRTIVKPVAKEFDPDMVLVSAGFDALEGHTPPLGGYKVTAKCFGHLTKQLMTLADGRVVLALEGGHDLTAICDASEACVNALLGNELEPLAEDILHQSPNMNAVISLQKIIEIQSKYWKSVRMVAVPRGCALAGAQLQEETETVSALASLTVDVEQPFAQEDSRTAGEPMEEEPAL

SEQ ID NO: 38658 - protein, 577 aa, Homo sapiens
  Payload ID: 7723
  Gene Symbol: HDAC9
  Gene Name: histone deacetylase 9
  ENSP ID: ENSP00000384017
MLQTIYESDSCFSSDGVAGREQLLAQQRMHSMISSVDVKSEVPVGLEPISPLDLRTDLRMMMPVVDPVVREKQLQQELLLIQQQQQIQKQLLIAEFQKQHENLTRQHQAQLQEHIKLQQELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 38659 - protein, 590 aa, Homo sapiens
  Payload ID: 7723
  Gene Symbol: HDAC9
  Gene Name: histone deacetylase 9
  Uniprot ID: Q9UKV0
  ENSP ID: ENSP00000384382
MHSMISSVDVKSEVPVGLEPISPLDLRTDLRMMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTASEPNLKVRSRLKQKVAERRSSPLLRRKDGNVVTSFKKRMFEVTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 38660 - protein, 1066 aa, Homo sapiens
  Payload ID: 7723
  Gene Symbol: HDAC9
  Gene Name: histone deacetylase 9
  Uniprot ID: Q9UKV0
  ENSP ID: ENSP00000384657
MHSMISSVDVKSEVPVGLEPISPLDLRTDLRMMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTASEPNLKVRSRLKQKVAERRSSPLLRRKDGNVVTSFKKRMFEVTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQPFLEPTHTRALSVRQAPLAAVGMDGLEKHRLVSRTHSSPAASVLPHPAMDRPLQPGSATGIAYDPLMLKHQCVCGNSTTHPEHAGRIQSIWSRLQETGLLNKCERIQGRKASLEEIQLVHSEHHSLLYGTNPLDGQKLDPRILLGDDSQKFFSSLPCGGLGVDSDTIWNELHSSGAARMAVGCVIELASKVASGELKNGFAVVRPPGHHAEESTAMGFCFFNSVAITAKYLRDQLNISKILIVDLDVHHGNGTQQAFYADPSILYISLHRYDEGNFFPGSGAPNEVGTGLGEGYNINIAWTGGLDPPMGDVEYLEAFRTIVKPVAKEFDPDMVLVSAGFDALEGHTPPLGGYKVTAKCFGHLTKQLMTLADGRVVLALEGGHDLTAICDASEACVNALLGNELEPLAEDILHQSPNMNAVISLQKIIEIQSKYWKSVRMVAVPRGCALAGAQLQEETETVSALASLTVDVEQPFAQEDSRTAGEPMEEEPAL

SEQ ID NO: 38661 - protein, 562 aa, Homo sapiens
  Payload ID: 7723
  Gene Symbol: HDAC9
  Gene Name: histone deacetylase 9
  Uniprot ID: Q9UKV0
  ENSP ID: ENSP00000388568
MMMPVVDPVVREKQLQQELLLIQQQQQIQKQLLIAEFQKQHENLTRQHQAQLQEHIKLQQELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTASEPNLKVRSRLKQKVAERRSSPLLRRKDGNVVTSFKKRMFEVTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 38662 - protein, 148 aa, Homo sapiens
  Payload ID: 7723
  Gene Symbol: HDAC9
  Gene Name: histone deacetylase 9
  ENSP ID: ENSP00000392564
MHSMISSVDVKSEVPVGLEPISPLDLRTDLRMMMPVVDPVVREKQLQQELLLIQQQQQIQKQLLIAEFQKQHENLTRQHQAQLQEHIKLQQELLAIKQQQELLEKEQKLEQQRQEQEVERHRREQQLPPLRGKDRGRERAVASTEVKQ

SEQ ID NO: 38663 - protein, 546 aa, Homo sapiens
  Payload ID: 7723
  Gene Symbol: HDAC9
  Gene Name: histone deacetylase 9
  Uniprot ID: Q9UKV0
  ENSP ID: ENSP00000395655
MHSMISSVDVKSEVPVGLEPISPLDLRTDLRMMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 38664 - protein, 588 aa, Homo sapiens
  Payload ID: 7723
  Gene Symbol: HDAC9
  Gene Name: histone deacetylase 9
  Uniprot ID: Q9UKV0
  ENSP ID: ENSP00000401669
MMSSPAQPDLMWNLVPWVLFCGCCRIFPDGVAGREQLLAQQRMHSMISSVDVKSEVPVGLEPISPLDLRTDLRMMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 38665 - protein, 110 aa, Homo sapiens
  Payload ID: 7723
  Gene Symbol: HDAC9
  Gene Name: histone deacetylase 9
  ENSP ID: ENSP00000404763
MMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRERAVAST

SEQ ID NO: 38666 - protein, 1069 aa, Homo sapiens
  Payload ID: 7723
  Gene Symbol: HDAC9
  Gene Name: histone deacetylase 9
  Uniprot ID: Q9UKV0
  ENSP ID: ENSP00000408617
MHSMISSVDVKSEVPVGLEPISPLDLRTDLRMMMPVVDPVVREKQLQQELLLIQQQQQIQKQLLIAEFQKQHENLTRQHQAQLQEHIKLQQELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTASEPNLKVRSRLKQKVAERRSSPLLRRKDGNVVTSFKKRMFEVTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQPFLEPTHTRALSVRQAPLAAVGMDGLEKHRLVSRTHSSPAASVLPHPAMDRPLQPGSATGIAYDPLMLKHQCVCGNSTTHPEHAGRIQSIWSRLQETGLLNKCERIQGRKASLEEIQLVHSEHHSLLYGTNPLDGQKLDPRILLGDDSQKFFSSLPCGGLGVDSDTIWNELHSSGAARMAVGCVIELASKVASGELKNGFAVVRPPGHHAEESTAMGFCFFNSVAITAKYLRDQLNISKILIVDLDVHHGNGTQQAFYADPSILYISLHRYDEGNFFPGSGAPNEVGTGLGEGYNINIAWTGGLDPPMGDVEYLEAFRTIVKPVAKEFDPDMVLVSAGFDALEGHTPPLGGYKVTAKCFGHLTKQLMTLADGRVVLALEGGHDLTAICDASEACVNALLGNELEPLAEDILHQSPNMNAVISLQKIIEIQSKYWKSVRMVAVPRGCALAGAQLQEETETVSALASLTVDVEQPFAQEDSRTAGEPMEEEPAL

SEQ ID NO: 38667 - protein, 22 aa, Homo sapiens
  Payload ID: 7723
  Gene Symbol: HDAC9
  Gene Name: histone deacetylase 9
  ENSP ID: ENSP00000409003
MHSMISSVDVKSEVPVGLEPIS

SEQ ID NO: 38668 - protein, 1011 aa, Homo sapiens
  Payload ID: 7723
  Gene Symbol: HDAC9
  Gene Name: histone deacetylase 9
  Uniprot ID: Q9UKV0
  ENSP ID: ENSP00000410337
MHSMISSVDVKSEVPVGLEPISPLDLRTDLRMMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTASEPNLKVRSRLKQKVAERRSSPLLRRKDGNVVTSFKKRMFEVTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQPFLEPTHTRALSVRQAPLAAVGMDGLEKHRLVSRTHSSPAASVLPHPAMDRPLQPGSATGIAYDPLMLKHQCVCGNSTTHPEHAGRIQSIWSRLQETGLLNKCERIQGRKASLEEIQLVHSEHHSLLYGTNPLDGQKLDPRILLGDDSQKFFSSLPCGGLGVDSDTIWNELHSSGAARMAVGCVIELASKVASGELKNGFAVVRPPGHHAEESTAMGFCFFNSVAITAKYLRDQLNISKILIVDLDVHHGNGTQQAFYADPSILYISLHRYDEGNFFPGSGAPNEVGTGLGEGYNINIAWTGGLDPPMGDVEYLEAFRTIVKPVAKEFDPDMVLVSAGFDALEGHTPPLGGYKVTAKCFGHLTKQLMTLADGRVVLALEGGHDLTAICDASEACVNALLGNELEPLAEDILHQSPNMNAVISLQKIIEIQSMSLKFS

SEQ ID NO: 38669 - protein, 70 aa, Homo sapiens
  Payload ID: 7723
  Gene Symbol: HDAC9
  Gene Name: histone deacetylase 9
  ENSP ID: ENSP00000411422
MMMPVVDPVVREKQLQQELLLIQQQQQIQKQLLIAEFQKQHENLTRQHQAQLQEHIKLQQELLAIKQQQE

SEQ ID NO: 38670 - protein, 138 aa, Homo sapiens
  Payload ID: 7723
  Gene Symbol: HDAC9
  Gene Name: histone deacetylase 9
  ENSP ID: ENSP00000412497
MHSMISSVDVKSEVPVGLEPISPLDLRTDLRMMMPVVDPVVREKQLQQELLLIQQQQQIQKQLLIAEFQKQHENLTRQHQAQLQEHIKLQQELLAIKQQQELLEKEQKLEQQRQEQEVERHRREQQLPPLRGKDRGRE

SEQ ID NO: 38671 - protein, 38 aa, Homo sapiens
  Payload ID: 7723
  Gene Symbol: HDAC9
  Gene Name: histone deacetylase 9
  ENSP ID: ENSP00000415095
MHSMISSVRSSCGPGAHLTFRPKDRPQDDDARGGPCCP

SEQ ID NO: 38672 - protein, 513 aa, Homo sapiens
  Payload ID: 7723
  Gene Symbol: HDAC9
  Gene Name: histone deacetylase 9
  Uniprot ID: Q9UKV0
  ENSP ID: ENSP00000430036
MMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRERAVASTEVKQKLQEFLLSKSATKDTPTNGKNHSVSRHPKLWAAHHTSLDQSSPPLSGTSPSYKYTLPGAQDAKDDFPLRKTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 38673 - protein, 549 aa, Homo sapiens
  Payload ID: 7723
  Gene Symbol: HDAC9
  Gene Name: histone deacetylase 9
  ENSP ID: ENSP00000478829
MHSMISSVDVKSEVPVGLEPISPLDLRTDLRMMMPVVDPVVREKQLQQELLLIQQQQQIQKQLLIAEFQKQHENLTRQHQAQLQEHIKLQQELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 38674 - protein, 517 aa, Homo sapiens
  Payload ID: 7724
  Gene Symbol: HINFP
  Gene Name: histone H4 transcription factor
  Uniprot ID: Q9BQA5
  ENSP ID: ENSP00000318085
MPPPGKVPRKENLWLQCEWGSCSFVCSTMEKFFEHVTQHLQQHLHGSGEEEEEEEEDDPLEEEFSCLWQECGFCSLDSSADLIRHVYFHCYHTKLKQWGLQALQSQADLGPCILDFQSRNVIPDIPDHFLCLWEHCENSFDNPEWFYRHVEAHSLCCEYEAVGKDNPVVLCGWKGCTCTFKDRSKLREHLRSHTQEKVVACPTCGGMFANNTKFLDHIRRQTSLDQQHFQCSHCSKRFATERLLRDHMRNHVNHYKCPLCDMTCPLPSSLRNHMRFRHSEDRPFKCDCCDYSCKNLIDLQKHLDTHSEEPAYRCDFENCTFSARSLCSIKSHYRKVHEGDSEPRYKCHVCDKCFTRGNNLTVHLRKKHQFKWPSGHPRFRYKEHEDGYMRLQLVRYESVELTQQLLRQPQEGSGLGTSLNESSLQGIILETVPGEPGRKEEEEEGKGSEGTALSASQDNPSSVIHVVNQTNAQGQQEIVYYVLSEAPGEPPPAPEPPSGGIMEKLQGIAEEPEIQMV

SEQ ID NO: 38675 - protein, 100 aa, Homo sapiens
  Payload ID: 7724
  Gene Symbol: HINFP
  Gene Name: histone H4 transcription factor
  ENSP ID: ENSP00000431468
MPPPGKVPRKENLWLQCEWGSCSFVCSTMEKFFEHVTQHLQQHLHGSGEEEEEEEEDDPLEEEFSCLWQECGFCSLDSSADLIRHVYFHCYHTKLKQWGL

SEQ ID NO: 38676 - protein, 54 aa, Homo sapiens
  Payload ID: 7724
  Gene Symbol: HINFP
  Gene Name: histone H4 transcription factor
  ENSP ID: ENSP00000433836
MPPPGKVPRKENLWLQCEWGSCSFVCSTMEKFFEHVTQHLQQHLHGSGEEEEEE

SEQ ID NO: 38677 - protein, 419 aa, Homo sapiens
  Payload ID: 7724
  Gene Symbol: HINFP
  Gene Name: histone H4 transcription factor
  Uniprot ID: Q9BQA5
  ENSP ID: ENSP00000436815
MPPPGKVPRKENLWLQCEWGSCSFVCSTMEKFFEHVTQHLQQHLHGSGEEEEEEEEDDPLEEEFSCLWQECGFCSLDSSADLIRHVYFHCYHTKLKQWGLQALQSQADLGPCILDFQSRNVIPDIPDHFLCLWEHCENSFDNPEWFYRHVEAHSLCCEYEAVGKDNPVVLCGWKGCTCTFKDRSKLREHLRSHTQEKVVACPTCGGMFANNTKFLDHIRRQTSLDQQHFQCSHCSKRFATERLLRDHMRNHVNHYKCPLCDMTCPLPSSLRNHMRFRHSEDRPFKCDCCDYSCKNLIDLQKHLDTHSEEPAYRCDFENCTFSARSLCSIKSHYRKVHEGDSEPRYKCHVCDKCFTRGNNLTVHLRKKHQFKWPSGHPRFRLGHFCIPLPGFAALYAPTSPGTRNMKMAICGCSWFATRV

SEQ ID NO: 38678 - protein, 242 aa, Homo sapiens
  Payload ID: 7725
  Gene Symbol: HTATIP2
  Gene Name: HIV-1 Tat interactive protein 2, 30kDa
  Uniprot ID: Q9BUP3
  ENSP ID: ENSP00000387876
MAETEALSKLREDFRMQNKSVFILGASGETGRVLLKEILEQGLFSKVTLIGRRKLTFDEEAYKNVNQEVVDFEKLDDYASAFQGHDVGFCCLGTTRGKAGAEGFVRVDRDYVLKSAELAKAGGCKHFNLLSSKGADKSSNFLYLQVKGEVEAKVEELKFDRYSVFRPGVLLCDRQESRPGEWLVRKFFGSLPDSWASGHSVPVVTVVRAMLNNVVRPRDKQMELLENKAIHDLGKAHGSLKP

SEQ ID NO: 38679 - protein, 276 aa, Homo sapiens
  Payload ID: 7725
  Gene Symbol: HTATIP2
  Gene Name: HIV-1 Tat interactive protein 2, 30kDa
  Uniprot ID: Q9BUP3
  ENSP ID: ENSP00000392985
MAGPAALSAAAAAALAAALLLLRREDPGPGAGPSMAETEALSKLREDFRMQNKSVFILGASGETGRVLLKEILEQGLFSKVTLIGRRKLTFDEEAYKNVNQEVVDFEKLDDYASAFQGHDVGFCCLGTTRGKAGAEGFVRVDRDYVLKSAELAKAGGCKHFNLLSSKGADKSSNFLYLQVKGEVEAKVEELKFDRYSVFRPGVLLCDRQESRPGEWLVRKFFGSLPDSWASGHSVPVVTVVRAMLNNVVRPRDKQMELLENKAIHDLGKAHGSLKP

SEQ ID NO: 38680 - protein, 242 aa, Homo sapiens; identical to SEQ ID NO: 38678
  Payload ID: 7725
  Gene Symbol: HTATIP2
  Gene Name: HIV-1 Tat interactive protein 2, 30kDa
  Uniprot ID: Q9BUP3
  ENSP ID: ENSP00000394259

SEQ ID NO: 38681 - protein, 242 aa, Homo sapiens; identical to SEQ ID NO: 38678
  Payload ID: 7725
  Gene Symbol: HTATIP2
  Gene Name: HIV-1 Tat interactive protein 2, 30kDa
  Uniprot ID: Q9BUP3
  ENSP ID: ENSP00000397752

SEQ ID NO: 38682 - protein, 133 aa, Homo sapiens
  Payload ID: 7725
  Gene Symbol: HTATIP2
  Gene Name: HIV-1 Tat interactive protein 2, 30kDa
  Uniprot ID: Q9BUP3
  ENSP ID: ENSP00000432107
MAETEALSKLREDFRMQNKSVFILGASGETGRVLLKEILEQGLFSKVTLIGRRKLTFDEEAYKNVNQEVVDFEKLDDYASAFQGHDVGFCCLGTTRGKAGAVRKAYALFPFCWPVISRILFLLTLFLCACCNA

SEQ ID NO: 38683 - protein, 133 aa, Homo sapiens; identical to SEQ ID NO: 38682
  Payload ID: 7725
  Gene Symbol: HTATIP2
  Gene Name: HIV-1 Tat interactive protein 2, 30kDa
  Uniprot ID: Q9BUP3
  ENSP ID: ENSP00000432338

SEQ ID NO: 38684 - protein, 133 aa, Homo sapiens; identical to SEQ ID NO: 38682
  Payload ID: 7725
  Gene Symbol: HTATIP2
  Gene Name: HIV-1 Tat interactive protein 2, 30kDa
  Uniprot ID: Q9BUP3
  ENSP ID: ENSP00000436548

SEQ ID NO: 38685 - protein, 196 aa, Homo sapiens
  Payload ID: 7725
  Gene Symbol: HTATIP2
  Gene Name: HIV-1 Tat interactive protein 2, 30kDa
  ENSP ID: ENSP00000436729
MAETEALSKLREDFRMQNKSVFILGASGETGRVLLKEILEQGLFSKVTLIGRRKLTFDEEAYKNVNQEVVDFEKLDDYASAFQGHDVGFCCLGTTRGKAGAGEVEAKVEELKFDRYSVFRPGVLLCDRQESRPGEWLVRKFFGSLPDSWASGHSVPVVTVVRAMLNNVVRPRDKQMELLENKAIHDLGKAHGSLKP

SEQ ID NO: 38686 - protein, 755 aa, Homo sapiens
  Payload ID: 7726
  Gene Symbol: HTATSF1
  Gene Name: HIV-1 Tat specific factor 1
  Uniprot ID: O43719
  ENSP ID: ENSP00000218364
MSGTNLDGNDEFDEQLRMQELYGDGKDGDTQTDAGGEPDSLGQQPTDTPYEWDLDKKAWFPKITEDFIATYQANYGFSNDGASSSTANVEDVHARTAEEPPQEKAPEPTDARKKGEKRKAESGWFHVEEDRNTNVYVSGLPPDITVDEFIQLMSKFGIIMRDPQTEEFKVKLYKDNQGNLKGDGLCCYLKRESVELALKLLDEDEIRGYKLHVEVAKFQLKGEYDASKKKKKCKDYKKKLSMQQKQLDWRPERRAGPSRMRHERVVIIKNMFHPMDFEDDPLVLNEIREDLRVECSKFGQIRKLLLFDRHPDGVASVSFRDPEEADYCIQTLDGRWFGGRQITAQAWDGTTDYQVEETSREREERLRGWEAFLNAPEANRGLRRSDSVSASERAGPSRARHFSEHPSTSKMNAQETATGMAFEEPIDEKKFEKTEDGGEFEEGASENNAKESSPEKEAEEGCPEKESEEGCPKRGFEGSCSQKESEEGNPVRGSEEDSPKKESKKKTLKNDCEENGLAKESEDDLNKESEEEVGPTKESEEDDSEKESDEDCSEKQSEDGSEREFEENGLEKDLDEEGSEKELHENVLDKELEENDSENSEFEDDGSEKVLDEEGSEREFDEDSDEKEEEEDTYEKVFDDESDEKEDEEYADEKGLEAADKKAEEGDADEKLFEESDDKEDEDADGKEVEDADEKLFEDDDSNEKLFDEEEDSSEKLFDDSDERGTLGGFGSVEEGPLSTGSSFILSSDDDDDDI

SEQ ID NO: 38687 - protein, 244 aa, Homo sapiens
  Payload ID: 7726
  Gene Symbol: HTATSF1
  Gene Name: HIV-1 Tat specific factor 1
  ENSP ID: ENSP00000411381
MSGTNLDGNDEFDEQLRMQELYGDGKDGDTQTDAGGEPDSLGQQPTDTPYEWDLDKKAWFPKITEDFIATYQANYGFSNDGASSSTANVEDVHARTAEEPPQEKAPEPTDARKKGEKRKAESGWFHVEEDRNTNVYVSGLPPDITVDEFIQLMSKFGIIMRDPQTEEFKVKLYKDNQGNLKGDGLCCYLKRESVELALKLLDEDEIRGYKLHVEVAKFQLKGEYDASKKKKKCKDYKKKLSMQQ

SEQ ID NO: 38688 - protein, 223 aa, Homo sapiens
  Payload ID: 7726
  Gene Symbol: HTATSF1
  Gene Name: HIV-1 Tat specific factor 1
  ENSP ID: ENSP00000412420
MSGTNLDGNDEFDEQLRMQELYGDGKDGDTQTDAGGEPDSLGQQPTDTPYEWDLDKKAWFPKITEDFIATYQANYGFSNDGASSSTANVEDVHARTAEEPPQEKAPEPTDARKKGEKRKAESGWFHVEEDRNTNVYVSGLPPDITVDEFIQLMSKFGIIMRDPQTEEFKVKLYKDNQGNLKGDGLCCYLKRESVELALKLLDEDEIRGYKLHVEVAKFQLKGE

SEQ ID NO: 38689 - protein, 755 aa, Homo sapiens; identical to SEQ ID NO: 38686
  Payload ID: 7726
  Gene Symbol: HTATSF1
  Gene Name: HIV-1 Tat specific factor 1
  Uniprot ID: O43719
  ENSP ID: ENSP00000442699

SEQ ID NO: 38690 - protein, 659 aa, Homo sapiens
  Payload ID: 7727
  Gene Symbol: HKR1
  Gene Name: HKR1, GLI-Kruppel zinc finger family member
  Uniprot ID: P10072
  ENSP ID: ENSP00000315505
MRVNHTVSTMLPTCMVHRQTMSCSGAGGITAFVAFRDVAVYFTQEEWRLLSPAQRTLHREVMLETYNHLVSLEIPSSKPKLIAQLERGEAPWREERKCPLDLCPESKPEIQLSPSCPLIFSSQQALSQHVWLSHLSQLFSSLWAGNPLHLGKHYPEDQKQQQDPFCFSGKAEWIQEGEDSRLLFGRVSKNGTSKALSSPPEEQQPAQSKEDNTVVDIGSSPERRADLEETDKVLHGLEVSGFGEIKYEEFGPGFIKESNLLSLQKTQTGETPYMYTEWGDSFGSMSVLIKNPRTHSGGKPYVCRECGRGFTWKSNLITHQRTHSGEKPYVCKDCGRGFTWKSNLFTHQRTHSGLKPYVCKECGQSFSLKSNLITHQRAHTGEKPYVCRECGRGFRQHSHLVRHKRTHSGEKPYICRECEQGFSQKSHLIRHLRTHTGEKPYVCTECGRHFSWKSNLKTHQRTHSGVKPYVCLECGQCFSLKSNLNKHQRSHTGEKPFVCTECGRGFTRKSTLSTHQRTHSGEKPFVCAECGRGFNDKSTLISHQRTHSGEKPFMCRECGRRFRQKPNLFRHKRAHSGAFVCRECGQGFCAKLTLIKHQRAHAGGKPHVCRECGQGFSRQSHLIRHQRTHSGEKPYICRKCGRGFSRKSNLIRHQRTHSG

SEQ ID NO: 38691 - protein, 640 aa, Homo sapiens
  Payload ID: 7727
  Gene Symbol: HKR1
  Gene Name: HKR1, GLI-Kruppel zinc finger family member
  Uniprot ID: P10072
  ENSP ID: ENSP00000375994
MATGLLRAKKEAFVAFRDVAVYFTQEEWRLLSPAQRTLHREVMLETYNHLVSLEIPSSKPKLIAQLERGEAPWREERKCPLDLCPESKPEIQLSPSCPLIFSSQQALSQHVWLSHLSQLFSSLWAGNPLHLGKHYPEDQKQQQDPFCFSGKAEWIQEGEDSRLLFGRVSKNGTSKALSSPPEEQQPAQSKEDNTVVDIGSSPERRADLEETDKVLHGLEVSGFGEIKYEEFGPGFIKESNLLSLQKTQTGETPYMYTEWGDSFGSMSVLIKNPRTHSGGKPYVCRECGRGFTWKSNLITHQRTHSGEKPYVCKDCGRGFTWKSNLFTHQRTHSGLKPYVCKECGQSFSLKSNLITHQRAHTGEKPYVCRECGRGFRQHSHLVRHKRTHSGEKPYICRECEQGFSQKSHLIRHLRTHTGEKPYVCTECGRHFSWKSNLKTHQRTHSGVKPYVCLECGQCFSLKSNLNKHQRSHTGEKPFVCTECGRGFTRKSTLSTHQRTHSGEKPFVCAECGRGFNDKSTLISHQRTHSGEKPFMCRECGRRFRQKPNLFRHKRAHSGAFVCRECGQGFCAKLTLIKHQRAHAGGKPHVCRECGQGFSRQSHLIRHQRTHSGEKPYICRKCGRGFSRKSNLIRHQRTHSG

SEQ ID NO: 38692 - protein, 386 aa, Homo sapiens
  Payload ID: 7727
  Gene Symbol: HKR1
  Gene Name: HKR1, GLI-Kruppel zinc finger family member
  ENSP ID: ENSP00000437774
MYTEWGDSFGSMSVLIKNPRTHSGGKPYVCRECGRGFTWKSNLITHQRTHSGEKPYVCKDCGRGFTWKSNLFTHQRTHSGLKPYVCKECGQSFSLKSNLITHQRAHTGEKPYVCRECGRGFRQHSHLVRHKRTHSGEKPYICRECEQGFSQKSHLIRHLRTHTGEKPYVCTECGRHFSWKSNLKTHQRTHSGVKPYVCLECGQCFSLKSNLNKHQRSHTGEKPFVCTECGRGFTRKSTLSTHQRTHSGEKPFVCAECGRGFNDKSTLISHQRTHSGEKPFMCRECGRRFRQKPNLFRHKRAHSGAFVCRECGQGFCAKLTLIKHQRAHAGGKPHVCRECGQGFSRQSHLIRHQRTHSGEKPYICRKCGRGFSRKSNLIRHQRTHSG

SEQ ID NO: 38693 - protein, 598 aa, Homo sapiens
  Payload ID: 7727
  Gene Symbol: HKR1
  Gene Name: HKR1, GLI-Kruppel zinc finger family member
  ENSP ID: ENSP00000438261
MLETYNHLVSLEIPSSKPKLIAQLERGEAPWREERKCPLDLCPESKPEIQLSPSCPLIFSSQQALSQHVWLSHLSQLFSSLWAGNPLHLGKHYPEDQKQQQDPFCFSGKAEWIQEGEDSRLLFGRVSKNGTSKALSSPPEEQQPAQSKEDNTVVDIGSSPERRADLEETDKVLHGLEVSGFGEIKYEEFGPGFIKESNLLSLQKTQTGETPYMYTEWGDSFGSMSVLIKNPRTHSGGKPYVCRECGRGFTWKSNLITHQRTHSGEKPYVCKDCGRGFTWKSNLFTHQRTHSGLKPYVCKECGQSFSLKSNLITHQRAHTGEKPYVCRECGRGFRQHSHLVRHKRTHSGEKPYICRECEQGFSQKSHLIRHLRTHTGEKPYVCTECGRHFSWKSNLKTHQRTHSGVKPYVCLECGQCFSLKSNLNKHQRSHTGEKPFVCTECGRGFTRKSTLSTHQRTHSGEKPFVCAECGRGFNDKSTLISHQRTHSGEKPFMCRECGRRFRQKPNLFRHKRAHSGAFVCRECGQGFCAKLTLIKHQRAHAGGKPHVCRECGQGFSRQSHLIRHQRTHSGEKPYICRKCGRGFSRKSNLIRHQRTHSG

SEQ ID NO: 38694 - protein, 22 aa, Homo sapiens
  Payload ID: 7727
  Gene Symbol: HKR1
  Gene Name: HKR1, GLI-Kruppel zinc finger family member
  ENSP ID: ENSP00000465297
MLETYNHLVSLEIPSSKPKLIA

SEQ ID NO: 38695 - protein, 91 aa, Homo sapiens
  Payload ID: 7727
  Gene Symbol: HKR1
  Gene Name: HKR1, GLI-Kruppel zinc finger family member
  ENSP ID: ENSP00000465862
MLETYNHLVSLEIPSSKPKLIAQLERGEAPWREERKCPLDLCPDEVSLCCLGWSAVARSRLTATSTSWFQAVLCLSLPISWDYRIEARNST

SEQ ID NO: 38696 - protein, 107 aa, Homo sapiens
  Payload ID: 7727
  Gene Symbol: HKR1
  Gene Name: HKR1, GLI-Kruppel zinc finger family member
  ENSP ID: ENSP00000465884
MLETYNHLVSLEIPSSKPKLIAQLERGEAPWREERKCPLDLCPESKPEIQLSPSCPLIFSSQQALSQHVWLSHLSQLFSSLWAGNPLHLGKHYPEDQKQQQDPFCFS

SEQ ID NO: 38697 - protein, 91 aa, Homo sapiens
  Payload ID: 7727
  Gene Symbol: HKR1
  Gene Name: HKR1, GLI-Kruppel zinc finger family member
  ENSP ID: ENSP00000465899
MLETYNHLVSLEIPSSKPKLIAQLERGEAPWREERKCPLDLCPDGALLCCQAGIQWCYIGSLQPLPPGFKQFPCLSLLSSWDYRIEARNST

SEQ ID NO: 38698 - protein, 77 aa, Homo sapiens
  Payload ID: 7727
  Gene Symbol: HKR1
  Gene Name: HKR1, GLI-Kruppel zinc finger family member
  ENSP ID: ENSP00000466360
MLETYNHLVSLEIPSSKPKLIAQLERGEAPWREERKCPLDLCPESKPEIQLSPSCPLIFSSQQALSQHVWLSHLSQL

SEQ ID NO: 38699 - protein, 386 aa, Homo sapiens; identical to SEQ ID NO: 38692
  Payload ID: 7727
  Gene Symbol: HKR1
  Gene Name: HKR1, GLI-Kruppel zinc finger family member
  ENSP ID: ENSP00000466467

SEQ ID NO: 38700 - protein, 171 aa, Homo sapiens
  Payload ID: 7727
  Gene Symbol: HKR1
  Gene Name: HKR1, GLI-Kruppel zinc finger family member
  ENSP ID: ENSP00000466472
MATGLLRAKKEAFVAFRDVAVYFTQEEWRLLSPAQRTLHREVMLETYNHLVSLEIPSSKPKLIAQLERGEAPWREERKCPLDLCPDGALLCCQAGIQWCYIGSLQPLPPGFKQFPCLSLLSSWDYRCTPPHLANFLYFSRDGVSPCWPGWSQSPDLVIHPPQPPKVLGLQA

SEQ ID NO: 38701 - protein, 132 aa, Homo sapiens
  Payload ID: 7727
  Gene Symbol: HKR1
  Gene Name: HKR1, GLI-Kruppel zinc finger family member
  ENSP ID: ENSP00000466498
MGIGCSGDFCDIPDPNCGALERTALHFVGRVFPPRPLLFLFTSPDLSSETLPFSRKSTQETRKMATGLLRAKKEKFHLLNQNSLLSWSEGKRPGERRENVHWTSVQGEWFQLSPIQYEVGCRSVTDNSSYFE

SEQ ID NO: 38702 - protein, 41 aa, Homo sapiens
  Payload ID: 7727
  Gene Symbol: HKR1
  Gene Name: HKR1, GLI-Kruppel zinc finger family member
  ENSP ID: ENSP00000466533
MATGLLRAKKESFALVAQAGVQWRNLGLPQVTGITGMRHHT

SEQ ID NO: 38703 - protein, 46 aa, Homo sapiens
  Payload ID: 7727
  Gene Symbol: HKR1
  Gene Name: HKR1, GLI-Kruppel zinc finger family member
  ENSP ID: ENSP00000466856
MLETYNHLVSLEIPSSKPKLIAQLERGEAPWREERKCPLDLCPDTE

SEQ ID NO: 38704 - protein, 641 aa, Homo sapiens
  Payload ID: 7727
  Gene Symbol: HKR1
  Gene Name: HKR1, GLI-Kruppel zinc finger family member
  ENSP ID: ENSP00000467562
MATGLLRAKKEAFVAFRDVAVYFTQEEWRLLSPAQRTLHREVMLETYNHLVSLEIPSSKPKLIAQLERGEAPWREERKCPLDLCPAESKPEIQLSPSCPLIFSSQQALSQHVWLSHLSQLFSSLWAGNPLHLGKHYPEDQKQQQDPFCFSGKAEWIQEGEDSRLLFGRVSKNGTSKALSSPPEEQQPAQSKEDNTVVDIGSSPERRADLEETDKVLHGLEVSGFGEIKYEEFGPGFIKESNLLSLQKTQTGETPYMYTEWGDSFGSMSVLIKNPRTHSGGKPYVCRECGRGFTWKSNLITHQRTHSGEKPYVCKDCGRGFTWKSNLFTHQRTHSGLKPYVCKECGQSFSLKSNLITHQRAHTGEKPYVCRECGRGFRQHSHLVRHKRTHSGEKPYICRECEQGFSQKSHLIRHLRTHTGEKPYVCTECGRHFSWKSNLKTHQRTHSGVKPYVCLECGQCFSLKSNLNKHQRSHTGEKPFVCTECGRGFTRKSTLSTHQRTHSGEKPFVCAECGRGFNDKSTLISHQRTHSGEKPFMCRECGRRFRQKPNLFRHKRAHSGAFVCRECGQGFCAKLTLIKHQRAHAGGKPHVCRECGQGFSRQSHLIRHQRTHSGEKPYICRKCGRGFSRKSNLIRHQRTHSG

SEQ ID NO: 38705 - protein, 54 aa, Homo sapiens
  Payload ID: 7727
  Gene Symbol: HKR1
  Gene Name: HKR1, GLI-Kruppel zinc finger family member
  ENSP ID: ENSP00000467822
MLETYNHLVSLEIPSSKPKLIAQLERGEAPWREERKCPLDLCPGGMVSAFAHSV

SEQ ID NO: 38706 - protein, 127 aa, Homo sapiens
  Payload ID: 7727
  Gene Symbol: HKR1
  Gene Name: HKR1, GLI-Kruppel zinc finger family member
  ENSP ID: ENSP00000468176
MATGLLRAKKEEEWRLLSPAQRTLHREVMLETYNHLVSLEIPSSKPKLIAQLERGEAPWREERKCPLDLCPAESKPEIQLSPSCPLIFSSQQALSQHVWLSHLSQLFSSLWAGNPLHLGKHYPEDQK

SEQ ID NO: 38707 - protein, 37 aa, Homo sapiens
  Payload ID: 7727
  Gene Symbol: HKR1
  Gene Name: HKR1, GLI-Kruppel zinc finger family member
  ENSP ID: ENSP00000468528
MRVNHTVSTMLPTCMVHRQTMSCSGAGGITVVLNVLK

SEQ ID NO: 38708 - protein, 21 aa, Homo sapiens
  Payload ID: 7727
  Gene Symbol: HKR1
  Gene Name: HKR1, GLI-Kruppel zinc finger family member
  ENSP ID: ENSP00000468572
MLETYNHLVSLEIPSSKPKLI

SEQ ID NO: 38709 - protein, 189 aa, Homo sapiens
  Payload ID: 7728
  Gene Symbol: HCG27
  Gene Name: HLA complex group 27 (non-protein coding)
  ENSP ID: ENSP00000453364
  MOD_RES (1)..(1): Any amino acid
XFSTHLSPNPSWCFKRVKIPDRAPGWTRNYCPAGLHFHSGRWLVVPDKEDPEGNHTLPCRAPGFSSAKLTLTRLQEGKEPTPDSRLKGTRTREMRHTRAGQLWGSFQRGAEIRLPGGAPGPGGAPQCDWVKCFQRTRVEVGGISSRPCRHLPQNPRAPPSSLLNGNAGDVLSHPLSTHTSPLIWKFFSL

SEQ ID NO: 38710 - protein, 163 aa, Homo sapiens
  Payload ID: 7728
  Gene Symbol: HCG27
  Gene Name: HLA complex group 27 (non-protein coding)
  ENSP ID: ENSP00000453627
  MOD_RES (1)..(1): Any amino acid
XQWRLKSARRRSPLCWLVVPDKEDPEGNHTLPCRAPGFSSAKLTLTRLQEGKEPTPDSRLKGTRTREMRHTRAGQLWGSFQRGAEIRLPGGAPGPGGAPQCDWVKCFQRTRVEVGGISSRPCRHLPQNPRAPPSSLLNGNAGDVLSHPLSTHTSPLIWKFFSL

SEQ ID NO: 38711 - protein, 266 aa, Homo sapiens
  Payload ID: 7729
  Gene Symbol:
  Gene Name: HLA-DRB4
  ENSP ID: ENSP00000412031
MVCLKLPGGSCMAALTVTLTVLSSPLALAGDTQPRFLEQAKCECHFLNGTERVWNLIRYIYNQEEYARYNSDLGEYQAVTELGRPDAEYWNSQKDLLERRRAEVDTYCRYNYGVVESFTVQRRVQPKVTVYPSKTQPLQHHNLLVCSVNGFYPGSIEVRWFRNGQEEKAGVVSTGLIQNGDWTFQTLVMLETVPRSGEVYTCQVEHPSMMSPLTVQWSARSESAQSKMLSGVGGFVLGLLFLGTGLFIYFRNQKGHSGLQPTGLLS

SEQ ID NO: 38712 - protein, 269 aa, Homo sapiens
  Payload ID: 7729
  Gene Symbol:
  Gene Name: HLA-DRB4
  ENSP ID: ENSP00000483579
MSWKKALRIPGGLRAATVTLMLAMLSTPVAEGRDSPEDFVYQFKAMCYFTNGTERVRYVTRYIYNREEYARFDSDVEVYRAVTPLGPPDAEYWNSQKEVLERTRAELDTVCRHNYQLELRTTLQRRGEPKVTVYPSKTQPLQHHNLLVCSVNGFYPGSIEVRWFRNGQEEKAGVVSTGLIQNGDWTFQTLVMLETVPRSGEVYTCQVEHPSMMSPLTVQWSARSESAQSKMLSGVGGFVLGLLFLGTGLFIYFRNQKGHSGLQPTGLLS

SEQ ID NO: 38713 - protein, 1292 aa, Homo sapiens
  Payload ID: 7730
  Gene Symbol: HMGXB3
  Gene Name: HMG box domain containing 3
  Uniprot ID: Q12766
  ENSP ID: ENSP00000421917
MDASYDGTEVTVVMEEIEEAYCYTSPGPPKKKKKYKIHGEKTKKPRSAYLLYYYDIYLKVQQELPHLPQSEINKKISESWRLLSVAERSYYLEKAKLEKEGLDPNSKLSALTAVVPDIPGFRKILPRSDYIIIPKSSLQEDRSCPQLELCVAQNQMSPKGPPLVSNTAPETVPSHAGMAEQCLAVEALAEEVGALTQSGAVQEIATSEILSQDVLLEDASLEVGESHQPYQTSLVIEETLVNGSPDLPTGSLAVPHPQVGESVSVVTVMRDSSESSSSAPATQFIMLPLPAYSVVENPTSIKLTTTYTRRGHGTCTSPGCSFTYVTRHKPPKCPTCGNFLGGKWIPKEKPAKVKVELASGVSSKGSVVKRNQQPVTTEQNSSKENASKLTLENSEAVSQLLNVAPPREVGEESEWEEVIISDAHVLVKEAPGNCGTAVTKTPVVKSGVQPEVTLGTTDNDSPGADVPTPSEGTSTSSPLPAPKKPTGADLLTPGSRAPELKGRARGKPSLLAAARPMRAILPAPVNVGRGSSMGLPRARQAFSLSDKTPSVRTCGLKPSTLKQLGQPIQQPSGPGEVKLPSGPSNRTSQVKVVEVKPDMFPPYKYSCTVTLDLGLATSRGRGKCKNPSCSYVYTNRHKPRICPSCGVNLAKDRTEKTTKAIEVSSPLPDVLNATEPLSTAQREIQRQSTLQLLRKVLQIPENESELAEVFALIHELNSSRLILSNVSEETVTIEQTSWSNYYESPSTQCLLCSSPLFKGGQNSLAGPQECWLLTASRLQTVTAQVKMCLNPHCLALHSFIDIYTGLFNVGNKLLVSLDLLFAIRNQIKLGEDPRVSINVVLKSVQEQTEKTLTSEELSQLQELLCNGYWAFECLTVRDYNDMICGICGVAPKVEMAQRSEENVLALKSVEFTWPEFLGSNEVNVEDFWATMETEVIEQVAFPASIPITKFDASVIAPFFPPLMRGAVVVNTEKDKNLDVQPVPGSGSALVRLLQEGTCKLDEIGSYSEEKLQHLLRQCGIPFGAEDSKDQLCFSLLALYESVQNGARAIRPPRHFTGGKIYKVCPHQVVCGSKYLVRGESARDHVDLLASSRHWPPVYVVDMATSVALCADLCYPELTNQMWGRNQGCFSSPTEPPVSVSCPELLDQHYTVDMTETEHSIQHPVTKTATRRIVHAGLQPNPGDPSAGHHSLALCPELAPYATILASIVDSKPNGVRQRPIAFDNATHYYLYNRLMDFLTSREIVNRQIHDIVQSCQPGEVVIRDTLYRLGVAQIKTETEEEGEEEEVAAVAE

SEQ ID NO: 38714 - protein, 1260 aa, Homo sapiens
  Payload ID: 7730
  Gene Symbol: HMGXB3
  Gene Name: HMG box domain containing 3
  ENSP ID: ENSP00000422231
MDASYDGTEVTVVMEEIEEAYCYTSPGPPKKKKKYKIHGEKTKKPRSAYLLYYYDIYLKVQQELPHLPQSEINKKISESWRLLSVAERSYYLEKAKLEKEGLDPNSKLSALTAVVPDIPGFRKILPRSDYIIIPKSSLQEDRSCPQLELCVAQNQMSPKGPPLVSNTAPETVPSHAGMAEQCLAVEALAEEVGALTQSGAVQEIATSEILSQDVLLEDASLEVGESHQPYQTSLVIEETLVNGSPDLPTGSLAVPHPQVGESVSVVTVMRDSSESSSSAPATQFIMLPLPAYSVVENPTSIKLTTTYTRRGHGTCTSPGCSFTYVTRHKPPKCPTCGNFLGGKWIPKEKPAKVKVELASGVSSKGSVVKRNQQPVTTEQNSSKENASKLTLENSEAEAPGNCGTAVTKTPVVKSGVQPEVTLGTTDNDSPGADVPTPSEGTSTSSPLPAPKKPTGADLLTPGSRAPELKGRARGKPSLLAAARPMRAILPAPVNVGRGSSMGLPRARQAFSLSDKTPSVRTCGLKPSTLKQLGQPIQQPSGPGEVKLPSGPSNRTSQVKVVEVKPDMFPPYKYSCTVTLDLGLATSRGRGKCKNPSCSYVYTNRHKPRICPSCGVNLAKDRTEKTTKAIEVSSPLPDVLNATEPLSTAQREIQRQSTLQLLRKVLQIPENESELAEVFALIHELNSSRLILSNVSEETVTIEQTSWSNYYESPSTQCLLCSSPLFKGGQNSLAGPQECWLLTASRLQTVTAQVKMCLNPHCLALHSFIDIYTGLFNVGNKLLVSLDLLFAIRNQIKLGEDPRVSINVVLKSVQEQTEKTLTSEELSQLQELLCNGYWAFECLTVRDYNDMICGICGVAPKVEMAQRSEENVLALKSVEFTWPEFLGSNEVNVEDFWATMETEVIEQVAFPASIPITKFDASVIAPFFPPLMRGAVVVNTEKDKNLDVQPVPGSGSALVRLLQEGTCKLDEIGSYSEEKLQHLLRQCGIPFGAEDSKDQLCFSLLALYESVQNGARAIRPPRHFTGGKIYKVCPHQVVCGSKYLVRGESARDHVDLLASSRHWPPVYVVDMATSVALCADLCYPELTNQMWGRNQGCFSSPTEPPVSVSCPELLDQHYTVDMTETEHSIQHPVTKTATRRIVHAGLQPNPGDPSAGHHSLALCPELAPYATILASIVDSKPNGVRQRPIAFDNATHYYLYNRLMDFLTSREIVNRQIHDIVQSCQPGEVVIRDTLYRLGVAQIKTETEEEGEEEEVAAVAE

SEQ ID NO: 38715 - protein, 112 aa, Homo sapiens
  Payload ID: 7730
  Gene Symbol: HMGXB3
  Gene Name: HMG box domain containing 3
  ENSP ID: ENSP00000426631
  MOD_RES (1)..(1): Any amino acid
XLKQLGQPIQQPSGPGEVKLPSGPSNRTSQVKVVEVKPDMFPPYKYSCTVTLDLGLATSRGRGKCKNPSCSYVYTNRHKPRICPSCGVNLAKDRTEKTTKAIVSLMWGTSCW

SEQ ID NO: 38716 - protein, 1538 aa, Homo sapiens
  Payload ID: 7730
  Gene Symbol: HMGXB3
  Gene Name: HMG box domain containing 3
  Uniprot ID: Q12766
  ENSP ID: ENSP00000479027
MQRTQPRPCYLNAPQQCPGAERPGRPTAGSHSFLLRPGPLAGSSPFALLDPLQAFEQFVWVRSQARAGLLRLRQGSHAVTRCRPLPVRREGRRDGSPWRSVVCRYCRCSRQTGASVTTVSLPSSSSSPGLDPRGPRQASVRSLRSEPVLLFLPFRTPYRDSEEGKREGLSRLRAVCRRAGPRGRGSFSPRDARASPRLHFLVAAVTTGAASRRQRGARVRQPSPSSSRRAKRLRECERRSLHAPPAMDASYDGTEVTVVMEEIEEAYCYTSPGPPKKKKKYKIHGEKTKKPRSAYLLYYYDIYLKVQQELPHLPQSEINKKISESWRLLSVAERSYYLEKAKLEKEGLDPNSKLSALTAVVPDIPGFRKILPRSDYIIIPKSSLQEDRSCPQLELCVAQNQMSPKGPPLVSNTAPETVPSHAGMAEQCLAVEALAEEVGALTQSGAVQEIATSEILSQDVLLEDASLEVGESHQPYQTSLVIEETLVNGSPDLPTGSLAVPHPQVGESVSVVTVMRDSSESSSSAPATQFIMLPLPAYSVVENPTSIKLTTTYTRRGHGTCTSPGCSFTYVTRHKPPKCPTCGNFLGGKWIPKEKPAKVKVELASGVSSKGSVVKRNQQPVTTEQNSSKENASKLTLENSEAVSQLLNVAPPREVGEESEWEEVIISDAHVLVKEAPGNCGTAVTKTPVVKSGVQPEVTLGTTDNDSPGADVPTPSEGTSTSSPLPAPKKPTGADLLTPGSRAPELKGRARGKPSLLAAARPMRAILPAPVNVGRGSSMGLPRARQAFSLSDKTPSVRTCGLKPSTLKQLGQPIQQPSGPGEVKLPSGPSNRTSQVKVVEVKPDMFPPYKYSCTVTLDLGLATSRGRGKCKNPSCSYVYTNRHKPRICPSCGVNLAKDRTEKTTKAIEVSSPLPDVLNATEPLSTAQREIQRQSTLQLLRKVLQIPENESELAEVFALIHELNSSRLILSNVSEETVTIEQTSWSNYYESPSTQCLLCSSPLFKGGQNSLAGPQECWLLTASRLQTVTAQVKMCLNPHCLALHSFIDIYTGLFNVGNKLLVSLDLLFAIRNQIKLGEDPRVSINVVLKSVQEQTEKTLTSEELSQLQELLCNGYWAFECLTVRDYNDMICGICGVAPKVEMAQRSEENVLALKSVEFTWPEFLGSNEVNVEDFWATMETEVIEQVAFPASIPITKFDASVIAPFFPPLMRGAVVVNTEKDKNLDVQPVPGSGSALVRLLQEGTCKLDEIGSYSEEKLQHLLRQCGIPFGAEDSKDQLCFSLLALYESVQNGARAIRPPRHFTGGKIYKVCPHQVVCGSKYLVRGESARDHVDLLASSRHWPPVYVVDMATSVALCADLCYPELTNQMWGRNQGCFSSPTEPPVSVSCPELLDQHYTVDMTETEHSIQHPVTKTATRRIVHAGLQPNPGDPSAGHHSLALCPELAPYATILASIVDSKPNGVRQRPIAFDNATHYYLYNRLMDFLTSREIVNRQIHDIVQSCQPGEVVIRDTLYRLGVAQIKTETEEEGEEEEVAAVAE

SEQ ID NO: 38717 - protein, 601 aa, Homo sapiens
  Payload ID: 7731
  Gene Symbol: HMGXB4
  Gene Name: HMG box domain containing 4
  Uniprot ID: Q9UGU5
  ENSP ID: ENSP00000216106
MAYDDSVKKEDCFDGDHTFEDIGLAAGRSQREKKRSYKDFLREEEEIAAQVRNSSKKKLKDSELYFLGTDTHKKKRKHSSDDYYYGDISSLESSQKKKKKSSPQSTDTAMDLLKAITSPLAAGSKPSKKTGEKSSGSSSHSESKKEHHRKKVSGSSGELPLEDGGSHKSKKMKPLYVNTETLTLREPDGLKMKLILSPKEKGSSSVDEESFQYPSQQATVKKSSKKSARDEQGALLLGHELQSFLKTARKKHKSSSDAHSSPGPEGCGSDASQFAESHSANLDLSGLEPILVESDSSSGGELEAGELVIDDSYREIKKKKKSKKSKKKKDKEKHKEKRHSKSKRSLGLSAVPVGEVTVTSGPPPSIPYAGAAAPPLPLPGLHTDGHSEKKKKKEEKDKERERGEKPKKKNMSAYQVFCKEYRVTIVADHPGIDFGELSKKLAEVWKQLPEKDKLIWKQKAQYLQHKQNKAEATTVKRKASSSEGSMKVKASSVGVLSPQKKSPPTTMLLPASPAKAPETEPIDVAAHLQLLGESLSLIGHRLQETEGMVAVSGSLSVLLDSIICALGPLACLTTQLPELNGCPKQVLSNTLDNIAYIMPGL

SEQ ID NO: 38718 - protein, 92 aa, Homo sapiens
  Payload ID: 7731
  Gene Symbol: HMGXB4
  Gene Name: HMG box domain containing 4
  ENSP ID: ENSP00000395532
MAYDDSVKKEDCFDGDHTFEDIGLAAGRSQREKKRSYKDFLREEEEIAAQVRNSSKKKLKDSELYFLGTDTHKKKRKHSSDDYYYGGQWFLF

SEQ ID NO: 38719 - protein, 285 aa, Homo sapiens
  Payload ID: 7731
  Gene Symbol: HMGXB4
  Gene Name: HMG box domain containing 4
  ENSP ID: ENSP00000401658
MDLLKAITSPLAAGSKPSKKTGEKSSGSSSHSESKKEHHRKKVSGSSGELPLEDGGSHKSKKMKPLYVNTETLTLREPDGLKMKLILSPKEKGSSSVDEESFQYPSQQATVKKSSKKSARDEQGALLLGHELQSFLKTARKKHKSSSDAHSSPGPEGCGSDASQFAESHSANLDLSGLEPILVESDSSSGGELEAGELVIDDSYREIKKKKKSKKSKKKKDKEKHKEKRHSKSKRSLGLSAVPVGEVTVTSGPPPSIPYAGAAAPPLPLPGLHTDGHSEKKKKKE

SEQ ID NO: 38720 - protein, 284 aa, Homo sapiens
  Payload ID: 7731
  Gene Symbol: HMGXB4
  Gene Name: HMG box domain containing 4
  ENSP ID: ENSP00000415500
MDLLKAITSPLAAGSKPSKKTGEKSSGSSSHSESKKEHHRKKVSGSSGELPLEDGGSHKSKKMKPLYVNTETLTLREPDGLKMKLILSPKEKGSSSVDEESFQYPSQQATVKKSSKKSARDEQGALLLGHELQSFLKTARKKHKSSSDAHSSPGPEGCGSDASQFAESHSANLDLSGLEPILVESDSSSGGELEAGELVIDDSYREIKKKKKSKKSKKKKDKEKHKEKRHSKSKRSLGLSAVPVGEVTVTSGPPPSIPYAGAAAPPLPLPGLHTDGHSEKKKKK

SEQ ID NO: 38721 - protein, 514 aa, Homo sapiens
  Payload ID: 7732
  Gene Symbol: HBP1
  Gene Name: HMG-box transcription factor 1
  Uniprot ID: O60381
  ENSP ID: ENSP00000222574
MVWEVKTNQMPNAVQKLLLVMDKRASGMNDSLELLQCNENLPSSPGYNSCDEHMELDDLPELQAVQSDPTQSGMYQLSSDVSHQEYPRSSWNQNTSDIPETTYRENEVDWLTELANIATSPQSPLMQCSFYNRSSPVHIIATSKSLHSYARPPPVSSSSKSEPAFPHHHWKEETPVRHERANSESESGIFCMSSLSDDDDLGWCNSWPSTVWHCFLKGTRLCFHKGSNKEWQDVEDFARAEGCDNEEDLQMGIHKGYGSDGLKLLSHEESVSFGESVLKLTFDPGTVEDGLLTVECKLDHPFYVKNKGWSSFYPSLTVVQHGIPCCEVHIGDVCLPPGHPDAINFDDSGVFDTFKSYDFTPMDSSAVYVLSSMARQRRASLSCGGPGGQDFARSGFSKNCGSPGSSQLSSNSLYAKAVKNHSSGTVSATSPNKCKRPMNAFMLFAKKYRVEYTQMYPGKDNRAISVILGDRWKKMKNEERRMYTLEAKALAEEQKRLNPDCWKRKRTNSGSQQH

SEQ ID NO: 38722 - protein, 108 aa, Homo sapiens
  Payload ID: 7732
  Gene Symbol: HBP1
  Gene Name: HMG-box transcription factor 1
  ENSP ID: ENSP00000417631
MVWEVKTNQMPNAVQKLLLVMDKRASGMNDSLELLQCNENLPSSPGYNSCDEHMELDDLPELQAVQSDPTQSGMYQLSSDVSHQEYPRSSWNQNTSDIPETTYRENEV

SEQ ID NO: 38723 - protein, 111 aa, Homo sapiens
  Payload ID: 7732
  Gene Symbol: HBP1
  Gene Name: HMG-box transcription factor 1
  ENSP ID: ENSP00000417927
MVWEVKTNQMPNAVQKLLLVMDKRASGMNDSLELLQCNENLPSSPGYNSCDEHMELDDLPELQAVQSDPTQSGMYQLSSDVSHQEYPRSSWNQNTSDIPETTYRENEVDWL

SEQ ID NO: 38724 - protein, 454 aa, Homo sapiens
  Payload ID: 7732
  Gene Symbol: HBP1
  Gene Name: HMG-box transcription factor 1
  ENSP ID: ENSP00000418017
QMPNAVQKLLLVMDKRASGMNDSLELLQCNENLPSSPGYNSCDEHMELDDLPELQAVQSDPTQSGMYQLSSDVSHQEYPRSSWNQNTSDIPETTYRENEVDWLTELANIATSPQSPLMQCSFYNRSSPVHIIATSKSLHSYARPPPVSSSSKSEPAFPHHHWKEETPVRHERANSESESGIFCMSSLSDDDDLGWCNSWPSTVWHCFLKGTRLCFHKGSNKEWQDVEDFARAEGCDNEEDLQMGIHKGYGSDGLKLLSHEESVSFGESVLKLTFDPGTVEDGLLTVECKLDHPFYVKNKGWSSFYPSLTVVQHGIPCCEVHIGDVCLPPGHPDAINFDDSGVFDTFKSYDFTPMDSSAVYVLSSMARQRRASLSCGGPGGQDFARSGFSKNCGSPGSSQLSSNSLYAKAVKNHSSGTVSATSPNKCKRPMNAFMLFAKKYRVEYTQMYPGKDNR

SEQ ID NO: 38725 - protein, 70 aa, Homo sapiens
  Payload ID: 7732
  Gene Symbol: HBP1
  Gene Name: HMG-box transcription factor 1
  ENSP ID: ENSP00000418022
MVWEVKTNQMPNAVQKLLLVMDKRASGMNDSLELLQCNENLPSSPGYNSCDEHMELDDLPELQAVQSDPT

SEQ ID NO: 38726 - protein, 514 aa, Homo sapiens; identical to SEQ ID NO: 38721
  Payload ID: 7732
  Gene Symbol: HBP1
  Gene Name: HMG-box transcription factor 1
  Uniprot ID: O60381
  ENSP ID: ENSP00000418738

SEQ ID NO: 38727 - protein, 85 aa, Homo sapiens
  Payload ID: 7732
  Gene Symbol: HBP1
  Gene Name: HMG-box transcription factor 1
  ENSP ID: ENSP00000419143
SQLSSNSLYAKAVKNHSSGTVSATSPNKCKRPMNAFMLFAKKYRVEYTQMYPGKDNRRSLAVSPKLESSGTISAHCNLRLPGSKP

SEQ ID NO: 38728 - protein, 124 aa, Homo sapiens
  Payload ID: 7732
  Gene Symbol: HBP1
  Gene Name: HMG-box transcription factor 1
  ENSP ID: ENSP00000420137
MVWEVKTNQMPNAVQKLLLVMDKRASGMNDSLELLQCNENLPSSPGYNSCDEHMELDDLPELQAVQSDPTQSGMYQLSSDVSHQEYPRSSWNQNTSDIPETTYRENEVDWLTELANIATSPQSP

SEQ ID NO: 38729 - protein, 28 aa, Homo sapiens
  Payload ID: 7732
  Gene Symbol: HBP1
  Gene Name: HMG-box transcription factor 1
  ENSP ID: ENSP00000420281
MVWEVKTNQMPNAVQKLLLVMDKRASGM

SEQ ID NO: 38730 - protein, 514 aa, Homo sapiens; identical to SEQ ID NO: 38721
  Payload ID: 7732
  Gene Symbol: HBP1
  Gene Name: HMG-box transcription factor 1
  Uniprot ID: O60381
  ENSP ID: ENSP00000420500

SEQ ID NO: 38731 - protein, 154 aa, Homo sapiens
  Payload ID: 7732
  Gene Symbol: HBP1
  Gene Name: HMG-box transcription factor 1
  ENSP ID: ENSP00000475809
  MOD_RES (1)..(1): Any amino acid
XMDSSAVYVLSSMARQRRASLSCGGPGGQDFARSGFSKNCGSPGSSQLSSNSLYAKAVKNHSSGTVSATSPNKCKRPMNAFMLFAKKYRVEYTQMYPGKDNRAISVILGDRWKKMKNEERRMYTLEAKALAEEQKRLNPDCWKRKRTNSVCFNK

SEQ ID NO: 38732 - protein, 171 aa, Homo sapiens
  Payload ID: 7733
  Gene Symbol:
  Gene Name: HMP19 protein [Source:EntrezGene
  Acc:51617]
  Uniprot ID: Q9Y328
  ENSP ID: ENSP00000307722
MVKLNSNPSEKGTKPPSVEDGFQTVPLITPLEVNHLQLPAPEKVIVKTRTEYQPEQKNKGKFRVPKIAEFTVTILVSLALAFLACIVFLVVYKAFTYDHSCPEGFVYKHKRCIPASLDAYYSSQDPNSRSRFYTVISHYSVAKQSTARAIGPWLSAAAVIHEPKPPKTQGH

SEQ ID NO: 38733 - protein, 94 aa, Homo sapiens
  Payload ID: 7733
  Gene Symbol:
  Gene Name: HMP19 protein [Source:EntrezGene
  Acc:51617]
  ENSP ID: ENSP00000427809
MVKLNSNPSEKGTKPPSVEDGFQTVPLITPLEVNHLQLPAPEKVIVKTRTEYQPEQKNKGKFRVPKIAEFTCLPHSTGPVKVDQDPAAYKYLQE

SEQ ID NO: 38734 - protein, 145 aa, Homo sapiens
  Payload ID: 7733
  Gene Symbol:
  Gene Name: HMP19 protein [Source:EntrezGene
  Acc:51617]
  ENSP ID: ENSP00000429689
MVKLNSNPSEKGTKPPSVEDGFQTVPLITPLEVNHLQLPAPEKVIVKTRTEYQPEQKNKGKFRVPKIAEFTVTILVSLALAFLACIVFLVVYKAFTYDHSCPEGFVYKHKRCIPASLDAYYSSQDPNSRSRFYTVISHYSVAKQS

SEQ ID NO: 38735 - protein, 99 aa, Homo sapiens
  Payload ID: 7733
  Gene Symbol:
  Gene Name: HMP19 protein [Source:EntrezGene
  Acc:51617]
  ENSP ID: ENSP00000429863
MVKLNSNPSEKGTKPPSVEDGFQTVPLITPLEVNHLQLPAPEKVIVKTRTEYQPEQKNKGKFRVPKIAEFTVHRTWHFSTSCRGAGMLDQFQSMKCGWK

SEQ ID NO: 38736 - protein, 158 aa, Homo sapiens
  Payload ID: 7733
  Gene Symbol:
  Gene Name: HMP19 protein [Source:EntrezGene
  Acc:51617]
  ENSP ID: ENSP00000430208
MVKLNSNPSEKGTKPPSVEDGFQTVPLITPLEVNHLQLPAPEKVIVKTRTEYQPEQKNKGKFRVPKIAEFTVTILVSLALAFLACIVFLVVYKAFTYDHSCPEGFVYKHKRCIPASLDAYYSSQDPNSRSRFYTVISHYSVAKQSTARAIGPWLSAAA

SEQ ID NO: 38737 - protein, 171 aa, Homo sapiens; identical to SEQ ID NO: 38732
  Payload ID: 7733
  Gene Symbol:
  Gene Name: HMP19 protein [Source:EntrezGene
  Acc:51617]
  Uniprot ID: Q9Y328
  ENSP ID: ENSP00000431119

SEQ ID NO: 38738 - protein, 631 aa, Homo sapiens
  Payload ID: 7734
  Gene Symbol: HNF1A
  Gene Name: HNF1 homeobox A
  ENSP ID: ENSP00000257555
MVSKLSQLQTELLAALLESGLSKEALIQALGEPGPYLLAGEGPLDKGESCGGGRGELAELPNGLGETRGSEDETDDDGEDFTPPILKELENLSPEEAAHQKAVVETLLQEDPWRVAKMVKSYLQQHNIPQREVVDTTGLNQSHLSQHLNKGTPMKTQKRAALYTWYVRKQREVAQQFTHAGQGGLIEEPTGDELPTKKGRRNRFKWGPASQQILFQAYERQKNPSKEERETLVEECNRAECIQRGVSPSQAQGLGSNLVTEVRVYNWFANRRKEEAFRHKLAMDTYSGPPPGPGPGPALPAHSSPGLPPPALSPSKVHGVRYGQPATSETAEVPSSSGGPLVTVSTPLHQVSPTGLEPSHSLLSTEAKLVSAAGGPLPPVSTLTALHSLEQTSPGLNQQPQNLIMASLPGVMTIGPGEPASLGPTFTNTGASTLVIGLASTQAQSVPVINSMGSSLTTLQPVQFSQPLHPSYQQPLMPPVQSHVTQSPFMATMAQLQSPHALYSHKPEVAQYTHTGLLPQTMLITDTTNLSALASLTPTKQVFTSDTEASSESGLHTPASQATTLHVPSQDPASIQHLQPAHRLSASPTVSSSSLVLYQSSDSSNGQSHLLPSNHSVIETFISTQMASSSQ

SEQ ID NO: 38739 - protein, 41 aa, Homo sapiens
  Payload ID: 7734
  Gene Symbol: HNF1A
  Gene Name: HNF1 homeobox A
  ENSP ID: ENSP00000438565
MVSKLSQLQTELLAALLESGLSKEASTSSPRTSSWPHFLGS

SEQ ID NO: 38740 - protein, 638 aa, Homo sapiens
  Payload ID: 7734
  Gene Symbol: HNF1A
  Gene Name: HNF1 homeobox A
  ENSP ID: ENSP00000438804
MVSKLSQLQTELLAALLESGLSKEALIQALGEPGPYLLAGEGPLDKGESCGGGRGELAELPNGLGETRGSEDETDDDGEDFTPPILKELENLSPEEAAHQKAVVETLLQEDPWRVAKMVKSYLQQHNIPQREVVDTTGLNQSHLSQHLNKGTPMKTQKRAALYTWYVRKQREVAQQFTHAGQGGLIEEPTGDELPTKKGRRNRFKWGPASQQILFQAYERQKNPSKEERETLVEECNRAECIQRGVSPSQAQGLGSNLVTEVRVYNWFANRRKEEAFRHKLAMDTYSGPPPGPGPGPALPAHSSPGLPPPALSPSKVHGVRYGQPATSETAEVPSSSGGPLVTVSTPLHQVSPTGLEPSHSLLSTEAKLVSAAGGPLPPVSTLTALHSLEQTSPGLNQQPQNLIMASLPGVMTIGPGEPASLGPTFTNTGASTLVIGLASTQAQSVPVINSMGSSLTTLQPVQFSQPLHPSYQQPLMPPVQSHVTQSPFMATMAQLQSPHALYSHKPEVAQYTHTGLLPQTMLITDTTNLSALASLTPTKQEAALLPQVFTSDTEASSESGLHTPASQATTLHVPSQDPASIQHLQPAHRLSASPTVSSSSLVLYQSSDSSNGQSHLLPSNHSVIETFISTQMASSSQ

SEQ ID NO: 38741 - protein, 452 aa, Homo sapiens
  Payload ID: 7734
  Gene Symbol: HNF1A
  Gene Name: HNF1 homeobox A
  ENSP ID: ENSP00000439721
MVSKLSQLQTELLAALLESGLSKEALIQALGEPGPYLLAGEGPLDKGESCGGGRGELAELPNGLGETRGSEDETDDDGEDFTPPILKELENLSPEEAAHQKAVVETLLQEDPWRVAKMVKSYLQQHNIPQREVVDTTGLNQSHLSQHLNKGTPMKTQKRAALYTWYVRKQREVAQQFTHAGQGGLIEEPTGDELPTKKGRRNRFKWGPASQQTSPGLNQQPQNLIMASLPGVMTIGPGEPASLGPTFTNTGASTLVIGLASTQAQSVPVINSMGSSLTTLQPVQFSQPLHPSYQQPLMPPVQSHVTQSPFMATMAQLQSPHALYSHKPEVAQYTHTGLLPQTMLITDTTNLSALASLTPTKQVFTSDTEASSESGLHTPASQATTLHVPSQDPASIQHLQPAHRLSASPTVSSSSLVLYQSSDSSNGQSHLLPSNHSVIETFISTQMASSSQ

SEQ ID NO: 38742 - protein, 247 aa, Homo sapiens
  Payload ID: 7734
  Gene Symbol: HNF1A
  Gene Name: HNF1 homeobox A
  Uniprot ID: P20823
  ENSP ID: ENSP00000440361
MVSKLSQLQTELLAALLESGLSKEALIQALGEPGPYLLAGEGPLDKGESCGGGRGELAELPNGLGETRGSEDETDDDGEDFTPPILKELENLSPEEAAHQKAVVETLLQEDPWRVAKMVKSYLQQHNIPQREVVDTTGLNQSHLSQHLNKGTPMKTQKRAALYTWYVRKQREVAQQFTHAGQGGLIEEPTGDELPTKKGRRNRFKWGPASQQILFQAYERQKNPSKEERETLVEECNRCALWTACDQ

SEQ ID NO: 38743 - protein, 662 aa, Homo sapiens
  Payload ID: 7734
  Gene Symbol: HNF1A
  Gene Name: HNF1 homeobox A
  ENSP ID: ENSP00000443112
MVSKLSQLQTELLAALLESGLSKEALIQALGEPGPYLLAGEGPLDKGESCGGGRGELAELPNGLGETRGSEDETDDDGEDFTPPILKELENLSPEEAAHQKAVVETLLQEDPWRVAKMVKSYLQQHNIPQREVVDTTGLNQSHLSQHLNKGTPMKTQKRAALYTWYVRKQREVAQQFTHAGQGGLIEEPTGDELPTKKGRRNRFKWGPASQQILFQAYERQKNPSKEERETLVEECNRAECIQRGVSPSQAQGLGSNLVTEVRVYNWFANRRKEEAFRHKLAMDTYSGPPPGPGPGPALPAHSSPGLPPPALSPSKVHGVRYGQPATSETAEVPSSSGGPLVTVSTPLHQVSPTGLEPSHSLLSTEAKLVSAAGGPLPPVSTLTALHSLEQTSPGLNQQPQNLIMASLPGVMTIGPGEPASLGPTFTNTGASTLVIGLASTQAQSVPVINSMGSSLTTLQPVQFSQPLHPSYQQPLMPPVQSHVTQSPFMATMAQLQSPHALYSHKPEVAQYTHTGLLPQTMLITDTTNLSALASLTPTKQVRSRPAGPPLACDRAPHPHIPRAQEAALLPQVFTSDTEASSESGLHTPASQATTLHVPSQDPASIQHLQPAHRLSASPTVSSSSLVLYQSSDSSNGQSHLLPSNHSVIETFISTQMASSSQ

SEQ ID NO: 38744 - protein, 278 aa, Homo sapiens
  Payload ID: 7734
  Gene Symbol: HNF1A
  Gene Name: HNF1 homeobox A
  Uniprot ID: P20823
  ENSP ID: ENSP00000443964
MVSKLSQLQTELLAALLESGLSKEALIQALGEPGPYLLAGEGPLDKGESCGGGRGELAELPNGLGETRGSEDETDDDGEDFTPPILKELENLSPEEAAHQKAVVETLLQEDPWRVAKMVKSYLQQHNIPQREVVDTTGLNQSHLSQHLNKGTPMKTQKRAALYTWYVRKQREVAQRRNASREGCPHHRHRGWAPTSSRRCVSTTGLPTGAKKKPSGTSWPWTRTAGPPQGQARDLRCPLTAPLACLHLPSPPVRSTVCAMDSLRPVRLQKYPQAAAVP

SEQ ID NO: 38745 - protein, 119 aa, Homo sapiens
  Payload ID: 7734
  Gene Symbol: HNF1A
  Gene Name: HNF1 homeobox A
  Uniprot ID: P20823
  ENSP ID: ENSP00000445445
MVSKLSQLQTELLAALLESGLSKEALIQALGEPGPYLLAGEGPLDKGESCGGGRGELAELPNGLGETRGSEDETDDDGEDFTPPILKELENLSPEEAAHQKAVVETLLQVHPCRAGRAD

SEQ ID NO: 38746 - protein, 356 aa, Homo sapiens
  Payload ID: 7734
  Gene Symbol: HNF1A
  Gene Name: HNF1 homeobox A
  ENSP ID: ENSP00000453965
  MOD_RES (1)..(1): Any amino acid
XWLVGFWGGSGCKEFGLCLPAGRQTQPTRWGRRLAWWTRAAWPCGSRAMVSKLSQLQTELLAALLESGLSKEALIQALGEPGPYLLAGEGPLDKGESCGGGRGELAELPNGLGETRGSEDETDDDGEDFTPPILKELENLSPEEAAHQKAVVETLLQEDPWRVAKMVKSYLQQHNIPQREVVDTTGLNQSHLSQHLNKGTPMKTQKRAALYTWYVRKQREVAQQFTHAGQGGLIEEPTGDELPTKKGRRNRFKWGPASQQILFQAYERQKNPSKEERETLVEECNRAECIQRGVSPSQPQPAEYRSQAGLSSWGPPPPCQHPDSTAQLGADIPRPQPAAPEPHHGLTSWGHDHRAW

SEQ ID NO: 38747 - protein, 542 aa, Homo sapiens
  Payload ID: 7734
  Gene Symbol: HNF1A
  Gene Name: HNF1 homeobox A
  ENSP ID: ENSP00000476181
MVSKLSQLQTELLAALLESGLSKEALIQALGEPGPYLLAGEGPLDKGESCGGGRGELAELPNGLGETRGSEDETDDDGEDFTPPILKELENLSPEEAAHQKAVVETLLQEDPWRVAKMVKSYLQQHNIPQREVVDTTGLNQSHLSQHLNKGTPMKTQKRAALYTWYVRKQREVAQQFTHAGQGGLIEEPTGDELPTKKGRRNRFKWGPASQQILFQAYERQKNPSKEERETLVEECNRAECIQRGVSPSQAQGLGSNLVTEVRVYNWFANRRKEEAFRHKLAMDTYSGPPPGPGPGPALPAHSSPGLPPPALSPSKVHGVRYGQPATSETAEVPSSSGGPLVTVSTPLHQVSPTGLEPSHSLLSTEAKLVSAAGGPLPPVSTLTALHSLEQTSPGLNQQPQNLIMASLPGVMTIGPGEPASLGPTFTNTGASTLVIGLASTQAQSVPVINSMGSSLTTLQPVQFSQPLHPSYQQPLMPPVQSHVTQSPFMATMAQLQSPHGERPVPHTAGDDDRGWLSMDAGERGAWQALQSACVSGTSVFP

SEQ ID NO: 38748 - protein, 235 aa, Homo sapiens [sequence omitted]

SEQ ID NO: 38749 - protein, 227 aa, Homo sapiens
  Payload ID: 7734
  Gene Symbol: HNF1A
  Gene Name: HNF1 homeobox A
  ENSP ID: ENSP00000483994
MASLPGVMTIGPGEPASLGPTFTNTGASTLVIGLASTQAQSVPVINSMGSSLTTLQPVQFSQPLHPSYQQPLMPPVQSHVTQSPFMATMAQLQSPHALYSHKPEVAQYTHTGLLPQTMLITDTTNLSALASLTPTKQVFTSDTEASSESGLHTPASQATTLHVPSQDPASIQHLQPAHRLSASPTVSSSSLVLYQSSDSSNGQSHLLPSNHSVIETFISTQMASSSQ

SEQ ID NO: 38750 - protein, 457 aa, Homo sapiens
  Payload ID: 7735
  Gene Symbol: HNF1B
  Gene Name: HNF1 homeobox B
  ENSP ID: ENSP00000477524
MVSKLTSLQQELLSALLSSGVTKEVLVQALEELLPSPNFGVKLETLPLSPGSGAEPDTKPVFHTLTNGHAKGRLSGDEGSEDGDDYDTPPILKELQALNTEEAAEQRAEVDRMLSEDPWRAAKMIKGYMQQHNIPQREVVDVTGLNQSHLSQHLNKGTPMKTQKRAALYTWYVRKQREILRQFSQQSHGPGQSDDACSEPTNKKMRRNRFKWGPASQQILYQAYDRQKNPSKEEREALVEECNRAECLQRGVSPSKAHGLGSNLVTEVRVYNWFANRRKEEAFRQKLAMDAYSSNQTHSLNPLLSHGSPHHQPSSSPPNKLSGVRYSQQGNNEITSSSTISHHGNSAMVTSQSVLQQVSPASLDPGHNLLSPDGKMISVSGGGLPPVSTLTNIHSLSHHNPQQSQNLIMTPLSGVMAIAQMSSTSLVMPTHHLLRAQQQGPCFPHHHPLGSCHGKAQ

SEQ ID NO: 38751 - protein, 425 aa, Homo sapiens
  Payload ID: 7735
  Gene Symbol: HNF1B
  Gene Name: HNF1 homeobox B
  ENSP ID: ENSP00000478682
MVSKLTSLQQELLSALLSSGVTKEVLVQALEELLPSPNFGVKLETLPLSPGSGAEPDTKPVFHTLTNGHAKGRLSGDEGSEDGDDYDTPPILKELQALNTEEAAEQRAEVDRMLSEDPWRAAKMIKGYMQQHNIPQREVVDVTGLNQSHLSQHLNKGTPMKTQKRAALYTWYVRKQREILRQFNQTVQSSGNMTDKSSQDQLLFLFPEFSQQSHGPGQSDDACSEPTNKKMRRNRFKWGPASQQILYQAYDRQKNPSKEEREALVEECNRAECLQRGVSPSKAHGLGSNLVTEVRVYNWFANRRKEEAFRQKLAMDAYSSNQTHSLNPLLSHGSPHHQPSSSPPNKLSGVRYSQQGNNEITSSSTISHHGNSAMVTSQSVLQQVSPASLDPGHNLLSPDGKMDLSLRRRFAPSQHLDEYPQPLPP

SEQ ID NO: 38752 - protein, 457 aa, Homo sapiens; identical to SEQ ID NO: 38750
  Payload ID: 7735
  Gene Symbol: HNF1B
  Gene Name: HNF1 homeobox B
  ENSP ID: ENSP00000479629

SEQ ID NO: 38753 - protein, 557 aa, Homo sapiens
  Payload ID: 7735
  Gene Symbol: HNF1B
  Gene Name: HNF1 homeobox B
  Uniprot ID: P35680
  ENSP ID: ENSP00000480291
MVSKLTSLQQELLSALLSSGVTKEVLVQALEELLPSPNFGVKLETLPLSPGSGAEPDTKPVFHTLTNGHAKGRLSGDEGSEDGDDYDTPPILKELQALNTEEAAEQRAEVDRMLSEDPWRAAKMIKGYMQQHNIPQREVVDVTGLNQSHLSQHLNKGTPMKTQKRAALYTWYVRKQREILRQFNQTVQSSGNMTDKSSQDQLLFLFPEFSQQSHGPGQSDDACSEPTNKKMRRNRFKWGPASQQILYQAYDRQKNPSKEEREALVEECNRAECLQRGVSPSKAHGLGSNLVTEVRVYNWFANRRKEEAFRQKLAMDAYSSNQTHSLNPLLSHGSPHHQPSSSPPNKLSGVRYSQQGNNEITSSSTISHHGNSAMVTSQSVLQQVSPASLDPGHNLLSPDGKMISVSGGGLPPVSTLTNIHSLSHHNPQQSQNLIMTPLSGVMAIAQSLNTSQAQSVPVINSVAGSLAALQPVQFSQQLHSPHQQPLMQQSPGSHMAQQPFMAAVTQLQNSHMYAHKQEPPQYSHTSRFPSAMVVTDTSSISTLTNMSSSKQCPLQAW

SEQ ID NO: 38754 - protein, 293 aa, Homo sapiens
  Payload ID: 7735
  Gene Symbol: HNF1B
  Gene Name: HNF1 homeobox B
  ENSP ID: ENSP00000481082
MVSKLTSLQQELLSALLSSGVTKEVLVQALEELLPSPNFGVKLETLPLSPGSGAEPDTKPVFHTLTNGHAKGRLSGDEGSEDGDDYDTPPILKELQALNTEEAAEQRAEVDRMLSEDPWRAAKMIKGYMQQHNIPQREVVDVTGLNQSHLSQHLNKGTPMKTQKRAALYTWYVRKQREILRQFSQQSHGPGQSDDACSEPTNKKMRRNRFKWGPASQRLRSAKEPQQEREALVEECNRQNVCSEGCPPPKPTAWAPTWSLRSVSTTGLQTAGRRRHSGKSWPWTPIAPTRLTA

SEQ ID NO: 38755 - protein, 293 aa, Homo sapiens; identical to SEQ ID NO: 38754
  Payload ID: 7735
  Gene Symbol: HNF1B
  Gene Name: HNF1 homeobox B
  ENSP ID: ENSP00000481245

SEQ ID NO: 38756 - protein, 548 aa, Homo sapiens
  Payload ID: 7735
  Gene Symbol: HNF1B
  Gene Name: HNF1 homeobox B
  ENSP ID: ENSP00000482529
MVSKLTSLQQELLSALLSSGVTKEVLVQALEELLPSPNFGVKLETLPLSPGSGAEPDTKPVFHTLTNGHAKGRLSGDEGSEDGDDYDTPPILKELQALNTEEAAEQRAEVDRMLSEDPWRAAKMIKGYMQQHNIPQREVVDVTGLNQSHLSQHLNKGTPMKTQKRAALYTWYVRKQREILRQFNQTVQSSGNMTDKSSQDQLLFLFPEFSQQSHGPGQSDDACSEPTNKKMRRNRFKWGPASQQILYQAYDRQKNPSKEEREALVEECNRAECLQRGVSPSKAHGLGSNLVTEVRVYNWFANRRKEEAFRQKLAMDAYSSNQTHSLNPLLSHGSPHHQPSSSPPNKLSGVRYSQQGNNEITSSSTISHHGNSAMVTSQSVLQQVSPASLDPGHNLLSPDGKMISVSGGGLPPVSTLTNIHSLSHHNPQQSQNLIMTPLSGVMAIAQSLNTSQAQSVPVINSVAGSLAALQPVQFSQQLHSPHQQPLMQQSPGSHMAQQPFMAAVTQLQNSHMSSTSLVMPTHHLLRAQQQGPCFPHHHPLGSCHGKAQ

SEQ ID NO: 38757 - protein, 531 aa, Homo sapiens
  Payload ID: 7735
  Gene Symbol: HNF1B
  Gene Name: HNF1 homeobox B
  Uniprot ID: P35680
  ENSP ID: ENSP00000482711
MVSKLTSLQQELLSALLSSGVTKEVLVQALEELLPSPNFGVKLETLPLSPGSGAEPDTKPVFHTLTNGHAKGRLSGDEGSEDGDDYDTPPILKELQALNTEEAAEQRAEVDRMLSEDPWRAAKMIKGYMQQHNIPQREVVDVTGLNQSHLSQHLNKGTPMKTQKRAALYTWYVRKQREILRQFSQQSHGPGQSDDACSEPTNKKMRRNRFKWGPASQQILYQAYDRQKNPSKEEREALVEECNRAECLQRGVSPSKAHGLGSNLVTEVRVYNWFANRRKEEAFRQKLAMDAYSSNQTHSLNPLLSHGSPHHQPSSSPPNKLSGVRYSQQGNNEITSSSTISHHGNSAMVTSQSVLQQVSPASLDPGHNLLSPDGKMISVSGGGLPPVSTLTNIHSLSHHNPQQSQNLIMTPLSGVMAIAQSLNTSQAQSVPVINSVAGSLAALQPVQFSQQLHSPHQQPLMQQSPGSHMAQQPFMAAVTQLQNSHMYAHKQEPPQYSHTSRFPSAMVVTDTSSISTLTNMSSSKQCPLQAW

SEQ ID NO: 38758 - protein, 425 aa, Homo sapiens; identical to SEQ ID NO: 38751
  Payload ID: 7735
  Gene Symbol: HNF1B
  Gene Name: HNF1 homeobox B
  ENSP ID: ENSP00000484132

SEQ ID NO: 38759 - protein, 557 aa, Homo sapiens; identical to SEQ ID NO: 38753
  Payload ID: 7735
  Gene Symbol: HNF1B
  Gene Name: HNF1 homeobox B
  Uniprot ID: P35680
  ENSP ID: ENSP00000484591

SEQ ID NO: 38760 - protein, 531 aa, Homo sapiens; identical to SEQ ID NO: 38757
  Payload ID: 7735
  Gene Symbol: HNF1B
  Gene Name: HNF1 homeobox B
  Uniprot ID: P35680
  ENSP ID: ENSP00000488080

SEQ ID NO: 38761 - protein, 548 aa, Homo sapiens; identical to SEQ ID NO: 38756
  Payload ID: 7735
  Gene Symbol: HNF1B
  Gene Name: HNF1 homeobox B
  ENSP ID: ENSP00000488519

SEQ ID NO: 38762 - protein, 746 aa, Homo sapiens
  Payload ID: 7736
  Gene Symbol: HNRNPUL2-BSCL2
  Gene Name: HNRNPUL2-BSCL2 readthrough (NMD candidate)
  ENSP ID: ENSP00000456010
MEVKRLKVTELRSELQRRGLDSRGLKVDLAQRLQEALDAEMLEDEAGGGGAGPGGACKAEPRPVAASGGGPGGDEEEDEEEEEEDEEALLEDEDEEPPPAQALGQAAQPPPEPPEAAAMEAAAEPDASEKPAEATAGSGGVNGGEEQGLGKREEDEPEERSGDETPGSEVPGDKAAEEQGDDQDSEKSKPAGSDGERRGVKRQRDEKDEHGRAYYEFREEAYHSRSKSPLPPEEEAKDEEEDQTLVNLDTYTSDLHFQVSKDRYGGQPLFSEKFPTLWSGARSTYGVTKGKVCFEAKVTQNLPMKEGCTEVSLLRVGWSVDFSRPQLGEDEFSYGFDGRGLKAENGQFEEFGQTFGENDVIGCFANFETEEVELSFSKNGEDLGVAFWISKDSLADRALLPHVLCKNCVVELNFGQKEEPFFPPPEEFVFIHAVPVEERVRTAVPPKTIEECEVILMVGLPGSGKTQWALKYAKENPEKRYNVLGAETVLNQMRMKGLEEPEMDPKSRDLLVQQASQCLSKLVQIASRTKRNFILDQCNVYNSGQRRKLLLFKTFSRKVVVVVPNEEDWKKRLELRKEVEGDDVPESIMLEMKANFSLPEKCDYMDEVTYGELEKEEAQPIVTKYKEEARKLLPPSEKRTNRRNNRNKRNRQNRSRGQGYVGGQRRGYDNRAYGQQYWGQPGNRGGYRNFYDRYRGDYDRFYGRDYEYNRYRDYYRQYNRDGPSIFHIQENVMRHRYQRLDRHFTF

SEQ ID NO: 38763 - protein, 570 aa, Homo sapiens
  Payload ID: 7737
  Gene Symbol: HJURP
  Gene Name: Holliday junction recognition protein
  ENSP ID: ENSP00000393253
MLGTLRAMEGEDVEDDQLLQKLRASRRRFQRRMQRLIEKYNQPFEDTPVVQMATLTYETPQGLRIWGGRLIKERNEGEIQCAGNRAGRDVRVTPLPSLASPAVPAPGYCSRISRKSPGDPAKPASSPREWDPLHPSSTDMALVPRNDSLSLQETSSSSFLSSQPFEDDDICNVTISDLYAGMLHSMSRLLSTKPSSIISTKTFIMQNWNSRRRHRYKSRMNKTYCKGARRSQRSSKENFIPCSEPVKGTGALRDCKNVLDVSCRKTGLKLEKAFLEVNRPQIHKLDPSWKERKVTPSKYSSLIYFDSSATYNLDEENRFRTLKWLISPVKIVSRPTIRQGHGENRQREIEIRFDQLHREYCLSPRNQPRRMCLPDSWAMNMYRGGPASPGGLQGLETRRLSLPSSKAKAKSLSEAFENLGKRSLEAGRCLPKSDSSSSLPKTNPTHSATRPQQTSDLHVQGNSSGIFRKSVSPSKTLSVPDKEVPGHGRNRYDEIKEEFDKLHQKYCLKSPGQMTVPLCIGVSTDKASMEVRYQTEGFLGKLNPDPHFQGFQKLPSSPLGCRKSLLGSTA

SEQ ID NO: 38764 - protein, 68 aa, Homo sapiens
  Payload ID: 7737
  Gene Symbol: HJURP
  Gene Name: Holliday junction recognition protein
  ENSP ID: ENSP00000395207
  MOD_RES (1)..(1): Any amino acid
XRPRLSEPQGSGRQGNSLGASDGVDNTVRPGDQGSSSQPNSEERGENTSYRMEEKSDFMLEKLETKSV

SEQ ID NO: 38765 - protein, 663 aa, Homo sapiens
  Payload ID: 7737
  Gene Symbol: HJURP
  Gene Name: Holliday junction recognition protein
  Uniprot ID: Q8NCD3
  ENSP ID: ENSP00000401944
MLGTLRAMEGEDVEDDQLLQKLRASRRRFQRRMQRLIEKYNQPFEDTPVVQMATLTYETPQGLRIWGGRLIKERNEGEIQCAGNRAGRDVRVTPLPSLASPAVPAPGYCSRISRKSPGDPAKPASSPREWDPLHPSSTDMALVPRNDSLSLQETSSSSFLSSQPFEDDDICNVTISDLYAGMLHSMSRLLSTKPSSIISTKTFIMQNWNSRRRHRYKSRMNKTYCKGARRSQRSSKENFIPCSEPVKGTGALRDCKNVLDVSCRKTGLKLEKAFLEVNRPQIHKLDPSWKERKVTPSKYSSLIYFDSSATYNLDEENRFRTLKWLISPVKIVSRPTIRQGHGENRQREIEIRFDQLHREYCLSPRNQPRRMCLPDSWAMNMYRGGPASPGGLQGLETRRLSLPSSKAKAKSLSEAFENLGKRSLEAGRCLPKSDSSSSLPKTNPTHSATRPQQTSDLHVQGNSSGIFRKSVSPSKTLSVPDKEVPGHGRNRYDEIKEEFDKLHQKYCLKSPGQMTVPLCIGVSTDKASMEVRYQTEGFLGKLNPDPHFQGFQKLPSSPLGCRKSLLGSTAIEAPSSTCVARAITRDGTRDHQFPAKRPRLSEPQGSGRQGNSLGASDGVDNTVRPGDQGSSSQPNSEERGENTSYRMEEKSDFMLEKLETKSV

SEQ ID NO: 38766 - protein, 122 aa, Homo sapiens
  Payload ID: 7737
  Gene Symbol: HJURP
  Gene Name: Holliday junction recognition protein
  ENSP ID: ENSP00000403668
MLGTLRAMEGEDVEDDQLLQKLRASRRRFQRRMQRLIEKYNQPFEDTPVVQMATLTYETPQGLRIWGGRLIKERNEGEIQDSSMKPADRTDGSVQAAAWGPELPSHRTVLGAACSASKPFEK

SEQ ID NO: 38767 - protein, 694 aa, Homo sapiens
  Payload ID: 7737
  Gene Symbol: HJURP
  Gene Name: Holliday junction recognition protein
  Uniprot ID: Q8NCD3
  ENSP ID: ENSP00000407208
MLGTLRAMEGEDVEDDQLLQKLRASRRRFQRRMQRLIEKYNQPFEDTPVVQMATLTYETPQGLRIWGGRLIKERNEGEIQPAVPQSPLKNELRRKYLTQVDILLQGAEYFECAGNRAGRDVRVTPLPSLASPAVPAPGYCSRISRKSPGDPAKPASSPREWDPLHPSSTDMALVPRNDSLSLQETSSSSFLSSQPFEDDDICNVTISDLYAGMLHSMSRLLSTKPSSIISTKTFIMQNWNSRRRHRYKSRMNKTYCKGARRSQRSSKENFIPCSEPVKGTGALRDCKNVLDVSCRKTGLKLEKAFLEVNRPQIHKLDPSWKERKVTPSKYSSLIYFDSSATYNLDEENRFRTLKWLISPVKIVSRPTIRQGHGENRQREIEIRFDQLHREYCLSPRNQPRRMCLPDSWAMNMYRGGPASPGGLQGLETRRLSLPSSKAKAKSLSEAFENLGKRSLEAGRCLPKSDSSSSLPKTNPTHSATRPQQTSDLHVQGNSSGIFRKSVSPSKTLSVPDKEVPGHGRNRYDEIKEEFDKLHQKYCLKSPGQMTVPLCIGVSTDKASMEVRYQTEGFLGKLNPDPHFQGFQKLPSSPLGCRKSLLGSTAIEAPSSTCVARAITRDGTRDHQFPAKRPRLSEPQGSGRQGNSLGASDGVDNTVRPGDQGSSSQPNSEERGENTSYRMEEKSDFMLEKLETKSV

SEQ ID NO: 38768 - protein, 268 aa, Homo sapiens
  Payload ID: 7737
  Gene Symbol: HJURP
  Gene Name: Holliday junction recognition protein
  ENSP ID: ENSP00000414051
GRGRGRRPAAAEAQGQSPPLPEAHAAADREVQPALRGHPGGANGHADLRDATGIENLGWKTNKGKKRRRDPDSKSGEVDATSDQEESVAWALAPAVPQSPLKNELRRKYLTQVDILLQGAEYFECAGNRAGRDVRVTPLPSLASPAVPAPGYCSRISRKSPGDPAKPASSPREWDPLHPSSTDMALVPRNDSLSLQETSSSSFLSSQPFEDDDICNVTISDLYAGMLHSMSRLLSTKPSSIISTKTFIMQNWNSRRRHRYKSRMNKTY

SEQ ID NO: 38769 - protein, 748 aa, Homo sapiens
  Payload ID: 7737
  Gene Symbol: HJURP
  Gene Name: Holliday junction recognition protein
  Uniprot ID: Q8NCD3
  ENSP ID: ENSP00000414109
MLGTLRAMEGEDVEDDQLLQKLRASRRRFQRRMQRLIEKYNQPFEDTPVVQMATLTYETPQGLRIWGGRLIKERNEGEIQDSSMKPADRTDGSVQAAAWGPELPSHRTVLGADSKSGEVDATSDQEESVAWALAPAVPQSPLKNELRRKYLTQVDILLQGAEYFECAGNRAGRDVRVTPLPSLASPAVPAPGYCSRISRKSPGDPAKPASSPREWDPLHPSSTDMALVPRNDSLSLQETSSSSFLSSQPFEDDDICNVTISDLYAGMLHSMSRLLSTKPSSIISTKTFIMQNWNSRRRHRYKSRMNKTYCKGARRSQRSSKENFIPCSEPVKGTGALRDCKNVLDVSCRKTGLKLEKAFLEVNRPQIHKLDPSWKERKVTPSKYSSLIYFDSSATYNLDEENRFRTLKWLISPVKIVSRPTIRQGHGENRQREIEIRFDQLHREYCLSPRNQPRRMCLPDSWAMNMYRGGPASPGGLQGLETRRLSLPSSKAKAKSLSEAFENLGKRSLEAGRCLPKSDSSSSLPKTNPTHSATRPQQTSDLHVQGNSSGIFRKSVSPSKTLSVPDKEVPGHGRNRYDEIKEEFDKLHQKYCLKSPGQMTVPLCIGVSTDKASMEVRYQTEGFLGKLNPDPHFQGFQKLPSSPLGCRKSLLGSTAIEAPSSTCVARAITRDGTRDHQFPAKRPRLSEPQGSGRQGNSLGASDGVDNTVRPGDQGSSSQPNSEERGENTSYRMEEKSDFMLEKLETKSV

SEQ ID NO: 38770 - protein, 726 aa, Homo sapiens
  Payload ID: 7738
  Gene Symbol: HLCS
  Gene Name: holocarboxylase synthetase (biotin-(proprionyl-CoA-carboxylase (ATP-hydrolysing)) ligase)
  Uniprot ID: P50747
  ENSP ID: ENSP00000338387
MEDRLHMDNGLVPQKIVSVHLQDSTLKEVKDQVSNKQAQILEPKPEPSLEIKPEQDGMEHVGRDDPKALGEEPKQRRGSASGSEPAGDSDRGGGPVEHYHLHLSSCHECLELENSTIESVKFASAENIPDLPYDYSSSLESVADETSPEREGRRVNLTGKAPNILLYVGSDSQEALGRFHEVRSVLADCVDIDSYILYHLLEDSALRDPWTDNCLLLVIATRESIPEDLYQKFMAYLSQGGKVLGLSSSFTFGGFQVTSKGALHKTVQNLVFSKADQSEVKLSVLSSGCRYQEGPVRLSPGRLQGHLENEDKDRMIVHVPFGTRGGEAVLCQVHLELPPSSNIVQTPEDFNLLKSSNFRRYEVLREILTTLGLSCDMKQVPALTPLYLLSAAEEIRDPLMQWLGKHVDSEGEIKSGQLSLRFVSSYVSEVEITPSCIPVVTNMEAFSSEHFNLEIYRQNLQTKQLGKVILFAEVTPTTMRLLDGLMFQTPQEMGLIVIAARQTEGKGRGGNVWLSPVGCALSTLLISIPLRSQLGQRIPFVQHLMSVAVVEAVRSIPEYQDINLRVKWPNDIYYSDLMKIGGVLVNSTLMGETFYILIGCGFNVTNSNPTICINDLITEYNKQHKAELKPLRADYLIARVVTVLEKLIKEFQDKGPNSVLPLYYRYWVHSGQQVHLGSAEGPKVSIVGLDDSGFLQVHQEGGEVVTVHPDGNSFDMLRNLILPKRR

SEQ ID NO: 38771 - protein, 726 aa, Homo sapiens; identical to SEQ ID NO: 38770
  Payload ID: 7738
  Gene Symbol: HLCS
  Gene Name: holocarboxylase synthetase (biotin-(proprionyl-CoA-carboxylase (ATP-hydrolysing)) ligase)
  Uniprot ID: P50747
  ENSP ID: ENSP00000382071

SEQ ID NO: 38772 - protein, 92 aa, Homo sapiens
  Payload ID: 7738
  Gene Symbol: HLCS
  Gene Name: holocarboxylase synthetase (biotin-(proprionyl-CoA-carboxylase (ATP-hydrolysing)) ligase)
  ENSP ID: ENSP00000392923
MEDRLHMDNGLVPQKIVSVHLQDSTLKEVKDQVSNKQAQILEPKPEPSLEIKPEQDGMEHVGRDDPKALGEEPKQRRGSASGSEPAGDSDRG

SEQ ID NO: 38773 - protein, 86 aa, Homo sapiens
  Payload ID: 7738
  Gene Symbol: HLCS
  Gene Name: holocarboxylase synthetase (biotin-(proprionyl-CoA-carboxylase (ATP-hydrolysing)) ligase)
  ENSP ID: ENSP00000396370
MEDRLHMDNGLVPQKIVSVHLQDSTLKEVKDQVSNKQAQILEPKPEPSLEIKPEQDGMEHVGRDDPKALGEEPKQRRGSASGSEPA

SEQ ID NO: 38774 - protein, 77 aa, Homo sapiens
  Payload ID: 7738
  Gene Symbol: HLCS
  Gene Name: holocarboxylase synthetase (biotin-(proprionyl-CoA-carboxylase (ATP-hydrolysing)) ligase)
  ENSP ID: ENSP00000396443
MEDRLHMDNGLVPQKIVSVHLQDSTLKEVKDQVSNKQAQILEPKPEPSLEIKPEQDGMEHVGRDDPKALGEEPKQRR

SEQ ID NO: 38775 - protein, 726 aa, Homo sapiens; identical to SEQ ID NO: 38770
  Payload ID: 7738
  Gene Symbol: HLCS
  Gene Name: holocarboxylase synthetase (biotin-(proprionyl-CoA-carboxylase (ATP-hydrolysing)) ligase)
  Uniprot ID: P50747
  ENSP ID: ENSP00000479939

SEQ ID NO: 38776 - protein, 268 aa, Homo sapiens
  Payload ID: 7739
  Gene Symbol: HCCS
  Gene Name: holocytochrome c synthase
  Uniprot ID: P53701
  ENSP ID: ENSP00000326579
MGLSPSAPAVAVQASNASASPPSGCPMHEGKMKGCPVNTEPSGPTCEKKTYSVPAHQERAYEYVECPIRGTAAENKENLDPSNLMPPPNQTPAPDQPFALSTVREESSIPRADSEKKWVYPSEQMFWNAMLKKGWKWKDEDISQKDMYNIIRIHNQNNEQAWKEILKWEALHAAECPCGPSLIRFGGKAKEYSPRARIRSWMGYELPFDRHDWIINRCGTEVRYVIDYYDGGEVNKDYQFTILDVRPALDSLSAVWDRMKVAWWRWTS

SEQ ID NO: 38777 - protein, 268 aa, Homo sapiens; identical to SEQ ID NO: 38776
  Payload ID: 7739
  Gene Symbol: HCCS
  Gene Name: holocytochrome c synthase
  Uniprot ID: P53701
  ENSP ID: ENSP00000370139

SEQ ID NO: 38778 - protein, 268 aa, Homo sapiens; identical to SEQ ID NO: 38776
  Payload ID: 7739
  Gene Symbol: HCCS
  Gene Name: holocytochrome c synthase
  Uniprot ID: P53701
  ENSP ID: ENSP00000370140

SEQ ID NO: 38779 - protein, 335 aa, Homo sapiens
  Payload ID: 7740
  Gene Symbol: HOXA1
  Gene Name: homeobox A1
  Uniprot ID: P49639
  ENSP ID: ENSP00000343246
MDNARMNSFLEYPILSSGDSGTCSARAYPSDHRITTFQSCAVSANSCGGDDRFLVGRGVQIGSPHHHHHHHHRHPQPATYQTSGNLGVSYSHSSCGPSYGSQNFSAPYSPYALNQEADVSGGYPQCAPAVYSGNLSSPMVQHHHHHQGYAGGAVGSPQYIHHSYGQEHQSLALATYNNSLSPLHASHQEACRSPASETSSPAQTFDWMKVKRNPPKTGKVGEYGYLGQPNAVRTNFTTKQLTELEKEFHFNKYLTRARRVEIAASLQLNETQVKIWFQNRRMKQKKREKEGLLPISPATPPGNDEKAEESSEKSSSSPCVPSPGSSTSDTLTTSH

SEQ ID NO: 38780 - protein, 137 aa, Homo sapiens
  Payload ID: 7740
  Gene Symbol: HOXA1
  Gene Name: homeobox A1
  ENSP ID: ENSP00000347851
MDNARMNSFLEYPILSSGDSGTCSARAYPSDHRITTFQSCAVSANSCGGDDRFLVGRGVQIGSPHHHHHHHHRHPQPATYQTSGNLGVSYSHSSCGPSYGSQNFSAPYSPYALNQEADPPRSLSLPRIGDIFSSADF

SEQ ID NO: 38781 - protein, 410 aa, Homo sapiens
  Payload ID: 7741
  Gene Symbol: HOXA10
  Gene Name: homeobox A10
  Uniprot ID: P31260
  ENSP ID: ENSP00000283921
MSARKGYLLPSPNYPTTMSCSESPAANSFLVDSLISSGRGEAGGGGGGAGGGGGGGYYAHGGVYLPPAADLPYGLQSCGLFPTLGGKRNEAASPGSGGGGGGLGPGAHGYGPSPIDLWLDAPRSCRMEPPDGPPPPPQQQPPPPPQPPQPAPQATSCSFAQNIKEESSYCLYDSADKCPKVSATAAELAPFPRGPPPDGCALGTSSGVPVPGYFRLSQAYGTAKGYGSGGGGAQQLGAGPFPAQPPGRGFDLPPALASGSADAARKERALDSPPPPTLACGSGGGSQGDEEAHASSSAAEELSPAPSESSKASPEKDSLGNSKGENAANWLTAKSGRKKRCPYTKHQTLELEKEFLFNMYLTRERRLEISRSVHLTDRQVKIWFQNRRMKLKKMNRENRIRELTANFNFS

SEQ ID NO: 38782 - protein, 94 aa, Homo sapiens
  Payload ID: 7741
  Gene Symbol: HOXA10
  Gene Name: homeobox A10
  Uniprot ID: P31260
  ENSP ID: ENSP00000379633
MCQGNSKGENAANWLTAKSGRKKRCPYTKHQTLELEKEFLFNMYLTRERRLEISRSVHLTDRQVKIWFQNRRMKLKKMNRENRIRELTANFNFS

SEQ ID NO: 38783 - protein, 202 aa, Homo sapiens
  Payload ID: 7741
  Gene Symbol: HOXA10
  Gene Name: homeobox A10
  ENSP ID: ENSP00000479619
MSCSESPAANSFLVDSLISSGRGEAGGGGGGAGGGGGGGYYAHGGVYLPPAADLPYGLQSCGLFPTLGGKRNEAASPGSGGGGGGLGPGAHGYGPSPIDLWLDAPRSCRRRAATRGWPVPRAAPGARFRSPARASLRLGRCGPEGASPRFAAAPHAGLRQRRGLAGRRGGARVVLGRGGALPGPFREQQSLAGEGFPGQFQR

SEQ ID NO: 38784 - protein, 313 aa, Homo sapiens
  Payload ID: 7742
  Gene Symbol: HOXA11
  Gene Name: homeobox A11
  Uniprot ID: P31270
  ENSP ID: ENSP00000006015
MDFDERGPCSSNMYLPSCTYYVSGPDFSSLPSFLPQTPSSRPMTYSYSSNLPQVQPVREVTFREYAIEPATKWHPRGNLAHCYSAEELVHRDCLQAPSAAGVPGDVLAKSSANVYHHPTPAVSSNFYSTVGRNGVLPQAFDQFFETAYGTPENLASSDYPGDKSAEKGPPAATATSAAAAAAATGAPATSSSDSGGGGGCRETAAAAEEKERRRRPESSSSPESSSGHTEDKAGGSSGQRTRKKRCPYTKYQIRELEREFFFSVYINKEKRLQLSRMLNLTDRQVKIWFQNRRMKEKKINRDRLQYYSANPLL

SEQ ID NO: 38785 - protein, 283 aa, Homo sapiens
  Payload ID: 7742
  Gene Symbol: HOXA11
  Gene Name: homeobox A11
  ENSP ID: ENSP00000448962
  MOD_RES (1)..(1): Any amino acid
XIRFKEAAAVENHVKLGYCGEPKVQPVREVTFREYAIEPATKWHPRGNLAHCYSAEELVHRDCLQAPSAAGVPGDVLAKSSANVYHHPTPAVSSNFYSTVGRNGVLPQAFDQFFETAYGTPENLASSDYPGDKSAEKGPPAATATSAAAAAAATGAPATSSSDSGGGGGCRETAAAAEEKERRRRPESSSSPESSSGHTEDKAGGSSGQRTRKKRCPYTKYQIRELEREFFFSVYINKEKRLQLSRMLNLTDRQVKIWFQNRRMKEKKINRDRLQYYSANPLL

SEQ ID NO: 38786 - protein, 388 aa, Homo sapiens
  Payload ID: 7743
  Gene Symbol: HOXA13
  Gene Name: homeobox A13
  Uniprot ID: P31271
  ENSP ID: ENSP00000222753
MTASVLLHPRWIEPTVMFLYDNGGGLVADELNKNMEGAAAAAAAAAAAAAAGAGGGGFPHPAAAAAGGNFSVAAAAAAAAAAAANQCRNLMAHPAPLAPGAASAYSSAPGEAPPSAAAAAAAAAAAAAAAAAASSSGGPGPAGPAGAEAAKQCSPCSAAAQSSSGPAALPYGYFGSGYYPCARMGPHPNAIKSCAQPASAAAAAAFADKYMDTAGPAAEEFSSRAKEFAFYHQGYAAGPYHHHQPMPGYLDMPVVPGLGGPGESRHEPLGLPMESYQPWALPNGWNGQMYCPKEQAQPPHLWKSTLPDVVSHPSDASSYRRGRKKRVPYTKVQLKELEREYATNKFITKDKRRRISATTNLSERQVTIWFQNRRVKEKKVINKLKTTS

SEQ ID NO: 38787 - protein, 376 aa, Homo sapiens
  Payload ID: 7744
  Gene Symbol: HOXA2
  Gene Name: homeobox A2
  Uniprot ID: O43364
  ENSP ID: ENSP00000222718
MNYEFEREIGFINSQPSLAECLTSFPPVADTFQSSSIKTSTLSHSTLIPPPFEQTIPSLNPGSHPRHGAGGRPKPSPAGSRGSPVPAGALQPPEYPWMKEKKAAKKTALLPAAAAAATAAATGPACLSHKESLEIADGSGGGSRRLRTAYTNTQLLELEKEFHFNKYLCRPRRVEIAALLDLTERQVKVWFQNRRMKHKRQTQCKENQNSEGKCKSLEDSEKVEEDEEEKTLFEQALSVSGALLEREGYTFQQNALSQQQAPNGHNGDSQSFPVSPLTSNEKNLKHFQHQSPTVPNCLSTMGQNCGAGLNNDSPEALEVPSLQDFSVFSTDSCLQLSDAVSPSLPGSLDSPVDISADSLDFFTDTLTTIDLQHLNY

SEQ ID NO: 38788 - protein, 443 aa, Homo sapiens
  Payload ID: 7745
  Gene Symbol: HOXA3
  Gene Name: homeobox A3
  Uniprot ID: O43365
  ENSP ID: ENSP00000324884
MQKATYYDSSAIYGGYPYQAANGFAYNANQQPYPASAALGADGEYHRPACSLQSPSSAGGHPKAHELSEACLRTLSAPPSQPPSLGEPPLHPPPPQAAPPAPQPPQPAPQPPAPTPAAPPPPSSASPPQNASNNPTPANAAKSPLLNSPTVAKQIFPWMKESRQNTKQKTSSSSSGESCAGDKSPPGQASSKRARTAYTSAQLVELEKEFHFNRYLCRPRRVEMANLLNLTERQIKIWFQNRRMKYKKDQKGKGMLTSSGGQSPSRSPVPPGAGGYLNSMHSLVNSVPYEPQSPPPFSKPPQGTYGLPPASYPASLPSCAPPPPPQKRYTAAGAGAGGTPDYDPHAHGLQGNGSYGTPHIQGSPVFVGGSYVEPMSNSGPALFGLTHLPHAASGAMDYGGAGPLGSGHHHGPGPGEPHPTYTDLTGHHPSQGRIQEAPKLTHL

SEQ ID NO: 38789 - protein, 443 aa, Homo sapiens; identical to SEQ ID NO: 38788
  Payload ID: 7745
  Gene Symbol: HOXA3
  Gene Name: homeobox A3
  Uniprot ID: O43365
  ENSP ID: ENSP00000379640

SEQ ID NO: 38790 - protein, 84 aa, Homo sapiens
  Payload ID: 7745
  Gene Symbol: HOXA3
  Gene Name: homeobox A3
  ENSP ID: ENSP00000429426
MQKATYYDSSAIYGGYPYQAANGFAYNANQQPYPASAALGADGEYHRPACSLQSPSSAGGHPKAHELSEACLRTLSAPPSQPPS

SEQ ID NO: 38791 - protein, 54 aa, Homo sapiens
  Payload ID: 7745
  Gene Symbol: HOXA3
  Gene Name: homeobox A3
  ENSP ID: ENSP00000430566
MQKATYYDSSAIYGGYPYQAANGFAYNANQQPYPASAALGADGEYHRPACSLQS

SEQ ID NO: 38792 - protein, 443 aa, Homo sapiens; identical to SEQ ID NO: 38788
  Payload ID: 7745
  Gene Symbol: HOXA3
  Gene Name: homeobox A3
  Uniprot ID: O43365
  ENSP ID: ENSP00000484411

SEQ ID NO: 38793 - protein, 320 aa, Homo sapiens
  Payload ID: 7746
  Gene Symbol: HOXA4
  Gene Name: homeobox A4
  Uniprot ID: Q00056
  ENSP ID: ENSP00000353151
MTMSSFLINSNYIEPKFPPFEEYAQHSGSGGADGGPGGGPGYQQPPAPPTQHLPLQQPQLPHAGGGREPTASYYAPRTAREPAYPAAALYPAHGAADTAYPYGYRGGASPGRPPQPEQPPAQAKGPAHGLHASHVLQPQLPPPLQPRAVPPAAPRRCEAAPATPGVPAGGSAPACPLLLADKSPLGLKGKEPVVYPWMKKIHVSAVNPSYNGGEPKRSRTAYTRQQVLELEKEFHFNRYLTRRRRIEIAHTLCLSERQVKIWFQNRRMKWKKDHKLPNTKMRSSNSASASAGPPGKAQTQSPHLHPHPHPSTSTPVPSSI

SEQ ID NO: 38794 - protein, 320 aa, Homo sapiens; identical to SEQ ID NO: 38793
  Payload ID: 7746
  Gene Symbol: HOXA4
  Gene Name: homeobox A4
  Uniprot ID: Q00056
  ENSP ID: ENSP00000408845

SEQ ID NO: 38795 - protein, 140 aa, Homo sapiens
  Payload ID: 7746
  Gene Symbol: HOXA4
  Gene Name: homeobox A4
  ENSP ID: ENSP00000448015
  MOD_RES (1)..(1): Any amino acid
XKSPLGLKGKEPVVYPWMKKIHVSAVNPSYNGGEPKRSRTAYTRQQVLELEKEFHFNRYLTRRRRIEIAHTLCLSERQVKIWFQNRRMKWKKDHKLPNTKMRSSNSASASAGPPGKAQTQSPHLHPHPHPSTSTPVPSSI

SEQ ID NO: 38796 - protein, 320 aa, Homo sapiens; identical to SEQ ID NO: 38793
  Payload ID: 7746
  Gene Symbol: HOXA4
  Gene Name: homeobox A4
  Uniprot ID: Q00056
  ENSP ID: ENSP00000479166

SEQ ID NO: 38797 - protein, 270 aa, Homo sapiens
  Payload ID: 7747
  Gene Symbol: HOXA5
  Gene Name: homeobox A5
  Uniprot ID: P20719
  ENSP ID: ENSP00000222726
MSSYFVNSFCGRYPNGPDYQLHNYGDHSSVSEQFRDSASMHSGRYGYGYNGMDLSVGRSGSGHFGSGERARSYAASASAAPAEPRYSQPATSTHSPQPDPLPCSAVAPSPGSDSHHGGKNSLSNSSGASADAGSTHISSREGVGTASGAEEDAPASSEQASAQSEPSPAPPAQPQIYPWMRKLHISHDNIGGPEGKRARTAYTRYQTLELEKEFHFNRYLTRRRRIEIAHALCLSERQIKIWFQNRRMKWKKDNKLKSMSMAAAGGAFRP

SEQ ID NO: 38798 - protein, 233 aa, Homo sapiens
  Payload ID: 7748
  Gene Symbol: HOXA6
  Gene Name: homeobox A6
  Uniprot ID: P31267
  ENSP ID: ENSP00000222728
MSSYFVNPTFPGSLPSGQDSFLGQLPLYQAGYDALRPFPASYGASSLPDKTYTSPCFYQQSNSVLACNRASYEYGASCFYSDKDLSGASPSGSGKQRGPGDYLHFSPEQQYKPDSSSGQGKALHDEGADRKYTSPVYPWMQRMNSCAGAVYGSHGRRGRQTYTRYQTLELEKEFHFNRYLTRRRRIEIANALCLTERQIKIWFQNRRMKWKKENKLINSTQPSGEDSEAKAGE

SEQ ID NO: 38799 - protein, 230 aa, Homo sapiens
  Payload ID: 7749
  Gene Symbol: HOXA7
  Gene Name: homeobox A7
  Uniprot ID: P31268
  ENSP ID: ENSP00000242159
MSSSYYVNALFSKYTAGASLFQNAEPTSCSFAPNSQRSGYGAGAGAFASTVPGLYNVNSPLYQSPFASGYGLGADAYGNLPCASYDQNIPGLCSDLAKGACDKTDEGALHGAAEANFRIYPWMRSSGPDRKRGRQTYTRYQTLELEKEFHFNRYLTRRRRIEIAHALCLTERQIKIWFQNRRMKWKKEHKDEGPTAAAAPEGAVPSAAATAAADKADEEDDDEEEEDEEE

SEQ ID NO: 38800 - protein, 30 aa, Homo sapiens
  Payload ID: 7749
  Gene Symbol: HOXA7
  Gene Name: homeobox A7
  ENSP ID: ENSP00000428563
MSSSYYVNALFSKYTAGASLFQNAEPTSCS

SEQ ID NO: 38801 - protein, 272 aa, Homo sapiens
  Payload ID: 7750
  Gene Symbol: HOXA9
  Gene Name: homeobox A9
  Uniprot ID: P31269
  ENSP ID: ENSP00000343619
MATTGALGNYYVDSFLLGADAADELSVGRYAPGTLGQPPRQAATLAEHPDFSPCSFQSKATVFGASWNPVHAAGANAVPAAVYHHHHHHPYVHPQAPVAAAAPDGRYMRSWLEPTPGALSFAGLPSSRPYGIKPEPLSARRGDCPTLDTHTLSLTDYACGSPPVDREKQPSEGAFSENNAENESGGDKPPIDPNNPAANWLHARSTRKKRCPYTKHQTLELEKEFLFNMYLTRDRRYEVARLLNLTERQVKIWFQNRRMKMKKINKDRAKDE

SEQ ID NO: 38802 - protein, 106 aa, Homo sapiens
  Payload ID: 7750
  Gene Symbol: HOXA9
  Gene Name: homeobox A9
  ENSP ID: ENSP00000379634
MATTGALGNYYVDSFLLGADAADELSVGRYAPGTLGQPPRQAATLAEHPDFSPCSFQSKATVFGASWNPVHAAGANAVPAAVYHHHHHHPYVHPQAPVAAAAPDGS

SEQ ID NO: 38803 - protein, 550 aa, Homo sapiens
  Payload ID: 7751
  Gene Symbol: HOMEZ
  Gene Name: homeobox and leucine zipper encoding
  Uniprot ID: Q8IX15
  ENSP ID: ENSP00000350049
MVRGWEPPPGLDCAISEGHKSEGTMPPNKEASGLSSSPAGLICLPPISEELQLVWTQAAQTSELDSNEHLLKTFSYFPYPSLADIALLCLRYGLQMEKVKTWFMAQRLRCGISWSSEEIEETRARVVYRRDQLHFKSLLSFTHHAGRPPEEVPPPPVPAPEQVGIGIGPPTLSKPTQTKGLKVEPEEPSQMPPLPQSHQKLKESLMTPGSGAFPYQSDFWQHLQSSGLSKEQAGRGPNQSHGIGTASWNHSTTVPQPQARDKPPPIALIASSCKEESASSVTPSSSSTSSSFQVLANGATAASKPLQPLGCVPQSVSPSEQALPPHLEPAWPQGLRHNSVPGRVGPTEYLSPDMQRQRKTKRKTKEQLAILKSFFLQCQWARREDYQKLEQITGLPRPEIIQWFGDTRYALKHGQLKWFRDNAVPGAPSFQDPAIPTPPPSTRSLNERAETPPLPIPPPPPDIQPLERYWAAHQQLRETDIPQLSQASRLSTQQVLDWFDSRLPQPAEVVVCLDEEEEEEEEELPEDDEEEEEEEEEDDDDDDDDVIIQD

SEQ ID NO: 38804 - protein, 552 aa, Homo sapiens
  Payload ID: 7751
  Gene Symbol: HOMEZ
  Gene Name: homeobox and leucine zipper encoding
  Uniprot ID: Q8IX15
  ENSP ID: ENSP00000453979
MLKSRISMRSRHPRRAISEGHKSEGTMPPNKEASGLSSSPAGLICLPPISEELQLVWTQAAQTSELDSNEHLLKTFSYFPYPSLADIALLCLRYGLQMEKVKTWFMAQRLRCGISWSSEEIEETRARVVYRRDQLHFKSLLSFTHHAGRPPEEVPPPPVPAPEQVGIGIGPPTLSKPTQTKGLKVEPEEPSQMPPLPQSHQKLKESLMTPGSGAFPYQSDFWQHLQSSGLSKEQAGRGPNQSHGIGTASWNHSTTVPQPQARDKPPPIALIASSCKEESASSVTPSSSSTSSSFQVLANGATAASKPLQPLGCVPQSVSPSEQALPPHLEPAWPQGLRHNSVPGRVGPTEYLSPDMQRQRKTKRKTKEQLAILKSFFLQCQWARREDYQKLEQITGLPRPEIIQWFGDTRYALKHGQLKWFRDNAVPGAPSFQDPAIPTPPPSTRSLNERAETPPLPIPPPPPDIQPLERYWAAHQQLRETDIPQLSQASRLSTQQVLDWFDSRLPQPAEVVVCLDEEEEEEEEELPEDDEEEEEEEEEDDDDDDDDVIIQD

SEQ ID NO: 38805 - protein, 324 aa, Homo sapiens
  Payload ID: 7751
  Gene Symbol: HOMEZ
  Gene Name: homeobox and leucine zipper encoding
  ENSP ID: ENSP00000475307
QMEKVKTWFMAQRLRCGISWSSEEIEETRARVVYRRDQLHFKSLLSFTHHAGRPPEEVPPPPVPAPEQVGIGIGTASWNHSTTVPQPQARDKPPPIALIASSCKEESASSVTPSSSSTSSSFQVLANGATAASKPLQPLGCVPQSVSPSEQALPPHLEPAWPQGLRHNSVPGRVGPTEYLSPDMQRQRKTKRKTKEQLAILKSFFLQCQWARREDYQKLEQITGLPRPEIIQWFGDTRYALKHGQLKWFRDNAVPGAPSFQDPAIPTPPPSTRSLNERAETPPLPIPPPPPDIQPLERYWAAHQQLRETDIPQLSQASRLSTQQ

SEQ ID NO: 38806 - protein, 301 aa, Homo sapiens
  Payload ID: 7752
  Gene Symbol: HOXB1
  Gene Name: homeobox B1
  Uniprot ID: P14653
  ENSP ID: ENSP00000355140
MDYNRMNSFLEYPLCNRGPSAYSAHSAPTSFPPSSAQAVDSYASEGRYGGGLSSPAFQQNSGYPAQQPPSTLGVPFPSSAPSGYAPAACSPSYGPSQYYPLGQSEGDGGYFHPSSYGAQLGGLSDGYGAGGAGPGPYPPQHPPYGNEQTASFAPAYADLLSEDKETPCPSEPNTPTARTFDWMKVKRNPPKTAKVSEPGLGSPSGLRTNFTTRQLTELEKEFHFNKYLSRARRVEIAATLELNETQVKIWFQNRRMKQKKREREEGRVPPAPPGCPKEAAGDASDQSTCTSPEASPSSVTS

SEQ ID NO: 38807 - protein, 232 aa, Homo sapiens
  Payload ID: 7752
  Gene Symbol: HOXB1
  Gene Name: homeobox B1
  Uniprot ID: P14653
  ENSP ID: ENSP00000459066
MDYNRMNSFLEYPLCNRGPSAYSAHSAPTSFPPSSAQAVDSYASEGRYGGGLSSPAFQQNSGYPAQQPPSTLGVPFPSSAPSGYAPAACSPSYGPSQYYPLGQSEGDGGYFHPSSYGAQLGGLSDGYGAGGAGPGPYPPQHPPYGNEQTASFAPAYADLLSEDKETPCPSEPNTPTARTFDWMKVKRNPPKTGRAQMWPPLLRGPKHLCFPCSDMSWVWAGFFSFSGSGRHR

SEQ ID NO: 38808 - protein, 284 aa, Homo sapiens
  Payload ID: 7753
  Gene Symbol: HOXB13
  Gene Name: homeobox B13
  Uniprot ID: Q92826
  ENSP ID: ENSP00000290295
MEPGNYATLDGAKDIEGLLGAGGGRNLVAHSPLTSHPAAPTLMPAVNYAPLDLPGSAEPPKQCHPCPGVPQGTSPAPVPYGYFGGGYYSCRVSRSSLKPCAQAATLAAYPAETPTAGEEYPSRPTEFAFYPGYPGTYQPMASYLDVSVVQTLGAPGEPRHDSLLPVDSYQSWALAGGWNSQMCCQGEQNPPGPFWKAAFADSSGQHPPDACAFRRGRKKRIPYSKGQLRELEREYAANKFITKDKRRKISAATSLSERQITIWFQNRRVKEKKVLAKVKNSATP

SEQ ID NO: 38809 - protein, 356 aa, Homo sapiens
  Payload ID: 7754
  Gene Symbol: HOXB2
  Gene Name: homeobox B2
  Uniprot ID: P14652
  ENSP ID: ENSP00000331741
MNFEFEREIGFINSQPSLAECLTSFPAVLETFQTSSIKESTLIPPPPPFEQTFPSLQPGASTLQRPRSQKRAEDGPALPPPPPPPLPAAPPAPEFPWMKEKKSAKKPSQSATSPSPAASAVPASGVGSPADGLGLPEAGGGGARRLRTAYTNTQLLELEKEFHFNKYLCRPRRVEIAALLDLTERQVKVWFQNRRMKHKRQTQHREPPDGEPACPGALEDICDPAEEPAASPGGPSASRAAWEACCHPPEVVPGALSADPRPLAVRLEGAGASSPGCALRGAGGLEPGPLPEDVFSGRQDSPFLPDLNFFAADSCLQLSGGLSPSLQGSLDSPVPFSEEELDFFTSTLCAIDLQFP

SEQ ID NO: 38810 - protein, 431 aa, Homo sapiens
  Payload ID: 7755
  Gene Symbol: HOXB3
  Gene Name: homeobox B3
  Uniprot ID: P14651
  ENSP ID: ENSP00000308252
MQKATYYDNAAAALFGGYSSYPGSNGFGFDVPPQPPFQAATHLEGDYQRSACSLQSLGNAAPHAKSKELNGSCMRPGLAPEPLSAPPGSPPPSAAPTSATSNSSNGGGPSKSGPPKCGPGTNSTLTKQIFPWMKESRQTSKLKNNSPGTAEGCGGGGGGGGGGGSGGSGGGGGGGGGGDKSPPGSAASKRARTAYTSAQLVELEKEFHFNRYLCRPRRVEMANLLNLSERQIKIWFQNRRMKYKKDQKAKGLASSSGGPSPAGSPPQPMQSTAGFMNALHSMTPSYESPSPPAFGKAHQNAYALPSNYQPPLKGCGAPQKYPPTPAPEYEPHVLQANGGAYGTPTMQGSPVYVGGGGYADPLPPPAGPSLYGLNHLSHHPSGNLDYNGAPPMAPSQHHGPCEPHPTYTDLSSHHAPPPQGRIQEAPKLTHL

SEQ ID NO: 38811 - protein, 431 aa, Homo sapiens; identical to SEQ ID NO: 38810
  Payload ID: 7755
  Gene Symbol: HOXB3
  Gene Name: homeobox B3
  Uniprot ID: P14651
  ENSP ID: ENSP00000417207

SEQ ID NO: 38812 - protein, 90 aa, Homo sapiens
  Payload ID: 7755
  Gene Symbol: HOXB3
  Gene Name: homeobox B3
  ENSP ID: ENSP00000417400
MRPGLAPEPLSAPPGSPPPSAAPTSATSNSSNGGGPSKSGPPKCGPGTNSTLTKQIFPWMKESRQTSKLKNNSPGTAEGCGGGGGGGGGG

SEQ ID NO: 38813 - protein, 299 aa, Homo sapiens
  Payload ID: 7755
  Gene Symbol: HOXB3
  Gene Name: homeobox B3
  Uniprot ID: P14651
  ENSP ID: ENSP00000418035
MKESRQTSKLKNNSPGTAEGCGGGGGGGGGGGSGGSGGGGGGGGGGDKSPPGSAASKRARTAYTSAQLVELEKEFHFNRYLCRPRRVEMANLLNLSERQIKIWFQNRRMKYKKDQKAKGLASSSGGPSPAGSPPQPMQSTAGFMNALHSMTPSYESPSPPAFGKAHQNAYALPSNYQPPLKGCGAPQKYPPTPAPEYEPHVLQANGGAYGTPTMQGSPVYVGGGGYADPLPPPAGPSLYGLNHLSHHPSGNLDYNGAPPMAPSQHHGPCEPHPTYTDLSSHHAPPPQGRIQEAPKLTHL

SEQ ID NO: 38814 - protein, 358 aa, Homo sapiens
  Payload ID: 7755
  Gene Symbol: HOXB3
  Gene Name: homeobox B3
  Uniprot ID: P14651
  ENSP ID: ENSP00000418729
MRPGLAPEPLSAPPGSPPPSAAPTSATSNSSNGGGPSKSGPPKCGPGTNSTLTKQIFPWMKESRQTSKLKNNSPGTAEGCGGGGGGGGGGGSGGSGGGGGGGGGGDKSPPGSAASKRARTAYTSAQLVELEKEFHFNRYLCRPRRVEMANLLNLSERQIKIWFQNRRMKYKKDQKAKGLASSSGGPSPAGSPPQPMQSTAGFMNALHSMTPSYESPSPPAFGKAHQNAYALPSNYQPPLKGCGAPQKYPPTPAPEYEPHVLQANGGAYGTPTMQGSPVYVGGGGYADPLPPPAGPSLYGLNHLSHHPSGNLDYNGAPPMAPSQHHGPCEPHPTYTDLSSHHAPPPQGRIQEAPKLTHL

SEQ ID NO: 38815 - protein, 431 aa, Homo sapiens; identical to SEQ ID NO: 38810
  Payload ID: 7755
  Gene Symbol: HOXB3
  Gene Name: homeobox B3
  Uniprot ID: P14651
  ENSP ID: ENSP00000418892

SEQ ID NO: 38816 - protein, 358 aa, Homo sapiens; identical to SEQ ID NO: 38814
  Payload ID: 7755
  Gene Symbol: HOXB3
  Gene Name: homeobox B3
  Uniprot ID: P14651
  ENSP ID: ENSP00000419676

SEQ ID NO: 38817 - protein, 431 aa, Homo sapiens; identical to SEQ ID NO: 38810
  Payload ID: 7755
  Gene Symbol: HOXB3
  Gene Name: homeobox B3
  Uniprot ID: P14651
  ENSP ID: ENSP00000420595

SEQ ID NO: 38818 - protein, 119 aa, Homo sapiens
  Payload ID: 7755
  Gene Symbol: HOXB3
  Gene Name: homeobox B3
  ENSP ID: ENSP00000446783
MNGICRVRARGGERRKGGEICRLPLALGLDVNIYYVCLFSPRRWLRPRRPPTRSPAEQSPEAEFLRRLLIRLPPAPKTCCRPRGSALGRLVCWEPASDNRFGVLIACSSSPPWAIVGGW

SEQ ID NO: 38819 - protein, 297 aa, Homo sapiens
  Payload ID: 7755
  Gene Symbol: HOXB3
  Gene Name: homeobox B3
  ENSP ID: ENSP00000449977
MNGICRVRARGGERRKEGCGGGGGGGGGGGSGGSGGGGGGGGGGDKSPPGSAASKRARTAYTSAQLVELEKEFHFNRYLCRPRRVEMANLLNLSERQIKIWFQNRRMKYKKDQKAKGLASSSGGPSPAGSPPQPMQSTAGFMNALHSMTPSYESPSPPAFGKAHQNAYALPSNYQPPLKGCGAPQKYPPTPAPEYEPHVLQANGGAYGTPTMQGSPVYVGGGGYADPLPPPAGPSLYGLNHLSHHPSGNLDYNGAPPMAPSQHHGPCEPHPTYTDLSSHHAPPPQGRIQEAPKLTHL

SEQ ID NO: 38820 - protein, 251 aa, Homo sapiens
  Payload ID: 7756
  Gene Symbol: HOXB4
  Gene Name: homeobox B4
  Uniprot ID: P17483
  ENSP ID: ENSP00000328928
MAMSSFLINSNYVDPKFPPCEEYSQSDYLPSDHSPGYYAGGQRRESSFQPEAGFGRRAACTVQRYAACRDPGPPPPPPPPPPPPPPPGLSPRAPAPPPAGALLPEPGQRCEAVSSSPPPPPCAQNPLHPSPSHSACKEPVVYPWMRKVHVSTVNPNYAGGEPKRSRTAYTRQQVLELEKEFHYNRYLTRRRRVEIAHALCLSERQIKIWFQNRRMKWKKDHKLPNTKIRSGGAAGSAGGPPGRPNGGPRAL

SEQ ID NO: 38821 - protein, 269 aa, Homo sapiens
  Payload ID: 7757
  Gene Symbol: HOXB5
  Gene Name: homeobox B5
  Uniprot ID: P09067
  ENSP ID: ENSP00000239151
MSSYFVNSFSGRYPNGPDYQLLNYGSGSSLSGSYRDPAAMHTGSYGYNYNGMDLSVNRSSASSSHFGAVGESSRAFPAPAQEPRFRQAASSCSLSSPESLPCTNGDSHGAKPSASSPSDQATSASSSANFTEIDEASASSEPEEAASQLSSPSLARAQPEPMATSTAAPEGQTPQIFPWMRKLHISHDMTGPDGKRARTAYTRYQTLELEKEFHFNRYLTRRRRIEIAHALCLSERQIKIWFQNRRMKWKKDNKLKSMSLATAGSAFQP

SEQ ID NO: 38822 - protein, 224 aa, Homo sapiens
  Payload ID: 7758
  Gene Symbol: HOXB6
  Gene Name: homeobox B6
  Uniprot ID: P17509
  ENSP ID: ENSP00000225648
MSSYFVNSTFPVTLASGQESFLGQLPLYSSGYADPLRHYPAPYGPGPGQDKGFATSSYYPPAGGGYGRAAPCDYGPAPAFYREKESACALSGADEQPPFHPEPRKSDCAQDKSVFGETEEQKCSTPVYPWMQRMNSCNSSSFGPSGRRGRQTYTRYQTLELEKEFHYNRYLTRRRRIEIAHALCLTERQIKIWFQNRRMKWKKESKLLSASQLSAEEEEEKQAE

SEQ ID NO: 38823 - protein, 224 aa, Homo sapiens; identical to SEQ ID NO: 38822
  Payload ID: 7758
  Gene Symbol: HOXB6
  Gene Name: homeobox B6
  Uniprot ID: P17509
  ENSP ID: ENSP00000420009

SEQ ID NO: 38824 - protein, 217 aa, Homo sapiens
  Payload ID: 7759
  Gene Symbol: HOXB7
  Gene Name: homeobox B7
  Uniprot ID: P09629
  ENSP ID: ENSP00000239165
MSSLYYANTLFSKYPASSSVFATGAFPEQTSCAFASNPQRPGYGAGSGASFAASMQGLYPGGGGMAGQSAAGVYAAGYGLEPSSFNMHCAPFEQNLSGVCPGDSAKAAGAKEQRDSDLAAESNFRIYPWMRSSGTDRKRGRQTYTRYQTLELEKEFHYNRYLTRRRRIEIAHTLCLTERQIKIWFQNRRMKWKKENKTAGPGTTGQDRAEAEEEEEE

SEQ ID NO: 38825 - protein, 243 aa, Homo sapiens
  Payload ID: 7760
  Gene Symbol: HOXB8
  Gene Name: homeobox B8
  Uniprot ID: P17481
  ENSP ID: ENSP00000239144
MSSYFVNSLFSKYKTGESLRPNYYDCGFAQDLGGRPTVVYGPSSGGSFQHPSQIQEFYHGPSSLSTAPYQQNPCAVACHGDPGNFYGYDPLQRQSLFGAQDPDLVQYADCKLAAASGLGEEAEGSEQSPSPTQLFPWMRPQAAAGRRRGRQTYSRYQTLELEKEFLFNPYLTRKRRIEVSHALGLTERQVKIWFQNRRMKWKKENNKDKFPSSKCEQEELEKQKLERAPEAADEGDAQKGDKK

SEQ ID NO: 38826 - protein, 128 aa, Homo sapiens
  Payload ID: 7760
  Gene Symbol: HOXB8
  Gene Name: homeobox B8
  ENSP ID: ENSP00000460254
  MOD_RES (1)..(1): Any amino acid
XYSRYQTLELEKEFLFNPYLTRKRRIEVSHALGLTERQVKIWFQNRRMKWKKENNKDKFPSSKCEQEELEKQKLERAPEAADEGDAQKGDKKNGSVQGPWAGSCALGAPRKTCSISARISGAPRETES

SEQ ID NO: 38827 - protein, 242 aa, Homo sapiens
  Payload ID: 7760
  Gene Symbol: HOXB8
  Gene Name: homeobox B8
  ENSP ID: ENSP00000460659
MSSYFVNSLFSKYKTGESLRPNYYDCGFAQDLGGRPTVVYGPSSGGSFQHPSQIQEFYHGPSSLSTAPYQQNPCAVACHGDPGNFYGYDPLQRQSLFGAQDPDLVQYADCKLAAASGLGEEAEGSEQSPSPTQLFPWMRPQAAGRRRGRQTYSRYQTLELEKEFLFNPYLTRKRRIEVSHALGLTERQVKIWFQNRRMKWKKENNKDKFPSSKCEQEELEKQKLERAPEAADEGDAQKGDKK

SEQ ID NO: 38828 - protein, 250 aa, Homo sapiens
  Payload ID: 7761
  Gene Symbol: HOXB9
  Gene Name: homeobox B9
  Uniprot ID: P17482
  ENSP ID: ENSP00000309439
MSISGTLSSYYVDSIISHESEDAPPAKFPSGQYASSRQPGHAEHLEFPSCSFQPKAPVFGASWAPLSPHASGSLPSVYHPYIQPQGVPPAESRYLRTWLEPAPRGEAAPGQGQAAVKAEPLLGAPGELLKQGTPEYSLETSAGREAVLSNQRPGYGDNKICEGSEDKERPDQTNPSANWLHARSSRKKRCPYTKYQTLELEKEFLFNMYLTRDRRHEVARLLNLSERQVKIWFQNRRMKMKKMNKEQGKE

SEQ ID NO: 38829 - protein, 342 aa, Homo sapiens
  Payload ID: 7762
  Gene Symbol: HOXC10
  Gene Name: homeobox C10
  Uniprot ID: Q9NYD6
  ENSP ID: ENSP00000307321
MTCPRNVTPNSYAEPLAAPGGGERYSRSAGMYMQSGSDFNCGVMRGCGLAPSLSKRDEGSSPSLALNTYPSYLSQLDSWGDPKAAYRLEQPVGRPLSSCSYPPSVKEENVCCMYSAEKRAKSGPEAALYSHPLPESCLGEHEVPVPSYYRASPSYSALDKTPHCSGANDFEAPFEQRASLNPRAEHLESPQLGGKVSFPETPKSDSQTPSPNEIKTEQSLAGPKGSPSESEKERAKAADSSPDTSDNEAKEEIKAENTTGNWLTAKSGRKKRCPYTKHQTLELEKEFLFNMYLTRERRLEISKTINLTDRQVKIWFQNRRMKLKKMNRENRIRELTSNFNFT

SEQ ID NO: 38830 - protein, 127 aa, Homo sapiens
  Payload ID: 7762
  Gene Symbol: HOXC10
  Gene Name: homeobox C10
  ENSP ID: ENSP00000421946
MYSAEKRAKSGPEAALYSHPLPESCLGEHEVPVPSYYRASPSYSALDKTPHCSGANDFEAPFEQRASLNPRAEHLESPQLGGKVSFPETPKSDSQTPSPNEIKTEQSLAGPKGSPSESEKERAKAAD

SEQ ID NO: 38831 - protein, 378 aa, Homo sapiens
  Payload ID: 7763
  Gene Symbol: HOXC11
  Gene Name: homeobox C11
  ENSP ID: ENSP00000243082
MFNSVNLGNFCSPSRKERGADFGERGSCASNLYLPSCTYYMPEFSTVSSFLPQAPSRQISYPYSAQVPPVREVSYGLEPSGKWHHRNSYSSCYAAADELMHRECLPPSTVTEILMKNEGSYGGHHHPSAPHATPAGFYSSVNKNSVLPQAFDRFFDNAYCGGGDPPAEPPCSGKGEAKGEPEAPPASGLASRAEAGAEAEAEEENTNPSSSGSAHSVAKEPAKGAAPSRRPPHPQEALPLFEIPDPGTGARVFLQRVYQQREAAAAVPDAEPDGPTSENLVSEQKDERKETEQRPAAVFLGKSSAVTCRPGPFGGGGRGKLFYFIFIFYFLTRLLSAGGKLDCGQGWPPPLWPALHSGTSWTLYLTLAVGQGPGLERG

SEQ ID NO: 38832 - protein, 304 aa, Homo sapiens
  Payload ID: 7763
  Gene Symbol: HOXC11
  Gene Name: homeobox C11
  Uniprot ID: O43248
  ENSP ID: ENSP00000446680
MFNSVNLGNFCSPSRKERGADFGERGSCASNLYLPSCTYYMPEFSTVSSFLPQAPSRQISYPYSAQVPPVREVSYGLEPSGKWHHRNSYSSCYAAADELMHRECLPPSTVTEILMKNEGSYGGHHHPSAPHATPAGFYSSVNKNSVLPQAFDRFFDNAYCGGGDPPAEPPCSGKGEAKGEPEAPPASGLASRAEAGAEAEAEEENTNPSSSGSAHSVAKEPAKGAAPNAPRTRKKRCPYSKFQIRELEREFFFNVYINKEKRLQLSRMLNLTDRQVKIWFQNRRMKEKKLSRDRLQYFSGNPLL

SEQ ID NO: 38833 - protein, 282 aa, Homo sapiens
  Payload ID: 7764
  Gene Symbol: HOXC12
  Gene Name: homeobox C12
  Uniprot ID: P31275
  ENSP ID: ENSP00000243103
MGEHNLLNPGFVGPLVNIHTGDTFYFPNFRASGAQLPGLPSLSYPRRDNVCSLSWPSAEPCNGYPQPYLGSPVSLNPPFGRTCELARVEDGKGYYREPCAEGGGGGLKREERGRDPGAGPGAALLPLEPSGPPALGFKYDYAAGGGGGDGGGGAGPPHDPPSCQSLESDSSSSLLNEGNKGAGAGDPGSLVSPLNPGGGLSASGAPWYPINSRSRKKRKPYSKLQLAELEGEFLVNEFITRQRRRELSDRLNLSDQQVKIWFQNRRMKKKRLLLREQALSFF

SEQ ID NO: 38834 - protein, 330 aa, Homo sapiens
  Payload ID: 7765
  Gene Symbol: HOXC13
  Gene Name: homeobox C13
  Uniprot ID: P31276
  ENSP ID: ENSP00000243056
MTTSLLLHPRWPESLMYVYEDSAAESGIGGGGGGGGGGTGGAGGGCSGASPGKAPSMDGLGSSCPASHCRDLLPHPVLGRPPAPLGAPQGAVYTDIPAPEAARQCAPPPAPPTSSSATLGYGYPFGGSYYGCRLSHNVNLQQKPCAYHPGDKYPEPSGALPGDDLSSRAKEFAFYPSFASSYQAMPGYLDVSVVPGISGHPEPRHDALIPVEGYQHWALSNGWDSQVYCSKEQSQSAHLWKSPFPDVVPLQPEVSSYRRGRKKRVPYTKVQLKELEKEYAASKFITKEKRRRISATTNLSERQVTIWFQNRRVKEKKVVSKSKAPHLHST

SEQ ID NO: 38835 - protein, 264 aa, Homo sapiens
  Payload ID: 7766
  Gene Symbol: HOXC4
  Gene Name: homeobox C4
  Uniprot ID: P09017
  ENSP ID: ENSP00000305973
MIMSSYLMDSNYIDPKFPPCEEYSQNSYIPEHSPEYYGRTRESGFQHHHQELYPPPPPRPSYPERQYSCTSLQGPGNSRGHGPAQAGHHHPEKSQSLCEPAPLSGASASPSPAPPACSQPAPDHPSSAASKQPIVYPWMKKIHVSTVNPNYNGGEPKRSRTAYTRQQVLELEKEFHYNRYLTRRRRIEIAHSLCLSERQIKIWFQNRRMKWKKDHRLPNTKVRSAPPAGAAPSTLSAATPGTSEDHSQSATPPEQQRAEDITRL

SEQ ID NO: 38836 - protein, 264 aa, Homo sapiens; identical to SEQ ID NO: 38835
  Payload ID: 7766
  Gene Symbol: HOXC4
  Gene Name: homeobox C4
  Uniprot ID: P09017
  ENSP ID: ENSP00000399808

SEQ ID NO: 38837 - protein, 222 aa, Homo sapiens
  Payload ID: 7767
  Gene Symbol: HOXC5
  Gene Name: homeobox C5
  Uniprot ID: Q00444
  ENSP ID: ENSP00000309336
MSSYVANSFYKQSPNIPAYNMQTCGNYGSASEVQASRYCYGGLDLSITFPPPAPSNSLHGVDMAANPRAHPDRPACSAAAAPGHAPGRDEAAPLNPGMYSQKAARPALEERAKSSGEIKEEQAQTGQPAGLSQPPAPPQIYPWMTKLHMSHETDGKRSRTSYTRYQTLELEKEFHFNRYLTRRRRIEIANNLCLNERQIKIWFQNRRMKWKKDSKMKSKEAL

SEQ ID NO: 38838 - protein, 235 aa, Homo sapiens
  Payload ID: 7768
  Gene Symbol: HOXC6
  Gene Name: homeobox C6
  Uniprot ID: P09630
  ENSP ID: ENSP00000243108
MNSYFTNPSLSCHLAGGQDVLPNVALNSTAYDPVRHFSTYGAAVAQNRIYSTPFYSPQENVVFSSSRGPYDYGSNSFYQEKDMLSNCRQNTLGHNTQTSIAQDFSSEQGRTAPQDQKASIQIYPWMQRMNSHSGVGYGADRRRGRQIYSRYQTLELEKEFHFNRYLTRRRRIEIANALCLTERQIKIWFQNRRMKWKKESNLTSTLSGGGGGATADSLGGKEEKREETEEEKQKE

SEQ ID NO: 38839 - protein, 153 aa, Homo sapiens
  Payload ID: 7768
  Gene Symbol: HOXC6
  Gene Name: homeobox C6
  Uniprot ID: P09630
  ENSP ID: ENSP00000377864
MLSNCRQNTLGHNTQTSIAQDFSSEQGRTAPQDQKASIQIYPWMQRMNSHSGVGYGADRRRGRQIYSRYQTLELEKEFHFNRYLTRRRRIEIANALCLTERQIKIWFQNRRMKWKKESNLTSTLSGGGGGATADSLGGKEEKREETEEEKQKE

SEQ ID NO: 38840 - protein, 71 aa, Homo sapiens
  Payload ID: 7768
  Gene Symbol: HOXC6
  Gene Name: homeobox C6
  ENSP ID: ENSP00000423898
MLSNCRQNTLGHNTQTSIAQDFSSEQGRTAPQDQKASIQIYPWMQRMNSHSVCFVPGSLGVGYGADRRRGR

SEQ ID NO: 38841 - protein, 51 aa, Homo sapiens
  Payload ID: 7768
  Gene Symbol: HOXC6
  Gene Name: homeobox C6
  ENSP ID: ENSP00000424124
MLSNCRQNTLGHNTQTSIAQDFSSEQGRTAPQDQKASIQIYPWMQRMNSHS

SEQ ID NO: 38842 - protein, 242 aa, Homo sapiens
  Payload ID: 7769
  Gene Symbol: HOXC8
  Gene Name: homeobox C8
  Uniprot ID: P31273
  ENSP ID: ENSP00000040584
MSSYFVNPLFSKYKAGESLEPAYYDCRFPQSVGRSHALVYGPGGSAPGFQHASHHVQDFFHHGTSGISNSGYQQNPCSLSCHGDASKFYGYEALPRQSLYGAQQEASVVQYPDCKSSANTNSSEGQGHLNQNSSPSLMFPWMRPHAPGRRSGRQTYSRYQTLELEKEFLFNPYLTRKRRIEVSHALGLTERQVKIWFQNRRMKWKKENNKDKLPGARDEEKVEEEGNEEEEKEEEEKEENKD

SEQ ID NO: 38843 - protein, 260 aa, Homo sapiens
  Payload ID: 7770
  Gene Symbol: HOXC9
  Gene Name: homeobox C9
  Uniprot ID: P31274
  ENSP ID: ENSP00000302836
MSATGPISNYYVDSLISHDNEDLLASRFPATGAHPAAARPSGLVPDCSDFPSCSFAPKPAVFSTSWAPVPSQSSVVYHPYGPQPHLGADTRYMRTWLEPLSGAVSFPSFPAGGRHYALKPDAYPGRRADCGPGEGRSYPDYMYGSPGELRDRAPQTLPSPEADALAGSKHKEEKADLDPSNPVANWIHARSTRKKRCPYTKYQTLELEKEFLFNMYLTRDRRYEVARVLNLTERQVKIWFQNRRMKMKKMNKEKTDKEQS

SEQ ID NO: 38844 - protein, 260 aa, Homo sapiens; identical to SEQ ID NO: 38843
  Payload ID: 7770
  Gene Symbol: HOXC9
  Gene Name: homeobox C9
  Uniprot ID: P31274
  ENSP ID: ENSP00000423861

SEQ ID NO: 38845 - protein, 420 aa, Homo sapiens
  Payload ID: 7771
  Gene Symbol: HMBOX1
  Gene Name: homeobox containing 1
  Uniprot ID: Q6NT76
  ENSP ID: ENSP00000287701
MLSSFPVVLLETMSHYTDEPRFTIEQIDLLQRLRRTGMTKHEILHALETLDRLDQEHSDKFGRRSSYGGSSYGNSTNNVPASSSTATASTQTQHSGMSPSPSNSYDTSPQPCTTNQNGRENNERLSTSNGKMSPTRYHANSMGQRSYSFEASEEDLDVDDKVEELMRRDSSVIKEEIKAFLANRRISQAVVAQVTGISQSRISHWLLQQGSDLSEQKKRAFYRWYQLEKTNPGATLSMRPAPIPIEDPEWRQTPPPVSATSGTFRLRRGSRFTWRKECLAVMESYFNENQYPDEAKREEIANACNAVIQKPGKKLSDLERVTSLKVYNWFANRRKEIKRRANIEAAILESHGIDVQSPGGHSNSDDVDGNDYSEQDDSTSHSDHQDPISLAVEMAAVNHTILALARQGANEIKTEALDDD

SEQ ID NO: 38846 - protein, 420 aa, Homo sapiens; identical to SEQ ID NO: 38845
  Payload ID: 7771
  Gene Symbol: HMBOX1
  Gene Name: homeobox containing 1
  Uniprot ID: Q6NT76
  ENSP ID: ENSP00000380516

SEQ ID NO: 38847 - protein, 118 aa, Homo sapiens
  Payload ID: 7771
  Gene Symbol: HMBOX1
  Gene Name: homeobox containing 1
  ENSP ID: ENSP00000429767
MLSSFPVVLLETMSHYTDEPRFTIEQIDLLQRLRRTGMTKHEILHALETLDRLDQEHSDKFGRRSSYGGSSYGNSTNNVPASSSTATASTQTQHSGMSPSPSNSYDTSPQPCTTNQNG

SEQ ID NO: 38848 - protein, 45 aa, Homo sapiens
  Payload ID: 7771
  Gene Symbol: HMBOX1
  Gene Name: homeobox containing 1
  ENSP ID: ENSP00000429854
DDSTSHSDHQDPISLAVEMAAVNHTILALARQGANEIKTEALDDD

SEQ ID NO: 38849 - protein, 386 aa, Homo sapiens
  Payload ID: 7771
  Gene Symbol: HMBOX1
  Gene Name: homeobox containing 1
  ENSP ID: ENSP00000430059
MLSSFPVVLLETMSHYTDEPRFTIEQIDLLQRLRRTGMTKHEILHALETLDRLDQEHSDKFGRRSSYGGSSYGNSTNNVPASSSTATASTQTQHSGMSPSPSNSYDTSPQPCTTNQNGRENNERLSTSNGKMSPTRYHANSMGQRSYSFEASEEDLDVDDKVEELMRRDSSVIKEEIKAFLANRRISQAVVAQVTGISQSRISHWLLQQGSDLSEQKKRAFYRWYQLEKTNPGATLSMRPAPIPIEDPEWRQTPPPVSATSGTFRLRRGSRFTWRKECLAVMESYFNENQYPDEAKREEIANACNAVIQKPGKKLSDLERVTSLKVYNWFANRRKEIKRRANIAAILESHGIDVQSPGGHSNSDDVDGNDYSEQTDRMQAEVVAQE

SEQ ID NO: 38850 - protein, 443 aa, Homo sapiens
  Payload ID: 7771
  Gene Symbol: HMBOX1
  Gene Name: homeobox containing 1
  Uniprot ID: Q6NT76
  ENSP ID: ENSP00000430110
MLSSFPVVLLETMSHYTDEPRFTIEQIDLLQRLRRTGMTKHEILHALETLDRLDQEHSDKFGRRSSYGGSSYGNSTNNVPASSSTATASTQTQHSGMSPSPSNSYDTSPQPCTTNQNGRENNERLSTSNGKMSPTRYHANSMGQRSYSFEASEEDLDVDDKVEELMRRDSSVIKEEIKAFLANRRISQAVVAQVTGISQSRISHWLLQQGSDLSEQKKRAFYRWYQLEKTNPGATLSMRPAPIPIEDPEWRQTPPPVSATSGTFRLRRGSRFTWRKECLAVMESYFNENQYPDEAKREEIANACNAVIQKPGKKLSDLERVTSLKVYNWFANRRKEIKRRANIAAILESHGIDVQSPGGHSNSDDVDGNDYSEQDTWQVRNGEEEEGRSSEGGREAEKDDSTSHSDHQDPISLAVEMAAVNHTILALARQGANEIKTEALDDD

SEQ ID NO: 38851 - protein, 304 aa, Homo sapiens
  Payload ID: 7771
  Gene Symbol: HMBOX1
  Gene Name: homeobox containing 1
  Uniprot ID: Q6NT76
  ENSP ID: ENSP00000430238
MLSSFPVVLLETMSHYTDEPRFTIEQIDLLQRLRRTGMTKHEILHALETLDRLDQEHSDKFGRRSSYGGSSYGNSTNNVPASSSTATASTQTQHSGMSPSPSNSYDTSPQPCTTNQNGRENNERLSTSNGKMSPTRYHANSMGQRSYSFEASEEDLDVDDKVEELMRRDSSVIKEEIKAFLANRRISQAVVAQVTGISQSRISHWLLQQGSDLSEQKKRAFYRWYQLEKTNPGATLSMRPAPIPIEDPEWRQTPPPVSATSGTFRLRRGSRFTWRKECLAVMERNTWSPERRMEENKWKLLSAG

SEQ ID NO: 38852 - protein, 396 aa, Homo sapiens
  Payload ID: 7771
  Gene Symbol: HMBOX1
  Gene Name: homeobox containing 1
  ENSP ID: ENSP00000452827
MLSSFPVVLLETMSHYTDEPRFTIEQIDLLQRLRRTGMTKHEILHALETLDRLDQEHSDKFGRRSSYGGSSYGNSTNNVPASSSTATASTQTQHSGMSPSPSNSYDTSPQPCTTNQNGRENNERLSTSNGKMSPTRYHANSMGQRSYSFEASEEDLDVDDKVEELMRRDSSVIKEEIKAFLANRRISQAVVAQVTGISQSRISHWLLQQGSDLSEQKKRAFYRWYQLEKTNPGATLSMRPAPIPIEDPEWRQTPPPVSATSGTFRLRRGSRFTWRKECLAVMESYFNENQYPDEAKREEIANACNAVIQKPGKKLSDLERVTSLKVYNWFANRRKEIKRRANIEAAILESHGIDVQSPGGHSNSDDVDGNDYSEQVSPCAAGRGSWCLSRGYSGTA

SEQ ID NO: 38853 - protein, 364 aa, Homo sapiens
  Payload ID: 7771
  Gene Symbol: HMBOX1
  Gene Name: homeobox containing 1
  ENSP ID: ENSP00000453185
MLSSFPVVLLETMSHYTDEPRFTIEQIDLLQRLRRTGMTKHEILHALETLDRLDQEHSDKFGRRSSYGGSSYGNSTNNVPASSSTATASTQTQHSGMSPSPSNSYDTSPQPCTTNQNGRENNERLSTSNGKMSPTRYHANSMGQRSYSFEASEEDLDVDDKVEELMRRDSSVIKEEIKAFLANRRISQAVVAQVTGISQSRISHWLLQQGSDLSEQKKRAFYRWYQLEKTNPGATLSMRPAPIPIEDPEWRQTPPPVSATSGTFRLRRGSRFTWRKECLAVMESYFNENQYPDEAKREEIANACNAVIQKPEAAILESHGIDVQSPGGHSNSDDVDGNDYSEQDTWQVRNGEEEEGRSSEGGRE

SEQ ID NO: 38854 - protein, 405 aa, Homo sapiens
  Payload ID: 7771
  Gene Symbol: HMBOX1
  Gene Name: homeobox containing 1
  Uniprot ID: Q6NT76
  ENSP ID: ENSP00000453211
MLSSFPVVLLETMSHYTDEPRFTIEQIDLLQRLRRTGMTKHEILHALETLDRLDQEHSDKFGRRSSYGGSSYGNSTNNVPASSSTATASTQTQHSGMSPSPSNSYDTSPQPCTTNQNGRENNERLSTSNGKMSPTRYHANSMGQRSYSFEASEEDLDVDDKVEELMRRDSSVIKEEIKAFLANRRISQAVVAQVTGISQSRISHWLLQQGSDLSEQKKRAFYRWYQLEKTNPGATLSMRPAPIPIEDPEWRQTPPPVSATSGTFRLRRGSRFTWRKECLAVMESYFNENQYPDEAKREEIANACNAVIQKPGKKLSDLERVTSLKVYNWFANRRKEIKRRANIAAILESHGIDVQSPGGHSNSDDVDGNDYSEQDTWQVRNGEEEEGRSSEGGREAEKVEEERRI

SEQ ID NO: 38855 - protein, 386 aa, Homo sapiens; identical to SEQ ID NO: 38849
  Payload ID: 7771
  Gene Symbol: HMBOX1
  Gene Name: homeobox containing 1
  ENSP ID: ENSP00000475196

SEQ ID NO: 38856 - protein, 328 aa, Homo sapiens
  Payload ID: 7772
  Gene Symbol: HOXD1
  Gene Name: homeobox D1
  Uniprot ID: Q9GZZ0
  ENSP ID: ENSP00000328598
MSSYLEYVSCSSSGGVGGDVLSLAPKFCRSDARPVALQPAFPLGNGDGAFVSCLPLAAARPSPSPPAAPARPSVPPPAAPQYAQCTLEGAYEPGAAPAAAAGGADYGFLGSGPAYDFPGVLGRAADDGGSHVHYATSAVFSGGGSFLLSGQVDYAAFGEPGPFPACLKASADGHPGAFQTASPAPGTYPKSVSPASGLPAAFSTFEWMKVKRNASKKGKLAEYGAASPSSAIRTNFSTKQLTELEKEFHFNKYLTRARRIEIANCLHLNDTQVKIWFQNRRMKQKKREREGLLATAIPVAPLQLPLSGTTPTKFIKNPGSPSQSQEPS

SEQ ID NO: 38857 - protein, 340 aa, Homo sapiens
  Payload ID: 7773
  Gene Symbol: HOXD10
  Gene Name: homeobox D10
  Uniprot ID: P28358
  ENSP ID: ENSP00000249501
MSFPNSSPAANTFLVDSLISACRSDSFYSSSASMYMPPPSADMGTYGMQTCGLLPSLAKREVNHQNMGMNVHPYIPQVDSWTDPNRSCRIEQPVTQQVPTCSFTTNIKEESNCCMYSDKRNKLISAEVPSYQRLVPESCPVENPEVPVPGYFRLSQTYATGKTQEYNNSPEGSSTVMLQLNPRGAAKPQLSAAQLQMEKKMNEPVSGQEPTKVSQVESPEAKGGLPEERSCLAEVSVSSPEVQEKESKEEIKSDTPTSNWLTAKSGRKKRCPYTKHQTLELEKEFLFNMYLTRERRLEISKSVNLTDRQVKIWFQNRRMKLKKMSRENRIRELTANLTFS

SEQ ID NO: 38858 - protein, 338 aa, Homo sapiens
  Payload ID: 7774
  Gene Symbol: HOXD11
  Gene Name: homeobox D11
  Uniprot ID: P31277
  ENSP ID: ENSP00000249504
MNDFDECGQSAASMYLPGCAYYVAPSDFASKPSFLSQPSSCQMTFPYSSNLAPHVQPVREVAFRDYGLERAKWPYRGGGGGGSAGGGSSGGGPGGGGGGAGGYAPYYAAAAAAAAAAAAAEEAAMQRELLPPAGRRPDVLFKAPEPVCAAPGPPHGPAGAASNFYSAVGRNGILPQGFDQFYEAAPGPPFAGPQPPPPPAPPQPEGAADKGDPRTGAGGGGGSPCTKATPGSEPKGAAEGSGGDGEGPPGEAGAEKSSSAVAPQRSRKKRCPYTKYQIRELEREFFFNVYINKEKRLQLSRMLNLTDRQVKIWFQNRRMKEKKLNRDRLQYFTGNPLF

SEQ ID NO: 38859 - protein, 161 aa, Homo sapiens
  Payload ID: 7774
  Gene Symbol: HOXD11
  Gene Name: homeobox D11
  ENSP ID: ENSP00000480304
MYLPGCAYYVAPSDFASKPSFLSQPSSCQMTFPYSSNLDRGGGGGSPCTKATPGSEPKGAAEGSGGDGEGPPGEAGAEKSSSAVAPQRSRKKRCPYTKYQIRELEREFFFNVYINKEKRLQLSRMLNLTDRQVKIWFQNRRMKEKKLNRDRLQYFTGNPLF

SEQ ID NO: 38860 - protein, 246 aa, Homo sapiens
  Payload ID: 7775
  Gene Symbol: HOXD12
  Gene Name: homeobox D12
  ENSP ID: ENSP00000385132
MCERSLYRAGYVGSLLNLQSPDSFYFSNLRPNGGQLAALPPISYPRGALPWAATPASCAPAQPAGATAFGGFSQPYLAGSGPLGLQPPTAKDGPEEQAKFYAPEAAAGPEERGRTRPSFAPESSLAPAVAALKAAKYDYAGVGRATPGSTTLLQGAPCAPGFKDDTKGPLNLNMTVQAAGVASCLRPSLPDGKRCPCSPGRPAVGGGPGEGPQEAETLHEAADCGVGERIPRQRIHQQAETQGIVQ

SEQ ID NO: 38861 - protein, 270 aa, Homo sapiens
  Payload ID: 7775
  Gene Symbol: HOXD12
  Gene Name: homeobox D12
  Uniprot ID: P35452
  ENSP ID: ENSP00000385586
MCERSLYRAGYVGSLLNLQSPDSFYFSNLRPNGGQLAALPPISYPRGALPWAATPASCAPAQPAGATAFGGFSQPYLAGSGPLGLQPPTAKDGPEEQAKFYAPEAAAGPEERGRTRPSFAPESSLAPAVAALKAAKYDYAGVGRATPGSTTLLQGAPCAPGFKDDTKGPLNLNMTVQAAGVASCLRPSLPDGLPWGAAPGRARKKRKPYTKQQIAELENEFLVNEFINRQKRKELSNRLNLSDQQVKIWFQNRRMKKKRVVLREQALALY

SEQ ID NO: 38862 - protein, 343 aa, Homo sapiens
  Payload ID: 7776
  Gene Symbol: HOXD13
  Gene Name: homeobox D13
  Uniprot ID: P35453
  ENSP ID: ENSP00000376322
MSRAGSWDMDGLRADGGGAGGAPASSSSSSVAAAAASGQCRGFLSAPVFAGTHSGRAAAAAAAAAAAAAAASGFAYPGTSERTGSSSSSSSSAVVAARPEAPPAKECPAPTPAAAAAAPPSAPALGYGYHFGNGYYSCRMSHGVGLQQNALKSSPHASLGGFPVEKYMDVSGLASSSVPANEVPARAKEVSFYQGYTSPYQHVPGYIDMVSTFGSGEPRHEAYISMEGYQSWTLANGWNSQVYCTKDQPQGSHFWKSSFPGDVALNQPDMCVYRRGRKKRVPYTKLQLKELENEYAINKFINKDKRRRISAATNLSERQVTIWFQNRRVKDKKIVSKLKDTVS

SEQ ID NO: 38863 - protein, 432 aa, Homo sapiens
  Payload ID: 7777
  Gene Symbol: HOXD3
  Gene Name: homeobox D3
  Uniprot ID: P31249
  ENSP ID: ENSP00000249440
MLFEQGQQALELPECTMQKAAYYENPGLFGGYGYSKTTDTYGYSTPHQPYPPPAAASSLDTDYPGSACSIQSSAPLRAPAHKGAELNGSCMRPGTGNSQGGGGGSQPPGLNSEQQPPQPPPPPPTLPPSSPTNPGGGVPAKKPKGGPNASSSSATISKQIFPWMKESRQNSKQKNSCATAGESCEDKSPPGPASKRVRTAYTSAQLVELEKEFHFNRYLCRPRRVEMANLLNLTERQIKIWFQNRRMKYKKDQKAKGILHSPASQSPERSPPLGGAAGHVAYSGQLPPVPGLAYDAPSPPAFAKSQPNMYGLAAYTAPLSSCLPQQKRYAAPEFEPHPMASNGGGFASANLQGSPVYVGGNFVESMAPASGPVFNLGHLSHPSSASVDYSCAAQIPGNHHHGPCDPHPTYTDLSAHHSSQGRLPEAPKLTHL

SEQ ID NO: 38864 - protein, 432 aa, Homo sapiens; identical to SEQ ID NO: 38863
  Payload ID: 7777
  Gene Symbol: HOXD3
  Gene Name: homeobox D3
  Uniprot ID: P31249
  ENSP ID: ENSP00000386498

SEQ ID NO: 38865 - protein, 100 aa, Homo sapiens
  Payload ID: 7777
  Gene Symbol: HOXD3
  Gene Name: homeobox D3
  ENSP ID: ENSP00000392615
MLFEQGQQALELPECTMQKAAYYENPGLFGGYGYSKTTDTYGYSTPHQPYPPPAAASSLDTDYPGSACSIQSSAPLRAPAHKGAELNGSCMRPGTGNSQG

SEQ ID NO: 38866 - protein, 255 aa, Homo sapiens
  Payload ID: 7778
  Gene Symbol: HOXD4
  Gene Name: homeobox D4
  Uniprot ID: P09016
  ENSP ID: ENSP00000302548
MVMSSYMVNSKYVDPKFPPCEEYLQGGYLGEQGADYYGGGAQGADFQPPGLYPRPDFGEQPFGGSGPGPGSALPARGHGQEPGGPGGHYAAPGEPCPAPPAPPPAPLPGARAYSQSDPKQPPSGTALKQPAVVYPWMKKVHVNSVNPNYTGGEPKRSRTAYTRQQVLELEKEFHFNRYLTRRRRIEIAHTLCLSERQIKIWFQNRRMKWKKDHKLPNTKGRSSSSSSSSSCSSSVAPSQHLQPMAKDHHTDLTTL

SEQ ID NO: 38867 - protein, 290 aa, Homo sapiens
  Payload ID: 7779
  Gene Symbol: HOXD8
  Gene Name: homeobox D8
  Uniprot ID: P13378
  ENSP ID: ENSP00000315949
MSSYFVNPLYSKYKAAAAAAAAAGEAINPTYYDCHFAPEVGGRHAAAAAALQLYGNSAAGFPHAPPQAHAHPHPSPPPSGTGCGGREGRGQEYFHPGGGSPAAAYQAAPPPPPHPPPPPPPPPCGGIACHGEPAKFYGYDNLQRQPIFTTQQEAELVQYPDCKSSSGNIGEDPDHLNQSSSPSQMFPWMRPQAAPGRRRGRQTYSRFQTLELEKEFLFNPYLTRKRRIEVSHALALTERQVKIWFQNRRMKWKKENNKDKFPVSRQEVKDGETKKEAQELEEDRAEGLTN

SEQ ID NO: 38868 - protein, 106 aa, Homo sapiens
  Payload ID: 7779
  Gene Symbol: HOXD8
  Gene Name: homeobox D8
  ENSP ID: ENSP00000406045
MFPWMRPQAAPGRRRGRQTYSRFQTLELEKEFLFNPYLTRKRRIEVSHALALTERQVKIWFQNRRMKWKKENNKDKFPVSRQEVKDGETKKEAQELEEDRAEGLTN

SEQ ID NO: 38869 - protein, 289 aa, Homo sapiens
  Payload ID: 7779
  Gene Symbol: HOXD8
  Gene Name: homeobox D8
  Uniprot ID: P13378
  ENSP ID: ENSP00000409026
MSSYFVNPLYSKYKAAAAAAAAAGEAINPTYYDCHFAPEVGGRHAAAAAALQLYGNSAAGFPHAPPQAHAHPHPSPPPSGTGCGGREGRGQEYFHPGGGSPAAAYQAAPPPPPHPPPPPPPPPCGGIACHGEPAKFYGYDNLQRQPIFTTQQEAELVQYPDCKSSSGNIGEDPDHLNQSSSPSQMFPWMRPQAPGRRRGRQTYSRFQTLELEKEFLFNPYLTRKRRIEVSHALALTERQVKIWFQNRRMKWKKENNKDKFPVSRQEVKDGETKKEAQELEEDRAEGLTN

SEQ ID NO: 38870 - protein, 186 aa, Homo sapiens
  Payload ID: 7779
  Gene Symbol: HOXD8
  Gene Name: homeobox D8
  ENSP ID: ENSP00000437431
MSSYFVNPLYSKYKAAAAAAAAAGEAINPTYYDCHFAPERQPIFTTQQEAELVQYPDCKSSSGNIGEDPDHLNQSSSPSQMFPWMRPQAAPGRRRGRQTYSRFQTLELEKEFLFNPYLTRKRRIEVSHALALTERQVKIWFQNRRMKWKKENNKDKFPVSRQEVKDGETKKEAQELEEDRAEGLTN

SEQ ID NO: 38871 - protein, 352 aa, Homo sapiens
  Payload ID: 7780
  Gene Symbol: HOXD9
  Gene Name: homeobox D9
  Uniprot ID: P28356
  ENSP ID: ENSP00000249499
MLGGSAGRLKMSSSGTLSNYYVDSLIGHEGDEVFAARFGPPGPGAQGRPAGVADGPAATAAEFASCSFAPRSAVFSASWSAVPSQPPAAAAMSGLYHPYVPPPPLAASASEPGRYVRSWMEPLPGFPGGAGGGGGGGGGGPGRGPSPGPSGPANGRHYGIKPETRAAPAPATAASTTSSSSTSLSSSSKRTECSVARESQGSSGPEFSCNSFLQEKAAAATGGTGPGAGIGAATGTGGSSEPSACSDHPIPGCSLKEEEKQHSQPQQQQLDPNNPAANWIHARSTRKKRCPYTKYQTLELEKEFLFNMYLTRDRRYEVARILNLTERQVKIWFQNRRMKMKKMSKEKCPKGD

SEQ ID NO: 38872 - protein, 341 aa, Homo sapiens
  Payload ID: 7780
  Gene Symbol: HOXD9
  Gene Name: homeobox D9
  ENSP ID: ENSP00000484642
MSSSGTLSNYYVDSLIGHEGDEVFAARFGPPGPGAQGRPAGVADGPAATAAEFASCSFAPRSAVFSASWSAVPSQPPAAAAMSGLYHPYVPPPPLAASASEPGRYVRSWMEPLPGFPGGAGGGGGGGGGGPGRGPSPGPSGPANGRHYGIKPETRAAPAPATAASTTSSSSTSLSSSSKRTECSVARESQGSSGPEFSCNSFLQEKAAGDGGNGPGAGIGAATGTGGSSEPSACSDHPIPGCSLKEEEKQHSQPQQQQLDPNNPAANWIHARSTRKKRCPYTKYQTLELEKEFLFNMYLTRDRRYEVARILNLTERQVKIWFQNRRMKMKKMSKEKCPKGD

SEQ ID NO: 38873 - protein, 836 aa, Homo sapiens
  Payload ID: 7781
  Gene Symbol: HIPK1
  Gene Name: homeodomain interacting protein kinase 1
  Uniprot ID: Q86Z02
  ENSP ID: ENSP00000340956
MWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSSSGLKPRSNVISYVTVNDSPDSDSSLSSPYSTDTLSALRGNSGSVLEGPGRVVADGTGTRTIIVPPLKTQLGDCTVATQASGLLSNKTKPVASVSGQSSGCCITPTGYRAQRGGTSAAQPLNLSQNQQSSAAPTSQERSSNPAPRRQQAFVAPLSQAPYTFQHGSPLHSTGHPHLAPAPAHLPSQAHLYTYAAPTSAAALGSTSSIAHLFSPQGSSRHAAAYTTHPSTLVHQVPVSVGPSLLTSASVAPAQYQHQFATQSYIGSSRGSTIYTGYPLSPTKISQYSYL

SEQ ID NO: 38874 - protein, 491 aa, Homo sapiens
  Payload ID: 7781
  Gene Symbol: HIPK1
  Gene Name: homeodomain interacting protein kinase 1
  ENSP ID: ENSP00000355191
  MOD_RES (1)..(1): Any amino acid
XTPQYAVPFTLSCAAGRPALVEQTAAVLAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSSSGLKPRSNVISYVTVNDSPDSDSSLSSPYSTDTLSALRGNSGSVLEGPGRVVADGTGTRTIIVPPLKTQLGDCTVATQASGLLSNKTKPVASVSGQSSGCCITPTGYRAQRGGTSAAQPLNLSQNQQSSAAPTSQERSSNPAPRRQQAFVAPLSQAPYTFQHGSPLHSTGHPHLAPAPAHLPSQAHLYTYAAPTSAAALGSTSSIAHLFSPQGSSRHAAAYTTHPSTLVHQVPVSVGPSLLTSASVAPAQYQHQFATQSYIGSSRGSTIYTGYPLSPTKISQYSYL

SEQ ID NO: 38875 - protein, 816 aa, Homo sapiens
  Payload ID: 7781
  Gene Symbol: HIPK1
  Gene Name: homeodomain interacting protein kinase 1
  Uniprot ID: Q86Z02
  ENSP ID: ENSP00000358566
MVLMFQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSSSGLKPRSNVISYVTVNDSPDSDSSLSSPYSTDTLSALRGNSGSVLEGPGRVVADGTGTRTIIVPPLKTQLGDCTVATQASGLLSNKTKPVASVSGQSSGCCITPTGYRAQRGGTSAAQPLNLSQNQQSSAAPTSQERSSNPAPRRQQAFVAPLSQAPYTFQHGSPLHSTGHPHLAPAPAHLPSQAHLYTYAAPTSAAALGSTSSIAHLFSPQGSSRHAAAYTTHPSTLVHQVPVSVGPSLLTSASVAPAQYQHQFATQSYIGSSRGSTIYTGYPLSPTKISQYSYL

SEQ ID NO: 38876 - protein, 1165 aa, Homo sapiens
  Payload ID: 7781
  Gene Symbol: HIPK1
  Gene Name: homeodomain interacting protein kinase 1
  ENSP ID: ENSP00000358568
MASQLQVFSPPSVSSSAFCSAKKLKIEPSGWDVSGQSSNDKYYTHSKTLPATQGQANSSHQVANFNIPAYDQGLLLPAPAVEHIVVTAADSSGSAATSTFQSSQTLTHRSNVSLLEPYQKCGLKRKSEEVDSNGSVQIIEEHPPLMLQNRTVVGAAATTTTVTTKSSSSSGEGDYQLVQHEILCSMTNSYEVLEFLGRGTFGQVAKCWKRSTKEIVAIKILKNHPSYARQGQIEVSILSRLSSENADEYNFVRSYECFQHKNHTCLVFEMLEQNLYDFLKQNKFSPLPLKYIRPILQQVATALMKLKSLGLIHADLKPENIMLVDPVRQPYRVKVIDFGSASHVSKAVCSTYLQSRYYRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSSSGLKPRSNVISYVTVNDSPDSDSSLSSPYSTDTLSALRGNSGSVLEGPGRVVADGTGTRTIIVPPLKTQLGDCTVATQASGLLSNKTKPVASVSGQSSGCCITPTGYRAQRGGTSAAQPLNLSQNQQSSAAPTSQERSSNPAPRRQQAFVAPLSQAPYTFQHGSPLHSTGHPHLAPAPAHLPSQAHLYTYAAPTSAAALGSTSSIAHLFSPQGSSRHAAAYTTHPSTLVHQVPVSVGPSLLTSASVAPAQYQHQFATQSYIGSSRGSTIYTGYPLSPTKISQYSYL

SEQ ID NO: 38877 - protein, 1210 aa, Homo sapiens
  Payload ID: 7781
  Gene Symbol: HIPK1
  Gene Name: homeodomain interacting protein kinase 1
  Uniprot ID: Q86Z02
  ENSP ID: ENSP00000358571
MASQLQVFSPPSVSSSAFCSAKKLKIEPSGWDVSGQSSNDKYYTHSKTLPATQGQANSSHQVANFNIPAYDQGLLLPAPAVEHIVVTAADSSGSAATSTFQSSQTLTHRSNVSLLEPYQKCGLKRKSEEVDSNGSVQIIEEHPPLMLQNRTVVGAAATTTTVTTKSSSSSGEGDYQLVQHEILCSMTNSYEVLEFLGRGTFGQVAKCWKRSTKEIVAIKILKNHPSYARQGQIEVSILSRLSSENADEYNFVRSYECFQHKNHTCLVFEMLEQNLYDFLKQNKFSPLPLKYIRPILQQVATALMKLKSLGLIHADLKPENIMLVDPVRQPYRVKVIDFGSASHVSKAVCSTYLQSRYYRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSSSGLKPRSNVISYVTVNDSPDSDSSLSSPYSTDTLSALRGNSGSVLEGPGRVVADGTGTRTIIVPPLKTQLGDCTVATQASGLLSNKTKPVASVSGQSSGCCITPTGYRAQRGGTSAAQPLNLSQNQQSSAAPTSQERSSNPAPRRQQAFVAPLSQAPYTFQHGSPLHSTGHPHLAPAPAHLPSQAHLYTYAAPTSAAALGSTSSIAHLFSPQGSSRHAAAYTTHPSTLVHQVPVSVGPSLLTSASVAPAQYQHQFATQSYIGSSRGSTIYTGYPLSPTKISQYSYL

SEQ ID NO: 38878 - protein, 1075 aa, Homo sapiens
  Payload ID: 7781
  Gene Symbol: HIPK1
  Gene Name: homeodomain interacting protein kinase 1
  Uniprot ID: Q86Z02
  ENSP ID: ENSP00000358572
MASQLQVFSPPSVSSSAFCSAKKLKIEPSGWDVSGQSSNDKYYTHSKTLPATQGQANSSHQVANFNIPAYDQGLLLPAPAVEHIVVTAADSSGSAATSTFQSSQTLTHRSNVSLLEPYQKCGLKRKSEEVDSNGSVQIIEEHPPLMLQNRTVVGAAATTTTVTTKSSSSSGEGDYQLVQHEILCSMTNSYEVLEFLGRGTFGQVAKCWKRSTKEIVAIKILKNHPSYARQGQIEVSILSRLSSENADEYNFVRSYECFQHKNHTCLVFEMLEQNLYDFLKQNKFSPLPLKYIRPILQQVATALMKLKSLGLIHADLKPENIMLVDPVRQPYRVKVIDFGSASHVSKAVCSTYLQSRYYRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSSSGLKPRSNVISYVTVNDSPDSDSSLSSPYSTDTLSALRGNSGSVLEGPGRVVADGTGTRTIIVPPLKTQLGDCTVATQASGLLSNKTKPVASVSGQSSGCCITPTGYRAQRGGTSAAQPLNLSQVSAMGYCLLFGPCTVVTFWRTLLLAGC

SEQ ID NO: 38879 - protein, 1176 aa, Homo sapiens
  Payload ID: 7781
  Gene Symbol: HIPK1
  Gene Name: homeodomain interacting protein kinase 1
  ENSP ID: ENSP00000358574
MASQLQVFSPPSVSSSAFCSAKKLKIEPSGWDVSGQSSNDKYYTHSKTLPATQGQANSSHQVANFNIPAYDQGLLLPAPAVEHIVVTAADSSGSAATSTFQSSQTLTHRSNVSLLEPYQKCGLKRKSEEVDSNGSVQIIEEHPPLMLQNRTVVGAAATTTTVTTKSSSSSGEGDYQLVQHEILCSMTNSYEVLEFLGRGTFGQVAKCWKRSTKEIVAIKILKNHPSYARQGQIEVSILSRLSSENADEYNFVRSYECFQHKNHTCLVFEMLEQNLYDFLKQNKFSPLPLKYIRPILQQVATALMKLKSLGLIHADLKPENIMLVDPVRQPYRVKVIDFGSASHVSKAVCSTYLQSRYYRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSSSGLKPRSNVISYVTVNDSPDSDSSLSSPYSTDTLSALRGNSGSVLEGPGRVVADGTGTRTIIVPPLKTQLGDCTVATQASGLLSNKTKPVASVSGQSSGCCITPTGYRAQRGGTSAAQPLNLSQNQQSSAAPTSQERSSNPAPRRQQAFVAPLSQAPYTFQHGSPLHSTGHPHLAPAPAHLPSQAHLYTYAAPTSAAALGSTSSIAHLFSPQGSSRHAAAYTTHPSTLVHQVPVSVGPSLLTSASVAPAQYQHQFATQSYIGSSRGSTIYTGYPLSPTKISQYSYL

SEQ ID NO: 38880 - protein, 1210 aa, Homo sapiens; identical to SEQ ID NO: 38877
  Payload ID: 7781
  Gene Symbol: HIPK1
  Gene Name: homeodomain interacting protein kinase 1
  Uniprot ID: Q86Z02
  ENSP ID: ENSP00000407442

SEQ ID NO: 38881 - protein, 119 aa, Homo sapiens
  Payload ID: 7781
  Gene Symbol: HIPK1
  Gene Name: homeodomain interacting protein kinase 1
  ENSP ID: ENSP00000422322
MASQLQVFSPPSVSSSAFCSAKKLKIEPSGWDVSGQSSNDKYYTHSKTLPATQGQANSSHQVANFNIPAYDQGLLLPAPAVEHIVVTAADSSGSAATSTFQSSQTLTHRSNVSLLEPYQ

SEQ ID NO: 38882 - protein, 106 aa, Homo sapiens
  Payload ID: 7781
  Gene Symbol: HIPK1
  Gene Name: homeodomain interacting protein kinase 1
  ENSP ID: ENSP00000426695
MASQLQVFSPPSVSSSAFCSAKKLKIEPSGWDVSGQSSNDKYYTHSKTLPATQGQANSSHQVANFNIPAYDQGLLLPAPAVEHIVVTAADSSGSAATSTFQSSQTL

SEQ ID NO: 38883 - protein, 1165 aa, Homo sapiens; identical to SEQ ID NO: 38876
  Payload ID: 7781
  Gene Symbol: HIPK1
  Gene Name: homeodomain interacting protein kinase 1
  ENSP ID: ENSP00000486090

SEQ ID NO: 38884 - protein, 911 aa, Homo sapiens
  Payload ID: 7782
  Gene Symbol: HIPK2
  Gene Name: homeodomain interacting protein kinase 2
  ENSP ID: ENSP00000343108
MASHVQVFSPHTLQSSAFCSVKKLKIEPSSNWDMTGYGSHSKVYSQSKNIPLSQPATTTVSTSLPVPNPSLPYEQTIVFPGSTGHIVVTSASSTSVTGQVLGGPHNLMRRSTVSLLDTYQKCGLKRKSEEIENTSSVQIIEEHPPMIQNNASGATVATATTSTATSKNSGSNSEGDYQLVQHEVLCSMTNTYEVLEFLGRGTFGQVVKCWKRGTNEIVAIKILKNHPSYARQGQIEVSILARLSTESADDYNFVRAYECFQHKNHTCLVFEMLEQNLYDFLKQNKFSPLPLKYIRPVLQQVATALMKLKSLGLIHADLKPENIMLVDPSRQPYRVKVIDFGSASHVSKAVCSTYLQSRYYRAPEIILGLPFCEAIDMWSLGCVIAELFLGWPLYPGASEYDQIRYISQTQGLPAEYLLSAGTKTTRFFNRDTDSPYPLWRLKTPDDHEAETGIKSKEARKYIFNCLDDMAQVNMTTDLEGSDMLVEKADRREFIDLLKKMLTIDADKRITPIETLNHPFVTMTHLLDFPHSTHVKSCFQNMEICKRRVNMYDTVNQSKTPFITHVAPSTSTNLTMTFNNQLTTVHNQAPSSTSATISLANPEVSILNYPSTLYQPSAASMAAVAQRSMPLQTGTAQICARPDPFQQALIVCPPGFQGLQASPSKHAGYSVRMENAVPIVTQAPGAQPLQIQPGLLAQQAWPSGTQQILLPPAWQQLTGVATHTSVQHATVIPETMAGTQQLADWRNTHAHGSHYNPIMQQPALLTGHVTLPAAQPLNVGVAHVMRQQPTSTTSSRKSKHTVSKQRKNVISCVTVHDSPYSDSSSNTSPYSVQQRAGHNNANAFDTKGSLENHCTGNPRTIIVPPLKTQASEVLVECDSLVPGNLGPGQGRNLSLESGFPAFLLLEMLLYGS

SEQ ID NO: 38885 - protein, 1198 aa, Homo sapiens
  Payload ID: 7782
  Gene Symbol: HIPK2
  Gene Name: homeodomain interacting protein kinase 2
  Uniprot ID: Q9H2X6
  ENSP ID: ENSP00000385571
MAPVYEGMASHVQVFSPHTLQSSAFCSVKKLKIEPSSNWDMTGYGSHSKVYSQSKNIPLSQPATTTVSTSLPVPNPSLPYEQTIVFPGSTGHIVVTSASSTSVTGQVLGGPHNLMRRSTVSLLDTYQKCGLKRKSEEIENTSSVQIIEEHPPMIQNNASGATVATATTSTATSKNSGSNSEGDYQLVQHEVLCSMTNTYEVLEFLGRGTFGQVVKCWKRGTNEIVAIKILKNHPSYARQGQIEVSILARLSTESADDYNFVRAYECFQHKNHTCLVFEMLEQNLYDFLKQNKFSPLPLKYIRPVLQQVATALMKLKSLGLIHADLKPENIMLVDPSRQPYRVKVIDFGSASHVSKAVCSTYLQSRYYRAPEIILGLPFCEAIDMWSLGCVIAELFLGWPLYPGASEYDQIRYISQTQGLPAEYLLSAGTKTTRFFNRDTDSPYPLWRLKTPDDHEAETGIKSKEARKYIFNCLDDMAQVNMTTDLEGSDMLVEKADRREFIDLLKKMLTIDADKRITPIETLNHPFVTMTHLLDFPHSTHVKSCFQNMEICKRRVNMYDTVNQSKTPFITHVAPSTSTNLTMTFNNQLTTVHNQAPSSTSATISLANPEVSILNYPSTLYQPSAASMAAVAQRSMPLQTGTAQICARPDPFQQALIVCPPGFQGLQASPSKHAGYSVRMENAVPIVTQAPGAQPLQIQPGLLAQQAWPSGTQQILLPPAWQQLTGVATHTSVQHATVIPETMAGTQQLADWRNTHAHGSHYNPIMQQPALLTGHVTLPAAQPLNVGVAHVMRQQPTSTTSSRKSKQHQSSVRNVSTCEVSSSQAISSPQRSKRVKENTPPRCAMVHSSPACSTSVTCGWGDVASSTTRERQRQTIVIPDTPSPTVSVITISSDTDEEEEQKHAPTSTVSKQRKNVISCVTVHDSPYSDSSSNTSPYSVQQRAGHNNANAFDTKGSLENHCTGNPRTIIVPPLKTQASEVLVECDSLVPVNTSHHSSSYKSKSSSNVTSTSGHSSGSSSGAITYRQQRPGPHFQQQQPLNLSQAQQHITTDRTGSHRRQQAYITPTMAQAPYSFPHNSPSHGTVHPHLAAAAAAAHLPTQPHLYTYTAPAALGSTGTVAHLVASQGSARHTVQHTAYPASIVHQVPVSMGPRVLPSPTIHPSQYPAQFAHQTYISASPASTVYTGYPLSPAKVNQYPYI

SEQ ID NO: 38886 - protein, 1171 aa, Homo sapiens
  Payload ID: 7782
  Gene Symbol: HIPK2
  Gene Name: homeodomain interacting protein kinase 2
  Uniprot ID: Q9H2X6
  ENSP ID: ENSP00000413724
MAPVYEGMASHVQVFSPHTLQSSAFCSVKKLKIEPSSNWDMTGYGSHSKVYSQSKNIPLSQPATTTVSTSLPVPNPSLPYEQTIVFPGSTGHIVVTSASSTSVTGQVLGGPHNLMRRSTVSLLDTYQKCGLKRKSEEIENTSSVQIIEEHPPMIQNNASGATVATATTSTATSKNSGSNSEGDYQLVQHEVLCSMTNTYEVLEFLGRGTFGQVVKCWKRGTNEIVAIKILKNHPSYARQGQIEVSILARLSTESADDYNFVRAYECFQHKNHTCLVFEMLEQNLYDFLKQNKFSPLPLKYIRPVLQQVATALMKLKSLGLIHADLKPENIMLVDPSRQPYRVKVIDFGSASHVSKAVCSTYLQSRYYRAPEIILGLPFCEAIDMWSLGCVIAELFLGWPLYPGASEYDQIRYISQTQGLPAEYLLSAGTKTTRFFNRDTDSPYPLWRLKTPDDHEAETGIKSKEARKYIFNCLDDMAQVNMTTDLEGSDMLVEKADRREFIDLLKKMLTIDADKRITPIETLNHPFVTMTHLLDFPHSTHVKSCFQNMEICKRRVNMYDTVNQSKTPFITHVAPSTSTNLTMTFNNQLTTVHNQPSAASMAAVAQRSMPLQTGTAQICARPDPFQQALIVCPPGFQGLQASPSKHAGYSVRMENAVPIVTQAPGAQPLQIQPGLLAQQAWPSGTQQILLPPAWQQLTGVATHTSVQHATVIPETMAGTQQLADWRNTHAHGSHYNPIMQQPALLTGHVTLPAAQPLNVGVAHVMRQQPTSTTSSRKSKQHQSSVRNVSTCEVSSSQAISSPQRSKRVKENTPPRCAMVHSSPACSTSVTCGWGDVASSTTRERQRQTIVIPDTPSPTVSVITISSDTDEEEEQKHAPTSTVSKQRKNVISCVTVHDSPYSDSSSNTSPYSVQQRAGHNNANAFDTKGSLENHCTGNPRTIIVPPLKTQASEVLVECDSLVPVNTSHHSSSYKSKSSSNVTSTSGHSSGSSSGAITYRQQRPGPHFQQQQPLNLSQAQQHITTDRTGSHRRQQAYITPTMAQAPYSFPHNSPSHGTVHPHLAAAAAAAHLPTQPHLYTYTAPAALGSTGTVAHLVASQGSARHTVQHTAYPASIVHQVPVSMGPRVLPSPTIHPSQYPAQFAHQTYISASPASTVYTGYPLSPAKVNQYPYI

SEQ ID NO: 38887 - protein, 1215 aa, Homo sapiens
  Payload ID: 7783
  Gene Symbol: HIPK3
  Gene Name: homeodomain interacting protein kinase 3
  Uniprot ID: Q9H422
  ENSP ID: ENSP00000304226
MASQVLVYPPYVYQTQSSAFCSVKKLKVEPSSCVFQERNYPRTYVNGRNFGNSHPPTKGSAFQTKIPFNRPRGHNFSLQTSAVVLKNTAGATKVIAAQAQQAHVQAPQIGAWRNRLHFLEGPQRCGLKRKSEELDNHSSAMQIVDELSILPAMLQTNMGNPVTVVTATTGSKQNCTTGEGDYQLVQHEVLCSMKNTYEVLDFLGRGTFGQVVKCWKRGTNEIVAIKILKNHPSYARQGQIEVSILARLSTENADEYNFVRAYECFQHRNHTCLVFEMLEQNLYDFLKQNKFSPLPLKVIRPILQQVATALKKLKSLGLIHADLKPENIMLVDPVRQPYRVKVIDFGSASHVSKTVCSTYLQSRYYRAPEIILGLPFCEAIDMWSLGCVIAELFLGWPLYPGALEYDQIRYISQTQGLPGEQLLNVGTKSTRFFCKETDMSHSGWRLKTLEEHEAETGMKSKEARKYIFNSLDDVAHVNTVMDLEGSDLLAEKADRREFVSLLKKMLLIDADLRITPAETLNHPFVNMKHLLDFPHSNHVKSCFHIMDICKSHLNSCDTNNHNKTSLLRPVASSSTATLTANFTKIGTLRSQALTTSAHSVVHHGIPLQAGTAQFGCGDAFQQTLIICPPAIQGIPATHGKPTSYSIRVDNTVPLVTQAPAVQPLQIRPGVLSQTWSGRTQQMLVPAWQQVTPLAPATTTLTSESVAGSHRLGDWGKMISCSNHYNSVMPQPLLTNQITLSAPQPVSVGIAHVVWPQPATTKKNKQCQNRGILVKLMEWEPGREEINAFSWSNSLQNTNIPHSAFISPKIINGKDVEEVSCIETQDNQNSEGEARNCCETSIRQDSDSSVSDKQRQTIIIADSPSPAVSVITISSDTDEEETSQRHSLRECKGSLDCEACQSTLNIDRMCSLSSPDSTLSTSSSGQSSPSPCKRPNSMSDEEQESSCDTVDGSPTSDSSGHDSPFAESTFVEDTHENTELVSSADTETKPAVCSVVVPPVELENGLNADEHMANTDSICQPLIKGRSAPGRLNQPSAVGTRQQKLTSAFQQQHLNFSQVQHFGSGHQEWNGNFGHRRQQAYIPTSVTSNPFTLSHGSPNHTAVHAHLAGNTHLGGQPTLLPYPSSATLSSAAPVAHLLASPCTSRPMLQHPTYNISHPSGIVHQVPVGLNPRLLPSPTIHQTQYKPIFPPHSYIAASPAYTGFPLSPTKLSQYPYM

SEQ ID NO: 38888 - protein, 1194 aa, Homo sapiens
  Payload ID: 7783
  Gene Symbol: HIPK3
  Gene Name: homeodomain interacting protein kinase 3
  Uniprot ID: Q9H422
  ENSP ID: ENSP00000368301
MASQVLVYPPYVYQTQSSAFCSVKKLKVEPSSCVFQERNYPRTYVNGRNFGNSHPPTKGSAFQTKIPFNRPRGHNFSLQTSAVVLKNTAGATKVIAAQAQQAHVQAPQIGAWRNRLHFLEGPQRCGLKRKSEELDNHSSAMQIVDELSILPAMLQTNMGNPVTVVTATTGSKQNCTTGEGDYQLVQHEVLCSMKNTYEVLDFLGRGTFGQVVKCWKRGTNEIVAIKILKNHPSYARQGQIEVSILARLSTENADEYNFVRAYECFQHRNHTCLVFEMLEQNLYDFLKQNKFSPLPLKVIRPILQQVATALKKLKSLGLIHADLKPENIMLVDPVRQPYRVKVIDFGSASHVSKTVCSTYLQSRYYRAPEIILGLPFCEAIDMWSLGCVIAELFLGWPLYPGALEYDQIRYISQTQGLPGEQLLNVGTKSTRFFCKETDMSHSGWRLKTLEEHEAETGMKSKEARKYIFNSLDDVAHVNTVMDLEGSDLLAEKADRREFVSLLKKMLLIDADLRITPAETLNHPFVNMKHLLDFPHSNHVKSCFHIMDICKSHLNSCDTNNHNKTSLLRPVASSSTATLTANFTKIGTLRSQALTTSAHSVVHHGIPLQAGTAQFGCGDAFQQTLIICPPAIQGIPATHGKPTSYSIRVDNTVPLVTQAPAVQPLQIRPGVLSQTWSGRTQQMLVPAWQQVTPLAPATTTLTSESVAGSHRLGDWGKMISCSNHYNSVMPQPLLTNQITLSAPQPVSVGIAHVVWPQPATTKKNKQCQNRSNSLQNTNIPHSAFISPKIINGKDVEEVSCIETQDNQNSEGEARNCCETSIRQDSDSSVSDKQRQTIIIADSPSPAVSVITISSDTDEEETSQRHSLRECKGSLDCEACQSTLNIDRMCSLSSPDSTLSTSSSGQSSPSPCKRPNSMSDEEQESSCDTVDGSPTSDSSGHDSPFAESTFVEDTHENTELVSSADTETKPAVCSVVVPPVELENGLNADEHMANTDSICQPLIKGRSAPGRLNQPSAVGTRQQKLTSAFQQQHLNFSQVQHFGSGHQEWNGNFGHRRQQAYIPTSVTSNPFTLSHGSPNHTAVHAHLAGNTHLGGQPTLLPYPSSATLSSAAPVAHLLASPCTSRPMLQHPTYNISHPSGIVHQVPVGLNPRLLPSPTIHQTQYKPIFPPHSYIAASPAYTGFPLSPTKLSQYPYM

SEQ ID NO: 38889 - protein, 1194 aa, Homo sapiens; identical to SEQ ID NO: 38888
  Payload ID: 7783
  Gene Symbol: HIPK3
  Gene Name: homeodomain interacting protein kinase 3
  Uniprot ID: Q9H422
  ENSP ID: ENSP00000398241

SEQ ID NO: 38890 - protein, 1194 aa, Homo sapiens; identical to SEQ ID NO: 38888
  Payload ID: 7783
  Gene Symbol: HIPK3
  Gene Name: homeodomain interacting protein kinase 3
  Uniprot ID: Q9H422
  ENSP ID: ENSP00000431710

SEQ ID NO: 38891 - protein, 76 aa, Homo sapiens
  Payload ID: 7783
  Gene Symbol: HIPK3
  Gene Name: homeodomain interacting protein kinase 3
  ENSP ID: ENSP00000433594
MASQVLVYPPYVYQTQSSAFCSVKKLKVEPSSCVFQERNYPRTYVNGRNFGNSHPPTKGSAFQTKIPFNRPRGHNF

SEQ ID NO: 38892 - protein, 616 aa, Homo sapiens
  Payload ID: 7784
  Gene Symbol: HIPK4
  Gene Name: homeodomain interacting protein kinase 4
  Uniprot ID: Q8NE63
  ENSP ID: ENSP00000291823
MSTIQSETDCYDIIEVLGKGTFGEVAKGWRRSTGEMVAIKILKNDAYRNRIIKNELKLLHCMRGLDPEEAHVIRFLEFFHDALKFYLVFELLEQNLFEFQKENNFAPLPARHIRTVTLQVLTALARLKELAIIHADLKPENIMLVDQTRCPFRVKVIDFGSASIFSEVRYVKEPYIQSRFYRAPEILLGLPFCEKVDVWSLGCVMAELHLGWPLYPGNNEYDQVRYICETQGLPKPHLLHAACKAHHFFKRNPHPDAANPWQLKSSADYLAETKVRPLERRKYMLKSLDQIETVNGGSVASRLTFPDREALAEHADLKSMVELIKRMLTWESHERISPSAALRHPFVSMQQLRSAHETTHYYQLSLRSYRLSLQVEGKPPTPVVAAEDGTPYYCLAEEKEAAGMGSVAGSSPFFREEKAPGMQRAIDQLDDLSLQEAGHGLWGETCTNAVSDMMVPLKAAITGHHVPDSGPEPILAFYSSRLAGRHKARKPPAGSKSDSNFSNLIRLSQVSPEDDRPCRGSSWEEGEHLGASAEPLAILQRDEDGPNIDNMTMEAERPDPELFDPSSCPGEWLSEPDCTLESVRGPRAQGLPPRRSHQHGPPRGATSFLQHVTGHH

SEQ ID NO: 38893 - protein, 224 aa, Homo sapiens
  Payload ID: 7785
  Gene Symbol: HOMER1
  Gene Name: homer scaffolding protein 1
  Uniprot ID: Q86YM7
  ENSP ID: ENSP00000282260
MGEQPIFSTRAHVFQIDPNTKKNWVPTSKHAVTVSYFYDSTRNVYRIISLDGSKAIINSTITPNMTFTKTSQKFGQWADSRANTVYGLGFSSEHHLSKVTELECVSSQANAVHTHKTELNQTIQELEETLKLKEEEIERLKQEIDNARELQEQRDSLTQKLQEVEIRNKDLEGQLSDLEQRLEKSQNEQEAFRNNLKTLLEILDGKIFELTELRDNLAKLLECS

SEQ ID NO: 38894 - protein, 354 aa, Homo sapiens
  Payload ID: 7785
  Gene Symbol: HOMER1
  Gene Name: homer scaffolding protein 1
  Uniprot ID: Q86YM7
  ENSP ID: ENSP00000334382
MGEQPIFSTRAHVFQIDPNTKKNWVPTSKHAVTVSYFYDSTRNVYRIISLDGSKAIINSTITPNMTFTKTSQKFGQWADSRANTVYGLGFSSEHHLSKFAEKFQEFKEAARLAKEKSQEKMELTSTPSQESAGGDLQSPLTPESINGTDDERTPDVTQNSEPRAEPTQNALPFSHSSAISKHWEAELATLKGNNAKLTAALLESTANVKQWKQQLAAYQEEAERLHKRVTELECVSSQANAVHTHKTELNQTIQELEETLKLKEEEIERLKQEIDNARELQEQRDSLTQKLQEVEIRNKDLEGQLSDLEQRLEKSQNEQEAFRNNLKTLLEILDGKIFELTELRDNLAKLLECS

SEQ ID NO: 38895 - protein, 177 aa, Homo sapiens
  Payload ID: 7785
  Gene Symbol: HOMER1
  Gene Name: homer scaffolding protein 1
  Uniprot ID: Q86YM7
  ENSP ID: ENSP00000426651
MGEQPIFSTRAHVFQIDPNTKKNWVPTSKHAVTVSYFYDSTRNVYRIISLDGSKAIINSTITPNMTFTKTSQKFGQWADSRANTVYGLGFSSEHHLSKFAEKFQEFKEAARLAKEKSQEKMELTSTPSQESAGGDLQSPLTPESINGTDDERTPDVTQNSEPRAEPTQNALPFSHRK

SEQ ID NO: 38896 - protein, 180 aa, Homo sapiens
  Payload ID: 7785
  Gene Symbol: HOMER1
  Gene Name: homer scaffolding protein 1
  ENSP ID: ENSP00000441587
MGSAISKHWEAELATLKGNNAKLTAALLESTANVKQWKQQLAAYQEEAERLHKRVTELECVSSQANAVHTHKTELNQTIQELEETLKLKEEEIERLKQEIDNARELQEQRDSLTQKLQEVEIRNKDLEGQLSDLEQRLEKSQNEQEAFRNNLKTLLEILDGKIFELTELRDNLAKLLECS

SEQ ID NO: 38897 - protein, 354 aa, Homo sapiens
  Payload ID: 7786
  Gene Symbol: HOMER2
  Gene Name: homer scaffolding protein 2
  Uniprot ID: Q9NSB8
  ENSP ID: ENSP00000305632
MGEQPIFTTRAHVFQIDPNTKKNWMPASKQAVTVSYFYDVTRNSYRIISVDGAKVIINSTITPNMTFTKTSQKFGQWADSRANTVFGLGFSSEQQLTKFAEKFQEVKEAAKIAKDKTQEKIETSSNHSQESGRETPSSTQASSVNGTDDEKASHAGPANTHLKSENDKLKIALTQSAANVKKWEIELQTLRESNARLTTALQESAASVEQWKRQFSICRDENDRLRNKIDELEEQCSEINREKEKNTQLKRRIEELEAELREKETELKDLRKQSEIIPQLMSECEYVSEKLEAAERDNQNLEDKVRSLKTDIEESKYRQRHLKVELKSFLEVLDGKIDDLHDFRRGLSKLGTDN

SEQ ID NO: 38898 - protein, 343 aa, Homo sapiens
  Payload ID: 7786
  Gene Symbol: HOMER2
  Gene Name: homer scaffolding protein 2
  Uniprot ID: Q9NSB8
  ENSP ID: ENSP00000407634
MGEQPIFTTRAHVFQIDPNTKKNWMPASKQAVTVSYFYDVTRNSYRIISVDGAKVIINSTITPNMTFTKTSQKFGQWADSRANTVFGLGFSSEQQLTKFAEKFQEVKEAAKIAKDKTQEKIETSSNHSQASSVNGTDDEKASHAGPANTHLKSENDKLKIALTQSAANVKKWEIELQTLRESNARLTTALQESAASVEQWKRQFSICRDENDRLRNKIDELEEQCSEINREKEKNTQLKRRIEELEAELREKETELKDLRKQSEIIPQLMSECEYVSEKLEAAERDNQNLEDKVRSLKTDIEESKYRQRHLKVELKSFLEVLDGKIDDLHDFRRGLSKLGTDN

SEQ ID NO: 38899 - protein, 4 aa, Homo sapiens
  Payload ID: 7786
  Gene Symbol: HOMER2
  Gene Name: homer scaffolding protein 2
  ENSP ID: ENSP00000452870
  MOD_RES (1)..(1): Any amino acid
XTDN

SEQ ID NO: 38900 - protein, 185 aa, Homo sapiens
  Payload ID: 7786
  Gene Symbol: HOMER2
  Gene Name: homer scaffolding protein 2
  ENSP ID: ENSP00000454125
FAEKFQEVKEAAKIAKDKTQEKIETSSNHSQIIHFGQESGRETPSSTQASSVNGTDDEKASHAGPANTHLKSENDKLKIALTQSAANVKKWEIELQTLRESNARLTTALQESAASVEQWKRQFSICRDENDRLRNKIDELEEQCSEINREKEKNTQLKRRIEELEAELREKETELKDLRKQSEII

SEQ ID NO: 38901 - protein, 358 aa, Homo sapiens
  Payload ID: 7787
  Gene Symbol: HOMER3
  Gene Name: homer scaffolding protein 3
  Uniprot ID: Q9NSC5
  ENSP ID: ENSP00000221222
MSTAREQPIFSTRAHVFQIDPATKRNWIPAGKHALTVSYFYDATRNVYRIISIGGAKAIINSTVTPNMTFTKTSQKFGQWADSRANTVYGLGFASEQHLTQFAEKFQEVKEAARLAREKSQDGGELTSPALGLASHQVPPSPLVSANGPGEEKLFRSQSADAPGPTERERLKKMLSEGSVGEVQWEAEFFALQDSNNKLAGALREANAAAAQWRQQLEAQRAEAERLRQRVAELEAQAASEVTPTGEKEGLGQGQSLEQLEALVQTKDQEIQTLKSQTGGPREALEAAEREETQQKVQTRNAELEHQLRAMERSLEEARAERERARAEVGRAAQLLDVSLFELSELREGLARLAEAAP

SEQ ID NO: 38902 - protein, 361 aa, Homo sapiens
  Payload ID: 7787
  Gene Symbol: HOMER3
  Gene Name: homer scaffolding protein 3
  Uniprot ID: Q9NSC5
  ENSP ID: ENSP00000376162
MSTAREQPIFSTRAHVFQIDPATKRNWIPAGKHALTVSYFYDATRNVYRIISIGGAKAIINSTVTPNMTFTKTSQKFGQWADSRANTVYGLGFASEQHLTQFAEKFQEVKEAARLAREKSQDGGELTSPALGLASHQVPPSPLVSANGPGEEKLFRSQSADAPGPTERERLKKMLSEGSVGEVQWEAEFFALQDSNNKLAGALREANAAAAQWRQQLEAQRAEAERLRQRVAELEAQAASEVTPTGEKEGLGQGQSLEQLEALVQTKDQEIQTLKSQTGGPREALEAAEREETQQKVQDLETRNAELEHQLRAMERSLEEARAERERARAEVGRAAQLLDVSLFELSELREGLARLAEAAP

SEQ ID NO: 38903 - protein, 358 aa, Homo sapiens; identical to SEQ ID NO: 38901
  Payload ID: 7787
  Gene Symbol: HOMER3
  Gene Name: homer scaffolding protein 3
  Uniprot ID: Q9NSC5
  ENSP ID: ENSP00000396154

SEQ ID NO: 38904 - protein, 361 aa, Homo sapiens; identical to SEQ ID NO: 38902
  Payload ID: 7787
  Gene Symbol: HOMER3
  Gene Name: homer scaffolding protein 3
  Uniprot ID: Q9NSC5
  ENSP ID: ENSP00000439937

SEQ ID NO: 38905 - protein, 361 aa, Homo sapiens; identical to SEQ ID NO: 38902
  Payload ID: 7787
  Gene Symbol: HOMER3
  Gene Name: homer scaffolding protein 3
  Uniprot ID: Q9NSC5
  ENSP ID: ENSP00000446026

SEQ ID NO: 38906 - protein, 152 aa, Homo sapiens
  Payload ID: 7787
  Gene Symbol: HOMER3
  Gene Name: homer scaffolding protein 3
  ENSP ID: ENSP00000469800
MSTARQQLEAQRAEAERLRQRVAELEAQAASEVTPTGEKEGLGQGQSLEQLEALVQTKDQEIQTLKSQTGGPREALEAAEREETQQKVQDLETRNAELEHQLRAMERSLEEARAERERARAEVGRAAQLLDVSLFELSELREGLARLAEAAP

SEQ ID NO: 38907 - protein, 150 aa, Homo sapiens
  Payload ID: 7787
  Gene Symbol: HOMER3
  Gene Name: homer scaffolding protein 3
  ENSP ID: ENSP00000470659
MSTAREQPIFSTRAHVFQIDPATKRNWIPAGKHALTVSYFYDATRNVYRIISIGGAKAIINSTVTPNMTFTKTSQKFGQWADSRANTVYGLGFASEQHLTQFAEKFQEVKEAARLAREKSQDGGELTSPALGLASHQVPPSPLVSANGPG

SEQ ID NO: 38908 - protein, 325 aa, Homo sapiens
  Payload ID: 7787
  Gene Symbol: HOMER3
  Gene Name: homer scaffolding protein 3
  Uniprot ID: Q9NSC5
  ENSP ID: ENSP00000471835
MSTAREQPIFSTRAHVFQIDPATKRNWIPAGKHALTVSYFYDATRNVYRIISIGGAKAIINSTVTPNMTFTKTSQKFGQWADSRANTVYGLGFASEQHLTQVPPSPLVSANGPGEEKLFRSQSADAPGPTERERLKKMLSEGSVGEVQWEAEFFALQDSNNKLAGALREANAAAAQWRQQLEAQRAEAERLRQRVAELEAQAASEVTPTGEKEGLGQGQSLEQLEALVQTKDQEIQTLKSQTGGPREALEAAEREETQQKVQDLETRNAELEHQLRAMERSLEEARAERERARAEVGRAAQLLDVSLFELSELREGLARLAEAAP

SEQ ID NO: 38909 - protein, 85 aa, Homo sapiens
  Payload ID: 7787
  Gene Symbol: HOMER3
  Gene Name: homer scaffolding protein 3
  ENSP ID: ENSP00000472800
MSTAREQPIFSTRAHVFQIDPATKRNWIPAGKHALTVSYFYDATRNVYRIISIGGAKAIINSTVTPNMTFTKTSQKFGQWADSRA

SEQ ID NO: 38910 - protein, 243 aa, Homo sapiens
  Payload ID: 7787
  Gene Symbol: HOMER3
  Gene Name: homer scaffolding protein 3
  ENSP ID: ENSP00000472815
MSTAREQPIFSTRAHVFQIDPATKRNWIPAGKHALTVSYFYDATRNVYRIISIGGAKAIINSTVTPNMTFTKTSQKFGQWADSRANTVYGLGFASEQHLTQFAEKFQEVKEAARLAREKSQDGGELTSPALGLASHQVPPSPLVSANGPGEEKLFRSQSADAPGPTERERLKKMLSEGSVGEVQWEAEFFALQDSNNKLAGALREANAAAAQWRQQLEAQRAEAERLRQRVAELEAQAASEVT

SEQ ID NO: 38911 - protein, 5405 aa, Homo sapiens
  Payload ID: 7788
  Gene Symbol:
  Gene Name: Homo sapiens Fc fragment of IgG binding protein (FCGBP), mRNA. [Source:RefSeq mRNA
  Acc:NM_003890]
  Uniprot ID: Q9Y6R7
  ENSP ID: ENSP00000487490
MGALWSWWILWAGATLLWGLTQEASVDLKNTGREEFLTAFLQNYQLAYSKAYPRLLISSLSESPASVSILSQADNTSKKVTVRPGESVMVNISAKAEMIGSKIFQHAVVIHSDYAISVQALNAKPDTAELTLLRPIQALGTEYFVLTPPGTSARNVKEFAVVAGAAGASVSVTLKGSVTFNGKFYPAGDVLRVTLQPYNVAQLQSSVDLSGSKVTASSPVAVLSGHSCAQKHTTCNHVVEQLLPTSAWGTHYVVPTLASQSRYDLAFVVASQATKLTYNHGGITGSRGLQAGDVVEFEVRPSWPLYLSANVGIQVLLFGTGAIRNEVTYDPYLVLIPDVAAYCPAYVVKSVPGCEGVALVVAQTKAISGLTIDGHAVGAKLTWEAVPGSEFSYAEVELGTADMIHTAEATTNLGLLTFGLAKAIGYATAADCGRTVLSPVEPSCEGMQCAAGQRCQVVGGKAGCVAESTAVCRAQGDPHYTTFDGRRYDMMGTCSYTMVELCSEDDTLPAFSVEAKNEHRGSRRVSYVGLVTVRAYSHSVSLTRGEVGFVLVDNQRSRLPVSLSEGRLRVYQSGPRAVVELVFGLVVTYDWDCQLALSLPARFQDQVCGLCGNYNGDPADDFLTPDGALAPDAVEFASSWKLDDGDYLCEDGCQNNCPACTPGQAQHYEGDRLCGMLTKLDGPFAVCHDTLDPRPFLEQCVYDLCVVGGERLSLCRGLSAYAQACLELGISVGDWRSPANCPLSCPANSRYELCGPACPTSCNGAAAPSNCSGRPCVEGCVCLPGFVASGGACVPASSCGCTFQGLQLAPGQEVWADELCQRRCTCNGATHQVTCRDKQSCPAGERCSVQNGLLGCYPDRFGTCQGSGDPHYVSFDGRRFDFMGTCTYLLVGSCGQNAALPAFRVLVENEHRGSQTVSYTRAVRVEARGVKVAVRREYPGQVLVDDVLQYLPFQAADGQVQVFRQGRDAVVRTDFGLTVTYDWNARVTAKVPSSYAEALCGLCGNFNGDPADDLALRGGGQAANALAFGNSWQEETRPGCGATEPGDCPKLDSLVAQQLQSKNECGILADPKGPFRECHSKLDPQGAVRDCVYDRCLLPGQSGPLCDALATYAAACQAAGATVHPWRSEELCPLSCPPHSHYEACSYGCPLSCGDLPVPGGCGSECHEGCVCDEGFALSGESCLPLASCGCVHQGTYHPPGQTFYPGPGCDSLCHCQEGGLVSCESSSCGPHEACQPSGGSLGCVAVGSSTCQASGDPHYTTFDGRRFDFMGTCVYVLAQTCGTRPGLHRFAVLQENVAWGNGRVSVTRVITVQVANFTLRLEQRQWKVTVNGVDMKLPVVLANGQIRASQHGSDVVIETDFGLRVAYDLVYYVRVTVPGNYYQQMCGLCGNYNGDPKDDFQKPNGSQAGNANEFGNSWEEVVPDSPCLPPTPCPPGSEDCIPSHKCPPELEKKYQKEEFCGLLSSPTGPLSSCHKLVDPQGPLKDCIFDLCLGGGNLSILCSNIHAYVSACQAAGGHVEPWRTETFCPMECPPNSHYELCADTCSLGCSALSAPPQCQDGCAEGCQCDSGFLYNGQACVPIQQCGCYHNGVYYEPEQTVLIDNCRQQCTCHAGKGMVCQEHSCKPGQVCQPSGGILSCVTKDPCHGVTCRPQETCKEQGGQGVCLPNYEATCWLWGDPHYHSFDGRKFDFQGTCNYVLATTGCPGVSTQGLTPFTVTTKNQNRGNPAVSYVRVVTVAALGTNISIHKDEIGKVRVNGVLTALPVSVADGRISVTQGASKALLVADFGLQVSYDWNWRVDVTLPSSYHGAVCGLCGNMDRNPNNDQVFPNGTLAPSIPIWGGSWRAPGWDPLCWDECRGSCPTCPEDRLEQYEGPGFCGPLAPGTGGPFTTCHAHVPPESFFKGCVLDVCMGGGDRDILCKALASYVAACQAAGVVIEDWRAQVGCEITCPENSHYEVCGSPCPASCPSPAPLTTPAVCEGPCVEGCQCDAGFVLSADRCVPLNNGCGCWANGTYHEAGSEFWADGTCSQWCRCGPGGGSLVCTPASCGLGEVCGLLPSGQHGCQPVSTAECQAWGDPHYVTLDGHRFNFQGTCEYLLSAPCHGPPLGAENFTVTVANEHRGSQAVSYTRSVTLQIYNHSLTLSARWPRKLQVDGVFVTLPFQLDSLLHAHLSGADVVVTTTSGLSLAFDGDSFVRLRVPAAYAGSLCGLCGNYNQDPADDLKAVGGKPAGWQVGGAQGCGECVSKPCPSPCTPEQQESFGGPDACGVISATDGPLAPCHGLVPPAQYFQGCLLDACQVQGHPGGLCPAVATYVAACQAAGAQLREWRRPDFCPFQCPAHSHYELCGDSCPGSCPSLSAPEGCESACREGCVCDAGFVLSGDTCVPVGQCGCLHDDRYYPLGQTFYPGPGCDSLCRCREGGEVSCEPSSCGPHETCRPSGGSLGCVAVGSTTCQASGDPHYTTFDGRRFDFMGTCVYVLAQTCGTRPGLHRFAVLQENVAWGNGRVSVTRVITVQVANFTLRLEQRQWKVTVNGVDMKLPVVLANGQIRASQHGSDVVIETDFGLRVAYDLVYYVRVTVPGNYYQLMCGLCGNYNGDPKDDFQKPNGSQAGNANEFGNSWEEVVPDSPCLPPPTCPPGSEGCIPSEECPPELEKKYQKEEFCGLLSSPTGPLSSCHKLVDPQGPLKDCIFDLCLGGGNLSILCSNIHAYVSACQAAGGQVEPWRNETFCPMECPQNSHYELCADTCSLGCSALSAPLQCPDGCAEGCQCDSGFLYNGQACVPIQQCGCYHNGAYYEPEQTVLIDNCRQQCTCHVGKVVVCQEHSCKPGQVCQPSGGILSCVNKDPCHGVTCRPQETCKEQGGQGVCLPNYEATCWLWGDPHYHSFDGRKFDFQGTCNYVLATTGCPGVSTQGLTPFTVTTKNQNRGNPAVSYVRVVTVAALGTNISIHKDEIGKVRVNGVLTALPVSVADGRISVTQGASKALLVADFGLQVSYDWNWRVDVTLPSSYHGAVCGLCGNMDRNPNNDQVFPNGTLAPSIPIWGGSWRAPGWDPLCWDECRGSCPTCPEDRLEQYEGPGFCGPLAPGTGGPFTTCHAHVPPESFFKGCVLDVCMGGGDRDILCKALASYVAACQAAGVVIEDWRAQVGCEITCPENSHYEVCGPPCPASCPSPAPLTTPAVCEGPCVEGCQCDAGFVLSADRCVPLNNGCGCWANGTYHEAGSEFWADGTCSQWCRCGPGGGSLVCTPASCGLGEVCGLLPSGQHGCQPVSTAECQAWGDPHYVTLDGHRFDFQGTCEYLLSAPCHGPPLGAENFTVTVANEHRGSQAVSYTRSVTLQIYNHSLTLSARWPRKLQVDGVFVTLPFQLDSLLHAHLSGADVVVTTTSGLSLAFDGDSFVRLRVPAAYAGSLCGLCGNYNQDPADDLKAVGGKPAGWQVGGAQGCGECVSKPCPSPCTPEQQESFGGPDACGVISATDGPLAPCHGLVPPAQYFQGCLLDACQVQGHPGGLCPAVATYVAACQAAGAQLREWRRPDFCPFQCPAHSHYELCGDSCPGSCPSLSAPEGCESACREGCVCDAGFVLSGDTCVPVGQCGCLHDDRYYPLGQTFYPGPGCDSLCRCREGGEVSCEPSSCGPHETCRPSGGSLGCVAVGSTTCQASGDPHYTTFDGHRFDFMGTCVYVLAQTCGTRPGLHRFAVLQENVAWGNGRVSVTRVITVQVANFTLRLEQRQWKVTVNGVDMKLPVVLANGQIRASQHGSDVVIETDFGLRVAYDLVYYVRVTVPGNYYQLMCGLCGNYNGDPKDDFQKPNGSQAGNANEFGNSWEEVVPDSPCLPPPTCPPGSAGCIPSDKCPPELEKKYQKEEFCGLLSSPTGPLSSCHKLVDPQGPLKDCIFDLCLGGGNLSILCSNIHAYVSACQAAGGHVEPWRNETFCPMECPQNSHYELCADTCSLGCSALSAPLQCPDGCAEGCQCDSGFLYNGQACVPIQQCGCYHNGVYYEPEQTVLIDNCRQQCTCHVGKVVVCQEHSCKPGQVCQPSGGILSCVTKDPCHGVTCRPQETCKEQGGQGVCLPNYEATCWLWGDPHYHSFDGRKFDFQGTCNYVLATTGCPGVSTQGLTPFTVTTKNQNRGNPAVSYVRVVTVAALGTNISIHKDEIGKVRVNGVLTALPVSVADGRISVAQGASKALLVADFGLQVSYDWNWRVDVTLPSSYHGAVCGLCGNMDRNPNNDQVFPNGTLAPSIPIWGGSWRAPGWDPLCWDECRGSCPTCPEDRLEQYEGPGFCGPLSSGTGGPFTTCHAHVPPESFFKGCVLDVCMGGGDRDILCKALASYVAACQAAGVVIEDWRAQVGCEITCPENSHYEVCGPPCPASCPSPAPLTTPAVCEGPCVEGCQCDAGFVLSADRCVPLNNGCGCWANGTYHEAGSEFWADGTCSQWCRCGPGGGSLVCTPASCGLGEVCGLLPSGQHGCQPVSTAECQAWGDPHYVTLDGHRFDFQGTCEYLLSAPCHGPPLGAENFTVTVANEHRGSQAVSYTRSVTLQIYNHSLTLSARWPRKLQVDGVFVALPFQLDSLLHAHLSGADVVVTTTSGLSLAFDGDSFVRLRVPAAYAASLCGLCGNYNQDPADDLKAVGGKPAGWQVGGAQGCGECVSKPCPSPCTPEQQESFGGPDACGVISATDGPLAPCHGLVPPAQYFQGCLLDACQVQGHPGGLCPAVATYVAACQAAGAQLGEWRRPDFCPLQCPAHSHYELCGDSCPVSCPSLSAPEGCESACREGCVCDAGFVLSGDTCVPVGQCGCLHDGRYYPLGEVFYPGPECERRCECGPGGHVTCQEGAACGPHEECRLEDGVQACHATGCGRCLANGGIHYITLDGRVYDLHGSCSYVLAQVCHPKPGDEDFSIVLEKNAAGDLQRLLVTVAGQVVSLAQGQQVTVDGEAVALPVAVGRVRVTAEGRNMVLQTTKGLRLLFDGDAHLLMSIPSPFRGRLCGLCGNFNGNWSDDFVLPNGSAASSVETFGAAWRAPGSSKGCGEGCGPQGCPVCLAEETAPYESNEACGQLRNPQGPFATCQAVLSPSEYFRQCVYDLCAQKGDKAFLCRSLAAYTAACQAAGVAVKPWRTDSFCPLHCPAHSHYSICTRTCQGSCAALSGLTGCTTRCFEGCECDDRFLLSQGVCIPVQDCGCTHNGRYLPVNSSLLTSDCSERCSCSSSSGLTCQAAGCPPGRVCEVKAEARNCWATRGLCVLSVGANLTTFDGARGATTSPGVYELSSRCPGLQNTIPWYRVVAEVQICHGKTEAVGQVHIFFQDGMVTLTPNKGVWVNGLRVDLPAEKLASVSVSRTPDGSLLVRQKAGVQVWLGANGKVAVIVSNDHAGKLCGACGNFDGDQTNDWHDSQEKPAMEKWRAQDFSPCYG

SEQ ID NO: 38912 - protein, 576 aa, Homo sapiens
  Payload ID: 7789
  Gene Symbol:
  Gene Name: Homo sapiens phosphatase and tensin homolog (PTEN), transcript variant 1, mRNA. [Source:RefSeq mRNA
  Acc:NM_001304717]
  ENSP ID: ENSP00000489359
LERGGEAAAAAAAAAAAPGRGSESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKV

SEQ ID NO: 38913 - protein, 226 aa, Homo sapiens
  Payload ID: 7790
  Gene Symbol:
  Gene Name: Homo sapiens surfeit 4 (SURF4), transcript variant 2, mRNA. [Source:RefSeq mRNA
  Acc:NM_001280788]
  ENSP ID: ENSP00000486033
MWFQWSEQRDYIDTTWNCGYLLASSFVFLNLLGQLTGCVLVLSRNFVQYACFGLFGIIALQTIAYSILWDLKFLMRNLALGGGLLLLLAESRSEGKSMFAGVPTMRESSPKQYMQLGGRVLLVLMFMTLLHFDASFFSIVQNIVGTALMILVAIGFKTKLAALTLVVWLFAINVYFNAFWTIPVYKPMHDFLKYDFFQTMSVIGGLLLVVALGPGGVSMDEKKKEW

SEQ ID NO: 38914 - protein, 269 aa, Homo sapiens
  Payload ID: 7790
  Gene Symbol:
  Gene Name: Homo sapiens surfeit 4 (SURF4), transcript variant 2, mRNA. [Source:RefSeq mRNA
  Acc:NM_001280788]
  ENSP ID: ENSP00000486049
MGQNDLMGTAEDFADQFLRVTKQYLPHVARLCLISTFLEDGIRMWFQWSEQRDYIDTTWNCGYLLASSFVFLNLLGQLTGCVLVLSRNFVQYACFGLFGIIALQTIAYSILWDLKFLMRNLALGGGLLLLLAESRSEGKSMFAGVPTMRESSPKQYMQLGGRVLLVLMFMTLLHFDASFFSIVQNIVGTALMILVAIGFKTKLAALTLVVWLFAINVYFNAFWTIPVYKPMHDFLKYDFFQTMSVIGGLLLVVALGPGGVSMDEKKKEW

SEQ ID NO: 38915 - protein, 226 aa, Homo sapiens; identical to SEQ ID NO: 38913
  Payload ID: 7790
  Gene Symbol:
  Gene Name: Homo sapiens surfeit 4 (SURF4), transcript variant 2, mRNA. [Source:RefSeq mRNA
  Acc:NM_001280788]
  ENSP ID: ENSP00000486393

SEQ ID NO: 38916 - protein, 128 aa, Homo sapiens
  Payload ID: 7790
  Gene Symbol:
  Gene Name: Homo sapiens surfeit 4 (SURF4), transcript variant 2, mRNA. [Source:RefSeq mRNA
  Acc:NM_001280788]
  ENSP ID: ENSP00000486869
MGQNDLMGTAEDFADQFLRVTKQYLPHVARLCLISTFLEDGIRMWFQWSEQRDYIDTTWNCGYLLASSFVFLNLLGQLTGCVLVLSRNFVQYACFGLFGIIALQTIAYSILWDLKFLMRLSRTSWAQL

SEQ ID NO: 38917 - protein, 186 aa, Homo sapiens
  Payload ID: 7790
  Gene Symbol:
  Gene Name: Homo sapiens surfeit 4 (SURF4), transcript variant 2, mRNA. [Source:RefSeq mRNA
  Acc:NM_001280788]
  ENSP ID: ENSP00000487188
MGQNDLMGTAEDFADQFLRVTKQYLPHVARLCLISTFLEDGIRMWFQWSEQRDYIDTTWNCGYLLASSFVFLNLLGQLTGCVLVLSRNFVQYACFGLFGIIALQTIAYSILWDLKFLMRNLALGGGLLLLLAESRSEGKSMFAGVPTMRESSPKQYMQLGGRVLLVLMFMTLLHFDASFFSQPSQQ

SEQ ID NO: 38918 - protein, 159 aa, Homo sapiens
  Payload ID: 7790
  Gene Symbol:
  Gene Name: Homo sapiens surfeit 4 (SURF4), transcript variant 2, mRNA. [Source:RefSeq mRNA
  Acc:NM_001280788]
  ENSP ID: ENSP00000487537
MGQNDLMGTAEDFADQFLRVTKQYLPHVARLCLISTFLEDGIRMWFQWSEQRDYIDTTWNCGYLLASSFVFLNLLGQLTGCVLVLSRNFVQYACFGLFGIIALQTIAYSILWDLKFLMRNLALGGGLLLLLAESRSEGKSMFAGVPTMRESSPKQYLPG

SEQ ID NO: 38919 - protein, 390 aa, Homo sapiens
  Payload ID: 7791
  Gene Symbol: HERPUD1
  Gene Name: homocysteine-inducible, endoplasmic reticulum stress-inducible, ubiquitin-like domain member 1
  Uniprot ID: Q15011
  ENSP ID: ENSP00000300302
MESETEPEPVTLLVKSPNQRHRDLELSGDRGWSVGHLKAHLSRVYPERPRPEDQRLIYSGKLLLDHQCLRDLLPKEKRHVLHLVCNVKSPSKMPEINAKVAESTEEPAGSNRGQYPEDSSSDGLRQREVLRNLSSPGWENISRPEAAQQAFQGLGPGFSGYTPYGWLQLSWFQQIYARQYYMQYLAATAASGAFVPPPSAQEIPVVSAPAPAPIHNQFPAENQPANQNAAPQVVVNPGANQNLRMNAQGGPIVEEDDEINRDWLDWTYSAATFSVFLSILYFYSSLSRFLMVMGATVVMYLHHVGWFPFRPRPVQNFPNDGPPPDVVNQDPNNNLQEGTDPETEDPNHLPPDRDVLDGEQTSPSFMSTAWLVFKTFFASLLPEGPPAIAN

SEQ ID NO: 38920 - protein, 232 aa, Homo sapiens
  Payload ID: 7791
  Gene Symbol: HERPUD1
  Gene Name: homocysteine-inducible, endoplasmic reticulum stress-inducible, ubiquitin-like domain member 1
  Uniprot ID: Q15011
  ENSP ID: ENSP00000340931
MESETEPEPVTLLVKSPNQRHRDLELSGDRGWSVGHLKAHLSRVYPERPRPEDQRLIYSGKLLLDHQCLRDLLPKEKRHVLHLVCNVKSPSKMPEINAKVAESTEEPAGSNRGQYPEDSSSDGLRQREVLRNLSSPGWENISRHHVGWFPFRPRPVQNFPNDGPPPDVVNQDPNNNLQEGTDPETEDPNHLPPDRDVLDGEQTSPSFMSTAWLVFKTFFASLLPEGPPAIAN

SEQ ID NO: 38921 - protein, 366 aa, Homo sapiens
  Payload ID: 7791
  Gene Symbol: HERPUD1
  Gene Name: homocysteine-inducible, endoplasmic reticulum stress-inducible, ubiquitin-like domain member 1
  Uniprot ID: Q15011
  ENSP ID: ENSP00000369118
MESETEPEPVTLLVKSPNQRHRDLELSGDRGWSVGHLKAHLSRVYPERPRPEDQRLIYSGKLLLDHQCLRDLLPKVAESTEEPAGSNRGQYPEDSSSDGLRQREVLRNLSSPGWENISRPEAAQQAFQGLGPGFSGYTPYGWLQLSWFQQIYARQYYMQYLAATAASGAFVPPPSAQEIPVVSAPAPAPIHNQFPAENQPANQNAAPQVVVNPGANQNLRMNAQGGPIVEEDDEINRDWLDWTYSAATFSVFLSILYFYSSLSRFLMVMGATVVMYLHHVGWFPFRPRPVQNFPNDGPPPDVVNQDPNNNLQEGTDPETEDPNHLPPDRDVLDGEQTSPSFMSTAWLVFKTFFASLLPEGPPAIAN

SEQ ID NO: 38922 - protein, 391 aa, Homo sapiens
  Payload ID: 7791
  Gene Symbol: HERPUD1
  Gene Name: homocysteine-inducible, endoplasmic reticulum stress-inducible, ubiquitin-like domain member 1
  Uniprot ID: Q15011
  ENSP ID: ENSP00000409555
MESETEPEPVTLLVKSPNQRHRDLELSGDRGWSVGHLKAHLSRVYPERPRPEDQRLIYSGKLLLDHQCLRDLLPKQEKRHVLHLVCNVKSPSKMPEINAKVAESTEEPAGSNRGQYPEDSSSDGLRQREVLRNLSSPGWENISRPEAAQQAFQGLGPGFSGYTPYGWLQLSWFQQIYARQYYMQYLAATAASGAFVPPPSAQEIPVVSAPAPAPIHNQFPAENQPANQNAAPQVVVNPGANQNLRMNAQGGPIVEEDDEINRDWLDWTYSAATFSVFLSILYFYSSLSRFLMVMGATVVMYLHHVGWFPFRPRPVQNFPNDGPPPDVVNQDPNNNLQEGTDPETEDPNHLPPDRDVLDGEQTSPSFMSTAWLVFKTFFASLLPEGPPAIAN

SEQ ID NO: 38923 - protein, 160 aa, Homo sapiens
  Payload ID: 7791
  Gene Symbol: HERPUD1
  Gene Name: homocysteine-inducible, endoplasmic reticulum stress-inducible, ubiquitin-like domain member 1
  ENSP ID: ENSP00000455094
MVKNVLERPEDQRLIYSGKLLLDHQCLRDLLPKQEKRHVLHLVCNVKSPSKMPEINAKVAESTEEPAGSNRGQYPEDSSSDGLRQREVLRNLSSPGWENISRPEAAQQAFQGLGPGFSGYTPYGWLQLSWFQQIYARQYYMQYLAATAASGAFVPPPSAQ

SEQ ID NO: 38924 - protein, 226 aa, Homo sapiens
  Payload ID: 7791
  Gene Symbol: HERPUD1
  Gene Name: homocysteine-inducible, endoplasmic reticulum stress-inducible, ubiquitin-like domain member 1
  ENSP ID: ENSP00000455841
  MOD_RES (1)..(1): Any amino acid
XGQYPEDSSSDGLRQREVLRNLSSPGWENISSLAATAASGAFVPPPSAQEIPVVSAPAPAPIHNQFPAENQPANQNAAPQVVVNPGANQNLRMNAQGGPIVEEDDEINRDWLDWTYSAATFSVFLSILYFYSSLSRFLMVMGATVVMYLHHVGWFPFRPRPVQNFPNDGPPPDVVNQDPNNNLQKAPQPSQTDGVCAVAVGGFDRNGLDHLTPARLPLLDMAMMSF

SEQ ID NO: 38925 - protein, 53 aa, Homo sapiens
  Payload ID: 7791
  Gene Symbol: HERPUD1
  Gene Name: homocysteine-inducible, endoplasmic reticulum stress-inducible, ubiquitin-like domain member 1
  ENSP ID: ENSP00000456384
MESETEPEPVTLLVKSPNQRHRDLELSGDRGWSVGHLKAHLSRVYPERPRTRG

SEQ ID NO: 38926 - protein, 109 aa, Homo sapiens
  Payload ID: 7791
  Gene Symbol: HERPUD1
  Gene Name: homocysteine-inducible, endoplasmic reticulum stress-inducible, ubiquitin-like domain member 1
  ENSP ID: ENSP00000457095
  MOD_RES (1)..(1): Any amino acid
XEKRHVLHLVCNVKSPSKMPEINAKVAESTEEPAGSNRGQYPEDSSSDGLRQREVLRNLSSPGWENISRPEAAQQAFQGLGPGFSGYTPYGWLQLSWFQQIYARQYYMQ

SEQ ID NO: 38927 - protein, 150 aa, Homo sapiens
  Payload ID: 7791
  Gene Symbol: HERPUD1
  Gene Name: homocysteine-inducible, endoplasmic reticulum stress-inducible, ubiquitin-like domain member 1
  ENSP ID: ENSP00000457321
MVKNVLERPEDQRLIYSGKLLLDHQCLRDLLPKVAESTEEPAGSNRGQYPEDSSSDGLRQREVLRNLSSPGWENISRPEAAQQAFQGLGPGFSGYTPYGWLQLSWFQQIYARQYYMQYLAATAASGAFVPPPSAQEIPVVSAPAPAPIHN

SEQ ID NO: 38928 - protein, 150 aa, Homo sapiens
  Payload ID: 7791
  Gene Symbol: HERPUD1
  Gene Name: homocysteine-inducible, endoplasmic reticulum stress-inducible, ubiquitin-like domain member 1
  ENSP ID: ENSP00000457955
  MOD_RES (1)..(1): Any amino acid
XQQAFQGLGPGFSGYTPYGWLQLSWFQQIYARQYYMQYILYFYSSLSRFLMVMGATVVMYLHHVGWFPFRPRPVQNFPNDGPPPDVVNQDPNNNLQEGTDPETEDPNHLPPDRDVLDGEQTSPSFMSTAWLVFKTFFASLLPEGPPAIAN

SEQ ID NO: 38929 - protein, 445 aa, Homo sapiens
  Payload ID: 7792
  Gene Symbol: HGD
  Gene Name: homogentisate 1,2-dioxygenase
  Uniprot ID: Q93099
  ENSP ID: ENSP00000283871
MAELKYISGFGNECSSEDPRCPGSLPEGQNNPQVCPYNLYAEQLSGSAFTCPRSTNKRSWLYRILPSVSHKPFESIDEGQVTHNWDEVDPDPNQLRWKPFEIPKASQKKVDFVSGLHTLCGAGDIKSNNGLAIHIFLCNTSMENRCFYNSDGDFLIVPQKGNLLIYTEFGKMLVQPNEICVIQRGMRFSIDVFEETRGYILEVYGVHFELPDLGPIGANGLANPRDFLIPIAWYEDRQVPGGYTVINKYQGKLFAAKQDVSPFNVVAWHGNYTPYKYNLKNFMVINSVAFDHADPSIFTVLTAKSVRPGVAIADFVIFPPRWGVADKTFRPPYYHRNCMSEFMGLIRGHYEAKQGGFLPGGGSLHSTMTPHGPDADCFEKASKVKLAPERIADGTMAFMFESSLSLAVTKWGLKASRCLDENYHKCWEPLKSHFTPNSRNPAEPN

SEQ ID NO: 38930 - protein, 88 aa, Homo sapiens
  Payload ID: 7792
  Gene Symbol: HGD
  Gene Name: homogentisate 1,2-dioxygenase
  ENSP ID: ENSP00000417977
  MOD_RES (1)..(1): Any amino acid
XPQKGNLLIYTEFGKMLVQPNEICVIQRGMRFSIDVFEETRGYILEVYGVHFELPDLGPIDSLGLPKRMSPRSMLWPGTGIIHPTSTT

SEQ ID NO: 38931 - protein, 145 aa, Homo sapiens
  Payload ID: 7792
  Gene Symbol: HGD
  Gene Name: homogentisate 1,2-dioxygenase
  ENSP ID: ENSP00000419163
  MOD_RES (1)..(1): Any amino acid
XETRGYILEVYGVHFELPDLGPIGANGLANPRDFLIPIAWYEDRQVPGGYTVINKYQGKLFAAKQDVSPFNVVAWHGNYTPYKYNLKNFMVINSVAFDHADPSIFTVLTAKSVRPGVAIADFVIFPPRWGVADKTFRPPYYHNLA

SEQ ID NO: 38932 - protein, 142 aa, Homo sapiens
  Payload ID: 7792
  Gene Symbol: HGD
  Gene Name: homogentisate 1,2-dioxygenase
  ENSP ID: ENSP00000419560
MSVLQRILAAQVPCQKDSWLYRILPSVSHKPFESIDEGQVTHNWDEVDPDPNQLRWKPFEIPKASQKKVDFVSGLHTLCGAGDIKSNNGLAIHIFLCNTSMENRCFYNSDGDFLIVPQKGNLLIYTEFGKMLVQPNEICVIQ

SEQ ID NO: 38933 - protein, 98 aa, Homo sapiens
  Payload ID: 7792
  Gene Symbol: HGD
  Gene Name: homogentisate 1,2-dioxygenase
  ENSP ID: ENSP00000419838
DIKSNNGLAIHIFLCNTSMENRCFYNSDGDFLIVPQKGNLLIYTEFGKMLVQPNEICVIQDVSPFNVVAWHGNYTPYKYNLKNFMVINSVAFDHAGTA

SEQ ID NO: 38934 - protein, 728 aa, Homo sapiens
  Payload ID: 7793
  Gene Symbol: HOOK1
  Gene Name: hook microtubule-tethering protein 1
  Uniprot ID: Q9UJC3
  ENSP ID: ENSP00000360252
MEETQPPPQPKLPLCDSLMIWLQTFNTASPCQDVKQLTSGVAMAQVLHQIDAAWFNESWLSRIKEDVGDNWRIKASNVKKVLQGIMSYYHEFLGQQISEALIPDLNQITECSDPVELGRLLQLILGCAINCEKKQEHIQNIMTLEESVQHVVMTAIQELMSKEILSSPPNDAVGELEQQLKRALEELQEALAEKEELRQRCEELDMQVTTLQDEKNSLVSENEMMNEKLDQLDGSFDDPNTVVAKKYFHAQLQLEQLQEENFRLEAAKDDYRVHCEELEKQLIEFQHRNDELTSLAEETRALKDEIDVLRATSDKANKLESTVEIYRQKLQDLNDLRKQVKTLQETNMMYMHNTVSLEEELKKANAARTQLETYKRQVQDLHVKLSSESKRADTLAFEMKRLEEKHEALLKEKERLIEQRDTLKETNEELRCSQVQQDHLNQTDASATKSYENLAAEIMPVEYREVFIRLQHENKMLRLQQEGSENERIEELQEQLEQKHRKMNELETEQRLSKERIRELQQQIEDLQKSLQEQGSKSEGESSSKLKQKLEAHMEKLTEVHEELQKKQELIEDLQPDINQNVQKINELEAALQKKDEDMKAMEERYKMYLEKARNVIKTLDPKLNPASAEIMLLRKQLAEKERRIEILESECKVAKFRDYEEKLIVSAWYNKSLAFQKLGMESRLVSGGGACSDTGACTPARSFLAQQRHITNTRRNLSVKVPATTSD

SEQ ID NO: 38935 - protein, 137 aa, Homo sapiens
  Payload ID: 7793
  Gene Symbol: HOOK1
  Gene Name: hook microtubule-tethering protein 1
  ENSP ID: ENSP00000398860
MEETQPPPQPKLPLCDSLMIWLQTFNTASPCQDVKQLTSGVAMAQVLHQIDAAWFNESWLSRIKEDVGDNWRIKASNVKKVLQGIMSYYHEFLGQQISEALIPDLNQITECSDPVELGRLLQLILGCAINCEKKQEH

SEQ ID NO: 38936 - protein, 717 aa, Homo sapiens
  Payload ID: 7794
  Gene Symbol: HOOK2
  Gene Name: hook microtubule-tethering protein 2
  Uniprot ID: Q96ED9
  ENSP ID: ENSP00000264827
MSVDKAELCGSLLTWLQTFHVPSPCASPQDLSSGLAVAYVLNQIDPSWFNEAWLQGISEDPGPNWKLKVSNLKMVLRSLVEYSQDVLAHPVSEEHLPDVSLIGEFSDPAELGKLLQLVLGCAISCEKKQDHIQRIMTLEESVQHVVMEAIQELMTKDTPDSLSPETYGNFDSQSRRYYFLSEEAEEGDELQQRCLDLERQLMLLSEEKQSLAQENAGLRERMGRPEGEGTPGLTAKKLLLLQSQLEQLQEENFRLESGREDERLRCAELEREVAELQHRNQALTSLAQEAQALKDEMDELRQSSERAGQLEATLTSCRRRLGELRELRRQVRQLEERNAGHAERTRQLEDELRRAGSLRAQLEAQRRQVQELQGQRQEEAMKAEKWLFECRNLEEKYESVTKEKERLLAERDSLREANEELRCAQLQPRGLTQADPSLDPTSTPVDNLAAEILPAELRETLLRLQLENKRLCRQEAADRERQEELQRHLEDANRARHGLETQHRLNQQQLSELRAQVEDLQKALQEQGGKTEDSILLKRKLEEHLQKLHEADLELQRKREYIEELEPPTDSSTARRIEELQHNLQKKDADLRAMEERYRRYVDKARMVMQTMEPKQRPAAGAPPELHSLRTQLRERDVRIRHLEMDFEKSRSQREQEEKLLISAWYNMGMALQQRAGEERAPAHAQSFLAQQRLATNSRRGPLGRLASLNLRPTDKH

SEQ ID NO: 38937 - protein, 719 aa, Homo sapiens
  Payload ID: 7794
  Gene Symbol: HOOK2
  Gene Name: hook microtubule-tethering protein 2
  Uniprot ID: Q96ED9
  ENSP ID: ENSP00000380785
MSVDKAELCGSLLTWLQTFHVPSPCASPQDLSSGLAVAYVLNQIDPSWFNEAWLQGISEDPGPNWKLKVSNLKMVLRSLVEYSQDVLAHPVSEEHLPDVSLIGEFSDPAELGKLLQLVLGCAISCEKKQDHIQRIMTLEESVQHVVMEAIQELMTKDTPDSLSPETYGNFDSQSRRYYFLSEEAEEGDELQQRCLDLERQLMLLSEEKQSLAQENAGLRERMGRPEGEGTPGLTAKKLLLLQSQLEQLQEENFRLESGREDERLRCAELEREVAELQHRNQALTSLAQEAQALKDEMDELRQSSERAGQLEATLTSCRRRLGELRELRRQVRQLEERNAGHAERTRQLEDELRRAGSLRAQLEAQRRQVQELQGQRQEEAMKAEKWLFECRNLEEKYESVTKEKERLLAERDSLREANEELRCAQLQPRGLTQADPSLDPTSTPVDNLAAEILPAELRETLLRLQLENKRLCRQEAADRERQEELQRHLEDANRARHGLETQHRLNQQQLSELRAQVEDLQKALQEQGGKTEDAISILLKRKLEEHLQKLHEADLELQRKREYIEELEPPTDSSTARRIEELQHNLQKKDADLRAMEERYRRYVDKARMVMQTMEPKQRPAAGAPPELHSLRTQLRERDVRIRHLEMDFEKSRSQREQEEKLLISAWYNMGMALQQRAGEERAPAHAQSFLAQQRLATNSRRGPLGRLASLNLRPTDKH

SEQ ID NO: 38938 - protein, 226 aa, Homo sapiens
  Payload ID: 7794
  Gene Symbol: HOOK2
  Gene Name: hook microtubule-tethering protein 2
  ENSP ID: ENSP00000465023
MVLRSLVEYSQDVLAHPVSEEHLPDVSLIGEFSDPAELGKLLQLVLGCAISCEKKQDHIQRIMTLEESVQHVVMEAIQELMTKDTPDSLSPETYGNFDSQSRRYYFLSEEAEEGDELQQRCLDLERQLMLLSEEKQSLAQENAGLRERMGRPEGEGTPGLTAKKLLLLQSQLEQLQEENFRLESGREDERLRCAELEREVAELQHRNQALTSLAQEAQALKDEMDE

SEQ ID NO: 38939 - protein, 209 aa, Homo sapiens
  Payload ID: 7794
  Gene Symbol: HOOK2
  Gene Name: hook microtubule-tethering protein 2
  ENSP ID: ENSP00000465042
MSVDKAELCGSLLTWLQTFHVPSPCASPQDLSSGLAVAYVLNQIDPSWFNEAWLQGISEDPGPNWKLKVTSGLLIRGQTGEEMTRDGPARHMSWVMGRKRDRCLVSNLKMVLRSLVEYSQDVLAHPVSEEHLPDVSLIGEFSDPAELGKLLQLVLGCAISCEKKQDHIQRIMTLEESVQHVVMEAIQELMTKDTPDSLSPETYGNFDSQ

SEQ ID NO: 38940 - protein, 71 aa, Homo sapiens
  Payload ID: 7794
  Gene Symbol: HOOK2
  Gene Name: hook microtubule-tethering protein 2
  ENSP ID: ENSP00000465091
  MOD_RES (1)..(1): Any amino acid
XVLGCAISCEKKQDHIQRIMTLEESVQHVVMEAIQELMTKDTPDSLSPETYGNFDSQPCRSRGARLKIPFC

SEQ ID NO: 38941 - protein, 93 aa, Homo sapiens
  Payload ID: 7794
  Gene Symbol: HOOK2
  Gene Name: hook microtubule-tethering protein 2
  ENSP ID: ENSP00000465427
MVLRSLVEYSQDVLAHPVSEEHLPDVSLIGEFSDPAELGKLLQLVLGCAISCEKKQASPTLIPRPHPENHDAGRIGSACGDGSHPRAHDQRHS

SEQ ID NO: 38942 - protein, 127 aa, Homo sapiens
  Payload ID: 7794
  Gene Symbol: HOOK2
  Gene Name: hook microtubule-tethering protein 2
  ENSP ID: ENSP00000466497
MVLRSLVEYSQDVLAHPVSEEHLPDVSLIGEFSDPAELGKLLQLVLGCAISCEKKQDHIQRIMTLEESVQHVVMEAIQELMTKDTPDSLSPETYGNFDSQSRRYYFLSEEAEEGDELQQRCLDLERQ

SEQ ID NO: 38943 - protein, 157 aa, Homo sapiens
  Payload ID: 7794
  Gene Symbol: HOOK2
  Gene Name: hook microtubule-tethering protein 2
  ENSP ID: ENSP00000466616
MVLRSLVEYSQDVLAHPVSEEHLPDVSLIGEFSDPAELGKLLQLVLGCAISCEKKQDHIQRIMTLEESVQHVVMEAIQELMTKDTPDSLSPETYGNFDSQSRRYYFLSEEAEEGDELQQRCLDLERQLMLLSEEKQSLAQENAGLRERMGRPEGEGT

SEQ ID NO: 38944 - protein, 270 aa, Homo sapiens
  Payload ID: 7794
  Gene Symbol: HOOK2
  Gene Name: hook microtubule-tethering protein 2
  ENSP ID: ENSP00000467097
MVLRSLVEYSQDVLAHPVSEEHLPDVSLIGEFSDPAELGKLLQLVLGCAISCEKKQDHIQRIMTLEESVQHVVMEAIQELMTKDTPDSLSPETYGNFDSQSRRYYFLSEEAEEGDELQQRCLDLERQLMLLSEEKQSLAQENAGLRERMGRPEGEGTPGLTAKKLLLLQSQLEQLQEENFRLESGREDERLRCAELEREVAELQHRNQALTSLAQEAQALKDEMDELRQSSERAGQLEATLTSCRRRLGELRELRRQVRQLEERNAGHAE

SEQ ID NO: 38945 - protein, 718 aa, Homo sapiens
  Payload ID: 7795
  Gene Symbol: HOOK3
  Gene Name: hook microtubule-tethering protein 3
  Uniprot ID: Q86VS8
  ENSP ID: ENSP00000305699
MFSVESLERAELCESLLTWIQTFNVDAPCQTVEDLTNGVVMAQVLQKIDPAYFDENWLNRIKTEVGDNWRLKISNLKKILKGILDYNHEILGQQINDFTLPDVNLIGEHSDAAELGRMLQLILGCAVNCEQKQEYIQAIMMMEESVQHVVMTAIQELMSKESPVSAGNDAYVDLDRQLKKTTEELNEALSAKEEIAQRCHELDMQVAALQEEKSSLLAENQVLMERLNQSDSIEDPNSPAGRRHLQLQTQLEQLQEETFRLEAAKDDYRIRCEELEKEISELRQQNDELTTLADEAQSLKDEIDVLRHSSDKVSKLEGQVESYKKKLEDLGDLRRQVKLLEEKNTMYMQNTVSLEEELRKANAARSQLETYKRQVVELQNRLSEESKKADKLDFEYKRLKEKVDSLQKEKDRLRTERDSLKETIEELRCVQAQEGQLTTQGLMPLGSQESSDSLAAEIVTPEIREKLIRLQHENKMLKLNQEGSDNEKIALLQSLLDDANLRKNELETENRLVNQRLLEVQSQVEELQKSLQDQGSKAEDSVLLKKKLEEHLEKLHEANNELQKKRAIIEDLEPRFNNSSLKIEELQEALRKKEEEMKQMEERYKKYLEKAKSVIRTLDPKQNQGAAPEIQALKNQLQERDRLFHSLEKEYEKTKSQREMEEKYIVSAWYNMGMTLHKKAAEDRLASTGSGQSFLARQRQATSSRRSYPGHVQPATAR

SEQ ID NO: 38946 - protein, 31 aa, Homo sapiens
  Payload ID: 7795
  Gene Symbol: HOOK3
  Gene Name: hook microtubule-tethering protein 3
  ENSP ID: ENSP00000433813
  MOD_RES (1)..(1): Any amino acid
XGSGQSFLARQRQATSSRRSYPGHVQPATAR

SEQ ID NO: 38947 - protein, 161 aa, Homo sapiens
  Payload ID: 7795
  Gene Symbol: HOOK3
  Gene Name: hook microtubule-tethering protein 3
  ENSP ID: ENSP00000433953
EELQKSLQDQGSKAEDAISVLLKKKLEEHLEKLHEANNELQKKRAIIEDLEPRFNNSSLKIEELQEALRKKEEEMKQMEERYKKYLEKAKSVIRTLDPKQNQGAAPEIQALKNQLQERDRLFHSLEKEYEKTKSQREMEEKYIVSAWYNMGMTLHKKAAED

SEQ ID NO: 38948 - protein, 101 aa, Homo sapiens
  Payload ID: 7795
  Gene Symbol: HOOK3
  Gene Name: hook microtubule-tethering protein 3
  ENSP ID: ENSP00000435077
  MOD_RES (1)..(1): Any amino acid
XERDSLKETIEELRCVQAQEGQLTTQGLMPLGSQESSDSLAAEIVTPEIREKLIRLQHENKMLKLNQEGSDNEKIALLQSLLDDANLRKNELETENRYLCP

SEQ ID NO: 38949 - protein, 73 aa, Homo sapiens
  Payload ID: 7796
  Gene Symbol: HOPX
  Gene Name: HOP homeobox
  Uniprot ID: Q9BPY8
  ENSP ID: ENSP00000315198
MSAETASGPTEDQVEILEYNFNKVDKHPDSTTLCLIAAEAGLSEEETQKWFKQRLAKWRRSEGLPSECRSVTD

SEQ ID NO: 38950 - protein, 73 aa, Homo sapiens; identical to SEQ ID NO: 38949
  Payload ID: 7796
  Gene Symbol: HOPX
  Gene Name: HOP homeobox
  Uniprot ID: Q9BPY8
  ENSP ID: ENSP00000337330

SEQ ID NO: 38951 - protein, 73 aa, Homo sapiens; identical to SEQ ID NO: 38949
  Payload ID: 7796
  Gene Symbol: HOPX
  Gene Name: HOP homeobox
  Uniprot ID: Q9BPY8
  ENSP ID: ENSP00000370654

SEQ ID NO: 38952 - protein, 94 aa, Homo sapiens
  Payload ID: 7796
  Gene Symbol: HOPX
  Gene Name: HOP homeobox
  Uniprot ID: Q9BPY8
  ENSP ID: ENSP00000370659
MSAETASGPTEDQVEILEYNFNKVDKHPDSTTLCLIAAEAGLSEEETQGSDLISRSKIWHPESSPQREGYPHDSLPCLAFDYFSLLPPQCKEMV

SEQ ID NO: 38953 - protein, 91 aa, Homo sapiens
  Payload ID: 7796
  Gene Symbol: HOPX
  Gene Name: HOP homeobox
  Uniprot ID: Q9BPY8
  ENSP ID: ENSP00000396275
MLIFLGCYRRRLEERAGTMSAETASGPTEDQVEILEYNFNKVDKHPDSTTLCLIAAEAGLSEEETQKWFKQRLAKWRRSEGLPSECRSVTD

SEQ ID NO: 38954 - protein, 73 aa, Homo sapiens; identical to SEQ ID NO: 38949
  Payload ID: 7796
  Gene Symbol: HOPX
  Gene Name: HOP homeobox
  Uniprot ID: Q9BPY8
  ENSP ID: ENSP00000422175

SEQ ID NO: 38955 - protein, 73 aa, Homo sapiens; identical to SEQ ID NO: 38949
  Payload ID: 7796
  Gene Symbol: HOPX
  Gene Name: HOP homeobox
  Uniprot ID: Q9BPY8
  ENSP ID: ENSP00000424101

SEQ ID NO: 38956 - protein, 112 aa, Homo sapiens
  Payload ID: 7796
  Gene Symbol: HOPX
  Gene Name: HOP homeobox
  Uniprot ID: Q9BPY8
  ENSP ID: ENSP00000450527
MLIFLGCYRRRLEERAGTMSAETASGPTEDQVEILEYNFNKVDKHPDSTTLCLIAAEAGLSEEETQGSDLISRSKIWHPESSPQREGYPHDSLPCLAFDYFSLLPPQCKEMV

SEQ ID NO: 38957 - protein, 73 aa, Homo sapiens; identical to SEQ ID NO: 38949
  Payload ID: 7796
  Gene Symbol: HOPX
  Gene Name: HOP homeobox
  Uniprot ID: Q9BPY8
  ENSP ID: ENSP00000451794

SEQ ID NO: 38958 - protein, 73 aa, Homo sapiens; identical to SEQ ID NO: 38949
  Payload ID: 7796
  Gene Symbol: HOPX
  Gene Name: HOP homeobox
  Uniprot ID: Q9BPY8
  ENSP ID: ENSP00000452003

SEQ ID NO: 38959 - protein, 73 aa, Homo sapiens; identical to SEQ ID NO: 38949
  Payload ID: 7796
  Gene Symbol: HOPX
  Gene Name: HOP homeobox
  Uniprot ID: Q9BPY8
  ENSP ID: ENSP00000452098

SEQ ID NO: 38960 - protein, 73 aa, Homo sapiens; identical to SEQ ID NO: 38949
  Payload ID: 7796
  Gene Symbol: HOPX
  Gene Name: HOP homeobox
  Uniprot ID: Q9BPY8
  ENSP ID: ENSP00000452340

SEQ ID NO: 38961 - protein, 387 aa, Homo sapiens
  Payload ID: 7797
  Gene Symbol: HORMAD1
  Gene Name: HORMA domain containing 1
  Uniprot ID: Q86X24
  ENSP ID: ENSP00000326489
MATAQLQRTPMSALVFPNKISTEHQSLVLVKRLLAVSVSCITYLRGIFPECAYGTRYLDDLCVKILREDKNCPGSTQLVKWMLGCYDALQKKYVYTNPEDPQTISECYQFKFKYTNNGPLMDFISKNQSNESSMLSTDTKKASILLIRKIYILMQNLGPLPNDVCLTMKLFYYDEVTPPDYQPPGFKDGDCEGVIFEGEPMYLNVGEVSTPFHIFKVKVTTERERMENIDSTILSPKQIKTPFQKILRDKDVEDEQEHYTSDDLDIETKMEEQEKNPASSELEEPSLVCEEDEIMRSKESPDLSISHSQVEQLVNKTSELDMSESKTRSGKVFQNKMANGNQPVKSSKENRKRSQHESGRIVLHHFDSSSQESVPKRRKFSEPKEHI

SEQ ID NO: 38962 - protein, 394 aa, Homo sapiens
  Payload ID: 7797
  Gene Symbol: HORMAD1
  Gene Name: HORMA domain containing 1
  Uniprot ID: Q86X24
  ENSP ID: ENSP00000355167
MATAQLQRTPMSALVFPNKISTEHQSLVLVKRLLAVSVSCITYLRGIFPECAYGTRYLDDLCVKILREDKNCPGSTQLVKWMLGCYDALQKKYLRMVVLAVYTNPEDPQTISECYQFKFKYTNNGPLMDFISKNQSNESSMLSTDTKKASILLIRKIYILMQNLGPLPNDVCLTMKLFYYDEVTPPDYQPPGFKDGDCEGVIFEGEPMYLNVGEVSTPFHIFKVKVTTERERMENIDSTILSPKQIKTPFQKILRDKDVEDEQEHYTSDDLDIETKMEEQEKNPASSELEEPSLVCEEDEIMRSKESPDLSISHSQVEQLVNKTSELDMSESKTRSGKVFQNKMANGNQPVKSSKENRKRSQHESGRIVLHHFDSSSQESVPKRRKFSEPKEHI

SEQ ID NO: 38963 - protein, 190 aa, Homo sapiens
  Payload ID: 7797
  Gene Symbol: HORMAD1
  Gene Name: HORMA domain containing 1
  ENSP ID: ENSP00000357983
MRLWNKISRWMLGCYDALQKKYLRMVVLAVYTNPEDPQTISECYQFKFKYTNNGPLMDFISKNQSNESSMLSTDTKKASILLIRKIYILMQNLGPLPNDVCLTMKLFYYDEVTPPDYQPPGFKDGDCEGVIFEGEPMYLNVGEVSTPFHIFKVKVTTERERMENIDSTILSPKQIKTPFQKILRDKDVED

SEQ ID NO: 38964 - protein, 314 aa, Homo sapiens
  Payload ID: 7797
  Gene Symbol: HORMAD1
  Gene Name: HORMA domain containing 1
  Uniprot ID: Q86X24
  ENSP ID: ENSP00000357991
MRLWNKISRWMLGCYDALQKKYLRMVVLATISECYQFKFKYTNNGPLMDFISKNQSNESSMLSTDTKKASILLIRKIYILMQNLGPLPNDVCLTMKLFYYDEVTPPDYQPPGFKDGDCEGVIFEGEPMYLNVGEVSTPFHIFKVKVTTERERMENIDSTILSPKQIKTPFQKILRDKDVEDEQEHYTSDDLDIETKMEEQEKNPASSELEEPSLVCEEDEIMRSKESPDLSISHSQVEQLVNKTSELDMSESKTRSGKVFQNKMANGNQPVKSSKENRKRSQHESGRIVLHHFDSSSQESVPKRRKFSEPKEHI

SEQ ID NO: 38965 - protein, 164 aa, Homo sapiens
  Payload ID: 7797
  Gene Symbol: HORMAD1
  Gene Name: HORMA domain containing 1
  ENSP ID: ENSP00000401940
MRLWNKISRWMLGCYDALQKKYVYTNPEDPQTISECYQFKFKYTNNGPLMDFISKNQSNESSMLSTDTKKASILLIRKIYILMQNLGPLPNDVCLTMKLFYYDEVTPPDYQPPGFKDGDCEGVIFEGEPMYLNVGEVSTPFHIFKVKVTTERERMENIDSTILS

SEQ ID NO: 38966 - protein, 307 aa, Homo sapiens
  Payload ID: 7798
  Gene Symbol: HORMAD2
  Gene Name: HORMA domain containing 2
  Uniprot ID: Q8N7B1
  ENSP ID: ENSP00000336984
MATAQLSHCITIHKASKETVFPSQITNEHESLKMVKKLFATSISCITYLRGLFPESSYGERHLDDLSLKILREDKKCPGSLHIIRWIQGCFDALEKRYLRMAVLTLYTDPMGSEKVTEMYQFKFKYTKEGATMDFDSHSSSTSFESGTNNEDIKKASVLLIRKLYILMQDLEPLPNNVVLTMKLHYYNAVTPHDYQPLGFKEGVNSHFLLFDKEPINVQVGFVSTGFHSMKVKVMTEATKVIDLENNLFRENSTTEIAHQGLDCDEEEECNDHIQRMNFVCSQQSSECSRKKRKVSEPVKVFIPNRK

SEQ ID NO: 38967 - protein, 307 aa, Homo sapiens; identical to SEQ ID NO: 38966
  Payload ID: 7798
  Gene Symbol: HORMAD2
  Gene Name: HORMA domain containing 2
  Uniprot ID: Q8N7B1
  ENSP ID: ENSP00000385055

SEQ ID NO: 38968 - protein, 91 aa, Homo sapiens
  Payload ID: 7798
  Gene Symbol: HORMAD2
  Gene Name: HORMA domain containing 2
  ENSP ID: ENSP00000393415
MATAQLSHCITIHKASKETVFPSQITNEHESLKMVKKLFATSISCITYLRGLFPESSYGERHLDDLSLKILREDKKCPGSLHIIRCYVWQY

SEQ ID NO: 38969 - protein, 714 aa, Homo sapiens
  Payload ID: 7799
  Gene Symbol: HUNK
  Gene Name: hormonally up-regulated Neu-associated kinase
  Uniprot ID: P57058
  ENSP ID: ENSP00000270112
MPAAAGDGLLGEPAAPGGGGGAEDAARPAAACEGSFLPAWVSGVPRERLRDFQHHKRVGNYLIGSRKLGEGSFAKVREGLHVLTGEKVAIKVIDKKRAKKDTYVTKNLRREGQIQQMIRHPNITQLLDILETENSYYLVMELCPGGNLMHKIYEKKRLEESEARRYIRQLISAVEHLHRAGVVHRDLKIENLLLDEDNNIKLIDFGLSNCAGILGYSDPFSTQCGSPAYAAPELLARKKYGPKIDVWSIGVNMYAMLTGTLPFTVEPFSLRALYQKMVDKEMNPLPTQLSTGAISFLRSLLEPDPVKRPNIQQALANRWLNENYTGKVPCNVTYPNRISLEDLSPSVVLHMTEKLGYKNSDVINTVLSNRACHILAIYFLLNKKLERYLSGKSDIQDSLCYKTRLYQIEKYRAPKESYEASLDTWTRDLEFHAVQDKKPKEQEKRGDFLHRPFSKKLDKNLPSHKQPSGSLMTQIQNTKALLKDRKASKSSFPDKDSFGCRNIFRKTSDSNCVASSSMEFIPVPPPRTPRIVKKPEPHQPGPGSTGIPHKEDPLMLDMVRSFESVDRDDHVEVLSPSHHYRILNSPVSLARRNSSERTLSPGLPSGSMSPLHTPLHPTLVSFAHEDKNSPPKEEGLCCPPPVPSNGPMQPLGSPNCVKSRGRFPMMGIGQMLRKRHQSLQPSADRPLEASLPPLQPLAPVNLAFDMADGVKTQC

SEQ ID NO: 38970 - protein, 112 aa, Homo sapiens
  Payload ID: 7799
  Gene Symbol: HUNK
  Gene Name: hormonally up-regulated Neu-associated kinase
  ENSP ID: ENSP00000408219
RYLSGKSDIQDSLCYKTRLYQIEKYRAPKESYEASLDTWTRDLEFHAVQDKKPKEQEKRGDFLHRPFSKKLDKNLPSHKQPSGSLMTQIQNTKALLKDRKASKSSFPDKGLS

SEQ ID NO: 38971 - protein, 162 aa, Homo sapiens
  Payload ID: 7799
  Gene Symbol: HUNK
  Gene Name: hormonally up-regulated Neu-associated kinase
  ENSP ID: ENSP00000411860
QMIRHPNITQLLDILETENSYYLVMELCPGGNLMHKIYEKKRLEESEARRYIRQLISAVEHLHRAGVVHRDLKIENLLLDEDNNIKLIDFGLSNCAGILGYSDPFSTQCGSPAYAAPELLARKKYGPKIDVWSMCHQFPALSPGTGSCEEAKYSAGTGESLA

SEQ ID NO: 38972 - protein, 2850 aa, Homo sapiens
  Payload ID: 7800
  Gene Symbol: HRNR
  Gene Name: hornerin
  Uniprot ID: Q86YZ3
  ENSP ID: ENSP00000357791
MPKLLQGVITVIDVFYQYATQHGEYDTLNKAELKELLENEFHQILKNPNDPDTVDIILQSLDRDHNKKVDFTEYLLMIFKLVQARNKIIGKDYCQVSGSKLRDDTHQHQEEQEETEKEENKRQESSFSHSSWSAGENDSYSRNVRGSLKPGTESISRRLSFQRDFSGQHNSYSGQSSSYGEQNSDSHQSSGRGQCGSGSGQSPNYGQHGSGSGQSSSNDTHGSGSGQSSGFSQHKSSSGQSSGYSQHGSGSGHSSGYGQHGSRSGQSSRGERHRSSSGSSSSYGQHGSGSRQSLGHGRQGSGSRQSPSHVRHGSGSGHSSSHGQHGSGSSYSYSRGHYESGSGQTSGFGQHESGSGQSSGYSKHGSGSGHSSSQGQHGSTSGQASSSGQHGSSSRQSSSYGQHESASRHSSGRGQHSSGSGQSPGHGQRGSGSGQSPSSGQHGTGFGRSSSSGPYVSGSGYSSGFGHHESSSEHSSGYTQHGSGSGHSSGHGQHGSRSGQSSRGERQGSSAGSSSSYGQHGSGSRQSLGHSRHGSGSGQSPSPSRGRHESGSRQSSSYGPHGYGSGRSSSRGPYESGSGHSSGLGHQESRSGQSSGYGQHGSSSGHSSTHGQHGSTSGQSSSCGQHGATSGQSSSHGQHGSGSSQSSRYGQQGSGSGQSPSRGRHGSDFGHSSSYGQHGSGSGWSSSNGPHGSVSGQSSGFGHKSGSGQSSGYSQHGSGSSHSSGYRKHGSRSGQSSRSEQHGSSSGLSSSYGQHGSGSHQSSGHGRQGSGSGHSPSRVRHGSSSGHSSSHGQHGSGTSCSSSCGHYESGSGQASGFGQHESGSGQGYSQHGSASGHFSSQGRHGSTSGQSSSSGQHDSSSGQSSSYGQHESASHHASGRGRHGSGSGQSPGHGQRGSGSGQSPSYGRHGSGSGRSSSSGRHGSGSGQSSGFGHKSSSGQSSGYTQHGSGSGHSSSYEQHGSRSGQSSRSEQHGSSSGSSSSYGQHGSGSRQSLGHGQHGSGSGQSPSPSRGRHGSGSGQSSSYGPYRSGSGWSSSRGPYESGSGHSSGLGHRESRSGQSSGYGQHGSSSGHSSTHGQHGSTSGQSSSCGQHGASSGQSSSHGQHGSGSSQSSGYGRQGSGSGQSPGHGQRGSGSRQSPSYGRHGSGSGRSSSSGQHGSGLGESSGFGHHESSSGQSSSYSQHGSGSGHSSGYGQHGSRSGQSSRGERHGSSSGSSSHYGQHGSGSRQSSGHGRQGSGSGHSPSRGRHGSGLGHSSSHGQHGSGSGRSSSRGPYESRSGHSSVFGQHESGSGHSSAYSQHGSGSGHFCSQGQHGSTSGQSSTFDQEGSSTGQSSSYGHRGSGSSQSSGYGRHGAGSGQSPSRGRHGSGSGHSSSYGQHGSGSGWSSSSGRHGSGSGQSSGFGHHESSSWQSSGCTQHGSGSGHSSSYEQHGSRSGQSSRGERHGSSSGSSSSYGQHGSGSRQSLGHGQHGSGSGQSPSPSRGRHGSGSGQSSSYSPYGSGSGWSSSRGPYESGSSHSSGLGHRESRSGQSSGYGQHGSSSGHSSTHGQHGSTSGQSSSCGQHGASSGQSSSHGQHGSGSSQSSGYGRQGSGSGQSPGHGQRGSGSRQSPSYGRHGSGSGRSSSSGQHGSGLGESSGFGHHESSSGQSSSYSQHGSGSGHSSGYGQHGSRSGQSSRGERHGSSSRSSSRYGQHGSGSRQSSGHGRQGSGSGQSPSRGRHGSGLGHSSSHGQHGSGSGRSSSRGPYESRSGHSSVFGQHESGSGHSSAYSQHGSGSGHFCSQGQHGSTSGQSSTFDQEGSSTGQSSSHGQHGSGSSQSSSYGQQGSGSGQSPSRGRHGSGSGHSSSYGQHGSGSGWSSSSGRHGSGSGQSSGFGHHESSSWQSSGYTQHGSGSGHSSSYEQHGSRSGQSSRGEQHGSSSGSSSSYGQHGSGSRQSLGHGQHGSGSGQSPSPSRGRHGSGSGQSSSYGPYGSGSGWSSSRGPYESGSGHSSGLGHRESRSGQSSGYGQHGSSSGHSSTHGQHGSASGQSSSCGQHGASSGQSSSHGQHGSGSSQSSGYGRQGSGSGQSPGHGQRGSGSRQSPSYGRHGSGSGRSSSSGQHGPGLGESSGFGHHESSSGQSSSYSQHGSGSGHSSGYGQHGSRSGQSSRGERHGSSSGSSSRYGQHGSGSRQSSGHGRQGSGSGHSPSRGRHGSGSGHSSSHGQHGSGSGRSSSRGPYESRSGHSSVFGQHESGSGHSSAYSQHGSGSGHFCSQGQHGSTSGQSSTFDQEGSSTGQSSSHGQHGSGSSQSSSYGQQGSGSGQSPSRGRHGSGSGHSSSYGQHGSGSGWSSSSGRHGSGSGQSSGFGHHESSSWQSSGYTQHGSGSGHSSSYEQHGSRSGQSSRGERHGSSSGSSSSYGQHGSGSRQSLGHGQHGSGSGQSPSPSRGRHGSGSGQSSSYSPYGSGSGWSSSRGPYESGSGHSSGLGHRESRSGQSSGYGQHGSSSGHSSTHGQHGSTSGQSSSCGQHGASSGQSSSHGQHGSGSSQSSGYGRQGSGSGQSPGHGQRGSGSRQSPSYGRHGSGSGRSSSSGQHGSGLGESSGFGHHESSSGQSSSYSQHGSGSGHSSGYGQHGSRSGQSSRGERHGSSSGSSSHYGQHGSGSRQSSGHGRQGSGSGQSPSRGRHGSGLGHSSSHGQHGSGSGRSSSRGPYESRLGHSSVFGQHESGSGHSSAYSQHGSGSGHFCSQGQHGSTSGQSSTFDQEGSSTGQSSSYGHRGSGSSQSSGYGRHGAGSGQSLSHGRHGSGSGQSSSYGQHGSGSGQSSGYSQHGSGSGQDGYSYCKGGSNHDGGSSGSYFLSFPSSTSPYEYVQEQRCYFYQ

SEQ ID NO: 38973 - protein, 2035 aa, Homo sapiens
  Payload ID: 7801
  Gene Symbol: HCFC1
  Gene Name: host cell factor C1
  Uniprot ID: P51610
  ENSP ID: ENSP00000309555
MASAVSPANLPAVLLQPRWKRVVGWSGPVPRPRHGHRAVAIKELIVVFGGGNEGIVDELHVYNTATNQWFIPAVRGDIPPGCAAYGFVCDGTRLLVFGGMVEYGKYSNDLYELQASRWEWKRLKAKTPKNGPPPCPRLGHSFSLVGNKCYLFGGLANDSEDPKNNIPRYLNDLYILELRPGSGVVAWDIPITYGVLPPPRESHTAVVYTEKDNKKSKLVIYGGMSGCRLGDLWTLDIDTLTWNKPSLSGVAPLPRSLHSATTIGNKMYVFGGWVPLVMDDVKVATHEKEWKCTNTLACLNLDTMAWETILMDTLEDNIPRARAGHCAVAINTRLYIWSGRDGYRKAWNNQVCCKDLWYLETEKPPPPARVQLVRANTNSLEVSWGAVATADSYLLQLQKYDIPATAATATSPTPNPVPSVPANPPKSPAPAAAAPAVQPLTQVGITLLPQAAPAPPTTTTIQVLPTVPGSSISVPTAARTQGVPAVLKVTGPQATTGTPLVTMRPASQAGKAPVTVTSLPAGVRMVVPTQSAQGTVIGSSPQMSGMAALAAAAAATQKIPPSSAPTVLSVPAGTTIVKTMAVTPGTTTLPATVKVASSPVMVSNPATRMLKTAAAQVGTSVSSATNTSTRPIITVHKSGTVTVAQQAQVVTTVVGGVTKTITLVKSPISVPGGSALISNLGKVMSVVQTKPVQTSAVTGQASTGPVTQIIQTKGPLPAGTILKLVTSADGKPTTIITTTQASGAGTKPTILGISSVSPSTTKPGTTTIIKTIPMSAIITQAGATGVTSSPGIKSPITIITTKVMTSGTGAPAKIITAVPKIATGHGQQGVTQVVLKGAPGQPGTILRTVPMGGVRLVTPVTVSAVKPAVTTLVVKGTTGVTTLGTVTGTVSTSLAGAGGHSTSASLATPITTLGTIATLSSQVINPTAITVSAAQTTLTAAGGLTTPTITMQPVSQPTQVTLITAPSGVEAQPVHDLPVSILASPTTEQPTATVTIADSGQGDVQPGTVTLVCSNPPCETHETGTTNTATTTVVANLGGHPQPTQVQFVCDRQEAAASLVTSTVGQQNGSVVRVCSNPPCETHETGTTNTATTATSNMAGQHGCSNPPCETHETGTTNTATTAMSSVGANHQRDARRACAAGTPAVIRISVATGALEAAQGSKSQCQTRQTSATSTTMTVMATGAPCSAGPLLGPSMAREPGGRSPAFVQLAPLSSKVRLSSPSIKDLPAGRHSHAVSTAAMTRSSVGAGEPRMAPVCESLQGGSPSTTVTVTALEALLCPSATVTQVCSNPPCETHETGTTNTATTSNAGSAQRVCSNPPCETHETGTTHTATTATSNGGTGQPEGGQQPPAGRPCETHQTTSTGTTMSVSVGALLPDATSSHRTVESGLEVAAAPSVTPQAGTALLAPFPTQRVCSNPPCETHETGTTHTATTVTSNMSSNQDPPPAASDQGEVESTQGDSVNITSSSAITTTVSSTLTRAVTTVTQSTPVPGPSVPPPEELQVSPGPRQQLPPRQLLQSASTALMGESAEVLSASQTPELPAAVDLSSTGEPSSGQESAGSAVVATVVVQPPPPTQSEVDQLSLPQELMAEAQAGTTTLMVTGLTPEELAVTAAAEAAAQAAATEEAQALAIQAVLQAAQQAVMGTGEPMDTSEAAATVTQAELGHLSAEGQEGQATTIPIVLTQQELAALVQQQQLQEAQAQQQHHHLPTEALAPADSLNDPAIESNCLNELAGTVPSTVALLPSTATESLAPSNTFVAPQPVVVASPAKLQAAATLTEVANGIESLGVKPDLPPPPSKAPMKKENQWFDVGVIKGTNVMVTHYFLPPDDAVPSDDDLGTVPDYNQLKKQELQPGTAYKFRVAGINACGRGPFSEISAFKTCLPGFPGAPCAIKISKSPDGAHLTWEPPSVTSGKIIEYSVYLAIQSSQAGGELKSSTPAQLAFMRVYCGPSPSCLVQSSSLSNAHIDYTTKPAIIFRIAARNEKGYGPATQVRWLQETSKDSSGTKPANKRPMSSPEMKSAPKKSKADGQ

SEQ ID NO: 38974 - protein, 2080 aa, Homo sapiens
  Payload ID: 7801
  Gene Symbol: HCFC1
  Gene Name: host cell factor C1
  ENSP ID: ENSP00000359001
MASAVSPANLPAVLLQPRWKRVVGWSGPVPRPRHGHRAVAIKELIVVFGGGNEGIVDELHVYNTATNQWFIPAVRGDIPPGCAAYGFVCDGTRLLVFGGMVEYGKYSNDLYELQASRWEWKRLKAKTPKNGPPPCPRLGHSFSLVGNKCYLFGGLANDSEDPKNNIPRYLNDLYILELRPGSGVVAWDIPITYGVLPPPRESHTAVVYTEKDNKKSKLVIYGGMSGCRLGDLWTLDIDTLTWNKPSLSGVAPLPRSLHSATTIGNKMYVFGGWVPLVMDDVKVATHEKEWKCTNTLACLNLDTMAWETILMDTLEDNIPRARAGHCAVAINTRLYIWSGRDGYRKAWNNQVCCKDLWYLETEKPPPPARVQLVRANTNSLEVSWGAVATADSYLLQLQKYDIPATAATATSPTPNPVPSVPANPPKSPAPAAAAPAVQPLTQVGITLLPQAAPAPPTTTTIQVLPTVPGSSISVPTAARTQGVPAVLKVTGPQATTGTPLVTMRPASQAGKAPVTVTSLPAGVRMVVPTQSAQGTVIGSSPQMSGMAALAAAAAATQKIPPSSAPTVLSVPAGTTIVKTMAVTPGTTTLPATVKVASSPVMVSNPATRMLKTAAAQVGTSVSSATNTSTRPIITVHKSGTVTVAQQAQVVTTVVGGVTKTITLVKSPISVPGGSALISNLGKVMSVVQTKPVQTSAVTGQASTGPVTQIIQTKGPLPAGTILKLVTSADGKPTTIITTTQASGAGTKPTILGISSVSPSTTKPGTTTIIKTIPMSAIITQAGATGVTSSPGIKSPITIITTKVMTSGTGAPAKIITAVPKIATGHGQQGVTQVVLKGAPGQPGTILRTVPMGGVRLVTPVTVSAVKPAVTTLVVKGTTGVTTLGTVTGTVSTSLAGAGGHSTSASLATPITTLGTIATLSSQVINPTAITVSAAQTTLTAAGGLTTPTITMQPVSQPTQVTLITAPSGVEAQPVHDLPVSILASPTTEQPTATVTIADSGQGDVQPGTVTLVCSNPPCETHETGTTNTATTTVVANLGGHPQPTQVQFVCDRQEAAASLVTSTVGQQNGSVVRVCSNPPCETHETGTTNTATTATSNMAGQHGCSNPPCETHETGTTNTATTAMSSVGANHQRDARRACAAGTPAVIRISVATGALEAAQGSKSQCQTRQTSATSTTMTVMATGAPCSAGPLLGPSMAREPGGRSPAFVQLAPLSSKVRLSSPSIKDLPAGRHSHAVSTAAMTRSSVGAGEPRMAPVCESLQGGSPSTTVTVTALEALLCPSATVTQVCSNPPCETHETGTTNTATTSNAGSAQRVCSNPPCETHETGTTHTATTATSNGGTGQPEGGQQPPAGRPCETHQTTSTGTTMSVSVGALLPDATSSHRTVESGLEVAAAPSVTPQAGTALLAPFPTQRVCSNPPCETHETGTTHTATTVTSNMSSNQDPPPAASDQGEVESTQGDSVNITSSSAITTTVSSTLTRAVTTVTQSTPVPGPSVPKISSMTETAPRALTTEVPIPAKITVTIANTETSDMPFSAVDILQPPEELQVSPGPRQQLPPRQLLQSASTALMGESAEVLSASQTPELPAAVDLSSTGEPSSGQESAGSAVVATVVVQPPPPTQSEVDQLSLPQELMAEAQAGTTTLMVTGLTPEELAVTAAAEAAAQAAATEEAQALAIQAVLQAAQQAVMAGTGEPMDTSEAAATVTQAELGHLSAEGQEGQATTIPIVLTQQELAALVQQQQLQEAQAQQQHHHLPTEALAPADSLNDPAIESNCLNELAGTVPSTVALLPSTATESLAPSNTFVAPQPVVVASPAKLQAAATLTEVANGIESLGVKPDLPPPPSKAPMKKENQWFDVGVIKGTNVMVTHYFLPPDDAVPSDDDLGTVPDYNQLKKQELQPGTAYKFRVAGINACGRGPFSEISAFKTCLPGFPGAPCAIKISKSPDGAHLTWEPPSVTSGKIIEYSVYLAIQSSQAGGELKSSTPAQLAFMRVYCGPSPSCLVQSSSLSNAHIDYTTKPAIIFRIAARNEKGYGPATQVRWLQETSKDSSGTKPANKRPMSSPEMKSAPKKSKADGQ

SEQ ID NO: 38975 - protein, 611 aa, Homo sapiens
  Payload ID: 7801
  Gene Symbol: HCFC1
  Gene Name: host cell factor C1
  ENSP ID: ENSP00000399589
  MOD_RES (1)..(1): Any amino acid
XTGTTHTATTVTSNMSSNQDPPPAASDQGEVESTQGDSVNITSSSAITTTVSSTLTRAVTTVTQSTPVPGPSVPPPEELQVSPGPRQQLPPRQLLQSASTALMGESAEVLSASQTPELPAAVDLSSTGEPSSGQESAGSAVVATVVVQPPPPTQSEVDQLSLPQELMAEAQAGTTTLMVTGLTPEELAVTAAAEAAAQAAATEEAQALAIQAVLQAAQQAVMAGTGEPMDTSEAAATVTQAELGHLSAEGQEGQATTIPIVLTQQELAALVQQQQLQEAQAQQQHHHLPTEALAPADSLNDPAIESNCLNELAGTVPSTVALLPSTATESLAPSNTFVAPQPVVVASPAKLQAAATLTEVANGIESLGVKPDLPPPPSKAPMKKENQWFDVGVIKGTNVMVTHYFLPPDDAVPSDDDLGTVPDYNQLKKQELQPGTAYKFRVAGINACGRGPFSEISAFKTCLPGFPGAPCAIKISKSPDGAHLTWEPPSVTSGKIIEYSVYLAIQSSQAGGELKSSTPAQLAFMRVYCGPSPSCLVQSSSLSNAHIDYTTKPAIIFRIAARNEKGYGPATQVRWLQETSKDSSGTKPANKRPMSSPEMKSAPKKSKADGQ

SEQ ID NO: 38976 - protein, 138 aa, Homo sapiens
  Payload ID: 7802
  Gene Symbol: HCFC1R1
  Gene Name: host cell factor C1 regulator 1 (XPO1 dependent)
  Uniprot ID: Q9NWW0
  ENSP ID: ENSP00000248089
MILQQPLQRGPQGGAQRLPRAALGVTWGLDASSPLRGAVPMSTKRRLEEEQEPLRKQFLSEENMATHFSQLSLHNDHPYCSPPMTFSPALPPLRSPCSELLLWRYPGSLIPEALRLLRLGDTPSPPYPATPAGDIMEL

SEQ ID NO: 38977 - protein, 136 aa, Homo sapiens
  Payload ID: 7802
  Gene Symbol: HCFC1R1
  Gene Name: host cell factor C1 regulator 1 (XPO1 dependent)
  ENSP ID: ENSP00000346708
MILQQPLQRGPQGGAQRLPRAALGVTWGLDARLPPVSVSQPASLPSLPREPLRKQFLSEENMATHFSQLSLHNDHPYCSPPMTFSPALPPLRSPCSELLLWRYPGSLIPEALRLLRLGDTPSPPYPATPAGDIMEL

SEQ ID NO: 38978 - protein, 120 aa, Homo sapiens
  Payload ID: 7802
  Gene Symbol: HCFC1R1
  Gene Name: host cell factor C1 regulator 1 (XPO1 dependent)
  ENSP ID: ENSP00000458628
MILQQPLQRGPQGGAQRLPRAALGVTWGLDASSPLRGAVPMSTKRRLEEEQEPLRKQFLSEENMATHFSQLSLHNDHPYCSPPMTFSPALPPLRSPCSELLLWRYPGSLIPEALRLLRLG

SEQ ID NO: 38979 - protein, 98 aa, Homo sapiens
  Payload ID: 7802
  Gene Symbol: HCFC1R1
  Gene Name: host cell factor C1 regulator 1 (XPO1 dependent)
  ENSP ID: ENSP00000458971
MSTKRRLEEEQEPLRKQFLSEENMATHFSQLSLHNDHPYCSPPMTFSPALPPLRSPCSELLLWRYPGSLIPEALRLLRLGDTPSPPYPATPAGDIMEL

SEQ ID NO: 38980 - protein, 119 aa, Homo sapiens
  Payload ID: 7802
  Gene Symbol: HCFC1R1
  Gene Name: host cell factor C1 regulator 1 (XPO1 dependent)
  Uniprot ID: Q9NWW0
  ENSP ID: ENSP00000459178
MILQQPLQRGPQGGAQRLPRAALGVTWGLDAREPLRKQFLSEENMATHFSQLSLHNDHPYCSPPMTFSPALPPLRSPCSELLLWRYPGSLIPEALRLLRLGDTPSPPYPATPAGDIMEL

SEQ ID NO: 38981 - protein, 138 aa, Homo sapiens; identical to SEQ ID NO: 38976
  Payload ID: 7802
  Gene Symbol: HCFC1R1
  Gene Name: host cell factor C1 regulator 1 (XPO1 dependent)
  Uniprot ID: Q9NWW0
  ENSP ID: ENSP00000460639

SEQ ID NO: 38982 - protein, 792 aa, Homo sapiens
  Payload ID: 7803
  Gene Symbol: HCFC2
  Gene Name: host cell factor C2
  Uniprot ID: Q9Y5Z7
  ENSP ID: ENSP00000229330
MAAPSLLNWRRVSSFTGPVPRARHGHRAVAIRELMIIFGGGNEGIADELHVYNTATNQWFLPAVRGDIPPGCAAHGFVCDGTRILVFGGMVEYGRYSNELYELQASRWLWKKVKPHPPPSGLPPCPRLGHSFSLYGNKCYLFGGLANESEDSNNNVPRYLNDFYELELQHGSGVVGWSIPVTKGVVPSPRESHTAVIYCKKDSGSPKMYVFGGMCGARLDDLWQLDLETMSWSKPETKGTVPLPRSLHTASVIGNKMYIFGGWVPHKGENTETSPHDCEWRCTSSFSYLNLDTTEWTTLVSDSQEDKKNSRPRPRAGHCAVAIGTRLYFWSGRDGYKKALNSQVCCKDLWYLDTEKPPAPSQVQLIKATTNSFHVKWDEVSTVEGYLLQLSTDLPYQAASSDSSAAPNMQGVRMDPHRQGSNNIVPNSINDTINSTKTEQPATKETSMKNKPDFKALTDSNAILYPSLASNASNHNSHVVDMLRKNEGPHTSANVGVLSSCLDVRTVIPETSVSSTVSSTQTMVTQQTIKTESSSTNGAVVKDETSLTTFSTKSEVDETYALPATKISRVETHATATPFSKETPSNPVATVKAGERQWCDVGIFKNNTALVSQFYLLPKGKQSISKVGNADVPDYSLLKKQDLVPGTGYRFRVAAINGCGIGPFSKISEFKTCIPGFPGAPSAVRISKNVEGIHLSWEPPTSPSGNILEYSAYLAIRTAQIQDNPSQLVFMRIYCGLKTSCIVTAGQLANAHIDYTSRPAIVFRISAKNEKGYGPATQVRWLQGNNKKAPLN

SEQ ID NO: 38983 - protein, 412 aa, Homo sapiens
  Payload ID: 7803
  Gene Symbol: HCFC2
  Gene Name: host cell factor C2
  Uniprot ID: Q9Y5Z7
  ENSP ID: ENSP00000442942
MAAPSLLNWRRVSSFTGPVPRARHGHRAVAIRELMIIFGGGNEGIADELHVYNTATNQWFLPAVRGDIPPGCAAHGFVCDGTRILVFGGMVEYGRYSNELYELQASRWLWKKVKPHPPPSGLPPCPRLGHSFSLYGNKCYLFGGLANESEDSNNNVPRYLNDFYELELQHGSGVVGWSIPVTKGVVPSPRESHTAVIYCKKDSGSPKMYVFGGMCGARLDDLWQLDLETMSWSKPETKGTVPLPRSLHTASVIGNKMYIFGGWVPHKGENTETSPHDCEWRCTSSFSYLNLDTTEWTTLVSDSQEDKKNSRPRPRAGHCAVAIGTRLYFWSGRDGYKKALNSQVCCKDLWYLDTEKPPAPSQVQLIKATTNSFHVKWDEVSTVEGYLLQLSTDLPYQAASSDSSAAPNMQDQ

SEQ ID NO: 38984 - protein, 78 aa, Homo sapiens
  Payload ID: 7803
  Gene Symbol: HCFC2
  Gene Name: host cell factor C2
  ENSP ID: ENSP00000447952
MVEYGRYSNELYELQASRWLWKKVKPHPPPSGLPPCPRLGHSFSLYGNKCYLFGGLANESEDSNNNVPRYLNDFYELE

SEQ ID NO: 38985 - protein, 112 aa, Homo sapiens
  Payload ID: 7804
  Gene Symbol:
  Gene Name: HOXA10-HOXA9
  ENSP ID: ENSP00000421799
MCQVDREKQPSEGAFSENNAENESGGDKPPIDPNNPAANWLHARSTRKKRCPYTKHQTLELEKEFLFNMYLTRDRRYEVARLLNLTERQVKIWFQNRRMKMKKINKDRAKDE

SEQ ID NO: 38986 - protein, 273 aa, Homo sapiens
  Payload ID: 7805
  Gene Symbol: HRASLS
  Gene Name: HRAS-like suppressor
  ENSP ID: ENSP00000264735
MVRASCRLGSARTPSPARRPPGVRASQSRGGAAGTVSAWRRWCWRWPWRTAPSDGWRLPPGCLPGTDGVVPRPPAARSAAARPRETPGHTQLPPGARRRPRLESEMAFNDCFSLNYPGNPCPGDLIEVFRPGYQHWALYLGDGYVINIAPVDGIPASFTSAKSVFSSKALVKMQLLKDVVGNDTYRINNKYDETYPPLPVEEIIKRSEFVIGQEVAYNLLVNNCEHFVTLLRYGEGVSEQANRAISTVEFVTAAVGVFSFLGLFPKGQRAKYY

SEQ ID NO: 38987 - protein, 111 aa, Homo sapiens
  Payload ID: 7805
  Gene Symbol: HRASLS
  Gene Name: HRAS-like suppressor
  ENSP ID: ENSP00000414431
SVFSSKALVKMQLLKDVVGNDTYRINNKYDETYPPLPVEEIIKRSEFVIGQEVAYNLLVNNCEHFVTLLRYGEGVSEQANRAISTVEFVTAAVGVFSFLGLFPKGQRAKYY

SEQ ID NO: 38988 - protein, 162 aa, Homo sapiens
  Payload ID: 7806
  Gene Symbol: HRASLS2
  Gene Name: HRAS-like suppressor 2
  Uniprot ID: Q9NWW9
  ENSP ID: ENSP00000255695
MALARPRPRLGDLIEISRFGYAHWAIYVGDGYVVHLAPASEIAGAGAASVLSALTNKAIVKKELLSVVAGGDNYRVNNKHDDRYTPLPSNKIVKRAEELVGQELPYSLTSDNCEHFVNHLRYGVSRSDQVTGAVTTVGVAAGLLAAASLVGILLARSKRERQ

SEQ ID NO: 38989 - protein, 279 aa, Homo sapiens
  Payload ID: 7807
  Gene Symbol: HRASLS5
  Gene Name: HRAS-like suppressor family, member 5
  Uniprot ID: Q96KN8
  ENSP ID: ENSP00000301790
MGLSPGAEGEYALRLPRIPPPLPKPASRTASTGPKDQPPALRRSAVPHSGLNSISPLELEESVGFAALVQLPAKQPPPGTLEQGRSIQQGEKAVVSLETTPSQKADWSSIPKPENEGKLIKQAAEGKPRPRPGDLIEIFRIGYEHWAIYVEDDCVVHLAPPSEEFEVGSITSIFSNRAVVKYSRLEDVLHGCSWKVNNKLDGTYLPLPVDKIIQRTKKMVNKIVQYSLIEGNCEHFVNGLRYGVPRSQQVEHALMEGAKAAGAVISAVVDSIKPKPITA

SEQ ID NO: 38990 - protein, 37 aa, Homo sapiens
  Payload ID: 7807
  Gene Symbol: HRASLS5
  Gene Name: HRAS-like suppressor family, member 5
  ENSP ID: ENSP00000378113
KPASRTASTGPKDQPPALRRSAVPHSGKTKTQTWRPD

SEQ ID NO: 38991 - protein, 253 aa, Homo sapiens
  Payload ID: 7807
  Gene Symbol: HRASLS5
  Gene Name: HRAS-like suppressor family, member 5
  Uniprot ID: Q96KN8
  ENSP ID: ENSP00000443873
MGLSPGAEGEYALRLPRIPPPLPKPASRTASTGPKDQPPALRRSAVPHSGLNSISPLELEESVGFAALVQLPAKQPPPGTLEQGRSIQQGEKAVVSLETTPSQKADWSSIPKPENEGKLIKQAAEGKPRPRPGDLIEIFRIGYEHWAIYVEDDCVVHLAPPSEEFEVGSITSIFSNRAVVKYSRLEDVLHGCSWKVNNKLDGTYLPLPVDKIIQRTKKMVNKIVQYSLIEGNCRARPDGRSEGCWSSYFSCSG

SEQ ID NO: 38992 - protein, 49 aa, Homo sapiens
  Payload ID: 7807
  Gene Symbol: HRASLS5
  Gene Name: HRAS-like suppressor family, member 5
  ENSP ID: ENSP00000444776
  MOD_RES (1)..(1): Any amino acid
XGPKDQPPALRRSAVPHSEESVGFAALVQLPAKQPPPGTLEQGRSIQQG

SEQ ID NO: 38993 - protein, 269 aa, Homo sapiens
  Payload ID: 7807
  Gene Symbol: HRASLS5
  Gene Name: HRAS-like suppressor family, member 5
  Uniprot ID: Q96KN8
  ENSP ID: ENSP00000444809
MGLSPGAEGEYALRLPRIPPPLPKPASRTASTGPKDQPPALRRSAVPHSEESVGFAALVQLPAKQPPPGTLEQGRSIQQGEKAVVSLETTPSQKADWSSIPKPENEGKLIKQAAEGKPRPRPGDLIEIFRIGYEHWAIYVEDDCVVHLAPPSEEFEVGSITSIFSNRAVVKYSRLEDVLHGCSWKVNNKLDGTYLPLPVDKIIQRTKKMVNKIVQYSLIEGNCEHFVNGLRYGVPRSQQVEHALMEGAKAAGAVISAVVDSIKPKPITA

SEQ ID NO: 38994 - protein, 19 aa, Homo sapiens
  Payload ID: 7807
  Gene Symbol: HRASLS5
  Gene Name: HRAS-like suppressor family, member 5
  ENSP ID: ENSP00000446016
MVNKIVQYSLIEGNCEHFV

SEQ ID NO: 38995 - protein, 235 aa, Homo sapiens
  Payload ID: 7808
  Gene Symbol: HSCB
  Gene Name: HscB mitochondrial iron-sulfur cluster co-chaperone
  Uniprot ID: Q8IWL3
  ENSP ID: ENSP00000216027
MWRGRAGALLRVWGFWPTGVPRRRPLSCDAASQAGSNYPRCWNCGGPWGPGREDRFFCPQCRALQAPDPTRDYFSLMDCNRSFRVDTAKLQHRYQQLQRLVHPDFFSQRSQTEKDFSEKHSTLVNDAYKTLLAPLSRGLYLLKLHGIEIPERTDYEMDRQFLIEIMEINEKLAEAESEAAMKEIESIVKAKQKEFTDNVSSAFEQDDFEEAKEILTKMRYFSNIEEKIKLKKIPL

SEQ ID NO: 38996 - protein, 143 aa, Homo sapiens
  Payload ID: 7808
  Gene Symbol: HSCB
  Gene Name: HscB mitochondrial iron-sulfur cluster co-chaperone
  ENSP ID: ENSP00000381914
MWRGRAGALLRVWGFWPTGVPRRRPLSCDAASQAGSNYPRCWNCGGPWGPGREDRFFCPQCRALQAPDPTRDYFSLMDCNRSFRVDTAKLQHRYQQLQRLVHPDFFSQRSQTEKDFSEKHSTLVNDAYKTLLAPLSRGLYLVS

SEQ ID NO: 38997 - protein, 105 aa, Homo sapiens
  Payload ID: 7808
  Gene Symbol: HSCB
  Gene Name: HscB mitochondrial iron-sulfur cluster co-chaperone
  ENSP ID: ENSP00000406284
MWRGRAGALLRVWGFWPTGVPRRRPLSCDAASQAGSNYPRCWNCGGPWGPGREDRFFCPQCRALQAPDPTRDYFSLMDCNRSFRVDTAKLQHRLKRTSQRSIRPW

SEQ ID NO: 38998 - protein, 143 aa, Homo sapiens; identical to SEQ ID NO: 38996
  Payload ID: 7808
  Gene Symbol: HSCB
  Gene Name: HscB mitochondrial iron-sulfur cluster co-chaperone
  ENSP ID: ENSP00000416679

SEQ ID NO: 38999 - protein, 359 aa, Homo sapiens
  Payload ID: 7809
  Gene Symbol: HSPBP1
  Gene Name: HSPA (heat shock 70kDa) binding protein, cytoplasmic cochaperone 1
  Uniprot ID: Q9NZL4
  ENSP ID: ENSP00000255631
MSDEGSRGSRLPLALPPASQGCSSGGGGGGSSAGGSGNSRPPRNLQGLLQMAITAGSEEPDPPPEPMSEERRQWLQEAMSAAFRGQREEVEQMKSCLRVLSQPMPPTAGEAEQAADQQEREGALELLADLCENMDNAADFCQLSGMHLLVGRYLEAGAAGLRWRAAQLIGTCSQNVAAIQEQVLGLGALRKLLRLLDRDACDTVRVKALFAISCLVREQEAGLLQFLRLDGFSVLMRAMQQQVQKLKVKSAFLLQNLLVGHPEHKGTLCSMGMVQQLVALVRTEHSPFHEHVLGALCSLVTDFPQGVRECREPELGLEELLRHRCQLLQQHEEYQEELEFCEKLLQTCFSSPADDSMDR

SEQ ID NO: 39000 - protein, 359 aa, Homo sapiens; identical to SEQ ID NO: 38999
  Payload ID: 7809
  Gene Symbol: HSPBP1
  Gene Name: HSPA (heat shock 70kDa) binding protein, cytoplasmic cochaperone 1
  Uniprot ID: Q9NZL4
  ENSP ID: ENSP00000398244

SEQ ID NO: 39001 - protein, 137 aa, Homo sapiens
  Payload ID: 7809
  Gene Symbol: HSPBP1
  Gene Name: HSPA (heat shock 70kDa) binding protein, cytoplasmic cochaperone 1
  ENSP ID: ENSP00000465690
MSDEGSRGSRLPLALPPASQGCSSGGGGGGSSAGGSGNSRPPRNLQGLLQMAITAGSEEPDPPPEPMSEERRQWLQEAMSAAFRGQREEVEQMKSCLRVLSQPMPPTAGEAEQAADQQEREGALELLADLCENMDNA

SEQ ID NO: 39002 - protein, 214 aa, Homo sapiens
  Payload ID: 7809
  Gene Symbol: HSPBP1
  Gene Name: HSPA (heat shock 70kDa) binding protein, cytoplasmic cochaperone 1
  ENSP ID: ENSP00000465876
MSDEGSRGSRLPLALPPASQGCSSGGGGGGSSAGGSGNSRPPRNLQGLLQMAITAGSEEPDPPPEPMSEERRQWLQEAMSAAFRGQREEVEQMKSCLRVLSQPMPPTAGEAEQAADQQEREGALELLADLCENMDNAADFCQLSGMHLLVGRYLEAGAAGLRWRAAQLIGTCSQNVAAIQEQVLGLGALRKLLRLLDRDACDTVRVKALFAISC

SEQ ID NO: 39003 - protein, 190 aa, Homo sapiens
  Payload ID: 7809
  Gene Symbol: HSPBP1
  Gene Name: HSPA (heat shock 70kDa) binding protein, cytoplasmic cochaperone 1
  ENSP ID: ENSP00000466569
MSDEGSRGSRLPLALPPASQGCSSGGGGGGSSAGGSGNSRPPRNLQGLLQMAITAGSEEPDPPPEPMSEEMKSCLRVLSQPMPPTAGEAEQAADQQEREGALELLADLCENMDNAADFCQLSGMHLLVGRYLEAGAAGLRWRAAQLIGTCSQNVAAIQEQVLGLGALCCSSMRSTRRSWSSVKSCYRPVS

SEQ ID NO: 39004 - protein, 97 aa, Homo sapiens
  Payload ID: 7809
  Gene Symbol: HSPBP1
  Gene Name: HSPA (heat shock 70kDa) binding protein, cytoplasmic cochaperone 1
  ENSP ID: ENSP00000466749
MDNAADFCQLSGMHLLVGRYLEAGAAGLRWRAAQLIGTCSQNVAAIQEQVLGLGALRKLLRLLDRDACDTVRVKALFAISCLVREQEAGLLQFLRLD

SEQ ID NO: 39005 - protein, 359 aa, Homo sapiens; identical to SEQ ID NO: 38999
  Payload ID: 7809
  Gene Symbol: HSPBP1
  Gene Name: HSPA (heat shock 70kDa) binding protein, cytoplasmic cochaperone 1
  Uniprot ID: Q9NZL4
  ENSP ID: ENSP00000467574

SEQ ID NO: 39006 - protein, 31 aa, Homo sapiens
  Payload ID: 7809
  Gene Symbol: HSPBP1
  Gene Name: HSPA (heat shock 70kDa) binding protein, cytoplasmic cochaperone 1
  ENSP ID: ENSP00000467926
MSDEGSRGSRLPLALPPASQGCSSGGGGGGS

SEQ ID NO: 39007 - protein, 136 aa, Homo sapiens
  Payload ID: 7809
  Gene Symbol: HSPBP1
  Gene Name: HSPA (heat shock 70kDa) binding protein, cytoplasmic cochaperone 1
  ENSP ID: ENSP00000468403
MSDEGSRGSRLPLALPPASQGCSSGGGGGGSSAGGSGNSRPPRNLQGLLQMAITAGSEEPDPPPEPMSEERRQWLQEAMSAAFRGQREEVEQMKSCLRVLSQPMPPTAGEAEQAADQQEREGALELLADLCENMDN

SEQ ID NO: 39008 - protein, 488 aa, Homo sapiens
  Payload ID: 7810
  Gene Symbol: HSPBAP1
  Gene Name: HSPB (heat shock 27kDa) associated protein 1
  Uniprot ID: Q96EW2
  ENSP ID: ENSP00000302562
MAAGSEATTPVIVAAGAGGEEGEHVKPFKPEKAKEIIMSLQQPAIFCNMVFDWPARHWNAKYLSQVLHGKQIRFRMGMKSMSTVPQFETTCNYVEATLEEFLTWNCDQSSISGPFRDYDHSKFWAYADYKYFVSLFEDKTDLFQDVKWSDFGFPGRNGQESTLWIGSLGAHTPCHLDSYGCNLVFQVQGRKRWHLFPPEDTPFLYPTRIPYEESSVFSKINVVNPDLKRFPQFRKAQRHAVTLSPGQVLFVPRHWWHYVESIDPVTVSINSWIELEEDHLARVEEAITRMLVCALKTAENPQNTRAWLNPTEVEETSHAVNCCYLNAAVSAFFDRCRTSEVVEIQALRTDGEHMKKEELNVCNHMEVGQTGSQNLTTGTDKPEAASPFGPDLVPVAQRSEEPPSERGGIFGSDGKDFVDKDGEHFGKLHCAKRQQIMSNSENAIEEQIASNTTTTPQTFISTDDLLDCLVNPQVTRIVAQLLIQGRSL

SEQ ID NO: 39009 - protein, 52 aa, Homo sapiens
  Payload ID: 7811
  Gene Symbol: HSPB2-C11orf52
  Gene Name: HSPB2-C11orf52 readthrough (NMD candidate)
  ENSP ID: ENSP00000455839
MSGRSVPHAHPATAEYEFANPSRLGEQRFGEGFFLLKLEAQVHGFIKRRFKS

SEQ ID NO: 39010 - protein, 182 aa, Homo sapiens; identical to SEQ ID NO: 37307
  Payload ID: 7811
  Gene Symbol: HSPB2-C11orf52
  Gene Name: HSPB2-C11orf52 readthrough (NMD candidate)
  ENSP ID: ENSP00000457706

SEQ ID NO: 39011 - protein, 261 aa, Homo sapiens
  Payload ID: 7812
  Gene Symbol: HSPE1-MOB4
  Gene Name: HSPE1-MOB4 readthrough
  ENSP ID: ENSP00000474534
MAGQAFRKFLPLFDRVLVERSAAETVTKGGIMLPEKSQGKVLQATVVAVGSGSKGKDFYNWPDESFDEMDSTLAVQQYIQQNIRADCSNIDKILEPPEGQDEGVWKYEHLRQFCLELNGLAVKLQSECHPDTCTQMTATEQWIFLCAAHKTPKECPAIDYTRHTLDGAACLLNSNKYFPSRVSIKESSVAKLGSVCRRIYRIFSHAYFHHRQIFDEYENETFLCHRFTKFVMKYNLMSKDNLIVPILEEEVQNSVSGESEA

SEQ ID NO: 39012 - protein, 480 aa, Homo sapiens
  Payload ID: 7813
  Gene Symbol: HTRA1
  Gene Name: HtrA serine peptidase 1
  Uniprot ID: Q92743
  ENSP ID: ENSP00000357980
MQIPRAALLPLLLLLLAAPASAQLSRAGRSAPLAAGCPDRCEPARCPPQPEHCEGGRARDACGCCEVCGAPEGAACGLQEGPCGEGLQCVVPFGVPASATVRRRAQAGLCVCASSEPVCGSDANTYANLCQLRAASRRSERLHRPPVIVLQRGACGQGQEDPNSLRHKYNFIADVVEKIAPAVVHIELFRKLPFSKREVPVASGSGFIVSEDGLIVTNAHVVTNKHRVKVELKNGATYEAKIKDVDEKADIALIKIDHQGKLPVLLLGRSSELRPGEFVVAIGSPFSLQNTVTTGIVSTTQRGGKELGLRNSDMDYIQTDAIINYGNSGGPLVNLDGEVIGINTLKVTAGISFAIPSDKIKKFLTESHDRQAKGKAITKKKYIGIRMMSLTSSKAKELKDRHRDFPDVISGAYIIEVIPDTPAEAGGLKENDVIISINGQSVVSANDVSDVIKRESTLNMVVRRGNEDIMITVIPEEIDP

SEQ ID NO: 39013 - protein, 221 aa, Homo sapiens
  Payload ID: 7813
  Gene Symbol: HTRA1
  Gene Name: HtrA serine peptidase 1
  ENSP ID: ENSP00000412676
GKLPVLLLGRSSELRPGEFVVAIGSPFSLQNTVTTGIVSTTQRGGKELGLRNSDMDYIQTDAIINYGNSGGPLVNLDGEVIGINTLKVTAGISFAIPSDKIKKFLTESHDRQAKGKAITKKKYIGIRMMSLTSSKAKELKDRHRDFPDVISGAYIIEVIPDTPAEAGGLKENDVIISINGQSVVSANDVSDVIKRESTLNMVVRRGNEDIMITVIPEEIDP

SEQ ID NO: 39014 - protein, 458 aa, Homo sapiens
  Payload ID: 7814
  Gene Symbol: HTRA2
  Gene Name: HtrA serine peptidase 2
  Uniprot ID: O43464
  ENSP ID: ENSP00000258080
MAAPRAGRGAGWSLRAWRALGGIRWGRRPRLTPDLRALLTSGTSDPRARVTYGTPSLWARLSVGVTEPRACLTSGTPGPRAQLTAVTPDTRTREASENSGTRSRAWLAVALGAGGAVLLLLWGGGRGPPAVLAAVPSPPPASPRSQYNFIADVVEKTAPAVVYIEILDRHPFLGREVPISNGSGFVVAADGLIVTNAHVVADRRRVRVRLLSGDTYEAVVTAVDPVADIATLRIQTKEPLPTLPLGRSADVRQGEFVVAMGSPFALQNTITSGIVSSAQRPARDLGLPQTNVEYIQTDAAIDFGNSGGPLVNLDGEVIGVNTMKVTAGISFAIPSDRLREFLHRGEKKNSSSGISGSQRRYIGVMMLTLSPSILAELQLREPSFPDVQHGVLIHKVILGSPAHRAGLRPGDVILAIGEQMVQNAEDVYEAVRTQSQLAVQIRRGRETLTLYVTPEVTE

SEQ ID NO: 39015 - protein, 361 aa, Homo sapiens
  Payload ID: 7814
  Gene Symbol: HTRA2
  Gene Name: HtrA serine peptidase 2
  Uniprot ID: O43464
  ENSP ID: ENSP00000312893
MAAPRAGRGAGWSLRAWRALGGIRWGRRPRLTPDLRALLTSGTSDPRARVTYGTPSLWARLSVGVTEPRACLTSGTPGPRAQLTAVTPDTRTREASENSGTRSRAWLAVALGAGGAVLLLLWGGGRGPPAVLAAVPSPPPASPRSQYNFIADVVEKTAPAVVYIEILDRHPFLGREVPISNGSGFVVAADGLIVTNAHVVADRRRVRVRLLSGDTYEAVVTAVDPVADIATLRIQTKFGNSGGPLVNLDGEVIGVNTMKVTAGISFAIPSDRLREFLHRGEKKNSSSGISGSQRRYIGVMMLTLSPRAGLRPGDVILAIGEQMVQNAEDVYEAVRTQSQLAVQIRRGRETLTLYVTPEVTE

SEQ ID NO: 39016 - protein, 423 aa, Homo sapiens
  Payload ID: 7814
  Gene Symbol: HTRA2
  Gene Name: HtrA serine peptidase 2
  ENSP ID: ENSP00000399166
LRAWRALGGIRWGRRPRLTPDLRALLTSGTSDPRARVTYGTPSLWARLSVGVTEPRACLTSGTPGPRAQLTAVTPDTRTREASENSGTRSRAWLAVALGAGGAVLLLLWGGGRGPPAVLAAVPSPPPASPRSQYNFIADVVEKTAPAVVYIEILDRHPFLGREVPISNGSGFVVAADGLIVTNAHVVADRRRVRVRLLSGDTYEAVVTAVDPVADIATLRIQTKEPLPTLPLGRSADVRQGEFVVAMGSPFALQNTITSGIVSSAQRPARDLGLPQTNVEYIQTDAAIDFGNSGGPLVNLARELGAVSLQDGEVIGVNTMKVTAGISFAIPSDRLREFLHRGEKKNSSSGISGSQRRYIGVMMLTLSPRAGLRPGDVILAIGEQMVQNAEDVYEAVRTQSQLAVQIRRGRETLTLYVTPEVTE

SEQ ID NO: 39017 - protein, 453 aa, Homo sapiens
  Payload ID: 7815
  Gene Symbol: HTRA3
  Gene Name: HtrA serine peptidase 3
  Uniprot ID: P83110
  ENSP ID: ENSP00000303766
MQARALLLAALAALALAREPPAAPCPARCDVSRCPSPRCPGGYVPDLCNCCLVCAASEGEPCGGPLDSPCGESLECVRGLCRCRWSHAVCGTDGHTYANVCALQAASRRALQLSGTPVRQLQKGACPLGLHQLSSPRYKFNFIADVVEKIAPAVVHIELFLRHPLFGRNVPLSSGSGFIMSEAGLIITNAHVVSSNSAAPGRQQLKVQLQNGDSYEATIKDIDKKSDIATIKIHPKKKLPVLLLGHSADLRPGEFVVAIGSPFALQNTVTTGIVSTAQREGRELGLRDSDMDYIQTDAIINYGNSGGPLVNLDGEVIGINTLKVTAGISFAIPSDRITRFLTEFQDKQIKDWKKRFIGIRMRTITPSLVDELKASNPDFPEVSSGIYVQEVAPNSPSQRGGIQDGDIIVKVNGRPLVDSSELQEAVLTESPLLLEVRRGNDDLLFSIAPEVVM

SEQ ID NO: 39018 - protein, 357 aa, Homo sapiens
  Payload ID: 7815
  Gene Symbol: HTRA3
  Gene Name: HtrA serine peptidase 3
  Uniprot ID: P83110
  ENSP ID: ENSP00000371952
MQARALLLAALAALALAREPPAAPCPARCDVSRCPSPRCPGGYVPDLCNCCLVCAASEGEPCGGPLDSPCGESLECVRGLCRCRWSHAVCGTDGHTYANVCALQAASRRALQLSGTPVRQLQKGACPLGLHQLSSPRYKFNFIADVVEKIAPAVVHIELFLRHPLFGRNVPLSSGSGFIMSEAGLIITNAHVVSSNSAAPGRQQLKVQLQNGDSYEATIKDIDKKSDIATIKIHPKKKLPVLLLGHSADLRPGEFVVAIGSPFALQNTVTTGIVSTAQREGRELGLRDSDMDYIQTDAIINYGNSGGPLVNLDGEVIGINTLKVTAGISFAIPSDRITRFLTEFQDKQIKAPSLAVH

SEQ ID NO: 39019 - protein, 476 aa, Homo sapiens
  Payload ID: 7816
  Gene Symbol: HTRA4
  Gene Name: HtrA serine peptidase 4
  Uniprot ID: P83105
  ENSP ID: ENSP00000305919
MIRPQLRTAGLGRCLLPGLLLLLVPVLWAGAEKLHTQPSCPAVCQPTRCPALPTCALGTTPVFDLCRCCRVCPAAEREVCGGAQGQPCAPGLQCLQPLRPGFPSTCGCPTLGGAVCGSDRRTYPSMCALRAENRAARRLGKVPAVPVQWGNCGDTGTRSAGPLRRNYNFIAAVVEKVAPSVVHVQLWGRLLHGSRLVPVYSGSGFIVSEDGLIITNAHVVRNQQWIEVVLQNGARYEAVVKDIDLKLDLAVIKIESNAELPVLMLGRSSDLRAGEFVVALGSPFSLQNTATAGIVSTKQRGGKELGMKDSDMDYVQIDATINYGNSGGPLVNLDGDVIGVNSLRVTDGISFAIPSDRVRQFLAEYHEHQMKGKAFSNKKYLGLQMLSLTVPLSEELKMHYPDFPDVSSGVYVCKVVEGTAAQSSGLRDHDVIVNINGKPITTTTDVVKALDSDSLSMAVLRGKDNLLLTVIPETIN

SEQ ID NO: 39020 - protein, 2718 aa, Homo sapiens
  Payload ID: 7817
  Gene Symbol: HIVEP1
  Gene Name: human immunodeficiency virus type I enhancer binding protein 1
  Uniprot ID: P15822
  ENSP ID: ENSP00000368698
MPRTKQIHPRNLRDKIEEAQKELNGAEVSKKEILQAGVKGTSESLKGVKRKKIVAENHLKKIPKSPLRNPLQAKHKQNTEESSFAVLHSASESHKKQNYIPVKNGKQFTKQNGETPGIIAEASKSEESVSPKKPLFLQQPSELRRWRSEGADPAKFSDLDEQCDSSSLSSKTRTDNSECISSHCGTTSPSYTNTAFDVLLKAMEPELSTLSQKGSPCAIKTEKLRPNKTARSPPKLKNSSMDAPNQTSQELVAESQSSCTSYTVHMSAAQKNEQGAMQSASHLYHQHEHFVPKSNQHNQQLPGCSGFTGSLTNLQNQENAKLEQVYNIAVTSSVGLTSPSSRSQVTPQNQQMDSASPLSISPANSTQSPPMPIYNSTHVASVVNQSVEQMCNLLLKDQKPKKQGKYICEYCNRACAKPSVLLKHIRSHTGERPYPCVTCGFSFKTKSNLYKHKKSHAHTIKLGLVLQPDAGGLFLSHESPKALSIHSDVEDSGESEEEGATDERQHDLGAMELQPVHIIKRMSNAETLLKSSFTPSSPENVIGDFLLQDRSAESQAVTELPKVVVHHVTVSPLRTDSPKAMDPKPELSSAQKQKDLQVTNVQPLSANMSQGGVSRLETNENSHQKGDMNPLEGKQDSHVGTVHAQLQRQQATDYSQEQQGKLLSPRSLGSTDSGYFSRSESADQTVSPPTPFARRLPSTEQDSGRSNGPSAALVTTSTPSALPTGEKALLLPGQMRPPLATKTLEERISKLISDNEALVDDKQLDSVKPRRTSLSRRGSIDSPKSYIFKDSFQFDLKPVGRRTSSSSDIPKSPFTPTEKSKQVFLLSVPSLDCLPITRSNSMPTTGYSAVPANIIPPPHPLRGSQSFDDKIGAFYDDVFVSGPNAPVPQSGHPRTLVRQAAIEDSSANESHVLGTGQSLDESHQGCHAAGEAMSVRSKALAQGPHIEKKKSHQGRGTMFECETCRNRYRKLENFENHKKFYCSELHGPKTKVAMREPEHSPVPGGLQPQILHYRVAGSSGIWEQTPQIRKRRKMKSVGDDEELQQNESGTSPKSSEGLQFQNALGCNPSLPKHNVTIRSDQQHKNIQLQNSHIHLVARGPEQTMDPKLSTIMEQQISSAAQDKIELQRHGTGISVIQHTNSLSRPNSFDKPEPFERASPVSFQELNRTGKSGSLKVIGISQEESHPSRDGSHPHQLALSDALRGELQESSRKSPSERHVLGQPSRLVRQHNIQVPEILVTEEPDRDLEAQCHDQEKSEKFSWPQRSETLSKLPTEKLPPKKKRLRLAEIEHSSTESSFDSTLSRSLSRESSLSHTSSFSASLDIEDVSKTEASPKIDFLNKAEFLMIPAGLNTLNVPGCHREMRRTASEQINCTQTSMEVSDLRSKSFDCGSITPPQTTPLTELQPPSSPSRVGVTGHVPLLERRRGPLVRQISLNIAPDSHLSPVHPTSFQNTALPSVNAVPYQGPQLTSTSLAEFSANTLHSQTQVKDLQAETSNSSSTNVFPVQQLCDINLLNQIHAPPSHQSTQLSLQVSTQGSKPDKNSVLSGSSKSEDCFAPKYQLHCQVFTSGPSCSSNPVHSLPNQVISDPVGTDHCVTSATLPTKLIDSMSNSHPLLPPELRPLGSQVQKVPSSFMLPIRLQSSVPAYCFATLTSLPQILVTQDLPNQPICQTNHSVVPISEEQNSVPTLQKGHQNALPNPEKEFLCENVFSEMSQNSSLSESLPITQKISVGRLSPQQESSASSKRMLSPANSLDIAMEKHQKRAKDENGAVCATDVRPLEALSSRVNEASKQKKPILVRQVCTTEPLDGVMLEKDVFSQPEISNEAVNLTNVLPADNSSTGCSKFVVIEPISELQEFENIKSSTSLTLTVRSSPAPSENTHISPLKCTDNNQERKSPGVKNQGDKVNIQEQSQQPVTSLSLFNIKDTQQLAFPSLKTTTNFTWCYLLRQKSLHLPQKDQKTSAYTDWTVSASNPNPLGLPTKVALALLNSKQNTGKSLYCQAITTHSKSDLLVYSSKWKSSLSKRALGNQKSTVVEFSNKDASEINSEQDKENSLIKSEPRRIKIFDGGYKSNEEYVYVRGRGRGKYICEECGIRCKKPSMLKKHIRTHTDVRPYHCTYCNFSFKTKGNLTKHMKSKAHSKKCVDLGVSVGLIDEQDTEESDEKQRFSYERSGYDLEESDGPDEDDNENEDDDEDSQAESVLSATPSVTASPQHLPSRSSLQDPVSTDEDVRITDCFSGVHTDPMDVLPRALLTRMTVLSTAQSDYNRKTLSPGKARQRAARDENDTIPSVDTSRSPCHQMSVDYPESEEILRSSMAGKAVAITQSPSSVRLPPAAAEHSPQTAAGMPSVASPHPDPQEQKQQITLQPTPGLPSPHTHLFSHLPLHSQQQSRTPYNMVPVGGIHVVPAGLTYSTFVPLQAGPVQLTIPAVSVVHRTLGTHRNTVTEVSGTTNPAGVAELSSVVPCIPIGQIRVPGLQNLSTPGLQSLPSLSMETVNIVGLANTNMAPQVHPPGLALNAVGLQVLTANPSSQSSPAPQAHIPGLQILNIALPTLIPSVSQVAVDAQGAPEMPASQSKACETQPKQTSVASANQVSRTESPQGLPTVQRENAKKVLNPPAPAGDHARLDGLSKMDTEKAASANHVKPKPELTSIQGQPASTSQPLLKAHSEVFTKPSGQQTLSPDRQVPRPTALPRRQPTVHFSDVSSDDDEDRLVIAT

SEQ ID NO: 39021 - protein, 43 aa, Homo sapiens
  Payload ID: 7817
  Gene Symbol: HIVEP1
  Gene Name: human immunodeficiency virus type I enhancer binding protein 1
  ENSP ID: ENSP00000382395
  MOD_RES (1)..(1): Any amino acid
XALALLNSKQNTGKSLYCQAITTHSKSDLLVYSSKWKSSLSKI

SEQ ID NO: 39022 - protein, 240 aa, Homo sapiens
  Payload ID: 7817
  Gene Symbol: HIVEP1
  Gene Name: human immunodeficiency virus type I enhancer binding protein 1
  ENSP ID: ENSP00000409078
MLSWVPWRRVTGLHGVALPHGLDKIEEAQKELNGAEVSKKEILQAGVKGTSESLKGNLTKHMKSKAHSKKCVDLGVSVGLIDEQDTEESDEKQRFSYERSGYDLEESDGPDEDDNENEDDDEDSQAESVLSATPSVTASPQHLPSRSSLQDPVSTDEDVRITDCFSGVHTDPMDVLPRALLTRMTVLSTAQSDYNRKTLSPGKARQRAARDENDTIPSVDTSRSPCHQMSVDYPESEEIL

SEQ ID NO: 39023 - protein, 142 aa, Homo sapiens
  Payload ID: 7817
  Gene Symbol: HIVEP1
  Gene Name: human immunodeficiency virus type I enhancer binding protein 1
  ENSP ID: ENSP00000417348
MPRTKQIHPRNLRDKIEEAQKELNGAEVSKKEILQAGVKGTSESLKGVKRKKIVAENHLKKIPKSPLRNPLQAKHKQNTEESSFAVLHSASESHKKQNYIPVKNGKQFTKQNGETPGIIAEASKSEESVSPKKPLFLQQPSE

SEQ ID NO: 39024 - protein, 128 aa, Homo sapiens
  Payload ID: 7817
  Gene Symbol: HIVEP1
  Gene Name: human immunodeficiency virus type I enhancer binding protein 1
  ENSP ID: ENSP00000418021
MPRTKQIHPRNLRDKIEEAQKELNGAEVSKKEILQAGVKGTSESLKGVKRKKIVAENHLKKIPKSPLRNPLQAKHKQNTEESSFAVLHSASESHKKQNYIPVKNGKQFTKQNGETPGIIAEASKSEES

SEQ ID NO: 39025 - protein, 47 aa, Homo sapiens
  Payload ID: 7817
  Gene Symbol: HIVEP1
  Gene Name: human immunodeficiency virus type I enhancer binding protein 1
  ENSP ID: ENSP00000419721
MPRTKQIHPRNLRGSCSFAQAGVQWCSCSSLQPQTSGDKLRLVPFLL

SEQ ID NO: 39026 - protein, 120 aa, Homo sapiens
  Payload ID: 7817
  Gene Symbol: HIVEP1
  Gene Name: human immunodeficiency virus type I enhancer binding protein 1
  ENSP ID: ENSP00000419762
MPRTKQIHPRNLRDKIEEAQKELNGAEVSKKEILQAGVKGTSESLKGVKRKKIVAENHLKKIPKSPLRNPLQAKHKQNTEESSFAVLHSASESHKKQNYIPVKNGKQFTKQNGETPGIIA

SEQ ID NO: 39027 - protein, 2717 aa, Homo sapiens
  Payload ID: 7817
  Gene Symbol: HIVEP1
  Gene Name: human immunodeficiency virus type I enhancer binding protein 1
  ENSP ID: ENSP00000445617
MPRTKQIHPRNLRDKIEEAQKELNGAEVSKKEILQAGVKGTSESLKGVKRKKIVAENHLKKIPKSPLRNPLQAKHKQNTEESSFAVLHSASESHKKQNYIPVKNGKQFTKQNGETPGIIAEASKSEESVSPKKPLFLQQPSELRRWRSEGADPAKFSDLDEQCDSSSLSSKTRTDNSECISSHCGTTSPSYTNTAFDVLLKAMEPELSTLSQKGSPCAIKTEKLRPNKTARSPPKLKNSSMDAPNQTSQELVAESQSSCTSYTVHMSAAQKNEQGAMQSASHLYHQHEHFVPKSNQHNQQLPGCSGFTGSLTNLQNQENAKLEQVYNIAVTSSVGLTSPSSRSQVTPQNQQMDSASPLSISPANSTQSPPMPIYNSTHVASVVNQSVEQMCNLLLKDQKPKKQGKYICEYCNRACAKPSVLLKHIRSHTGERPYPCVTCGFSFKTKSNLYKHKKSHAHTIKLGLVLQPDAGGLFLSHESPKALSIHSDVEDSGESEEEGATDERQHDLGAMELQPVHIIKRMSNAETLLKSSFTPSSPENVIGDFLLQDRSAESQAVTELPKVVVHHVTVSPLRTDSPKAMDPKPELSSAQKQKDLQVTNVQPLSANMSQGGVSRLETNENSHQKGDMNPLEGKQDSHVGTVHAQLQRQQATDYSQEQQGKLLSPRSLGSTDSGYFSRSESADQTVSPPTPFARRLPSTEQDSGRSNGPSAALVTTSTPSALPTGEKALLLPGQMRPPLATKTLEERISKLISDNEALVDDKQLDSVKPRRTSLSRRGSIDSPKSYIFKDSFQFDLKPVGRRTSSSSDIPKSPFTPTEKSKQVFLLSVPSLDCLPITRSNSMPTTGYSAVPANIIPPPHPLRGSQSFDDKIGAFYDDVFVSGPNAPVPQSGHPRTLVRQAAIEDSSANESHVLGTGQSLDESHQGCHAAGEAMSVRSKALAQGPHIEKKKSHQGRGTMFECETCRNRYRKLENFENHKKFYCSELHGPKTKVAMREPEHSPVPGGLQPQILHYRVAGSSGIWEQTPQIRKRRKMKSVGDDEELQQNESGTSPKSSEGLQFQNALGCNPSLPKHNVTIRSDQQHKNIQLQNSHIHLVARGPEQTMDPKLSTIMEQQISSAAQDKIELQRHGTGISVIQHTNSLSRPNSFDKPEPFERASPVSFQELNRTGKSGSLKVIGISQEESHPSRDGSHPHQLALSDALRGELQESSRKSPSERHVLGQPSRLVRQHNIQVPEILVTEEPDRDLEAQCHDQEKSEKFSWPQRSETLSKLPTEKLPPKKKRLRLAEIEHSSTESSFDSTLSRSLSRESSLSHTSSFSASLDIEDVSKTEASPKIDFLNKAEFLMIPAGLNTLNVPGCHREMRRTASEQINCTQTSMEVSDLRSKSFDCGSITPPQTTPLTELQPPSSPSRVGVTGHVPLLERRRGPLVRQISLNIAPDSHLSPVHPTSFQNTALPSVNAVPYQGPQLTSTSLAEFSANTLHSQTQVKDLQAETSNSSSTNVFPVQQLCDINLLNQIHAPPSHQSTQLSLQVSTQGSKPDKNSVLSGSSKSEDCFAPKYQLHCQVFTSGPSCSSNPVHSLPNQVISDPVGTDHCVTSATLPTKLIDSMSNSHPLLPPELRPLGSQVQKVPSSFMLPIRLQSSVPAYCFATLTSLPQILVTQDLPNQPICQTNHSVVPISEEQNSVPTLQKGHQNALPNPEKEFLCENVFSEMSQNSSLSESLPITQKISVGRLSPQQESSASSKRMLSPANSLDIAMEKHQKRAKDENGAVCATDVRPLEALSSRVNEASKQKKPILVRQVCTTEPLDGVMLEKDVFSQPEISNEAVNLTNVLPADNSSTGCSKFVVIEPISELQEFENIKSSTSLTLTVRSSPAPSENTHISPLKCTDNNQERKSPGVKNQGDKVNIQEQSQQPVTSLSLFNIKDTQQLAFPSLKTTTNFTWCYLLRQKSLHLPQKDQKTSAYTDWTVSASNPNPLGLPTKVALALLNSKQNTGKSLYCQAITTHSKSDLLVYSSKWKSSLSKRALGNQKSTVVEFSNKDASEINSEQDKENSLIKSEPRRIKIFDGGQSNEEYVYVRGRGRGKYICEECGIRCKKPSMLKKHIRTHTDVRPYHCTYCNFSFKTKGNLTKHMKSKAHSKKCVDLGVSVGLIDEQDTEESDEKQRFSYERSGYDLEESDGPDEDDNENEDDDEDSQAESVLSATPSVTASPQHLPSRSSLQDPVSTDEDVRITDCFSGVHTDPMDVLPRALLTRMTVLSTAQSDYNRKTLSPGKARQRAARDENDTIPSVDTSRSPCHQMSVDYPESEEILRSSMAGKAVAITQSPSSVRLPPAAAEHSPQTAAGMPSVASPHPDPQEQKQQITLQPTPGLPSPHTHLFSHLPLHSQQQSRTPYNMVPVGGIHVVPAGLTYSTFVPLQAGPVQLTIPAVSVVHRTLGTHRNTVTEVSGTTNPAGVAELSSVVPCIPIGQIRVPGLQNLSTPGLQSLPSLSMETVNIVGLANTNMAPQVHPPGLALNAVGLQVLTANPSSQSSPAPQAHIPGLQILNIALPTLIPSVSQVAVDAQGAPEMPASQSKACETQPKQTSVASANQVSRTESPQGLPTVQRENAKKVLNPPAPAGDHARLDGLSKMDTEKAASANHVKPKPELTSIQGQPASTSQPLLKAHSEVFTKPSGQQTLSPDRQVPRPTALPRRQPTVHFSDVSSDDDEDRLVIAT

SEQ ID NO: 39028 - protein, 583 aa, Homo sapiens
  Payload ID: 7817
  Gene Symbol: HIVEP1
  Gene Name: human immunodeficiency virus type I enhancer binding protein 1
  ENSP ID: ENSP00000486543
MLKKHIRTHTDVRPYHCTYCNFSFKTKDEKQRFSYERSGYDLEESDGPDEDDNENEDDDEDSQAESVLSATPSVTASPQHLPSRSSLQDPVSTDEDVRITDCFSGVHTDPMDVLPRALLTRMTVLSTAQSDYNRKTLSPGKARQRAARDENDTIPSVDTSRSPCHQMSVDYPESEEILRSSMAGKAVAITQSPSSVRLPPAAAEHSPQTAAGMPSVASPHPDPQEQKQQITLQPTPGLPSPHTHLFSHLPLHSQQQSRTPYNMVPVGGIHVVPAGLTYSTFVPLQAGPVQLTIPAVSVVHRTLGTHRNTVTEVSGTTNPAGVAELSSVVPCIPIGQIRVPGLQNLSTPGLQSLPSLSMETVNIVGLANTNMAPQVHPPGLALNAVGLQVLTANPSSQSSPAPQAHIPGLQILNIALPTLIPSVSQVAVDAQGAPEMPASQSKACETQPKQTSVASANQVSRTESPQGLPTVQRENAKKVLNPPAPAGDHARLDGLSKMDTEKAASANHVKPKPELTSIQGQPASTSQPLLKAHSEVFTKPSGQQTLSPDRQVPRPTALPRRQPTVHFSDVSSDDDEDRLVIAT

SEQ ID NO: 39029 - protein, 2446 aa, Homo sapiens
  Payload ID: 7818
  Gene Symbol: HIVEP2
  Gene Name: human immunodeficiency virus type I enhancer binding protein 2
  Uniprot ID: P31629
  ENSP ID: ENSP00000012134
MDTGDTALGQKATSRSGETDKASGRWRQEQSAVIKMSTFGSHEGQRQPQIEPEQIGNTASAQLFGSGKLASPSEVVQQVAEKQYPPHRPSPYSCQHSLSFPQHSLPQGVMHSTKPHQSLEGPPWLFPGPLPSVASEDLFPFPIHGHSGGYPRKKISSLNPAYSQYSQKSIEQAEEAHKKEHKPKKPGKYICPYCSRACAKPSVLKKHIRSHTGERPYPCIPCGFSFKTKSNLYKHRKSHAHAIKAGLVPFTESAVSKLDLEAGFIDVEAEIHSDGEQSTDTDEESSLFAEASDKMSPGPPIPLDIASRGGYHGSLEESLGGPMKVPILIIPKSGIPLPNESSQYIGPDMLPNPSLNTKADDSHTVKQKLALRLSEKKGQDSEPSLNLLSPHSKGSTDSGYFSRSESAEQQISPPNTNAKSYEEIIFGKYCRLSPRNALSVTTTSQERAAMGRKGIMEPLPHVNTRLDVKMFEDPVSQLIPSKGDVDPSQTSMLKSTKFNSESRQPQIIPSSIRNEGKLYPANFQGSNPVLLEAPVDSSPLIRSNSVPTSSATNLTIPPSLRGSHSFDERMTGSDDVFYPGTVGIPPQRMLRRQAAFELPSVQEGHVEVEHHGRMLKGISSSSLKEKKLSPGDRVGYDYDVCRKPYKKWEDSETPKQNYRDISCLSSLKHGGEYFMDPVVPLQGVPSMFGTTCENRKRRKEKSVGDEEDTPMICSSIVSTPVGIMASDYDPKLQMQEGVRSGFAMAGHENLSHGHTERFDPCRPQLQPGSPSLVSEESPSAIDSDKMSDLGGRKPPGNVISVIQHTNSLSRPNSFERSESAELVACTQDKAPSPSETCDSEISEAPVSPEWAPPGDGAESGGKPSPSQQVQQQSYHTQPRLVRQHNIQVPEIRVTEEPDKPEKEKEAQSKEPEKPVEEFQWPQRSETLSQLPAEKLPPKKKRLRLADMEHSSGESSFESTGTGLSRSPSQESNLSHSSSFSMSFEREETSKLSALPKQDEFGKHSEFLTVPAGSYSLSVPGHHHQKEMRRCSSEQMPCPHPAEVPEVRSKSFDYGNLSHAPVSGAAASTVSPSRERKKCFLVRQASFSGSPEISQGEVGMDQSVKQEQLEHLHAGLRSGWHHGPPAVLPPLQQEDPGKQVAGPCPPLSSGPLHLAQPQIMHMDSQESLRNPLIQPTSYMTSKHLPEQPHLFPHQETIPFSPIQNALFQFQYPTVCMVHLPAQQPPWWQAHFPHPFAQHPQKSYGKPSFQTEIHSSYPLEHVAEHTGKKPAEYAHTKEQTYPCYSGASGLHPKNLLPKFPSDQSSKSTETPSEQVLQEDFASANAGSLQSLPGTVVPVRIQTHVPSYGSVMYTSISQILGQNSPAIVICKVDENMTQRTLVTNAAMQGIGFNIAQVLGQHAGLEKYPIWKAPQTLPLGLESSIPLCLPSTSDSVATLGGSKRMLSPASSLELFMETKQQKRVKEEKMYGQIVEELSAVELTNSDIKKDLSRPQKPQLVRQGCASEPKDGLQSGSSSFSSLSPSSSQDYPSVSPSSREPFLPSKEMLSGSRAPLPGQKSSGPSESKESSDELDIDETASDMSMSPQSSSLPAGDGQLEEEGKGHKRPVGMLVRMASAPSGNVADSTLLLTDMADFQQILQFPSLRTTTTVSWCFLNYTKPNYVQQATFKSSVYASWCISSCNPNPSGLNTKTTLALLRSKQKITAEIYTLAAMHRPGTGKLTSSSAWKQFTQMKPDASFLFGSKLERKLVGNILKERGKGDIHGDKDIGSKQTEPIRIKIFEGGYKSNEDYVYVRGRGRGKYICEECGIRCKKPSMLKKHIRTHTDVRPYVCKLCNFAFKTKGNLTKHMKSKAHMKKCLELGVSMTSVDDTETEEAENLEDLHKAAEKHSMSSISTDHQFSDAEESDGEDGDDNDDDDEDEDDFDDQGDLTPKTRSRSTSPQPPRFSSLPVNVGAVPHGVPSDSSLGHSSLISYLVTLPSIRVTQLMTPSDSCEDTQMTEYQRLFQSKSTDSEPDKDRLDIPSCMDEECMLPSEPSSSPRDFSPSSHHSSPGYDSSPCRDNSPKRYLIPKGDLSPRRHLSPRRDLSPMRHLSPRKEAALRREMSQRDVSPRRHLSPRRPVSPGKDITARRDLSPRRERRYMTTIRAPSPRRALYHNPPLSMGQYLQAEPIVLGPPNLRRGLPQVPYFSLYGDQEGAYEHPGSSLFPEGPNDYVFSHLPLHSQQQVRAPIPMVPVGGIQMVHSMPPALSSLHPSPTLPLPMEGFEEKKGASGESFSKDPYVLSKQHEKRGPHALQSSGPPSTPSSPRLLMKQSTSEDSLNATEREQEENIQTCTKAIASLRIATEEAALLGPDQPARVQEPHQNPLGSAHVSIRHFSRPEPGQPCTSATHPDLHDGEKDNFGTSQTPLAHSTFYSKSCVDDKQLDFHSSKELSSSTEESKDPSSEKSQLH

SEQ ID NO: 39030 - protein, 2446 aa, Homo sapiens; identical to SEQ ID NO: 39029
  Payload ID: 7818
  Gene Symbol: HIVEP2
  Gene Name: human immunodeficiency virus type I enhancer binding protein 2
  Uniprot ID: P31629
  ENSP ID: ENSP00000356575

SEQ ID NO: 39031 - protein, 2446 aa, Homo sapiens; identical to SEQ ID NO: 39029
  Payload ID: 7818
  Gene Symbol: HIVEP2
  Gene Name: human immunodeficiency virus type I enhancer binding protein 2
  Uniprot ID: P31629
  ENSP ID: ENSP00000356576

SEQ ID NO: 39032 - protein, 2406 aa, Homo sapiens
  Payload ID: 7819
  Gene Symbol: HIVEP3
  Gene Name: human immunodeficiency virus type I enhancer binding protein 3
  Uniprot ID: Q5T1R4
  ENSP ID: ENSP00000247584
MDPEQSVKGTKKAEGSPRKRLTKGEAIQTSVSSSVPYPGSGTAATQESPAQELLAPQPFPGPSSVLREGSQEKTGQQQKPPKRPPIEASVHISQLPQHPLTPAFMSPGKPEHLLEGSTWQLVDPMRPGPSGSFVAPGLHPQSQLLPSHASIIPPEDLPGVPKVFVPRPSQVSLKPTEEAHKKERKPQKPGKYICQYCSRPCAKPSVLQKHIRSHTGERPYPCGPCGFSFKTKSNLYKHRKSHAHRIKAGLASGMGGEMYPHGLEMERIPGEEFEEPTEGESTDSEEETSATSGHPAELSPRPKQPLLSSGLYSSGSHSSSHERCSLSQSSTAQSLEDPPPFVEPSSEHPLSHKPEDTHTIKQKLALRLSERKKVIDEQAFLSPGSKGSTESGYFSRSESAEQQVSPPNTNAKSYAEIIFGKCGRIGQRTAMLTATSTQPLLPLSTEDKPSLVPLSVPRTQVIEHITKLITINEAVVDTSEIDSVKPRRSSLSRRSSMESPKSSLYREPLSSHSEKTKPEQSLLSLQHPPSTAPPVPLLRSHSMPSAACTISTPHHPFRGSYSFDDHITDSEALSHSSHVFTSHPRMLKRQPAIELPLGGEYSSEEPGPSSKDTASKPSDEVEPKESELTKKTKKGLKTKGVIYECNICGARYKKRDNYEAHKKYYCSELQIAKPISAGTHTSPEAEKSQIEHEPWSQMMHYKLGTTLELTPLRKRRKEKSLGDEEEPPAFESTKSQFGSPGPSDAARNLPLESTKSPAEPSKSVPSLEGPTGFQPRTPKPGSGSESGKERRTTSKEISVIQHTSSFEKSDSLEQPSGLEGEDKPLAQFPSPPPAPHGRSAHSLQPKLVRQPNIQVPEILVTEEPDRPDTEPEPPPKEPEKTEEFQWPQRSQTLAQLPAEKLPPKKKRLRLAEMAQSSGESSFESSVPLSRSPSQESNVSLSGSSRSASFERDDHGKAEAPSPSSDMRPKPLGTHMLTVPSHHPHAREMRRSASEQSPNVSHSAHMTETRSKSFDYGSLSLTGPSAPAPVAPPARVAPPERRKCFLVRQASLSRPPESELEVAPKGRQESEEPQPSSSKPSAKSSLSQISSAATSHGGPPGGKGPGQDRPPLGPTVPYTEALQVFHHPVAQTPLHEKPYLPPPVSLFSFQHLVQHEPGQSPEFFSTQAMSSLLSSPYSMPPLPPSLFQAPPLPLQPTVLHPGQLHLPQLMPHPANIPFRQPPSFLPMPYPTSSALSSGFFLPLQSQFALQLPGDVESHLPQIKTSLAPLATGSAGLSPSTEYSSDIRLPPVAPPASSSAPTSAPPLALPACPDTMVSLVVPVRVQTNMPSYGSAMYTTLSQILVTQSQGSSATVALPKFEEPPSKGTTVCGADVHEVGPGPSGLSEEQSRAFPTPYLRVPVTLPERKGTSLSSESILSLEGSSSTAGGSKRVLSPAGSLELTMETQQQKRVKEEEASKADEKLELVKPCSVVLTSTEDGKRPEKSHLGNQGQGRRELEMLSSLSSDPSDTKEIPPLPHPALSHGTAPGSEALKEYPQPSGKPHRRGLTPLSVKKEDSKEQPDLPSLAPPSSLPLSETSSRPAKSQEGTDSKKVLQFPSLHTTTNVSWCYLNYIKPNHIQHADRRSSVYAGWCISLYNPNLPGVSTKAALSLLRSKQKVSKETYTMATAPHPEAGRLVPSSSRKPRMTEVHLPSLVSPEGQKDLARVEKEEERRGEPEEDAPASQRGEPARIKIFEGGYKSNEEYVYVRGRGRGKYVCEECGIRCKKPSMLKKHIRTHTDVRPYVCKHCHFAFKTKGNLTKHMKSKAHSKKCQETGVLEELEAEEGTSDDLFQDSEGREGSEAVEEHQFSDLEDSDSDSDLDEDEDEDEEESQDELSRPSSEAPPPGPPHALRADSSPILGPQPPDAPASGTEATRGSSVSEAERLTASSCSMSSQSMPGLPWLGPAPLGSVEKDTGSALSYKPVSPRRPWSPSKEAGSRPPLARKHSLTKNDSSPQRCSPAREPQASAPSPPGLHVDPGRGMGALPCGSPRLQLSPLTLCPLGRELAPRAHVLSKLEGTTDPGLPRYSPTRRWSPGQAESPPRSAPPGKWALAGPGSPSAGEHGPGLGLDPRVLFPPAPLPHKLLSRSPETCASPWQKAESRSPSCSPGPAHPLSSRPFSALHDFHGHILARTEENIFSHLPLHSQHLTRAPCPLIPIGGIQMVQARPGAHPTLLPGPTAAWVSGFSGGGSDLTGAREAQERGRWSPTESSSASVSPVAKVSKFTLSSELEGGDYPKERERTGGGPGRPPDWTPHGTGAPAEPTPTHSPCTPPDTLPRPPQGRRAAQSWSPRLESPRAPTNPEPSATPPLDRSSSVGCLAEASARFPARTRNLSGEPRTRQDSPKPSGSGEPRAHPHQPEDRVPPNA

SEQ ID NO: 39033 - protein, 2406 aa, Homo sapiens; identical to SEQ ID NO: 39032
  Payload ID: 7819
  Gene Symbol: HIVEP3
  Gene Name: human immunodeficiency virus type I enhancer binding protein 3
  Uniprot ID: Q5T1R4
  ENSP ID: ENSP00000361664

SEQ ID NO: 39034 - protein, 2405 aa, Homo sapiens
  Payload ID: 7819
  Gene Symbol: HIVEP3
  Gene Name: human immunodeficiency virus type I enhancer binding protein 3
  Uniprot ID: Q5T1R4
  ENSP ID: ENSP00000361665
MDPEQSVKGTKKAEGSPRKRLTKGEAIQTSVSSSVPYPGSGTAATQESPAQELLAPQPFPGPSSVLREGSQEKTGQQQKPPKRPPIEASVHISQLPQHPLTPAFMSPGKPEHLLEGSTWQLVDPMRPGPSGSFVAPGLHPQSQLLPSHASIIPPEDLPGVPKVFVPRPSQVSLKPTEEAHKKERKPQKPGKYICQYCSRPCAKPSVLQKHIRSHTGERPYPCGPCGFSFKTKSNLYKHRKSHAHRIKAGLASGMGGEMYPHGLEMERIPGEEFEEPTEGESTDSEEETSATSGHPAELSPRPKQPLLSSGLYSSGSHSSSHERCSLSQSSTAQSLEDPPPFVEPSSEHPLSHKPEDTHTIKQKLALRLSERKKVIDEQAFLSPGSKGSTESGYFSRSESAEQQVSPPNTNAKSYAEIIFGKCGRIGQRTAMLTATSTQPLLPLSTEDKPSLVPLSVPRTQVIEHITKLITINEAVVDTSEIDSVKPRRSSLSRRSSMESPKSSLYREPLSSHSEKTKPEQSLLSLQHPPSTAPPVPLLRSHSMPSAACTISTPHHPFRGSYSFDDHITDSEALSHSSHVFTSHPRMLKRQPAIELPLGGEYSSEEPGPSSKDTASKPSDEVEPKESELTKKTKKGLKTKGVIYECNICGARYKKRDNYEAHKKYYCSELQIAKPISAGTHTSPEAEKSQIEHEPWSQMMHYKLGTTLELTPLRKRRKEKSLGDEEEPPAFESTKSQFGSPGPSDAARNLPLESTKSPAEPSKSVPSLEGPTGFQPRTPKPGSGSESGKERRTTSKEISVIQHTSSFEKSDSLEQPSGLEGEDKPLAQFPSPPPAPHGRSAHSLQPKLVRQPNIQVPEILVTEEPDRPDTEPEPPPKEPEKTEEFQWPQRSQTLAQLPAEKLPPKKKRLRLAEMAQSSGESSFESSVPLSRSPSQESNVSLSGSSRSASFERDDHGKAEAPSPSSDMRPKPLGTHMLTVPSHHPHAREMRRSASEQSPNVSHSAHMTETRSKSFDYGSLSLTGPSAPAPVAPPARVAPPERRKCFLVRQASLSRPPESELEVAPKGRQESEEPQPSSSKPSAKSSLSQISSAATSHGGPPGGKGPGQDRPPLGPTVPYTEALQVFHHPVAQTPLHEKPYLPPPVSLFSFQHLVQHEPGQSPEFFSTQAMSSLLSSPYSMPPLPPSLFQAPPLPLQPTVLHPGQLHLPQLMPHPANIPFRQPPSFLPMPYPTSSALSSGFFLPLQSQFALQLPGDVESHLPQIKTSLAPLATGSAGLSPSTEYSSDIRLPPVAPPASSSAPTSAPPLALPACPDTMVSLVVPVRVQTNMPSYGSAMYTTLSQILVTQSQGSSATVALPKFEEPPSKGTTVCGADVHEVGPGPSGLSEEQSRAFPTPYLRVPVTLPERKGTSLSSESILSLEGSSSTAGGSKRVLSPAGSLELTMETQQQKRVKEEEASKADEKLELVKPCSVVLTSTEDGKRPEKSHLGNQGQGRRELEMLSSLSSDPSDTKEIPPLPHPALSHGTAPGSEALKEYPQPSGKPHRRGLTPLSVKKEDSKEQPDLPSLAPPSSLPLSETSSRPAKSQEGTDSKKVLQFPSLHTTTNVSWCYLNYIKPNHIQHADRRSSVYAGWCISLYNPNLPGVSTKAALSLLRSKQKVSKETYTMATAPHPEAGRLVPSSSRKPRMTEVHLPSLVSPEGQKDLARVEKEEERRGEPEEDAPASQRGEPARIKIFEGGYKSNEEYVYVRGRGRGKYVCEECGIRCKKPSMLKKHIRTHTDVRPYVCKHCHFAFKTKGNLTKHMKSKAHSKKCQETGVLEELEAEEGTSDDLFQDSEGREGSEAVEEHQFSDLEDSDSDSDLDEDEDEDEEESQDELSRPSSEAPPPGPPHALRADSSPILGPQPPDAPASGTEATRGSSVSEAERLTASSCSMSSQSMPGLPWLGPAPLGSVEKDTGSALSYKPVSPRRPWSPSKEAGSRPPLARKHSLTKNDSSPQRCSPAREPQASAPSPPGLHVDPGRGMGALPCGSPRLQLSPLTLCPLGRELAPRAHVLSKLEGTTDPGLPRYSPTRRWSPGQAESPPRSAPPGKWALAGPGSPSAGEHGPGLGLDPRVLFPPAPLPHKLLSRSPETCASPWKAESRSPSCSPGPAHPLSSRPFSALHDFHGHILARTEENIFSHLPLHSQHLTRAPCPLIPIGGIQMVQARPGAHPTLLPGPTAAWVSGFSGGGSDLTGAREAQERGRWSPTESSSASVSPVAKVSKFTLSSELEGGDYPKERERTGGGPGRPPDWTPHGTGAPAEPTPTHSPCTPPDTLPRPPQGRRAAQSWSPRLESPRAPTNPEPSATPPLDRSSSVGCLAEASARFPARTRNLSGEPRTRQDSPKPSGSGEPRAHPHQPEDRVPPNA

SEQ ID NO: 39035 - protein, 3142 aa, Homo sapiens
  Payload ID: 7820
  Gene Symbol: HTT
  Gene Name: huntingtin
  Uniprot ID: P42858
  ENSP ID: ENSP00000347184
MATLEKLMKAFESLKSFQQQQQQQQQQQQQQQQQQQQQPPPPPPPPPPPQLPQPPPQAQPLLPQPQPPPPPPPPPPGPAVAEEPLHRPKKELSATKKDRVNHCLTICENIVAQSVRNSPEFQKLLGIAMELFLLCSDDAESDVRMVADECLNKVIKALMDSNLPRLQLELYKEIKKNGAPRSLRAALWRFAELAHLVRPQKCRPYLVNLLPCLTRTSKRPEESVQETLAAAVPKIMASFGNFANDNEIKVLLKAFIANLKSSSPTIRRTAAGSAVSICQHSRRTQYFYSWLLNVLLGLLVPVEDEHSTLLILGVLLTLRYLVPLLQQQVKDTSLKGSFGVTRKEMEVSPSAEQLVQVYELTLHHTQHQDHNVVTGALELLQQLFRTPPPELLQTLTAVGGIGQLTAAKEESGGRSRSGSIVELIAGGGSSCSPVLSRKQKGKVLLGEEEALEDDSESRSDVSSSALTASVKDEISGELAASSGVSTPGSAGHDIITEQPRSQHTLQADSVDLASCDLTSSATDGDEEDILSHSSSQVSAVPSDPAMDLNDGTQASSPISDSSQTTTEGPDSAVTPSDSSEIVLDGTDNQYLGLQIGQPQDEDEEATGILPDEASEAFRNSSMALQQAHLLKNMSHCRQPSDSSVDKFVLRDEATEPGDQENKPCRIKGDIGQSTDDDSAPLVHCVRLLSASFLLTGGKNVLVPDRDVRVSVKALALSCVGAAVALHPESFFSKLYKVPLDTTEYPEEQYVSDILNYIDHGDPQVRGATAILCGTLICSILSRSRFHVGDWMGTIRTLTGNTFSLADCIPLLRKTLKDESSVTCKLACTAVRNCVMSLCSSSYSELGLQLIIDVLTLRNSSYWLVRTELLETLAEIDFRLVSFLEAKAENLHRGAHHYTGLLKLQERVLNNVVIHLLGDEDPRVRHVAAASLIRLVPKLFYKCDQGQADPVVAVARDQSSVYLKLLMHETQPPSHFSVSTITRIYRGYNLLPSITDVTMENNLSRVIAAVSHELITSTTRALTFGCCEALCLLSTAFPVCIWSLGWHCGVPPLSASDESRKSCTVGMATMILTLLSSAWFPLDLSAHQDALILAGNLLAASAPKSLRSSWASEEEANPAATKQEEVWPALGDRALVPMVEQLFSHLLKVINICAHVLDDVAPGPAIKAALPSLTNPPSLSPIRRKGKEKEPGEQASVPLSPKKGSEASAASRQSDTSGPVTTSKSSSLGSFYHLPSYLKLHDVLKATHANYKVTLDLQNSTEKFGGFLRSALDVLSQILELATLQDIGKCVEEILGYLKSCFSREPMMATVCVQQLLKTLFGTNLASQFDGLSSNPSKSQGRAQRLGSSSVRPGLYHYCFMAPYTHFTQALADASLRNMVQAEQENDTSGWFDVLQKVSTQLKTNLTSVTKNRADKNAIHNHIRLFEPLVIKALKQYTTTTCVQLQKQVLDLLAQLVQLRVNYCLLDSDQVFIGFVLKQFEYIEVGQFRESEAIIPNIFFFLVLLSYERYHSKQIIGIPKIIQLCDGIMASGRKAVTHAIPALQPIVHDLFVLRGTNKADAGKELETQKEVVVSMLLRLIQYHQVLEMFILVLQQCHKENEDKWKRLSRQIADIILPMLAKQQMHIDSHEALGVLNTLFEILAPSSLRPVDMLLRSMFVTPNTMASVSTVQLWISGILAILRVLISQSTEDIVLSRIQELSFSPYLISCTVINRLRDGDSTSTLEEHSEGKQIKNLPEETFSRFLLQLVGILLEDIVTKQLKVEMSEQQHTFYCQELGTLLMCLIHIFKSGMFRRITAAATRLFRSDGCGGSFYTLDSLNLRARSMITTHPALVLLWCQILLLVNHTDYRWWAEVQQTPKRHSLSSTKLLSPQMSGEEEDSDLAAKLGMCNREIVRRGALILFCDYVCQNLHDSEHLTWLIVNHIQDLISLSHEPPVQDFISAVHRNSAASGLFIQAIQSRCENLSTPTMLKKTLQCLEGIHLSQSGAVLTLYVDRLLCTPFRVLARMVDILACRRVEMLLAANLQSSMAQLPMEELNRIQEYLQSSGLAQRHQRLYSLLDRFRLSTMQDSLSPSPPVSSHPLDGDGHVSLETVSPDKDWYVHLVKSQCWTRSDSALLEGAELVNRIPAEDMNAFMMNSEFNLSLLAPCLSLGMSEISGGQKSALFEAAREVTLARVSGTVQQLPAVHHVFQPELPAEPAAYWSKLNDLFGDAALYQSLPTLARALAQYLVVVSKLPSHLHLPPEKEKDIVKFVVATLEALSWHLIHEQIPLSLDLQAGLDCCCLALQLPGLWSVVSSTEFVTHACSLIYCVHFILEAVAVQPGEQLLSPERRTNTPKAISEEEEEVDPNTQNPKYITAACEMVAEMVESLQSVLALGHKRNSGVPAFLTPLLRNIIISLARLPLVNSYTRVPPLVWKLGWSPKPGGDFGTAFPEIPVEFLQEKEVFKEFIYRINTLGWTSRTQFEETWATLLGVLVTQPLVMEQEESPPEEDTERTQINVLAVQAITSLVLSAMTVPVAGNPAVSCLEQQPRNKPLKALDTRFGRKLSIIRGIVEQEIQAMVSKRENIATHHLYQAWDPVPSLSPATTGALISHEKLLLQINPERELGSMSYKLGQVSIHSVWLGNSITPLREEEWDEEEEEEADAPAPSSPPTSPVNSRKHRAGVDIHSCSQFLLELYSRWILPSSSARRTPAILISEVVRSLLVVSDLFTERNQFELMYVTLTELRRVHPSEDEILAQYLVPATCKAAAVLGMDKAVAEPVSRLLESTLRSSHLPSRVGALHGVLYVLECDLLDDTAKQLIPVISDYLLSNLKGIAHCVNIHSQQHVLVMCATAFYLIENYPLDVGPEFSASIIQMCGVMLSGSEESTPSIIYHCALRGLERLLLSEQLSRLDAESLVKLSVDRVNVHSPHRAMAALGLMLTCMYTGKEKVSPGRTSDPNPAAPDSESVIVAMERVSVLFDRIRKGFPCEARVVARILPQFLDDFFPPQDIMNKVIGEFLSNQQPYPQFMATVVYKVFQTLHSTGQSSMVRDWVMLSLSNFTQRAPVAMATWSLSCFFVSASTSPWVAAILPHVISRMGKLEQVDVNLFCLVATDFYRHQIEEELDRRAFQSVLEVVAAPGSPYHRLLTCLRNVHKVTTC

SEQ ID NO: 39036 - protein, 112 aa, Homo sapiens
  Payload ID: 7820
  Gene Symbol: HTT
  Gene Name: huntingtin
  ENSP ID: ENSP00000425743
  MOD_RES (1)..(1): Any amino acid
XELATLQDIGKCVEEILGYLKSCFSREPMMATVCVQQLLKTLFGTNLASQFDGLSSNPSKSQGRAQRLGSSSVRPGLYHYCFMAPYTHFTQALADASLRNMVQAEQENDTSG

SEQ ID NO: 39037 - protein, 1037 aa, Homo sapiens
  Payload ID: 7821
  Gene Symbol: HIP1
  Gene Name: huntingtin interacting protein 1
  Uniprot ID: O00291
  ENSP ID: ENSP00000336747
MDRMASSMKQVPNPLPKVLSRRGVGAGLEAAERESFERTQTVSINKAINTQEVAVKEKHARTCILGTHHEKGAQTFWSVVNRLPLSSNAVLCWKFCHVFHKLLRDGHPNVLKDSLRYRNELSDMSRMWGHLSEGYGQLCSIYLKLLRTKMEYHTKNPRFPGNLQMSDRQLDEAGESDVNNFFQLTVEMFDYLECELNLFQTVFNSLDMSRSVSVTAAGQCRLAPLIQVILDCSHLYDYTVKLLFKLHSCLPADTLQGHRDRFMEQFTKLKDLFYRSSNLQYFKRLIQIPQLPENPPNFLRASALSEHISPVVVIPAEASSPDSEPVLEKDDLMDMDASQQNLFDNKFDDIFGSSFSSDPFNFNSQNGVNKDEKDHLIERLYREISGLKAQLENMKTESQRVVLQLKGHVSELEADLAEQQHLRQQAADDCEFLRAELDELRRQREDTEKAQRSLSEIERKAQANEQRYSKLKEKYSELVQNHADLLRKNAEVTKQVSMARQAQVDLEREKKELEDSLERISDQGQRKTQEQLEVLESLKQELATSQRELQVLQGSLETSAQSEANWAAEFAELEKERDSLVSGAAHREEELSALRKELQDTQLKLASTEESMCQLAKDQRKMLLVGSRKAAEQVIQDALNQLEEPPLISCAGSADHLLSTVTSISSCIEQLEKSWSQYLACPEDISGLLHSITLLAHLTSDAIAHGATTCLRAPPEPADSLTEACKQYGRETLAYLASLEEEGSLENADSTAMRNCLSKIKAIGEELLPRGLDIKQEELGDLVDKEMAATSAAIETATARIEEMLSKSRAGDTGVKLEVNERILGCCTSLMQAIQVLIVASKDLQREIVESGRGTASPKEFYAKNSRWTEGLISASKAVGWGATVMVDAADLVVQGRGKFEELMVCSHEIAASTAQLVAASKVKADKDSPNLAQLQQASRGVNQATAGVVASTISGKSQIEETDNMDFSSMTLTQIKRQEMDSQVRVLELENELQKERQKLGELRKKHYELAGVAEGWEEGTEASPPTLQEVVTEKE

SEQ ID NO: 39038 - protein, 986 aa, Homo sapiens
  Payload ID: 7821
  Gene Symbol: HIP1
  Gene Name: huntingtin interacting protein 1
  Uniprot ID: O00291
  ENSP ID: ENSP00000410300
MDRMASSMKQVPNPLPKVLSRRGVGAGLEAAERESFERTQTVSINKAINTQEVAVKEKHARTCILGTHHEKGAQTFWSVVNRLPLSSNAVLCWKFCHVFHKLLRDGHPNVLKDSLRYRNELSDMSRMWGHLSEGYGQLCSIYLKLLRTKMEYHTKNPRFPGNLQMSDRQLDEAGESDVNNFFQLTVEMFDYLECELNLFQTVFNSLDMSRSVSVTAAGQCRLAPLIQVILDCSHLYDYTVKLLFKLHSCLPADTLQGHRDRFMEQFTKLKDLFYRSSNLQYFKRLIQIPQLPENPPNFLRASALSEHISPVVVIPAEASSPDSEPVLEKDDLMDMDASQQNLFDNKFDDIFGSSFSSDPFNFNSQNGVNKDEKDHLIERLYREISGLKAQLENMKTESQRVVLQLKGHVSELEADLAEQQHLRQQAADDCEFLRAELDELRRQREDTEKAQRSLSEIERKAQANEQRYSKLKEKYSELVQNHADLLRKNAEVTKQVSMARQAQVDLEREKKELEDSLERISDQGQRKTQEQLEVLESLKQELATSQRELQVLQGSLETSAQSEANWAAEFAELEKERDSLVSGAAHREEELSALRKELQDTQLKLASTEESMCQLAKDQRKMLLVGSRKAAEQVIQDALNQLEEPPLISCAGSADHLLSTVTSISSCIEQLEKSWSQYLACPEDISGLLHSITLLAHLTSDAIAHGATTCLRAPPEPADSLTEACKQYGRETLAYLASLEEEGSLENADSTAMRNCLSKIKAIGEELLPRGLDIKQEELGDLVDKEMAATSAAIETATARIEGTASPKEFYAKNSRWTEGLISASKAVGWGATVMVDAADLVVQGRGKFEELMVCSHEIAASTAQLVAASKVKADKDSPNLAQLQQASRGVNQATAGVVASTISGKSQIEETDNMDFSSMTLTQIKRQEMDSQVRVLELENELQKERQKLGELRKKHYELAGVAEGWEEGTEASPPTLQEVVTEKE

SEQ ID NO: 39039 - protein, 146 aa, Homo sapiens
  Payload ID: 7821
  Gene Symbol: HIP1
  Gene Name: huntingtin interacting protein 1
  ENSP ID: ENSP00000414280
MMFPNPEPPPETVSINKAINTQEVAVKEKHARTCILGTHHEKGAQTFWSVVNRLPLSSNAVLCWKFCHVFHKLLRDGHPNVLKDSLRYRNELSDMSRMWGHLSEGYGQLCSIYLKLLRTKMEYHTKNPRFPGNLQMSDRQLDEAGE

SEQ ID NO: 39040 - protein, 1008 aa, Homo sapiens
  Payload ID: 7821
  Gene Symbol: HIP1
  Gene Name: huntingtin interacting protein 1
  Uniprot ID: O00291
  ENSP ID: ENSP00000484528
MMFPNPEPPPETVSINKAINTQEVAVKEKHARTCILGTHHEKGAQTFWSVVNRLPLSSNAVLCWKFCHVFHKLLRDGHPNVLKDSLRYRNELSDMSRMWGHLSEGYGQLCSIYLKLLRTKMEYHTKNPRFPGNLQMSDRQLDEAGESDVNNFFQLTVEMFDYLECELNLFQTVFNSLDMSRSVSVTAAGQCRLAPLIQVILDCSHLYDYTVKLLFKLHSCLPADTLQGHRDRFMEQFTKLKDLFYRSSNLQYFKRLIQIPQLPENPPNFLRASALSEHISPVVVIPAEASSPDSEPVLEKDDLMDMDASQQNLFDNKFDDIFGSSFSSDPFNFNSQNGVNKDEKDHLIERLYREISGLKAQLENMKTESQRVVLQLKGHVSELEADLAEQQHLRQQAADDCEFLRAELDELRRQREDTEKAQRSLSEIERKAQANEQRYSKLKEKYSELVQNHADLLRKNAEVTKQVSMARQAQVDLEREKKELEDSLERISDQGQRKTQEQLEVLESLKQELATSQRELQVLQGSLETSAQSEANWAAEFAELEKERDSLVSGAAHREEELSALRKELQDTQLKLASTEESMCQLAKDQRKMLLVGSRKAAEQVIQDALNQLEEPPLISCAGSADHLLSTVTSISSCIEQLEKSWSQYLACPEDISGLLHSITLLAHLTSDAIAHGATTCLRAPPEPADSLTEACKQYGRETLAYLASLEEEGSLENADSTAMRNCLSKIKAIGEELLPRGLDIKQEELGDLVDKEMAATSAAIETATARIEEMLSKSRAGDTGVKLEVNERILGCCTSLMQAIQVLIVASKDLQREIVESGRGTASPKEFYAKNSRWTEGLISASKAVGWGATVMVDAADLVVQGRGKFEELMVCSHEIAASTAQLVAASKVKADKDSPNLAQLQQASRGVNQATAGVVASTISGKSQIEETDNMDFSSMTLTQIKRQEMDSQVRVLELENELQKERQKLGELRKKHYELAGVAEGWEEGTEASPPTLQEVVTEKE

SEQ ID NO: 39041 - protein, 1068 aa, Homo sapiens
  Payload ID: 7822
  Gene Symbol: HIP1R
  Gene Name: huntingtin interacting protein 1 related
  Uniprot ID: O75146
  ENSP ID: ENSP00000253083
MNSIKNVPARVLSRRPGHSLEAEREQFDKTQAISISKAINTQEAPVKEKHARRIILGTHHEKGAFTFWSYAIGLPLPSSSILSWKFCHVLHKVLRDGHPNVLHDCQRYRSNIREIGDLWGHLHDRYGQLVNVYTKLLLTKISFHLKHPQFPAGLEVTDEVLEKAAGTDVNNIFQLTVEMFDYMDCELKLSESVFRQLNTAIAVSQMSSGQCRLAPLIQVIQDCSHLYHYTVKLLFKLHSCLPADTLQGHRDRFHEQFHSLRNFFRRASDMLYFKRLIQIPRLPEGPPNFLRASALAEHIKPVVVIPEEAPEDEEPENLIEISTGPPAGEPVVVADLFDQTFGPPNGSVKDDRDLQIESLKREVEMLRSELEKIKLEAQRYIAQLKSQVNALEGELEEQRKQKQKALVDNEQLRHELAQLRAAQLEGERSQGLREEAERKASATEARYNKLKEKHSELVHVHAELLRKNADTAKQLTVTQQSQEEVARVKEQLAFQVEQVKRESELKLEEKSDQLEKLKRELEAKAGELARAQEALSHTEQSKSELSSRLDTLSAEKDALSGAVRQREADLLAAQSLVRETEAALSREQQRSSQEQGELQGRLAERESQEQGLRQRLLDEQFAVLRGAAAEAAGILQDAVSKLDDPLHLRCTSSPDYLVSRAQEALDAVSTLEEGHAQYLTSLADASALVAALTRFSHLAADTIINGGATSHLAPTDPADRLIDTCRECGARALELMGQLQDQQALRHMQASLVRTPLQGILQLGQELKPKSLDVRQEELGAVVDKEMAATSAAIEDAVRRIEDMMNQARHASSGVKLEVNERILNSCTDLMKAIRLLVTTSTSLQKEIVESGRGAATQQEFYAKNSRWTEGLISASKAVGWGATQLVEAADKVVLHTGKYEELIVCSHEIAASTAQLVAASKVKANKHSPHLSRLQECSRTVNERAANVVASTKSGQEQIEDRDTMDFSGLSLIKLKKQEMETQVRVLELEKTLEAERMRLGELRKQHYVLAGASGSPGEEVAIRPSTAPRSVTTKKPPLAQKPSVAPRQDHQLDKKDGIYPAQLVNY

SEQ ID NO: 39042 - protein, 197 aa, Homo sapiens
  Payload ID: 7822
  Gene Symbol: HIP1R
  Gene Name: huntingtin interacting protein 1 related
  ENSP ID: ENSP00000446236
  MOD_RES (1)..(1): Any amino acid
XRHPLACRRRSWRAAGEAADKVVLHTGKYEELIVCSHEIAASTAQLVAASKVKANKHSPHLSRLQECSRTVNERAANVVASTKSGQEQIEDRDTMDFSGLSLIKLKKQEMETQVRVLELEKTLEAERMRLGELRKQHYVLAGASGSPGEEVAIRPSTAPRSVTTKKPPLAQKPSVAPRQDHQLDKKDGIYPAQLVNY

SEQ ID NO: 39043 - protein, 129 aa, Homo sapiens
  Payload ID: 7823
  Gene Symbol: HYPK
  Gene Name: huntingtin interacting protein K
  Uniprot ID: Q9NX55
  ENSP ID: ENSP00000384474
MRRRGEIDMATEGDVELELETETSGPERPPEKPRKHDSGAADLERVTDYAEEKEIQSSNLETAMSVIGDRRSREQKAKQEREKELAKVTIKKEDLELIMTEMEISRAAAERSLREHMGNVVEALIALTN

SEQ ID NO: 39044 - protein, 82 aa, Homo sapiens
  Payload ID: 7823
  Gene Symbol: HYPK
  Gene Name: huntingtin interacting protein K
  ENSP ID: ENSP00000394060
MRRRGEIDMATEGDVELELETETSGPERPPEKPRKHDSGAADLERVTDYAEEKEIQSSNLETGERTGKSHYQEGRSGANSEW

SEQ ID NO: 39045 - protein, 129 aa, Homo sapiens; identical to SEQ ID NO: 39043
  Payload ID: 7823
  Gene Symbol: HYPK
  Gene Name: huntingtin interacting protein K
  Uniprot ID: Q9NX55
  ENSP ID: ENSP00000401155

SEQ ID NO: 39046 - protein, 201 aa, Homo sapiens
  Payload ID: 7823
  Gene Symbol: HYPK
  Gene Name: huntingtin interacting protein K
  ENSP ID: ENSP00000481433
MGKGKRETKNIGKRTDETTKEEPIPNERGLGQAYCTLFQILTQRYLIASGQCFTVYKGLCYQDNPTVTSILDARSTKSGSRLHSKYTRSRDLNLFSVFLQCYYFIPEFPLPSLCLLSLLCPLPTQKVHTNLLCSCARGLVGEWRWTSNTACSRWKVAVPAHTRYTAPEPLSTGQSERPNRWAHNPEGIWIWECVEKWQDKS

SEQ ID NO: 39047 - protein, 117 aa, Homo sapiens
  Payload ID: 7824
  Gene Symbol: HYPM
  Gene Name: huntingtin interacting protein M
  Uniprot ID: O75409
  ENSP ID: ENSP00000339511
MSEKKNCKNSSTNNNQTQDPSRNELQVPRSFVDRVVQDERDVQSQSSSTINTLLTLLDCLADYIMERVGLEASNNGSMRNTSQDREREVDNNREPHSAESDVTRFLFDEMPKSRKND

SEQ ID NO: 39048 - protein, 671 aa, Homo sapiens
  Payload ID: 7825
  Gene Symbol: HAP1
  Gene Name: huntingtin-associated protein 1
  Uniprot ID: P54257
  ENSP ID: ENSP00000309392
MRPKRLGRCCAGSRLGPGDPAALTCAPSPSASPAPEPSAQPQARGTGQRVGSRATSGSQFLSEARTGARPASEAGAKAGARRPSAFSAIQGDVRSMPDNSDAPWTRFVFQGPFGSRATGRGTGKAAGIWKTPAAYVGRRPGVSGPERAAFIRELEEALCPNLPPPVKKITQEDVKVMLYLLEELLPPVWESVTYGMVLQRERDLNTAARIGQSLVKQNSVLMEENSKLEALLGSAKEEILYLRHQVNLRDELLQLYSDSDEEDEDEEEEEEEKEAEEEQEEEEAEEDLQCAHPCDAPKLISQEALLHQHHCPQLEALQEKLRLLEEENHQLREEASQLDTLEDEEQMLILECVEQFSEASQQMAELSEVLVLRLENYERQQQEVARLQAQVLKLQQRCRMYGAETEKLQKQLASEKEIQMQLQEESVWVGSQLQDLREKYMDCGGMLIEMQEEVKTLRQQPPVSTGSATHYPYSVPLETLPGFQETLAEELRTSLRRMISDPVYFMERNYEMPRGDTSSLRYDFRYSEDREQVRGFEAEEGLMLAADIMRGEDFTPAEEFVPQEELGAAKKVPAEEGVMEEAELVSEETEGWEEVELELDEATRMNVVTSALEASGLGPSHLDMNYVLQQLANWQDAHYRRQLRWKMLQKGECPHGALPAASRTSCRSSCR

SEQ ID NO: 39049 - protein, 619 aa, Homo sapiens
  Payload ID: 7825
  Gene Symbol: HAP1
  Gene Name: huntingtin-associated protein 1
  Uniprot ID: P54257
  ENSP ID: ENSP00000334002
MRPKRLGRCCAGSRLGPGDPAALTCAPSPSASPAPEPSAQPQARGTGQRVGSRATSGSQFLSEARTGARPASEAGAKAGARRPSAFSAIQGDVRSMPDNSDAPWTRFVFQGPFGSRATGRGTGKAAGIWKTPAAYVGRRPGVSGPERAAFIRELEEALCPNLPPPVKKITQEDVKVMLYLLEELLPPVWESVTYGMVLQRERDLNTAARIGQSLVKQNSVLMEENSKLEALLGSAKEEILYLRHQVNLRDELLQLYSDSDEEDEDEEEEEEEKEAEEEQEEEEAEEDLQCAHPCDAPKLISQEALLHQHHCPQLEALQEKLRLLEEENHQLREEASQLDTLEDEEQMLILECVEQFSEASQQMAELSEVLVLRLENYERQQQEVARLQAQVLKLQQRCRMYGAETEKLQKQLASEKEIQMQLQEEETLPGFQETLAEELRTSLRRMISDPVYFMERNYEMPRGDTSSLRYDFRYSEDREQVRGFEAEEGLMLAADIMRGEDFTPAEEFVPQEELGAAKKVPAEEGVMEEAELVSEETEGWEEVELELDEATRMNVVTSALEASGLGPSHLDMNYVLQQLANWQDAHYRRQLRWKMLQKGECPHGALPAASRTSCRSSCR

SEQ ID NO: 39050 - protein, 602 aa, Homo sapiens
  Payload ID: 7825
  Gene Symbol: HAP1
  Gene Name: huntingtin-associated protein 1
  Uniprot ID: P54257
  ENSP ID: ENSP00000343170
MRPKRLGRCCAGSRLGPGDPAALTCAPSPSASPAPEPSAQPQARGTGQRVGSRATSGSQFLSEARTGARPASEAGAKAGARRPSAFSAIQGDVRSMPDNSDAPWTRFVFQGPFGSRATGRGTGKAAGIWKTPAAYVGRRPGVSGPERAAFIRELEEALCPNLPPPVKKITQEDVKVMLYLLEEVCTAFLIQLLPPVWESVTYGMVLQRERDLNTAARIGQSLVKQNSVLMEENSKLEALLGSAKEEILYLRHQVNLRDELLQLYSDSDEEDEDEEEEEEEKEAEEEQEEEEAEEDLQCAHPCDAPKLISQEALLHQHHCPQLEALQEKLRLLEEENHQLREEASQLDTLEDEEQMLILECVEQFSEASQQMAELSEVLVLRLENYERQQQEVARLQAQVLKLQQRCRMETLPGFQETLAEELRTSLRRMISDPVYFMERNYEMPRGDTSSLRYDFRYSEDREQVRGFEAEEGLMLAADIMRGEDFTPAEEFVPQEELGAAKKVPAEEGVMEEAELVSEETEGWEEVELELDEATRMNVVTSALEASGLGPSHLDMNYVLQQLANWQDAHYRRQLRWKMLQKGECPHGALPAASRTSCRSSCR

SEQ ID NO: 39051 - protein, 594 aa, Homo sapiens
  Payload ID: 7825
  Gene Symbol: HAP1
  Gene Name: huntingtin-associated protein 1
  Uniprot ID: P54257
  ENSP ID: ENSP00000377513
MRPKRLGRCCAGSRLGPGDPAALTCAPSPSASPAPEPSAQPQARGTGQRVGSRATSGSQFLSEARTGARPASEAGAKAGARRPSAFSAIQGDVRSMPDNSDAPWTRFVFQGPFGSRATGRGTGKAAGIWKTPAAYVGRRPGVSGPERAAFIRELEEALCPNLPPPVKKITQEDVKVMLYLLEELLPPVWESVTYGMVLQRERDLNTAARIGQSLVKQNSVLMEENSKLEALLGSAKEEILYLRHQVNLRDELLQLYSDSDEEDEDEEEEEEEKEAEEEQEEEEAEEDLQCAHPCDAPKLISQEALLHQHHCPQLEALQEKLRLLEEENHQLREEASQLDTLEDEEQMLILECVEQFSEASQQMAELSEVLVLRLENYERQQQEVARLQAQVLKLQQRCRMETLPGFQETLAEELRTSLRRMISDPVYFMERNYEMPRGDTSSLRYDFRYSEDREQVRGFEAEEGLMLAADIMRGEDFTPAEEFVPQEELGAAKKVPAEEGVMEEAELVSEETEGWEEVELELDEATRMNVVTSALEASGLGPSHLDMNYVLQQLANWQDAHYRRQLRWKMLQKGECPHGALPAASRTSCRSSCR

SEQ ID NO: 39052 - protein, 73 aa, Homo sapiens
  Payload ID: 7825
  Gene Symbol: HAP1
  Gene Name: huntingtin-associated protein 1
  ENSP ID: ENSP00000388981
YSEDREQVRGFEAEEGLMLAADIMRGEDFTPAEEFVPQEELGAAKKQLANWQDAHYRRQLRWKMLQKEPQPRT

SEQ ID NO: 39053 - protein, 40 aa, Homo sapiens
  Payload ID: 7825
  Gene Symbol: HAP1
  Gene Name: huntingtin-associated protein 1
  ENSP ID: ENSP00000397242
  MOD_RES (1)..(1): Any amino acid
XNYEMPRGDTSSLRAPAEDLRWVEKTLSLLYSPQVAGSSR

SEQ ID NO: 39054 - protein, 111 aa, Homo sapiens
  Payload ID: 7825
  Gene Symbol: HAP1
  Gene Name: huntingtin-associated protein 1
  ENSP ID: ENSP00000404640
ADIMRGEDFTPAEEFVPQEELGAAKKVPAEEGVMEEAELVSEETEGWEEVELELDEATRMNVVTSALEASGLGPSHLDMNYVLQQLANWQDAHYRRQLRWKMLQKEPQPRT

SEQ ID NO: 39055 - protein, 280 aa, Homo sapiens
  Payload ID: 7826
  Gene Symbol: HUS1
  Gene Name: HUS1 checkpoint clamp component
  Uniprot ID: O60921
  ENSP ID: ENSP00000258774
MKFRAKIVDGACLNHFTRISNMIAKLAKTCTLRISPDKLNFILCDKLANGGVSMWCELEQENFFNEFQMEGVSAENNEIYLELTSENLSRALKTAQNARALKIKLTNKHFPCLTVSVELLSMSSSSRIVTHDIPIKVIPRKLWKDLQEPVVPDPDVSIYLPVLKTMKSVVEKMKNISNHLVIEANLDGELNLKIETELVCVTTHFKDLGNPPLASESTHEDRNVEHMAEVHIDIRKLLQFLAGQQVNPTKALCNIVNNKMVHFDLLHEDVSLQYFIPALS

SEQ ID NO: 39056 - protein, 145 aa, Homo sapiens
  Payload ID: 7826
  Gene Symbol: HUS1
  Gene Name: HUS1 checkpoint clamp component
  ENSP ID: ENSP00000398806
MIAKLAKTCTLRISPDKLNFILCDKLANGGVSMWCELEQENFFNEFQMEGVSAENNEIYLELTSENLSRALKTAQNARALKIKLTNKHFPCLTVSVELLSMSSSSRIVTHDIPIKVIPRKLWKDLQEPVVPDPDVSIYLPVLKTM

SEQ ID NO: 39057 - protein, 259 aa, Homo sapiens
  Payload ID: 7826
  Gene Symbol: HUS1
  Gene Name: HUS1 checkpoint clamp component
  Uniprot ID: O60921
  ENSP ID: ENSP00000400727
MIAKLAKTCTLRISPDKLNFILCDKLANGGVSMWCELEQENFFNEFQMEGVSAENNEIYLELTSENLSRALKTAQNARALKIKLTNKHFPCLTVSVELLSMSSSSRIVTHDIPIKVIPRKLWKDLQEPVVPDPDVSIYLPVLKTMKSVVEKMKNISNHLVIEANLDGELNLKIETELVCVTTHFKDLGNPPLASESTHEDRNVEHMAEVHIDIRKLLQFLAGQQVNPTKALCNIVNNKMVHFDLLHEDVSLQYFIPALS

SEQ ID NO: 39058 - protein, 280 aa, Homo sapiens; identical to SEQ ID NO: 39055
  Payload ID: 7826
  Gene Symbol: HUS1
  Gene Name: HUS1 checkpoint clamp component
  Uniprot ID: O60921
  ENSP ID: ENSP00000403844

SEQ ID NO: 39059 - protein, 105 aa, Homo sapiens
  Payload ID: 7826
  Gene Symbol: HUS1
  Gene Name: HUS1 checkpoint clamp component
  ENSP ID: ENSP00000404348
  MOD_RES (1)..(1): Any amino acid
XLELTSENLSRALKTAQNARALKIKLTNKHFPCLTVSVELLSMSSSSRIVTHDIPIKVIPRKLWKDLQEPVVPDPDVSIYLPVLKTMKSVVEKMKNISNHLVPSN

SEQ ID NO: 39060 - protein, 183 aa, Homo sapiens
  Payload ID: 7826
  Gene Symbol: HUS1
  Gene Name: HUS1 checkpoint clamp component
  ENSP ID: ENSP00000404855
MIAKLAKTCTLRISPDKLNFILCDKLANGGVSMWCELEQENFFNEFQMEGVSAENNEIYLELTSENLSRALKTAQNARALKIKLTNKHFPCLTVSVELLSMSSSSRIVTHDIPIKVIPRKLWKDLQEPVVPDPDVSIYLPVLKTMKSVVEKMKNISNHLVIEANLDGELNLKIETELVCVTTH

SEQ ID NO: 39061 - protein, 160 aa, Homo sapiens
  Payload ID: 7826
  Gene Symbol: HUS1
  Gene Name: HUS1 checkpoint clamp component
  ENSP ID: ENSP00000405175
MIAKLAKTCTLRISPDKLNFILCDKLANGGVSMWCELEQENFFNEFQMEGVSAENNEIYLELTSENLSRALKTAQNARALKIKLTNKHFPCLTVSVELLSMSSSSRIVTHDIPIKVIPRKLWKDLQEPVVPDPDDLIFSSAGQERYLDVHESQEEKNFMA

SEQ ID NO: 39062 - protein, 259 aa, Homo sapiens; identical to SEQ ID NO: 39057
  Payload ID: 7826
  Gene Symbol: HUS1
  Gene Name: HUS1 checkpoint clamp component
  Uniprot ID: O60921
  ENSP ID: ENSP00000416588

SEQ ID NO: 39063 - protein, 278 aa, Homo sapiens
  Payload ID: 7827
  Gene Symbol: HUS1B
  Gene Name: HUS1 checkpoint clamp component B
  Uniprot ID: Q8NHY5
  ENSP ID: ENSP00000370293
MKFRAKITGKGCLELFIHVSGTVARLAKVCVLRVRPDSLCFGPAGSGGLHEARLWCEVRQGAFQQFRMEGVSEDLDEIHLELTAEHLSRAARSAAGASSLKLQLTHKRRPSLTVAVELVSSLGRARSVVHDLPVRVLPRRVWRDCLPPSLRASDASIRLPRWRTLRSIVERMANVGSHVLVEANLSGRMTLSIETEVVSIQSYFKNLGNPPQSAVGVPENRDLESMVQVRVDNRKLLQFLEGQQIHPTTALCNIWDNTLLQLVLVQEDVSLQYFIPAL

SEQ ID NO: 39064 - protein, 354 aa, Homo sapiens
  Payload ID: 7828
  Gene Symbol: HAPLN1
  Gene Name: hyaluronan and proteoglycan link protein 1
  Uniprot ID: P10915
  ENSP ID: ENSP00000274341
MKSLLLLVLISICWADHLSDNYTLDHDRAIHIQAENGPHLLVEAEQAKVFSHRGGNVTLPCKFYRDPTAFGSGIHKIRIKWTKLTSDYLKEVDVFVSMGYHKKTYGGYQGRVFLKGGSDSDASLVITDLTLEDYGRYKCEVIEGLEDDTVVVALDLQGVVFPYFPRLGRYNLNFHEAQQACLDQDAVIASFDQLYDAWRGGLDWCNAGWLSDGSVQYPITKPREPCGGQNTVPGVRNYGFWDKDKSRYDVFCFTSNFNGRFYYLIHPTKLTYDEAVQACLNDGAQIAKVGQIFAAWKILGYDRCDAGWLADGSVRYPISRPRRRCSPTEAAVRFVGFPDKKHKLYGVYCFRAYN

SEQ ID NO: 39065 - protein, 199 aa, Homo sapiens
  Payload ID: 7828
  Gene Symbol: HAPLN1
  Gene Name: hyaluronan and proteoglycan link protein 1
  ENSP ID: ENSP00000421341
MKSLLLLVLISICWADHLSDNYTLDHDRAIHIQAENGPHLLVEAEQAKVFSHRGGNVTLPCKFYRDPTAFGSGIHKIRIKWTKLTSDYLKEVDVFVSMGYHKKTYGGYQGRVFLKGGSDSDASLVITDLTLEDYGRYKCEVIEGLEDDTVVVALDLQGVVFPYFPRLGRYNLNFHEAQQACLDQDAVIASFDQLYDAWR

SEQ ID NO: 39066 - protein, 161 aa, Homo sapiens
  Payload ID: 7828
  Gene Symbol: HAPLN1
  Gene Name: hyaluronan and proteoglycan link protein 1
  ENSP ID: ENSP00000421726
MKSLLLLVLISICWADHLSDNYTLDHDRAIHIQAENGPHLLVEAEQAKVFSHRGGNVTLPCKFYRDPTAFGSGIHKIRIKWTKLTSDYLKEVDVFVSMGYHKKTYGGYQGRVFLKGGSDSDASLVITDLTLEDYGRYKCEVIEGLEDDTVVVALDLQGMYL

SEQ ID NO: 39067 - protein, 169 aa, Homo sapiens
  Payload ID: 7828
  Gene Symbol: HAPLN1
  Gene Name: hyaluronan and proteoglycan link protein 1
  ENSP ID: ENSP00000422522
MKSLLLLVLISICWADHLSDNYTLDHDRAIHIQAENGPHLLVEAEQAKVFSHRGGNVTLPCKFYRDPTAFGSGIHKIRIKWTKLTSDYLKEVDVFVSMGYHKKTYGGYQGRVFLKGGSDSDASLVITDLTLEDYGRYKCEVIEGLEDDTVVVALDLQGVVFPYFPRLGR

SEQ ID NO: 39068 - protein, 258 aa, Homo sapiens
  Payload ID: 7828
  Gene Symbol: HAPLN1
  Gene Name: hyaluronan and proteoglycan link protein 1
  ENSP ID: ENSP00000422592
MKSLLLLVLISICWADHLSDNYTLDHDRAIHIQAENGPHLLVEAEQAKVFSHRGGNVTLPCKFYRDPTAFGSGIHKIRIKWTKLTSDYLKEVDVFVSMGYHKKTYGGYQGRVFLKGGSDSDASLVITDLTLEDYGRYKCEVIEGLEDDTVVVALDLQGVVFPYFPRLGRYNLNFHEAQQACLDQDAVIASFDQLYDAWRGGLDWCNAGWLSDGSVQYPITKPREPCGGQNTVPGVRNYGFWDKDKSRYDVFCFTSNFN

SEQ ID NO: 39069 - protein, 153 aa, Homo sapiens
  Payload ID: 7828
  Gene Symbol: HAPLN1
  Gene Name: hyaluronan and proteoglycan link protein 1
  ENSP ID: ENSP00000423836
MKSLLLLVLISICWADHLSDNYTLDHDRAIHIQAENGPHLLVEAEQAKVFSHRGGNVTLPCKFYRDPTAFGSGIHKIRIKWTKLTSDYLKEVDVFVSMGYHKKTYGGYQGRVFLKGGSDSDASLVITDLTLEDYGRYKCEVIEGLEDDTVVVA

SEQ ID NO: 39070 - protein, 182 aa, Homo sapiens
  Payload ID: 7828
  Gene Symbol: HAPLN1
  Gene Name: hyaluronan and proteoglycan link protein 1
  ENSP ID: ENSP00000426610
MKSLLLLVLISICWADHLSDNYTLDHDRAIHIQENGPHLLVEAEQAKVFSHRGGNVTLPCKFYRDPTAFGSGIHKIRIKWTKLTSDYLKEVDVFVSMGYHKKTYGGYQGRVFLKGGSDSDASLVITDLTLEDYGRYKCEVIEGLEDDTVVVALDLQGVVFPYFPRLGRYNLNFHEAQQACLD

SEQ ID NO: 39071 - protein, 340 aa, Homo sapiens
  Payload ID: 7829
  Gene Symbol: HAPLN2
  Gene Name: hyaluronan and proteoglycan link protein 2
  Uniprot ID: Q9GZV7
  ENSP ID: ENSP00000255039
MPGWLTLPTLCRFLLWAFTIFHKAQGDPASHPGPHYLLPPIHEVIHSHRGATATLPCVLGTTPPSYKVRWSKVEPGELRETLILITNGLHARGYGPLGGRARMRRGHRLDASLVIAGVRLEDEGRYRCELINGIEDESVALTLSLEGVVFPYQPSRGRYQFNYYEAKQACEEQDGRLATYSQLYQAWTEGLDWCNAGWLLEGSVRYPVLTARAPCGGRGRPGIRSYGPRDRMRDRYDAFCFTSALAGQVFFVPGRLTLSEAHAACRRRGAVVAKVGHLYAAWKFSGLDQCDGGWLADGSVRFPITTPRPRCGGLPDPGVRSFGFPRPQQAAYGTYCYAEN

SEQ ID NO: 39072 - protein, 185 aa, Homo sapiens
  Payload ID: 7829
  Gene Symbol: HAPLN2
  Gene Name: hyaluronan and proteoglycan link protein 2
  ENSP ID: ENSP00000388835
MPGWLTLPTLCRFLLWAFTIFHKAQGDPASHPGPHYLLPPIHEVIHSHRGATATLPCVLGTTPPSYKVRWSKVEPGELRETLILITNGLHARGYGPLGGRARMRRGHRLDASLVIAGVRLEDEGRYRCELINGIEDESVALTLSLEGVVFPYQPSRGRYQFNYYEAKQACEEQDGRLATYSQLYQ

SEQ ID NO: 39073 - protein, 360 aa, Homo sapiens
  Payload ID: 7830
  Gene Symbol: HAPLN3
  Gene Name: hyaluronan and proteoglycan link protein 3
  Uniprot ID: Q96S86
  ENSP ID: ENSP00000352606
MGLLLLVPLLLLPGSYGLPFYNGFYYSNSANDQNLGNGHGKDLLNGVKLVVETPEETLFTYQGASVILPCRYRYEPALVSPRRVRVKWWKLSENGAPEKDVLVAIGLRHRSFGDYQGRVHLRQDKEHDVSLEIQDLRLEDYGRYRCEVIDGLEDESGLVELELRGVVFPYQSPNGRYQFNFHEGQQVCAEQAAVVASFEQLFRAWEEGLDWCNAGWLQDATVQYPIMLPRQPCGGPGLAPGVRSYGPRHRRLHRYDVFCFATALKGRVYYLEHPEKLTLTEAREACQEDDATIAKVGQLFAAWKFHGLDRCDAGWLADGSVRYPVVHPHPNCGPPEPGVRSFGFPDPQSRLYGVYCYRQH

SEQ ID NO: 39074 - protein, 186 aa, Homo sapiens
  Payload ID: 7830
  Gene Symbol: HAPLN3
  Gene Name: hyaluronan and proteoglycan link protein 3
  ENSP ID: ENSP00000456458
MGLLLLVPLLLLPGSYGLPFYNGFYYSNSANDQNLGNGHGKDLLNGVKLVVETPEETLFTYQGASVILPCRYRYEPALVSPRRVRVKWWKLSENGAPEKDVLVAIGLRHRSFGDYQGRVHLRQDKEHDVSLEIQDLRLEDYGRYRCEVIDGLEDESGLVELELRGWGCVSSHLSHMLGRQFGDRGR

SEQ ID NO: 39075 - protein, 226 aa, Homo sapiens
  Payload ID: 7830
  Gene Symbol: HAPLN3
  Gene Name: hyaluronan and proteoglycan link protein 3
  ENSP ID: ENSP00000456985
MGLLLLVPLLLLPGSYGLPFYNGFYYSNSANDQNLGNGHGKDLLNGVKLVVETPEETLFTYQGASVILPCRYRYEPALVSPRRVRVKWWKLSENGAPEKDVLVAIGLRHRSFGDYQGRVHLRQDKEHDVSLEIQDLRLEDYGRYRCEVIDGLEDESGLVELELRAESQERGGNGQEVWSFLTSPPTGATSSTSTRASRSVQSRLRWWPPLSSSSGPGRRAWTGATR

SEQ ID NO: 39076 - protein, 422 aa, Homo sapiens
  Payload ID: 7830
  Gene Symbol: HAPLN3
  Gene Name: hyaluronan and proteoglycan link protein 3
  ENSP ID: ENSP00000457180
MRKWRHREVNLPEVTQQDAVCPAPIPSPGLSAQTGLQKIWGTIHCQVCPGAPAWPGSPWHEEMGLLLLVPLLLLPGSYGLPFYNGFYYSNSANDQNLGNGHGKDLLNGVKLVVETPEETLFTYQGASVILPCRYRYEPALVSPRRVRVKWWKLSENGAPEKDVLVAIGLRHRSFGDYQGRVHLRQDKEHDVSLEIQDLRLEDYGRYRCEVIDGLEDESGLVELELRGVVFPYQSPNGRYQFNFHEGQQVCAEQAAVVASFEQLFRAWEEGLDWCNAGWLQDATVQYPIMLPRQPCGGPGLAPGVRSYGPRHRRLHRYDVFCFATALKGRVYYLEHPEKLTLTEAREACQEDDATIAKVGQLFAAWKFHGLDRCDAGWLADGSVRYPVVHPHPNCGPPEPGVRSFGFPDPQSRLYGVYCYRQH

SEQ ID NO: 39077 - protein, 402 aa, Homo sapiens
  Payload ID: 7831
  Gene Symbol: HAPLN4
  Gene Name: hyaluronan and proteoglycan link protein 4
  Uniprot ID: Q86UW8
  ENSP ID: ENSP00000291481
MVCARAALGPGALWAAAWGVLLLTAPAGAQRGRKKVVHVLEGESGSVVVQTAPGQVVSHRGGTIVLPCRYHYEAAAHGHDGVRLKWTKVVDPLAFTDVFVALGPQHRAFGSYRGRAELQGDGPGDASLVLRNVTLQDYGRYECEVTNELEDDAGMVKLDLEGVVFPYHPRGGRYKLTFAEAQRACAEQDGILASAEQLHAAWRDGLDWCNAGWLRDGSVQYPVNRPREPCGGLGGTGSAGGGGDANGGLRNYGYRHNAEERYDAFCFTSNLPGRVFFLKPLRPVPFSGAARACAARGAAVAKVGQLFAAWKLQLLDRCTAGWLADGSARYPIVNPRARCGGRRPGVRSLGFPDATRRLFGVYCYRAPGAPDPAPGGWGWGWAGGGGWAGGARDPAAWTPLHV

SEQ ID NO: 39078 - protein, 560 aa, Homo sapiens
  Payload ID: 7832
  Gene Symbol: HABP2
  Gene Name: hyaluronan binding protein 2
  Uniprot ID: Q14520
  ENSP ID: ENSP00000277903
MFARMSDLHVLLLMALVGKTACGFSLMSLLESLDPDWTPDQYDYSYEDYNQEENTSSTLTHAENPDWYYTEDQADPCQPNPCEHGGDCLVHGSTFTCSCLAPFSGNKCQKVQNTCKDNPCGRGQCLITQSPPYYRCVCKHPYTGPSCSQVVPVCRPNPCQNGATCSRHKRRSKFTCACPDQFKGKFCEIGSDDCYVGDGYSYRGKMNRTVNQHACLYWNSHLLLQENYNMFMEDAETHGIGEHNFCRNPDADEKPWCFIKVTNDKVKWEYCDVSACSAQDVAYPEESPTEPSTKLPGFDSCGKTEIAERKIKRIYGGFKSTAGKHPWQASLQSSLPLTISMPQGHFCGGALIHPCWVLTAAHCTDIKTRHLKVVLGDQDLKKEEFHEQSFRVEKIFKYSHYNERDEIPHNDIALLKLKPVDGHCALESKYVKTVCLPDGSFPSGSECHISGWGVTETGKGSRQLLDAKVKLIANTLCNSRQLYDHMIDDSMICAGNLQKPGQDTCQGDSGGPLTCEKDGTYYVYGIVSWGLECGKRPGVYTQVTKFLNWIKATIKSESGF

SEQ ID NO: 39079 - protein, 534 aa, Homo sapiens
  Payload ID: 7832
  Gene Symbol: HABP2
  Gene Name: hyaluronan binding protein 2
  Uniprot ID: Q14520
  ENSP ID: ENSP00000443283
MSLLESLDPDWTPDQYDYSYEDYNQEENTSSTLTHAENPDWYYTEDQADPCQPNPCEHGGDCLVHGSTFTCSCLAPFSGNKCQKVQNTCKDNPCGRGQCLITQSPPYYRCVCKHPYTGPSCSQVVPVCRPNPCQNGATCSRHKRRSKFTCACPDQFKGKFCEIGSDDCYVGDGYSYRGKMNRTVNQHACLYWNSHLLLQENYNMFMEDAETHGIGEHNFCRNPDADEKPWCFIKVTNDKVKWEYCDVSACSAQDVAYPEESPTEPSTKLPGFDSCGKTEIAERKIKRIYGGFKSTAGKHPWQASLQSSLPLTISMPQGHFCGGALIHPCWVLTAAHCTDIKTRHLKVVLGDQDLKKEEFHEQSFRVEKIFKYSHYNERDEIPHNDIALLKLKPVDGHCALESKYVKTVCLPDGSFPSGSECHISGWGVTETGKGSRQLLDAKVKLIANTLCNSRQLYDHMIDDSMICAGNLQKPGQDTCQGDSGGPLTCEKDGTYYVYGIVSWGLECGKRPGVYTQVTKFLNWIKATIKSESGF

SEQ ID NO: 39080 - protein, 413 aa, Homo sapiens
  Payload ID: 7833
  Gene Symbol: HABP4
  Gene Name: hyaluronan binding protein 4
  Uniprot ID: Q5JVS0
  ENSP ID: ENSP00000364398
MKGALGSPVAAAGAAMQESFGCVVANRFHQLLDDESDPFDILREAERRRQQQLQRKRRDEAAAAAGAGPRGGRSPAGASGHRAGAGGRRESQKERKSLPAPVAQRPDSPGGGLQAPGQKRTPRRGEQQGWNDSRGPEGMLERAERRSYREYRPYETERQADFTAEKFPDEKPGDRFDRDRPLRGRGGPRGGMRGRGRGGPGNRVFDAFDQRGKREFERYGGNDKIAVRTEDNMGGCGVRTWGSGKDTSDVEPTAPMEEPTVVEESQGTPEEESPAKVPELEVEEETQVQEMTLDEWKNLQEQTRPKPEFNIRKPESTVPSKAVVIHKSKYRDDMVKDDYEDDSHVFRKPANDITSQLEINFGNLPRPGRGARGGTRGGRGRIRRAENYGPRAEVVMQDVAPNPDDPEDFPALS

SEQ ID NO: 39081 - protein, 308 aa, Homo sapiens
  Payload ID: 7833
  Gene Symbol: HABP4
  Gene Name: hyaluronan binding protein 4
  Uniprot ID: Q5JVS0
  ENSP ID: ENSP00000364400
MKGALGSPVAAAGAAMQESFGCVVANRFHQLLDDESDPFDILREAERRRQQQLQRKRRDEAAAAAGAGPRGGRSPAGASGHRAGAGGRRESQKERKSLPAPVAQRPDSPGGGLQAPGQKRTPRRGEQQGWNDSRGPEGMLERAERRSYREYRPYETERQADFTAEKFPDEKVPELEVEEETQVQEMTLDEWKNLQEQTRPKPEFNIRKPESTVPSKAVVIHKSKYRDDMVKDDYEDDSHVFRKPANDITSQLEINFGNLPRPGRGARGGTRGGRGRIRRAENYGPRAEVVMQDVAPNPDDPEDFPALS

SEQ ID NO: 39082 - protein, 578 aa, Homo sapiens
  Payload ID: 7834
  Gene Symbol: HAS1
  Gene Name: hyaluronan synthase 1
  Uniprot ID: Q92839
  ENSP ID: ENSP00000222115
MRQQDAPKPTPAACRCSGLARRVLTIAFALLILGLMTWAYAAGVPLASDRYGLLAFGLYGAFLSAHLVAQSLFAYLEHRRVAAAARGPLDAATARSVALTISAYQEDPAYLRQCLASARALLYPRARLRVLMVVDGNRAEDLYMVDMFREVFADEDPATYVWDGNYHQPWEPAAAGAVGAGAYREVEAEDPGRLAVEALVRTRRCVCVAQRWGGKREVMYTAFKALGDSVDYVQVCDSDTRLDPMALLELVRVLDEDPRVGAVGGDVRILNPLDSWVSFLSSLRYWVAFNVERACQSYFHCVSCISGPLGLYRNNLLQQFLEAWYNQKFLGTHCTFGDDRHLTNRMLSMGYATKYTSRSRCYSETPSSFLRWLSQQTRWSKSYFREWLYNALWWHRHHAWMTYEAVVSGLFPFFVAATVLRLFYAGRPWALLWVLLCVQGVALAKAAFAAWLRGCLRMVLLSLYAPLYMCGLLPAKFLALVTMNQSGWGTSGRRKLAANYVPLLPLALWALLLLGGLVRSVAHEARADWSGPSRAAEAYHLAAGAGAYVGYWVAMLTLYWVGVRRLCRRRTGGYRVQV

SEQ ID NO: 39083 - protein, 577 aa, Homo sapiens
  Payload ID: 7834
  Gene Symbol: HAS1
  Gene Name: hyaluronan synthase 1
  ENSP ID: ENSP00000445021
MRQDAPKPTPAACRCSGLARRVLTIAFALLILGLMTWAYAAGVPLASDRYGLLAFGLYGAFLSAHLVAQSLFAYLEHRRVAAAARGPLDAATARSVALTISAYQEDPAYLRQCLASARALLYPRARLRVLMVVDGNRAEDLYMVDMFREVFADEDPATYVWDGNYHQPWEPAAAGAVGAGAYREVEAEDPGRLAVEALVRTRRCVCVAQRWGGKREVMYTAFKALGDSVDYVQVCDSDTRLDPMALLELVRVLDEDPRVGAVGGDVRILNPLDSWVSFLSSLRYWVAFNVERACQSYFHCVSCISGPLGLYRNNLLQQFLEAWYNQKFLGTHCTFGDDRHLTNRMLSMGYATKYTSRSRCYSETPSSFLRWLSQQTRWSKSYFREWLYNALWWHRHHAWMTYEAVVSGLFPFFVAATVLRLFYAGRPWALLWVLLCVQGVALAKAAFAAWLRGCLRMVLLSLYAPLYMCGLLPAKFLALVTMNQSGWGTSGRRKLAANYVPLLPLALWALLLLGGLVRSVAHEARADWSGPSRAAEAYHLAAGAGAYVGYWVAMLTLYWVGVRRLCRRRTGGYRVQV

SEQ ID NO: 39084 - protein, 214 aa, Homo sapiens
  Payload ID: 7834
  Gene Symbol: HAS1
  Gene Name: hyaluronan synthase 1
  ENSP ID: ENSP00000469165
MFREVFADEDPATYVWDGNYHQPWEPAAAGAVGAGAYREVEAEDPGRLAVEALVRTRRCVCVAQRWGGKREVMYTAFKALGDSVDYVQVCDSDTRLDPMALLELVRVLDEDPRVGAVGGDVRILNPLDSWVSFLSSLRYWVAFNVERACQSYFHCVSCISGPLESCPGPREHAMMPSFLAPVQVHLQVPLLLRDALVLPAVAEPADTLVQVVLP

SEQ ID NO: 39085 - protein, 140 aa, Homo sapiens
  Payload ID: 7834
  Gene Symbol: HAS1
  Gene Name: hyaluronan synthase 1
  ENSP ID: ENSP00000471953
  MOD_RES (1)..(1): Any amino acid
XREVMYTAFKALGDSVDYVQVCDSDTRLDPMALLELVRVLDEDPRVGAVGGDVRILNPLDSWVSFLSSLRYWVAFNVERACQSYFHCVSCISGPLGLYRNNLLQQFLEAWYNQKFLGTHCTFGDDRHLTNRMLSMGYATK

SEQ ID NO: 39086 - protein, 585 aa, Homo sapiens
  Payload ID: 7834
  Gene Symbol: HAS1
  Gene Name: hyaluronan synthase 1
  ENSP ID: ENSP00000472821
MPLPFPSRSQQDAPKPTPAACRCSGLARRVLTIAFALLILGLMTWAYAAGVPLASDRYGLLAFGLYGAFLSAHLVAQSLFAYLEHRRVAAAARGPLDAATARSVALTISAYQEDPAYLRQCLASARALLYPRARLRVLMVVDGNRAEDLYMVDMFREVFADEDPATYVWDGNYHQPWEPAAAGAVGAGAYREVEAEDPGRLAVEALVRTRRCVCVAQRWGGKREVMYTAFKALGDSVDYVQVCDSDTRLDPMALLELVRVLDEDPRVGAVGGDVRILNPLDSWVSFLSSLRYWVAFNVERACQSYFHCVSCISGPLGLYRNNLLQQFLEAWYNQKFLGTHCTFGDDRHLTNRMLSMGYATKYTSRSRCYSETPSSFLRWLSQQTRWSKSYFREWLYNALWWHRHHAWMTYEAVVSGLFPFFVAATVLRLFYAGRPWALLWVLLCVQGVALAKAAFAAWLRGCLRMVLLSLYAPLYMCGLLPAKFLALVTMNQSGWGTSGRRKLAANYVPLLPLALWALLLLGGLVRSVAHEARADWSGPSRAAEAYHLAAGAGAYVGYWVAMLTLYWVGVRRLCRRRTGGYRVQV

SEQ ID NO: 39087 - protein, 552 aa, Homo sapiens
  Payload ID: 7835
  Gene Symbol: HAS2
  Gene Name: hyaluronan synthase 2
  Uniprot ID: Q92819
  ENSP ID: ENSP00000306991
MHCERFLCILRIIGTTLFGVSLLLGITAAYIVGYQFIQTDNYYFSFGLYGAFLASHLIIQSLFAFLEHRKMKKSLETPIKLNKTVALCIAAYQEDPDYLRKCLQSVKRLTYPGIKVVMVIDGNSEDDLYMMDIFSEVMGRDKSATYIWKNNFHEKGPGETDESHKESSQHVTQLVLSNKSICIMQKWGGKREVMYTAFRALGRSVDYVQVCDSDTMLDPASSVEMVKVLEEDPMVGGVGGDVQILNKYDSWISFLSSVRYWMAFNIERACQSYFGCVQCISGPLGMYRNSLLHEFVEDWYNQEFMGNQCSFGDDRHLTNRVLSLGYATKYTARSKCLTETPIEYLRWLNQQTRWSKSYFREWLYNAMWFHKHHLWMTYEAIITGFFPFFLIATVIQLFYRGKIWNILLFLLTVQLVGLIKSSFASCLRGNIVMVFMSLYSVLYMSSLLPAKMFAIATINKAGWGTSGRKTIVVNFIGLIPVSVWFTILLGGVIFTIYKESKRPFSESKQTVLIVGTLLYACYWVMLLTLYVVLINKCGRRKKGQQYDMVLDV

SEQ ID NO: 39088 - protein, 281 aa, Homo sapiens
  Payload ID: 7836
  Gene Symbol: HAS3
  Gene Name: hyaluronan synthase 3
  Uniprot ID: O00219
  ENSP ID: ENSP00000219322
MPVQLTTALRVVGTSLFALAVLGGILAAYVTGYQFIHTEKHYLSFGLYGAILGLHLLIQSLFAFLEHRRMRRAGQALKLPSPRRGSVALCIAAYQEDPDYLRKCLRSAQRISFPDLKVVMVVDGNRQEDAYMLDIFHEVLGGTEQAGFFVWRSNFHEAGEGETEASLQEGMDRVRDVVRASTFSCIMQKWGGKREVMYTAFKALGDSVDYIQVCDSDTVLDPACTIEMLRVLEEDPQVGGVGGDVQPPGKGMAVEDDQVQAAQVRATEAWSVHQRHVSREQ

SEQ ID NO: 39089 - protein, 553 aa, Homo sapiens
  Payload ID: 7836
  Gene Symbol: HAS3
  Gene Name: hyaluronan synthase 3
  Uniprot ID: O00219
  ENSP ID: ENSP00000304440
MPVQLTTALRVVGTSLFALAVLGGILAAYVTGYQFIHTEKHYLSFGLYGAILGLHLLIQSLFAFLEHRRMRRAGQALKLPSPRRGSVALCIAAYQEDPDYLRKCLRSAQRISFPDLKVVMVVDGNRQEDAYMLDIFHEVLGGTEQAGFFVWRSNFHEAGEGETEASLQEGMDRVRDVVRASTFSCIMQKWGGKREVMYTAFKALGDSVDYIQVCDSDTVLDPACTIEMLRVLEEDPQVGGVGGDVQILNKYDSWISFLSSVRYWMAFNVERACQSYFGCVQCISGPLGMYRNSLLQQFLEDWYHQKFLGSKCSFGDDRHLTNRVLSLGYRTKYTARSKCLTETPTKYLRWLNQQTRWSKSYFREWLYNSLWFHKHHLWMTYESVVTGFFPFFLIATVIQLFYRGRIWNILLFLLTVQLVGIIKATYACFLRGNAEMIFMSLYSLLYMSSLLPAKIFAIATINKSGWGTSGRKTIVVNFIGLIPVSIWVAVLLGGLAYTAYCQDLFSETELAFLVSGAILYGCYWVALLMLYLAIIARRCGKKPEQYSLAFAEV

SEQ ID NO: 39090 - protein, 553 aa, Homo sapiens; identical to SEQ ID NO: 39089
  Payload ID: 7836
  Gene Symbol: HAS3
  Gene Name: hyaluronan synthase 3
  Uniprot ID: O00219
  ENSP ID: ENSP00000454731

SEQ ID NO: 39091 - protein, 264 aa, Homo sapiens
  Payload ID: 7836
  Gene Symbol: HAS3
  Gene Name: hyaluronan synthase 3
  ENSP ID: ENSP00000456246
MPVQLTTALRVVGTSLFALAVLGGILAAYVTGYQFIHTEKHYLSFGLYGAILGLHLLIQSLFAFLEHRRMRRAGQALKLPSPRRGSVALCIAAYQEDPDYLRKCLRSAQRISFPDLKVVMVVDGNRQEDAYMLDIFHEVLGGTEQAGFFVWRSNFHEAGEGETEASLQEGMDRVRDVVRASTFSCIMQKWGGKREVMYTAFKALGDSVDYIQVCDSDTVLDPACTIEMLRVLEEDPQVGGVGGDVQILNKYDSWISFLSSVRYW

SEQ ID NO: 39092 - protein, 709 aa, Homo sapiens
  Payload ID: 7837
  Gene Symbol: HMMR
  Gene Name: hyaluronan-mediated motility receptor (RHAMM)
  Uniprot ID: O75330
  ENSP ID: ENSP00000185942
MSFPKAPLKRFNDPSGCAPSPGAYDVKTLEVLKGPVSFQKSQRFKQQKESKQNLNVDKDTTLPASARKVKSSESKIRVLLQERGAQDRRIQDLETELEKMEARLNAALREKTSLSANNATLEKQLIELTRTNELLKSKFSENGNQKNLRILSLELMKLRNKRETKMRGMMAKQEGMEMKLQVTQRSLEESQGKIAQLEGKLVSIEKEKIDEKSETEKLLEYIEEISCASDQVEKYKLDIAQLEENLKEKNDEILSLKQSLEENIVILSKQVEDLNVKCQLLEKEKEDHVNRNREHNENLNAEMQNLKQKFILEQQEREKLQQKELQIDSLLQQEKELSSSLHQKLCSFQEEMVKEKNLFEEELKQTLDELDKLQQKEEQAERLVKQLEEEAKSRAEELKLLEEKLKGKEAELEKSSAAHTQATLLLQEKYDSMVQSLEDVTAQFESYKALTASEIEDLKLENSSLQEKAAKAGKNAEDVQHQILATESSNQEYVRMLLDLQTKSALKETEIKEITVSFLQKITDLQNQLKQQEEDFRKQLEDEEGRKAEKENTTAELTEEINKWRLLYEELYNKTKPFQLQLDAFEVEKQALLNEHGAAQEQLNKIRDSYAKLLGHQNLKQKIKHVVKLKDENSQLKSEVSKLRCQLAKKKQSETKLQEELNKVLGIKHFDPSKAFHHESKENFALKTPLKEGNTNCYRAPMECQESWK

SEQ ID NO: 39093 - protein, 724 aa, Homo sapiens
  Payload ID: 7837
  Gene Symbol: HMMR
  Gene Name: hyaluronan-mediated motility receptor (RHAMM)
  Uniprot ID: O75330
  ENSP ID: ENSP00000351554
MSFPKAPLKRFNDPSGCAPSPGAYDVKTLEVLKGPVSFQKSQRFKQQKESKQNLNVDKDTTLPASARKVKSSESKESQKNDKDLKILEKEIRVLLQERGAQDRRIQDLETELEKMEARLNAALREKTSLSANNATLEKQLIELTRTNELLKSKFSENGNQKNLRILSLELMKLRNKRETKMRGMMAKQEGMEMKLQVTQRSLEESQGKIAQLEGKLVSIEKEKIDEKSETEKLLEYIEEISCASDQVEKYKLDIAQLEENLKEKNDEILSLKQSLEENIVILSKQVEDLNVKCQLLEKEKEDHVNRNREHNENLNAEMQNLKQKFILEQQEREKLQQKELQIDSLLQQEKELSSSLHQKLCSFQEEMVKEKNLFEEELKQTLDELDKLQQKEEQAERLVKQLEEEAKSRAEELKLLEEKLKGKEAELEKSSAAHTQATLLLQEKYDSMVQSLEDVTAQFESYKALTASEIEDLKLENSSLQEKAAKAGKNAEDVQHQILATESSNQEYVRMLLDLQTKSALKETEIKEITVSFLQKITDLQNQLKQQEEDFRKQLEDEEGRKAEKENTTAELTEEINKWRLLYEELYNKTKPFQLQLDAFEVEKQALLNEHGAAQEQLNKIRDSYAKLLGHQNLKQKIKHVVKLKDENSQLKSEVSKLRCQLAKKKQSETKLQEELNKVLGIKHFDPSKAFHHESKENFALKTPLKEGNTNCYRAPMECQESWK

SEQ ID NO: 39094 - protein, 725 aa, Homo sapiens
  Payload ID: 7837
  Gene Symbol: HMMR
  Gene Name: hyaluronan-mediated motility receptor (RHAMM)
  Uniprot ID: O75330
  ENSP ID: ENSP00000377492
MSFPKAPLKRFNDPSGCAPSPGAYDVKTLEVLKGPVSFQKSQRFKQQKESKQNLNVDKDTTLPASARKVKSSESKKESQKNDKDLKILEKEIRVLLQERGAQDRRIQDLETELEKMEARLNAALREKTSLSANNATLEKQLIELTRTNELLKSKFSENGNQKNLRILSLELMKLRNKRETKMRGMMAKQEGMEMKLQVTQRSLEESQGKIAQLEGKLVSIEKEKIDEKSETEKLLEYIEEISCASDQVEKYKLDIAQLEENLKEKNDEILSLKQSLEENIVILSKQVEDLNVKCQLLEKEKEDHVNRNREHNENLNAEMQNLKQKFILEQQEREKLQQKELQIDSLLQQEKELSSSLHQKLCSFQEEMVKEKNLFEEELKQTLDELDKLQQKEEQAERLVKQLEEEAKSRAEELKLLEEKLKGKEAELEKSSAAHTQATLLLQEKYDSMVQSLEDVTAQFESYKALTASEIEDLKLENSSLQEKAAKAGKNAEDVQHQILATESSNQEYVRMLLDLQTKSALKETEIKEITVSFLQKITDLQNQLKQQEEDFRKQLEDEEGRKAEKENTTAELTEEINKWRLLYEELYNKTKPFQLQLDAFEVEKQALLNEHGAAQEQLNKIRDSYAKLLGHQNLKQKIKHVVKLKDENSQLKSEVSKLRCQLAKKKQSETKLQEELNKVLGIKHFDPSKAFHHESKENFALKTPLKEGNTNCYRAPMECQESWK

SEQ ID NO: 39095 - protein, 638 aa, Homo sapiens
  Payload ID: 7837
  Gene Symbol: HMMR
  Gene Name: hyaluronan-mediated motility receptor (RHAMM)
  Uniprot ID: O75330
  ENSP ID: ENSP00000402673
MTLLIRVLLQERGAQDRRIQDLETELEKMEARLNAALREKTSLSANNATLEKQLIELTRTNELLKSKFSENGNQKNLRILSLELMKLRNKRETKMRGMMAKQEGMEMKLQVTQRSLEESQGKIAQLEGKLVSIEKEKIDEKSETEKLLEYIEEISCASDQVEKYKLDIAQLEENLKEKNDEILSLKQSLEENIVILSKQVEDLNVKCQLLEKEKEDHVNRNREHNENLNAEMQNLKQKFILEQQEREKLQQKELQIDSLLQQEKELSSSLHQKLCSFQEEMVKEKNLFEEELKQTLDELDKLQQKEEQAERLVKQLEEEAKSRAEELKLLEEKLKGKEAELEKSSAAHTQATLLLQEKYDSMVQSLEDVTAQFESYKALTASEIEDLKLENSSLQEKAAKAGKNAEDVQHQILATESSNQEYVRMLLDLQTKSALKETEIKEITVSFLQKITDLQNQLKQQEEDFRKQLEDEEGRKAEKENTTAELTEEINKWRLLYEELYNKTKPFQLQLDAFEVEKQALLNEHGAAQEQLNKIRDSYAKLLGHQNLKQKIKHVVKLKDENSQLKSEVSKLRCQLAKKKQSETKLQEELNKVLGIKHFDPSKAFHHESKENFALKTPLKEGNTNCYRAPMECQESWK

SEQ ID NO: 39096 - protein, 92 aa, Homo sapiens
  Payload ID: 7837
  Gene Symbol: HMMR
  Gene Name: hyaluronan-mediated motility receptor (RHAMM)
  ENSP ID: ENSP00000428406
MEARLNAALREKTSLSANNATLEKQLIELTRTNELLKSKFSENGNQKNLRILSLELMKLRNKRETKMRGMMAKQEGMEMKLQVTQRSLEESQ

SEQ ID NO: 39097 - protein, 101 aa, Homo sapiens
  Payload ID: 7837
  Gene Symbol: HMMR
  Gene Name: hyaluronan-mediated motility receptor (RHAMM)
  ENSP ID: ENSP00000428481
MEARLNAALREKTSLSANNATLEKQLIELTRTNELLKSKFSENGNQKNLRILSLELMKLRNKRETKMRGMMAKQEGMEMKLQVTQRSLEESQGKIAQLEGK

SEQ ID NO: 39098 - protein, 435 aa, Homo sapiens
  Payload ID: 7838
  Gene Symbol: HYAL1
  Gene Name: hyaluronoglucosaminidase 1
  Uniprot ID: Q12794
  ENSP ID: ENSP00000266031
MAAHLLPICALFLTLLDMAQGFRGPLLPNRPFTTVWNANTQWCLERHGVDVDVSVFDVVANPGQTFRGPDMTIFYSSQLGTYPYYTPTGEPVFGGLPQNASLIAHLARTFQDILAAIPAPDFSGLAVIDWEAWRPRWAFNWDTKDIYRQRSRALVQAQHPDWPAPQVEAVAQDQFQGAARAWMAGTLQLGRALRPRGLWGFYGFPDCYNYDFLSPNYTGQCPSGIRAQNDQLGWLWGQSRALYPSIYMPAVLEGTGKSQMYVQHRVAEAFRVAVAAGDPNLPVLPYVQIFYDTTNHFLPLDELEHSLGESAAQGAAGVVLWVSWENTRTKESCQAIKEYMDTTLGPFILNVTSGALLCSQALCSGHGRCVRRTSHPKALLLLNPASFSIQLTPGGGPLSLRGALSLEDQAQMAVEFKCRCYPGWQAPWCERKSMW

SEQ ID NO: 39099 - protein, 435 aa, Homo sapiens; identical to SEQ ID NO: 39098
  Payload ID: 7838
  Gene Symbol: HYAL1
  Gene Name: hyaluronoglucosaminidase 1
  Uniprot ID: Q12794
  ENSP ID: ENSP00000346068

SEQ ID NO: 39100 - protein, 405 aa, Homo sapiens
  Payload ID: 7838
  Gene Symbol: HYAL1
  Gene Name: hyaluronoglucosaminidase 1
  Uniprot ID: Q12794
  ENSP ID: ENSP00000378575
MAAHLLPICALFLTLLDMAQGFRGPLLPNRPFTTVWNANTQWCLERHGVDVDVSVFDVVANPGQTFRGPDMTIFYSSQLGTYPYYTPTGEPVFGGLPQNASLIAHLARTFQDILAAIPAPDFSGLAVIDWEAWRPRWAFNWDTKDIYRQRSRALVQAQHPDWPAPQVEAVAQDQFQGAARAWMAGTLQLGRALRPRGLWGFYGFPDCYNYDFLSPNYTGQCPSGIRAQNDQLGWLWGQSRALYPSIYMPAVLEGTGKSQMYVQHRVAEAFRVAVAAGDPNLPVLPYVQIFYDTTNHFLPLESCQAIKEYMDTTLGPFILNVTSGALLCSQALCSGHGRCVRRTSHPKALLLLNPASFSIQLTPGGGPLSLRGALSLEDQAQMAVEFKCRCYPGWQAPWCERKSMW

SEQ ID NO: 39101 - protein, 435 aa, Homo sapiens; identical to SEQ ID NO: 39098
  Payload ID: 7838
  Gene Symbol: HYAL1
  Gene Name: hyaluronoglucosaminidase 1
  Uniprot ID: Q12794
  ENSP ID: ENSP00000378576

SEQ ID NO: 39102 - protein, 176 aa, Homo sapiens
  Payload ID: 7838
  Gene Symbol: HYAL1
  Gene Name: hyaluronoglucosaminidase 1
  Uniprot ID: Q12794
  ENSP ID: ENSP00000390149
MYVQHRVAEAFRVAVAAGDPNLPVLPYVQIFYDTTNHFLPLDELEHSLGESAAQGAAGVVLWVSWENTRTKESCQAIKEYMDTTLGPFILNVTSGALLCSQALCSGHGRCVRRTSHPKALLLLNPASFSIQLTPGGGPLSLRGALSLEDQAQMAVEFKCRCYPGWQAPWCERKSMW

SEQ ID NO: 39103 - protein, 69 aa, Homo sapiens
  Payload ID: 7838
  Gene Symbol: HYAL1
  Gene Name: hyaluronoglucosaminidase 1
  ENSP ID: ENSP00000391666
MAAHLLPICALFLTLLDMAQGFRGPLLPNRPFTTVWNANTQWCLERHGVDVDVSVFDVVANPGQTFRGP

SEQ ID NO: 39104 - protein, 253 aa, Homo sapiens
  Payload ID: 7838
  Gene Symbol: HYAL1
  Gene Name: hyaluronoglucosaminidase 1
  Uniprot ID: Q12794
  ENSP ID: ENSP00000393358
MAGTLQLGRALRPRGLWGFYGFPDCYNYDFLSPNYTGQCPSGIRAQNDQLGWLWGQSRALYPSIYMPAVLEGTGKSQMYVQHRVAEAFRVAVAAGDPNLPVLPYVQIFYDTTNHFLPLDELEHSLGESAAQGAAGVVLWVSWENTRTKESCQAIKEYMDTTLGPFILNVTSGALLCSQALCSGHGRCVRRTSHPKALLLLNPASFSIQLTPGGGPLSLRGALSLEDQAQMAVEFKCRCYPGWQAPWCERKSMW

SEQ ID NO: 39105 - protein, 103 aa, Homo sapiens
  Payload ID: 7838
  Gene Symbol: HYAL1
  Gene Name: hyaluronoglucosaminidase 1
  ENSP ID: ENSP00000394526
MAAHLLPICALFLTLLDMAQGFRGPLLPNRPFTTVWNANTQWCLERHGVDVDVSVFDVVANPGQTFRGPDMTIFYSSQLGTYPYYTPTGEPVFGGLPQNASLI

SEQ ID NO: 39106 - protein, 435 aa, Homo sapiens; identical to SEQ ID NO: 39098
  Payload ID: 7838
  Gene Symbol: HYAL1
  Gene Name: hyaluronoglucosaminidase 1
  Uniprot ID: Q12794
  ENSP ID: ENSP00000477903

SEQ ID NO: 39107 - protein, 473 aa, Homo sapiens
  Payload ID: 7839
  Gene Symbol: HYAL2
  Gene Name: hyaluronoglucosaminidase 2
  Uniprot ID: Q12891
  ENSP ID: ENSP00000350387
MRAGPGPTVTLALVLAVSWAMELKPTAPPIFTGRPFVVAWDVPTQDCGPRLKVPLDLNAFDVQASPNEGFVNQNITIFYRDRLGLYPRFDSAGRSVHGGVPQNVSLWAHRKMLQKRVEHYIRTQESAGLAVIDWEDWRPVWVRNWQDKDVYRRLSRQLVASRHPDWPPDRIVKQAQYEFEFAAQQFMLETLRYVKAVRPRHLWGFYLFPDCYNHDYVQNWESYTGRCPDVEVARNDQLAWLWAESTALFPSVYLDETLASSRHGRNFVSFRVQEALRVARTHHANHALPVYVFTRPTYSRRLTGLSEMDLISTIGESAALGAAGVILWGDAGYTTSTETCQYLKDYLTRLLVPYVVNVSWATQYCSRAQCHGHGRCVRRNPSASTFLHLSTNSFRLVPGHAPGEPQLRPVGELSWADIDHLQTHFRCQCYLGWSGEQCQWDHRQAAGGASEAWAGSHLTSLLALAALAFTWTL

SEQ ID NO: 39108 - protein, 473 aa, Homo sapiens; identical to SEQ ID NO: 39107
  Payload ID: 7839
  Gene Symbol: HYAL2
  Gene Name: hyaluronoglucosaminidase 2
  Uniprot ID: Q12891
  ENSP ID: ENSP00000378571

SEQ ID NO: 39109 - protein, 117 aa, Homo sapiens
  Payload ID: 7839
  Gene Symbol: HYAL2
  Gene Name: hyaluronoglucosaminidase 2
  ENSP ID: ENSP00000398714
MRAGPGPTVTLALVLAVSWAMELKPTAPPIFTGRPFVVAWDVPTQDCGPRLKVPLDLNAFDVQASPNEGFVNQNITIFYRDRLGLYPRFDSAGRSVHGGVPQNVSLWAHRKMLQKRV

SEQ ID NO: 39110 - protein, 121 aa, Homo sapiens
  Payload ID: 7839
  Gene Symbol: HYAL2
  Gene Name: hyaluronoglucosaminidase 2
  ENSP ID: ENSP00000399677
MRAGPGPTVTLALVLAVSWAMELKPTAPPIFTGRPFVVAWDVPTQDCGPRLKVPLDLNAFDVQASPNEGFVNQNITIFYRDRLGLYPRFDSAGRSVHGGVPQNVSLWAHRKMLQKRVEHYI

SEQ ID NO: 39111 - protein, 473 aa, Homo sapiens; identical to SEQ ID NO: 39107
  Payload ID: 7839
  Gene Symbol: HYAL2
  Gene Name: hyaluronoglucosaminidase 2
  Uniprot ID: Q12891
  ENSP ID: ENSP00000401853

SEQ ID NO: 39112 - protein, 47 aa, Homo sapiens
  Payload ID: 7839
  Gene Symbol: HYAL2
  Gene Name: hyaluronoglucosaminidase 2
  ENSP ID: ENSP00000405855
MRAGPGPTVTLALVLAVSWAMELKPTAPPIFTGRPFVVAWDVPTQDC

SEQ ID NO: 39113 - protein, 473 aa, Homo sapiens; identical to SEQ ID NO: 39107
  Payload ID: 7839
  Gene Symbol: HYAL2
  Gene Name: hyaluronoglucosaminidase 2
  Uniprot ID: Q12891
  ENSP ID: ENSP00000406657

SEQ ID NO: 39114 - protein, 81 aa, Homo sapiens
  Payload ID: 7839
  Gene Symbol: HYAL2
  Gene Name: hyaluronoglucosaminidase 2
  ENSP ID: ENSP00000409642
MRAGPGPTVTLALVLAVSWAMELKPTAPPIFTGRPFVVAWDVPTQDCGPRLKVPLDLNAFDVQASPNEGFVNQNITIFYRD

SEQ ID NO: 39115 - protein, 76 aa, Homo sapiens
  Payload ID: 7839
  Gene Symbol: HYAL2
  Gene Name: hyaluronoglucosaminidase 2
  ENSP ID: ENSP00000414656
MRAGPGPTVTLALVLAVSWAMELKPTAPPIFTGRPFVVAWDVPTQDCGPRLKVPLDLNAFDVQASPNEGFVNQNIT

SEQ ID NO: 39116 - protein, 417 aa, Homo sapiens
  Payload ID: 7840
  Gene Symbol: HYAL3
  Gene Name: hyaluronoglucosaminidase 3
  Uniprot ID: O43820
  ENSP ID: ENSP00000337425
MTTQLGPALVLGVALCLGCGQPLPQVPERPFSVLWNVPSAHCEARFGVHLPLNALGIIANRGQHFHGQNMTIFYKNQLGLYPYFGPRGTAHNGGIPQALPLDRHLALAAYQIHHSLRPGFAGPAVLDWEEWCPLWAGNWGRRRAYQAASWAWAQQVFPDLDPQEQLYKAYTGFEQAARALMEDTLRVAQALRPHGLWGFYHYPACGNGWHSMASNYTGRCHAATLARNTQLHWLWAASSALFPSIYLPPRLPPAHHQAFVRHRLEEAFRVALVGHRHPLPVLAYVRLTHRRSGRFLSQDDLVQSIGVSAALGAAGVVLWGDLSLSSSEEECWHLHDYLVDTLGPYVINVTRAAMACSHQRCHGHGRCARRDPGQMEAFLHLWPDGSLGDWKSFSCHCYWGWAGPTCQEPRPGPKEAV

SEQ ID NO: 39117 - protein, 387 aa, Homo sapiens
  Payload ID: 7840
  Gene Symbol: HYAL3
  Gene Name: hyaluronoglucosaminidase 3
  Uniprot ID: O43820
  ENSP ID: ENSP00000351946
MTTQLGPALVLGVALCLGCGQPLPQVPERPFSVLWNVPSAHCEARFGVHLPLNALGIIANRGQHFHGQNMTIFYKNQLGLYPYFGPRGTAHNGGIPQALPLDRHLALAAYQIHHSLRPGFAGPAVLDWEEWCPLWAGNWGRRRAYQAASWAWAQQVFPDLDPQEQLYKAYTGFEQAARALMEDTLRVAQALRPHGLWGFYHYPACGNGWHSMASNYTGRCHAATLARNTQLHWLWAASSALFPSIYLPPRLPPAHHQAFVRHRLEEAFRVALVGHRHPLPVLAYVRLTHRRSGRFLSQEECWHLHDYLVDTLGPYVINVTRAAMACSHQRCHGHGRCARRDPGQMEAFLHLWPDGSLGDWKSFSCHCYWGWAGPTCQEPRPGPKEAV

SEQ ID NO: 39118 - protein, 159 aa, Homo sapiens
  Payload ID: 7840
  Gene Symbol: HYAL3
  Gene Name: hyaluronoglucosaminidase 3
  ENSP ID: ENSP00000391663
MTTQLGPALVLGVALCLGCGQPLPQVPERPFSVLWNVPSAHCEARFGVHLPLNALGIIANRGQHFHGQNMTIFYKNQLGLYPYFGPRGTAHNGGIPQALPLDRHLALAAYQIHHSLRPGFAGPAVLDWEEWCPLWAGNWGRRRAYQAASWAWAQQVFPD

SEQ ID NO: 39119 - protein, 387 aa, Homo sapiens; identical to SEQ ID NO: 39117
  Payload ID: 7840
  Gene Symbol: HYAL3
  Gene Name: hyaluronoglucosaminidase 3
  Uniprot ID: O43820
  ENSP ID: ENSP00000391922

SEQ ID NO: 39120 - protein, 168 aa, Homo sapiens
  Payload ID: 7840
  Gene Symbol: HYAL3
  Gene Name: hyaluronoglucosaminidase 3
  Uniprot ID: O43820
  ENSP ID: ENSP00000401092
MLPPAHHQAFVRHRLEEAFRVALVGHRHPLPVLAYVRLTHRRSGRFLSQDDLVQSIGVSAALGAAGVVLWGDLSLSSSEEECWHLHDYLVDTLGPYVINVTRAAMACSHQRCHGHGRCARRDPGQMEAFLHLWPDGSLGDWKSFSCHCYWGWAGPTCQEPRPGPKEAV

SEQ ID NO: 39121 - protein, 138 aa, Homo sapiens
  Payload ID: 7840
  Gene Symbol: HYAL3
  Gene Name: hyaluronoglucosaminidase 3
  Uniprot ID: O43820
  ENSP ID: ENSP00000424633
MLPPAHHQAFVRHRLEEAFRVALVGHRHPLPVLAYVRLTHRRSGRFLSQEECWHLHDYLVDTLGPYVINVTRAAMACSHQRCHGHGRCARRDPGQMEAFLHLWPDGSLGDWKSFSCHCYWGWAGPTCQEPRPGPKEAV

SEQ ID NO: 39122 - protein, 417 aa, Homo sapiens; identical to SEQ ID NO: 39116
  Payload ID: 7840
  Gene Symbol: HYAL3
  Gene Name: hyaluronoglucosaminidase 3
  Uniprot ID: O43820
  ENSP ID: ENSP00000479935

SEQ ID NO: 39123 - protein, 481 aa, Homo sapiens
  Payload ID: 7841
  Gene Symbol: HYAL4
  Gene Name: hyaluronoglucosaminidase 4
  Uniprot ID: Q2M3T9
  ENSP ID: ENSP00000223026
MKVLSEGQLKLCVVQPVHLTSWLLIFFILKSISCLKPARLPIYQRKPFIAAWNAPTDQCLIKYNLRLNLKMFPVIGSPLAKARGQNVTIFYVNRLGYYPWYTSQGVPINGGLPQNISLQVHLEKADQDINYYIPAEDFSGLAVIDWEYWRPQWARNWNSKDVYRQKSRKLISDMGKNVSATDIEYLAKVTFEESAKAFMKETIKLGIKSRPKGLWGYYLYPDCHNYNVYAPNYSGSCPEDEVLRNNELSWLWNSSAALYPSIGVWKSLGDSENILRFSKFRVHESMRISTMTSHDYALPVFVYTRLGYRDEPLFFLSKQDLVSTIGESAALGAAGIVIWGDMNLTASKANCTKVKQFVSSDLGSYIANVTRAAEVCSLHLCRNNGRCIRKMWNAPSYLHLNPASYHIEASEDGEFTVKGKASDTDLAVMADTFSCHCYQGYEGADCREIKTADGCSGVSPSPGSLMTLCLLLLASYRSIQL

SEQ ID NO: 39124 - protein, 481 aa, Homo sapiens; identical to SEQ ID NO: 39123
  Payload ID: 7841
  Gene Symbol: HYAL4
  Gene Name: hyaluronoglucosaminidase 4
  Uniprot ID: Q2M3T9
  ENSP ID: ENSP00000417186

SEQ ID NO: 39125 - protein, 45 aa, Homo sapiens
  Payload ID: 7841
  Gene Symbol: HYAL4
  Gene Name: hyaluronoglucosaminidase 4
  ENSP ID: ENSP00000417872
MKVLSEGQLKLCVVQPVHLTSWLLIFFILKSISCLKPARLPIYQR

SEQ ID NO: 39126 - protein, 63 aa, Homo sapiens
  Payload ID: 7841
  Gene Symbol: HYAL4
  Gene Name: hyaluronoglucosaminidase 4
  ENSP ID: ENSP00000419522
MKVLSEGQLKLCVVQPVHLTSWLLIFFILKSISCLKPARLPIYQRKPFIAAWNAPTDQCLIKY

SEQ ID NO: 39127 - protein, 349 aa, Homo sapiens
  Payload ID: 7841
  Gene Symbol: HYAL4
  Gene Name: hyaluronoglucosaminidase 4
  ENSP ID: ENSP00000420264
MKVLSEGQLKLCVVQPVHLTSWLLIFFILKSISCLKPARLPIYQRKPFIAAWNAPTDQCLIKYNLRLNLKMFPVIGSPLAKARGQNVTIFYVNRLGYYPWYTSQGVPINGGLPQNISLQVHLEKADQDINYYIPAEDFSGLAVIDWEYWRPQWARNWNSKDVYRQKSRKLISDMGKNVSATDIEYLAKVTFEESAKAFMKETIKLGIKSRPKGLWGYYLYPDCHNYNVYAPNYSGSCPEDEVLRNNELSWLWNSSAALYPSIGVWKSLGDSENILRFSKFRVHESMRISTMTSHDYALPVFVYTRLGYRDEPLFFLSKQDLVSTIGESAALGAAGIVIWGDMNLTASKV

SEQ ID NO: 39128 - protein, 151 aa, Homo sapiens
  Payload ID: 7842
  Gene Symbol:
  Gene Name: HYDIN
  ENSP ID: ENSP00000488915
  MOD_RES (1)..(1): Any amino acid
XPKVVTEEEVNRMLTPSEFLKEMSLTTEQRLAKTRLMCRPQIIELLDMGETTHQKFSGIDLDQALFQPFPSEIIFQNYTPCEVYEVPLILRNNDKIPRLVKVVEESSPYFKVISPKDIGHKVAPGVPSIFRILFTPEENKAFLYRTSYWNS

SEQ ID NO: 39129 - protein, 43 aa, Homo sapiens
  Payload ID: 7842
  Gene Symbol:
  Gene Name: HYDIN
  ENSP ID: ENSP00000488931
  MOD_RES (1)..(1): Any amino acid
XNSGRVQLEFSWVSEDTSKAVSFAKPDHQGFPTCHLESKVRSW

SEQ ID NO: 39130 - protein, 725 aa, Homo sapiens
  Payload ID: 7842
  Gene Symbol:
  Gene Name: HYDIN
  ENSP ID: ENSP00000488978
MESAGGFKLGEKKKLLKMTSRRLEESMGAVQMGLVNMFKGFQSKVLPPLSPKVVTEEEVNRMLTPSEFLKEMSLTTEQRLAKTRLMCRPQIIELLDMGETTHQKFSGIDLDQALFQPFPSEIIFQNYTPCEVYEVPLILRNNDKIPRLVKVVEESSPYFKVISPKDIGHKVAPGVPSIFRILFTPEENKDYAHTLTCVTEREKFIVPIKARGARAILDFPDKLNFSTCPVKYSTQKILLVRNIGNKNAVFHIKTCRPFSIEPAIGTLNVGESMQLEVEFEPQSVGDHSGRLIVCYDTGEKVFVSLYGAAIDMNIRLDKNSLTIEKTYISLANQRTITIHNRSNIIAHFLWKVFATQQEEDREKYRACDDLIKEEKDETDEFFEECITDPLLREHLSVLSRTFANQRRLVQGDSKLFFNNVFTVEPLEGDVWPNSSAEITVYFNPLEAKLYQQTIYCDILGREIRLPLRIKGEGMGPKIHFNFELLDIGKVFTGSAHCYEAILYNKGSIDALFNMTPPTSALGACFVFSPKEGIIEPSGVQAIQISFSSTILGNFEEEFLVNVNGSPEPVKLTIRGCVIGPTFHFNVPALHFGDVSFGFPHTLICSLNNTSLIPMTYKLRIPGDGLGHKSISYCEQHVDYKRPSWTKEEISSMKPKEFTISPDCGTIRPQGFAAIRVTLCSNTVQKYELALVVDVEGIGEEVLALLITARYCSPACSSPESPPSLQ

SEQ ID NO: 39131 - protein, 36 aa, Homo sapiens
  Payload ID: 7842
  Gene Symbol:
  Gene Name: HYDIN
  ENSP ID: ENSP00000489054
MTSRRLEESMGAVQMGLVNMFKGFQSKVLPPLSPKV

SEQ ID NO: 39132 - protein, 39 aa, Homo sapiens
  Payload ID: 7842
  Gene Symbol:
  Gene Name: HYDIN
  ENSP ID: ENSP00000489086
MTSRRLEESMGAVQMGLVNMFKGFQSKVLPPLSPKVVTE

SEQ ID NO: 39133 - protein, 528 aa, Homo sapiens
  Payload ID: 7842
  Gene Symbol:
  Gene Name: HYDIN
  ENSP ID: ENSP00000489101
VKYSTQKILLVRNIGNKNAVFHIKTCRPFSIEPAIGTLNVGESMQLEVEFEPQSVGDHSGRLIVCYDTGEKVFVSLYGAAIDMNIRLDKNSLTIEKTYISLANQRTITIHNRSNIIAHFLWKVFATQQEEDREKYRACDDLIKEEKDETDEFFEECITDPLLREHLSVLSRTFANQRRLVQGDSKLFFNNVFTVEPLEGDVWPNSSAEITVYFNPLEAKLYQQTIYCDILGREIRLPLRIKGEGMGPKIHFNFELLDIGKVFTGSAHCYEAILYNKGSIDALFNMTPPTSALGACFVFSPKEGIIEPSGVQAIQISFSSTILGNFEEEFLVNVNGSPEPVKLTIRGCVIGPTFHFNVPALHFGDVSFATQELRDPQVLIPFQRFPHTLICSLNNTSLIPMTYKLRIPGDGLGHKSISYCEQHVDYKRPSWTKEEISSMKPKEFTISPDCGTIRPQGFAAIRVTLCSNTVQKYELALVVDVEGIGEEVLALLITASAPELCNRKVMLSVLQWKIHRAKRSLPRDTVAVT

SEQ ID NO: 39134 - protein, 833 aa, Homo sapiens
  Payload ID: 7842
  Gene Symbol:
  Gene Name: HYDIN
  ENSP ID: ENSP00000489173
RTFANQRRLVQGDSKLFFNNVFTVEPLEGDVWPNSSAEITVYFNPLEAKLYQQTIYCDILGREIRLPLRIKGEGMGPKIHFNFELLDIGKVFTGSAHCYEAILYNKGSIDALFNMTPPTSALGACFVFSPKEGIIEPSGVQAIQISFSSTILGNFEEEFLVNVNGSPEPVKLTIRGCVIGPTFHFNVPALHFGDVSFGFPHTLICSLNNTSLIPMTYKLRIPGDGLGHKSISYCEQHVDYKRPSWTKEEISSMKPKEFTISPDCGTIRPQGFAAIRVTLCSNTVQKYELALVVDVEGIGEEVLALLITARCVVPALHLVNTEVDFGHCFLKYPYEKTLQLANQDDLPGFYEVQPQVCEEVPTVLFSSPTPSGVISPSSTIHIPLVLETQVTGEHRSTVYISIFGSQDPPLVCHLKSAGEGPVIYVHPNQVDFGNIYVLKDSSRILNLCNQSFIPAFFQAHMAHKKSLWTIEPNEGMVPPETDVQLALTANLNDTLTFKDCVILDIENSSTYRIPVQASGTGSTIVSDKPFAPELNLGAHFSLDTHYYHFKLINKGRRIQQLFWMNDSFRPQAKLSKKGRVKKGHAHVQPQPSGSQEPRDPQSPVFHLHPASMELYPGQAIDVILEGYSATPRKPNSILKPDYQPLAIKNISTLPVNLLLSTSGPFFICETDKSLLPATPEPIKLEIDEEKNLLIKFDPSYRNDLNNWVAEEILAIKYVEHPQIDSLDLRGEVHYPNLSFETKELDFGCILNDTELIRYVTITNCSPLVVKFRWFFLVNDEENQIRFVTLPKKPYSAPVSQMESIPATSEAASPPAILVTVESPEMDLNDFVKK

SEQ ID NO: 39135 - protein, 950 aa, Homo sapiens
  Payload ID: 7842
  Gene Symbol:
  Gene Name: HYDIN
  ENSP ID: ENSP00000489181
MESAGGFKLGMEPLSGGGVCEKKKLLKMTSRRLEESMGAVQMGLVNMFKGFQSKVLPPLSPKVVTEEEVNRMLTPSEFLKEMSLTTEQRLAKTRLMCRPQIIELLDMGETTHQKFSGIDLDQALFQPFPSEIIFQNYTPCEVYEVPLILRNNDKIPRLVKVVEESSPYFKVISPKDIGHKVAPGVPSIFRILFTPEENKDYAHTLTCVTEREKFIVPIKARGARAILDFPDKLNFSTCPVKYSTQKILLVRNIGNKNAVFHIKTCRPFSIEPAIGTLNVGESMQLEVEFEPQSVGDHSGRLIVCYDTGEKVFVSLYGAAIDMNIRLDKNSLTIEKTYISLANQRTITIHNRSNIIAHFLWKVFATQQEEDREKYRACDDLIKEEKDETDEFFEECITDPLLREHLSVLSRTFANQRRLVQGDSKLFFNNVFTVEPLEGDVWPNSSAEITVYFNPLEAKLYQQTIYCDILGREIRLPLRIKGEGMGPKIHFNFELLDIGKVFTGSAHCYEAILYNKGSIDALFNMTPPTSALGACFVFSPKEGIIEPSGVQAIQISFSSTILGNFEEEFLVNVNGSPEPVKLTIRGCVIGPTFHFNVPALHFGDVSFGFPHTLICSLNNTSLIPMTYKLRIPGDGLGHKSISYCEQHVDYKRPSWTKEEISSMKPKEFTISPDCGTIRPQGFAAIRVTLCSNTVQKYELALVVDVEGIGEEVLALLITARCVVPALHLVNTEVDFGHCFLKYPYEKTLQLANQDDLPGFYEVQPQVCEEVPTVLFSSPTPSGVISPSSTIHIPLVLETQVTGEHRSTVYISIFGSQDPPLVCHLKSAGEGPVIYVHPNQVDFGNIYVLKDSSRILNLCNQSFIPAFFQAHMAHKKSLWTIEPNEGMVPPETDVQLALTANLNDTLTFKDCVILDIENSSTYRIPVQASGTGSTIVSDKPFAPELNLGAHFR

SEQ ID NO: 39136 - protein, 940 aa, Homo sapiens
  Payload ID: 7842
  Gene Symbol:
  Gene Name: HYDIN
  ENSP ID: ENSP00000489221
MESAGGFKLGEKKKLLKMTSRRLEESMGAVQMGLVNMFKGFQSKVLPPLSPKVVTEEEVNRMLTPSEFLKEMSLTTEQRLAKTRLMCRPQIIELLDMGETTHQKFSGIDLDQALFQPFPSEIIFQNYTPCEVYEVPLILRNNDKIPRLVKVVEESSPYFKVISPKDIGHKVAPGVPSIFRILFTPEENKDYAHTLTCVTEREKFIVPIKARGARAILDFPDKLNFSTCPVKYSTQKILLVRNIGNKNAVFHIKTCRPFSIEPAIGTLNVGESMQLEVEFEPQSVGDHSGRLIVCYDTGEKVFVSLYGAAIDMNIRLDKNSLTIEKTYISLANQRTITIHNRSNIIAHFLWKVFATQQEEDREKYRACDDLIKEEKDETDEFFEECITDPLLREHLSVLSRTFANQRRLVQGDSKLFFNNVFTVEPLEGDVWPNSSAEITVYFNPLEAKLYQQTIYCDILGREIRLPLRIKGEGMGPKIHFNFELLDIGKVFTGSAHCYEAILYNKGSIDALFNMTPPTSALGACFVFSPKEGIIEPSGVQAIQISFSSTILGNFEEEFLVNVNGSPEPVKLTIRGCVIGPTFHFNVPALHFGDVSFGFPHTLICSLNNTSLIPMTYKLRIPGDGLGHKSISYCEQHVDYKRPSWTKEEISSMKPKEFTISPDCGTIRPQGFAAIRVTLCSNTVQKYELALVVDVEGIGEEVLALLITARCVVPALHLVNTEVDFGHCFLKYPYEKTLQLANQDDLPGFYEVQPQVCEEVPTVLFSSPTPSGVISPSSTIHIPLVLETQVTGEHRSTVYISIFGSQDPPLVCHLKSAGEGPVIYVHPNQVDFGNIYVLKDSSRILNLCNQSFIPAFFQAHMAHKKSLWTIEPNEGMVPPETDVQLALTANLNDTLTFKDCVILDIENSSTYRIPVQASGTGSTIVSDKPFAPELNLGAHFR

SEQ ID NO: 39137 - protein, 1017 aa, Homo sapiens
  Payload ID: 7842
  Gene Symbol:
  Gene Name: HYDIN
  ENSP ID: ENSP00000489246
MTSRRLEESMGAVQMGLVNMFKGFQSKVLPPLSPKVVTEEEVNRMLTPSEFLKEMSLTTEQRLAKTRLMCRPQIIELLDMGETTHQKFSGIDLDQALFQPFPSEIIFQNYTPCEVYEVPLILRNNDKIPRLVKVVEESSPYFKVISPKDIGHKVAPGVPSIFRILFTPEENKDYAHTLTCVTEREKFIVPIKARGARAILDFPDKLNFSTCPVKYSTQKILLVRNIGNKNAVFHIKTCRPFSIEPAIGTLNVGESMQLEVEFEPQSVGDHSGRLIVCYDTGEKVFVSLYGAAIDMNIRLDKNSLTIEKTYISLANQRTITIHNRSNIIAHFLWKVFATQQEEDREKYRACDDLIKEEKDETDEFFEECITDPLLREHLSVLSRTFANQRRLVQGDSKLFFNNVFTVEPLEGDVWPNSSAEITVYFNPLEAKLYQQTIYCDILGREIRLPLRIKGEGMGPKIHFNFELLDIGKVFTGSAHCYEAILYNKGSIDALFNMTPPTSALGACFVFSPKEGIIEPSGVQAIQISFSSTILGNFEEEFLVNVNGSPEPVKLTIRGCVIGPTFHFNVPALHFGDVSFGFPHTLICSLNNTSLIPMTYKLRIPGDGLGHKSISYCEQHVDYKRPSWTKEEISSMKPKEFTISPDCGTIRPQGFAAIRVTLCSNTVQKYELALVVDVEGIGEEVLALLITARCVVPALHLVNTEVDFGHCFLKYPYEKTLQLANQDDLPGFYEVQPQVCEEVPTVLFSSPTPSGVISPSSTIHIPLVLETQVTGEHRSTVYISIFGSQDPPLVCHLKSAGEGPVIYVHPNQVDFGNIYVLKDSSRILNLCNQSFIPAFFQAHMAHKKSLWTIEPNEGMVPPETDVQLALTANLNDTLTFKDCVILDIENSSTYRIPVQASGTGSTIVSDKPFAPELNLGAHFSLDTHYYHFKLINKGRRIQQLFWMNDSFRPQAKLSKKGRVKKGHAHVQPQPSGSQEPRDPQSPVFHLHPASMELYPGQAIDVILEGYSATPRVRG

SEQ ID NO: 39138 - protein, 113 aa, Homo sapiens
  Payload ID: 7842
  Gene Symbol:
  Gene Name: HYDIN
  ENSP ID: ENSP00000489274
  MOD_RES (1)..(1): Any amino acid
XIYVLKDSSRILNLCNQSFIPAFFQAHMAHKKSLWTIEPNEGMVPPETDVQLALTANLNDTLTFKDCVILDIENSSTYRIPVQASGTGSTIVSDKPFAPELNLGAHFRNLTVS

SEQ ID NO: 39139 - protein, 82 aa, Homo sapiens
  Payload ID: 7842
  Gene Symbol:
  Gene Name: HYDIN
  ENSP ID: ENSP00000489358
  MOD_RES (1)..(1): Any amino acid
XTYLEEEEDEESLEKIIFQTDKLQSIDSHSMEEVGEVENNPVSKAIARHLGIDISAEGRLAKNRKGIAIIIHGTPLSGRQQF

SEQ ID NO: 39140 - protein, 49 aa, Homo sapiens
  Payload ID: 7842
  Gene Symbol:
  Gene Name: HYDIN
  ENSP ID: ENSP00000489382
  MOD_RES (1)..(1): Any amino acid
XVLEENYQELQLQISANVDFASYHCQARDVRFKETLVYQTRVFDIMSCA

SEQ ID NO: 39141 - protein, 204 aa, Homo sapiens
  Payload ID: 7842
  Gene Symbol:
  Gene Name: HYDIN
  ENSP ID: ENSP00000489482
  MOD_RES (1)..(1): Any amino acid
XRILFTPEENKDYAHTLTCVTEREKFIVPIKARGARAILDFPDKLNFSTCPVKYSTQKILLVRNIGNKNAVFHIKTCRPFSIEPAIGTLNVGESMQLEVEFEPQSVGDHSGRLIVCYDTGEKVFVSLYGAAIDMNIRLDKNSLTIEKTYISLANQRTITIHNRSNIIAHFLWKVFATQQEEDREKYRWMAPFVPGQVWTWEYFL

SEQ ID NO: 39142 - protein, 127 aa, Homo sapiens
  Payload ID: 7842
  Gene Symbol:
  Gene Name: HYDIN
  ENSP ID: ENSP00000489503
  MOD_RES (1)..(1): Any amino acid
XKLRIPGDGLGHKSISYCEQHVDYKRPSWTKEEISSMKPKEFTISPDCGTIRPQGFAAIRVTLCSNTVQKYELALVVDVEGIGEEVLALLITASAPELCNRKVMLSVLQWKIHRAKRSLPRDTVAVT

SEQ ID NO: 39143 - protein, 5121 aa, Homo sapiens
  Payload ID: 7842
  Gene Symbol:
  Gene Name: HYDIN
  ENSP ID: ENSP00000489526
MTSRRLEESMGAVQMGLVNMFKGFQSKVLPPLSPKVVTEEEVNRMLTPSEFLKEMSLTTEQRLAKTRLMCRPQIIELLDMGETTHQKFSGIDLDQALFQPFPSEIIFQNYTPCEVYEVPLILRNNDKIPRLVKVVEESSPYFKVISPKDIGHKVAPGVPSIFRILFTPEENKDYAHTLTCVTEREKFIVPIKARGARAILDFPDKLNFSTCPVKYSTQKILLVRNIGNKNAVFHIKTCRPFSIEPAIGTLNVGESMQLEVEFEPQSVGDHSGRLIVCYDTGEKVFVSLYGAAIDMNIRLDKNSLTIEKTYISLANQRTITIHNRSNIIAHFLWKVFATQQEEDREKYRACDDLIKEEKDETDEFFEECITDPLLREHLSVLSRTFANQRRLVQGDSKLFFNNVFTVEPLEGDVWPNSSAEITVYFNPLEAKLYQQTIYCDILGREIRLPLRIKGEGMGPKIHFNFELLDIGKVFTGSAHCYEAILYNKGSIDALFNMTPPTSALGACFVFSPKEGIIEPSGVQAIQISFSSTILGNFEEEFLVNVNGSPEPVKLTIRGCVIGPTFHFNVPALHFGDVSFGFPHTLICSLNNTSLIPMTYKLRIPGDGLGHKSISYCEQHVDYKRPSWTKEEISSMKPKEFTISPDCGTIRPQGFAAIRVTLCSNTVQKYELALVVDVEGIGEEVLALLITARCVVPALHLVNTEVDFGHCFLKYPYEKTLQLANQDDLPGFYEVQPQVCEEVPTVLFSSPTPSGVISPSSTIHIPLVLETQVTGEHRSTVYISIFGSQDPPLVCHLKSAGEGPVIYVHPNQVDFGNIYVLKDSSRILNLCNQSFIPAFFQAHMAHKKSLWTIEPNEGMVPPETDVQLALTANLNDTLTFKDCVILDIENSSTYRIPVQASGTGSTIVSDKPFAPELNLGAHFSLDTHYYHFKLINKGRRIQQLFWMNDSFRPQAKLSKKGRVKKGHAHVQPQPSGSQEPRDPQSPVFHLHPASMELYPGQAIDVILEGYSATPRIVKEKLVCHAIIGAQKGKSLVMAVNITCEFVAPLIQLSTKQLIYRLEKKPNSILKPDYQPLAIKNISTLPVNLLLSTSGPFFICETDKSLLPATPEPIKLEIDEEKNLLIKFDPSYRNDLNNWVAEEILAIKYVEHPQIDSLDLRGEVHYPNLSFETKELDFGCILNDTELIRYVTITNCSPLVVKFRWFFLVNDEENQIRFVTLPKKPYSAPVSQMESIPATSEAASPPAILVTVESPEMDLNDFVKTVLVDEDARPEEKELRKTKASSVISDEIKISSTEIERIYSSQSQVEDQESLQTCEQNEMLSIGIEEVFDILPLFGVLQPHSSHQISFTFYGHANIIAQAKALCEVEEGPTYEITLKGEASLVNYSFDTKDIHYGLQLFDHVTEREITLTNMGKVGFEFKVLTDHQSSPDNLLPGVPLILPVSGFISSHQEQVLKVYYLPGVPEVFKRSFQIQIAHLDPENITLSGEGIFPQICLDLPRNLTANEKYEMFLNQARKNTDKEYNKCEMLDHFDIITEEVPEDEPAEVSAHLQMEVERLIVQSYVLEHQKTTTPDPMDDPCFSHRSRRKLAKIQLPEYILDFGYIILGEVRTHIIKIINTSHFPVSFHADKRVLHETGFSTELDRVKNLPHCETEIFEVRFDPQGANLPVGSKEVILPIKVVGGPTVHICLQAKVTIPTMTLSRGKVDFATIQCGQCLVETIQLSNHLQVPCEWFVQSQKPVDKLEKHMPKYLRQKLRAELKPKTRIFEIQPISGVLDPGEKSNVQVKFMPKEEKFYSQTLVFQIAQSAQKLTLLARGQGLEPRLEFSPSVLDLGPLLLCAPGDEAEVIVKNPCNFPIEFYSLEFDQQYLIEEKILRKLKGYDSYNTLLLPPRNPGEKLPPELYEYFKEIKKSKEEQMRAKYLENLAQENEEEDITSSDQGTSNSTKRTSLSRGISVTSNLEEWHALLVESKTYLEEEEDEESLEKIIFQTDKLQSIDSHSMEEVGEVENNPVSKAIARHLGIDISAEGRLAKNRKGIAIIIHGTPLSGKSANAVSVAKYYNAACLSIDSIVLEAVANSNNIPGIRARELCIRAAIEQSVKEGEEAAQEAAVGQNVIGQGRLSTDTLGKLASEMTLVAPEIKPGKSVRGSVVITKSKADSHGSGSQKQHHSHQSETPQISSSPLPPGPIHRWLSVSPSVGGETGLMSCVLPDELLVQILAERIQLSDCYRGVVFDGLDTLFAQNAAAALLCLLKAIGSREHIYILNMAQDYAAMKAQEKAKKEQEERKHKGALEKEKERLQNMDEEEYDALTEEEKLTFDRGIQQALRERKKREQERLAKEMQEKKLQQELERQKEEDELKRRVKKGKQGPIKEEPPMKKSQAANKQVPPLTKVDVKMETIERKISVREQTMSEKEELNKKKRNMGDVSMHGLPLVQDQEDSEGDNSKDPDKQLAPKFKTYELTLKDVQNILMYWDRKQGVQLPPAGMEEAPHEPDDQRQVPLGGRRGRKDRERERLEKERTEKERLEREKAERERLEKLRALEERSDWEGEGEEDHEGKKEKDLGVPFLDIQTPDFEGLSWKQALESDKLPKGEQILDILGLGASGPPIPPPALFSIVSYPVKRPPLTMTDDLEHFVFVIPPSEDISLDEKKEMEIESDFLATTNTTKAQEEQTSSSKGGKQKMKEKIDQVFEIQKDKRHMALNRKVLSGEPAGTISQLSDTDLDNFNGQHSQEKFTRLNHFRWIVPANGEVTLQVHFSSDEFGNFDQTFNFEILGTCCQYQLYCRGICTYPYICQDPKVVFPQRKMDMKTNEVIFKKYVMSTETYYFGPLLCGKSRDKYKSSLFPGNMETLTILNTSLMVVEASFYFQNDVKANTYFLEPNTMVLKPNEKQILNVWAYPTSVGVFEDSIVCCINDNPEPAIFQLSCQGIRPELELEPRQLHFDRLLLHRQESRVVLLRNVTLLPVAWRITSLEHLGDDFTVSLMQGTIPPEAEYGLHLYFQPTKPVNIKKAIRLEVLDAENLLGVVQIENIMVFAEAYDIALDITFPKGAEGGLDFGIVRVTEEAKQPLQLKNRGKYEIAFSFSVDSVGISTPNINSMISVQPKKGSLTPTEKPTNVQVFFHAKKEVKIEHQPVLRCQIIEPNISEGGEIIASIPIKFSANAVYSKYNITPSSVINFGALICGTRKSTTFTIENQGVTDFKFALYKLTGESPIHQKKAASHVRHARSRESESFYKTGSSRAAKFSDTIQKEVTTTGQARFAHGMFTVYPGFGSIPSGGQQVINVDCVADAMGKCEEFIAIDISGRDPAVHPAGILYTLLAEACLPAFVTENNALIFEEHQICTSANLHHILQTIESGGLFVEDENKFIFCNVLVGRQAKARFKISNVGKITCDVNIVVRPISNKPFARIVDIFEVEPSKMCIASHSHAFATVSFTPQIMQNYQCIFEATLDGLPSTLAKSRGLVFDIAGEGNLPRVTVVRPVLHNQYGNPLLLFKRLLLGHSEKLPLILKNNGVLPAQLHVDLQDELGVFSLKGRPTTAYIYITEENKPHVKAKKAHTASLVVSPGDTAEFDVVFHSQKVGRMRGIIHLSVINNQYEETSIHMVGEGYEDDITLDNIHGLVAPTSQEDISISEFTEIIEDNDMEDLVAAALVDHIQFGDCHIGHSYNASFTVTNHSQVNLIRFEWPVSATIAFSPQMGHLHPGCAKDIVVTMKSDVPINLKNMRIRCKLSRIMFQLPADQVPDWDDRMHTVKWVDVPRNMPGTFTTKRKVIETDPEPAHSVLEENYQELQLQISANVDFASYHCQARDVRFKETLVYQTRVFEFDVINSGRVQLEFSWVSEDTSKAVSFAKPDHQGSAQKDQLSQGTMHTGSTLDSTMDHWAEGSPQPFSVEPSSGIVPVGKIQKFKVKFSPLDIGDFESNLFCQIPNLPPGEQGPVLVAKGRSTLPICHFDLKDSDYISGHQRNPELRGSSGGALDPNTRVIEFTTVGIGGKNLRTFTILNPTNSTYSFCWISEEIESLQNPAAFTCLTEKGFIHPEKKAEIVFQFTPFHLGITESSWTFLIPEHNITVPFLLVGKTTEPLISLNKSHLNFSSLLIGREARETVQIINKEEQGFDFSFQDNSRYSEGFSNSLLVCPMEGWIPPLSRFPIDIFFTPKQEGDVNFNLICNVEKKVHPVTLNVKAEGYTMNVEIKCKDRTGSITLLTPNQTNIINFYEVELNECVQCEFNFINTGKFTFSFQAQLCGSKTLLQYLEFSPIDSTVDVGQSVHATLSFQPLKKCVLTDLELIIKISHGPTFMCNISGCAVSPAIHFSFTSYNFGTCFIYQAGMPPYKQTLVITNKEETPMSIDCLYTNTTHLEVNSRVDVVKPGNTLEIPITFYPRESINYQELIPFEINGLSQQTVEIKGKGTKMKILVLDPANRIVKLGAVLPGQVVKRTVSIMNNSLAQLTFNQSILFTIPELQEPKVLTLAPFHNITLKPKEVCKLEVIFAPKKRVPPFSEEVFMECMGLLRPLFLLSGCCQALEISLDQEHIPFGPVVYQTQATRRILMMNTGDVGARFKWDIKKFEPHFSISPEEGYITSGMEVSFEVTYHPTEVGKESLCKNILCYIQGGSPLSLTLSGVCVGPPAVKEVVNFTCQVRSKHTQTILLSNRTNQTWNLHPIFEGEHWEGPEFITLEAHQQNKPYEITYRPRTMNLENRKHQGTLFFPLPDGTGWLYALHGTSELPKAVANIYREVPCKTPYTELLPITNWLNKPQRFRVIVEILKPEKPDLSITMKGLDYIDVLSGSKKDYKLNFFSHKEGTYAAKVIFRNEVTNEFLYYNVSFRVIPSGIIKTIEMVTPVRQVASASIKLENPLPYSVTFSTECRMPDIALPSQFVVPANSEGTFSFEFQPLKAGETFGRLTLHNTDLGYYQYELYLKATPALPEKPVHFQTVLGSSQIILVKFINYTRQRTEYYCRTDCTDFHAEKLINAAPGGQGGTEASVEVLFEPSHLGETKGILILSSLAGGEYIIPLFGMALPPKPQGPFSIRAGYSIIIPFKNVFYHMVTFSIIVDNPAFTIRAGESVRPKKINNITVSFEGNPSGSKTPITTKLTVSCPPGEGSETGVKWVYYLKGITL

SEQ ID NO: 39144 - protein, 725 aa, Homo sapiens; identical to SEQ ID NO: 39130
  Payload ID: 7843
  Gene Symbol: HYDIN
  Gene Name: HYDIN, axonemal central pair apparatus protein
  ENSP ID: ENSP00000288168

SEQ ID NO: 39145 - protein, 1017 aa, Homo sapiens; identical to SEQ ID NO: 39137
  Payload ID: 7843
  Gene Symbol: HYDIN
  Gene Name: HYDIN, axonemal central pair apparatus protein
  Uniprot ID: Q4G0P3
  ENSP ID: ENSP00000314736

SEQ ID NO: 39146 - protein, 5121 aa, Homo sapiens; identical to SEQ ID NO: 39143
  Payload ID: 7843
  Gene Symbol: HYDIN
  Gene Name: HYDIN, axonemal central pair apparatus protein
  Uniprot ID: Q4G0P3
  ENSP ID: ENSP00000377197

SEQ ID NO: 39147 - protein, 940 aa, Homo sapiens; identical to SEQ ID NO: 39136
  Payload ID: 7843
  Gene Symbol: HYDIN
  Gene Name: HYDIN, axonemal central pair apparatus protein
  Uniprot ID: Q4G0P3
  ENSP ID: ENSP00000437341

SEQ ID NO: 39148 - protein, 204 aa, Homo sapiens; identical to SEQ ID NO: 39141
  Payload ID: 7843
  Gene Symbol: HYDIN
  Gene Name: HYDIN, axonemal central pair apparatus protein
  ENSP ID: ENSP00000437598
  MOD_RES (1)..(1): Any amino acid

SEQ ID NO: 39149 - protein, 36 aa, Homo sapiens; identical to SEQ ID NO: 39131
  Payload ID: 7843
  Gene Symbol: HYDIN
  Gene Name: HYDIN, axonemal central pair apparatus protein
  ENSP ID: ENSP00000440202

SEQ ID NO: 39150 - protein, 39 aa, Homo sapiens; identical to SEQ ID NO: 39132
  Payload ID: 7843
  Gene Symbol: HYDIN
  Gene Name: HYDIN, axonemal central pair apparatus protein
  ENSP ID: ENSP00000443525

SEQ ID NO: 39151 - protein, 950 aa, Homo sapiens; identical to SEQ ID NO: 39135
  Payload ID: 7843
  Gene Symbol: HYDIN
  Gene Name: HYDIN, axonemal central pair apparatus protein
  Uniprot ID: Q4G0P3
  ENSP ID: ENSP00000444970

SEQ ID NO: 39152 - protein, 127 aa, Homo sapiens; identical to SEQ ID NO: 39142
  Payload ID: 7843
  Gene Symbol: HYDIN
  Gene Name: HYDIN, axonemal central pair apparatus protein
  ENSP ID: ENSP00000446122
  MOD_RES (1)..(1): Any amino acid

SEQ ID NO: 39153 - protein, 113 aa, Homo sapiens; identical to SEQ ID NO: 39138
  Payload ID: 7843
  Gene Symbol: HYDIN
  Gene Name: HYDIN, axonemal central pair apparatus protein
  ENSP ID: ENSP00000462031
  MOD_RES (1)..(1): Any amino acid

SEQ ID NO: 39154 - protein, 43 aa, Homo sapiens; identical to SEQ ID NO: 39129
  Payload ID: 7843
  Gene Symbol: HYDIN
  Gene Name: HYDIN, axonemal central pair apparatus protein
  ENSP ID: ENSP00000462711
  MOD_RES (1)..(1): Any amino acid

SEQ ID NO: 39155 - protein, 151 aa, Homo sapiens; identical to SEQ ID NO: 39128
  Payload ID: 7843
  Gene Symbol: HYDIN
  Gene Name: HYDIN, axonemal central pair apparatus protein
  ENSP ID: ENSP00000463093
  MOD_RES (1)..(1): Any amino acid

SEQ ID NO: 39156 - protein, 49 aa, Homo sapiens; identical to SEQ ID NO: 39140
  Payload ID: 7843
  Gene Symbol: HYDIN
  Gene Name: HYDIN, axonemal central pair apparatus protein
  ENSP ID: ENSP00000463350
  MOD_RES (1)..(1): Any amino acid

SEQ ID NO: 39157 - protein, 528 aa, Homo sapiens; identical to SEQ ID NO: 39133
  Payload ID: 7843
  Gene Symbol: HYDIN
  Gene Name: HYDIN, axonemal central pair apparatus protein
  ENSP ID: ENSP00000463422

SEQ ID NO: 39158 - protein, 833 aa, Homo sapiens; identical to SEQ ID NO: 39134
  Payload ID: 7843
  Gene Symbol: HYDIN
  Gene Name: HYDIN, axonemal central pair apparatus protein
  ENSP ID: ENSP00000463767

SEQ ID NO: 39159 - protein, 82 aa, Homo sapiens; identical to SEQ ID NO: 39139
  Payload ID: 7843
  Gene Symbol: HYDIN
  Gene Name: HYDIN, axonemal central pair apparatus protein
  ENSP ID: ENSP00000479502
  MOD_RES (1)..(1): Any amino acid

SEQ ID NO: 39160 - protein, 273 aa, Homo sapiens
  Payload ID: 7844
  Gene Symbol: HVCN1
  Gene Name: hydrogen voltage gated channel 1
  Uniprot ID: Q96D96
  ENSP ID: ENSP00000242607
MATWDEKAVTRRAKVAPAERMSKFLRHFTVVGDDYHAWNINYKKWENEEEEEEEEQPPPTPVSGEEGRAAAPDVAPAPGPAPRAPLDFRGMLRKLFSSHRFQVIIICLVVLDALLVLAELILDLKIIQPDKNNYAAMVFHYMSITILVFFMMEIIFKLFVFRLEFFHHKFEILDAVVVVVSFILDIVLLFQEHQFEALGLLILLRLWRVARIINGIIISVKTRSERQLLRLKQMNVQLAAKIQHLEFSCSEKEQEIERLNKLLRQHGLLGEVN

SEQ ID NO: 39161 - protein, 273 aa, Homo sapiens; identical to SEQ ID NO: 39160
  Payload ID: 7844
  Gene Symbol: HVCN1
  Gene Name: hydrogen voltage gated channel 1
  Uniprot ID: Q96D96
  ENSP ID: ENSP00000349181

SEQ ID NO: 39162 - protein, 253 aa, Homo sapiens
  Payload ID: 7844
  Gene Symbol: HVCN1
  Gene Name: hydrogen voltage gated channel 1
  Uniprot ID: Q96D96
  ENSP ID: ENSP00000412052
MSKFLRHFTVVGDDYHAWNINYKKWENEEEEEEEEQPPPTPVSGEEGRAAAPDVAPAPGPAPRAPLDFRGMLRKLFSSHRFQVIIICLVVLDALLVLAELILDLKIIQPDKNNYAAMVFHYMSITILVFFMMEIIFKLFVFRLEFFHHKFEILDAVVVVVSFILDIVLLFQEHQFEALGLLILLRLWRVARIINGIIISVKTRSERQLLRLKQMNVQLAAKIQHLEFSCSEKEQEIERLNKLLRQHGLLGEVN

SEQ ID NO: 39163 - protein, 78 aa, Homo sapiens
  Payload ID: 7844
  Gene Symbol: HVCN1
  Gene Name: hydrogen voltage gated channel 1
  ENSP ID: ENSP00000447227
MATWDEKAVTRRAKVAPAERMSKFLRHFTVVGDDYHAWNINYKKWENEEEEEEEEQPPPTPVSGEEGRAAAPDVAPAP

SEQ ID NO: 39164 - protein, 79 aa, Homo sapiens
  Payload ID: 7844
  Gene Symbol: HVCN1
  Gene Name: hydrogen voltage gated channel 1
  ENSP ID: ENSP00000448379
MATWDEKAVTRRAKVAPAERMSKFLRHFTVVGDDYHAWNINYKKWENEEEEEEEEQPPPTPVSGHHHLLGGSGCPPGAC

SEQ ID NO: 39165 - protein, 255 aa, Homo sapiens
  Payload ID: 7844
  Gene Symbol: HVCN1
  Gene Name: hydrogen voltage gated channel 1
  Uniprot ID: Q96D96
  ENSP ID: ENSP00000449601
MATWDEKAVTRRAKVAPAERMSKFLRHFTVVGDDYHAWNINYKKWENEEEEEEEEQPPPTPVSGEEGRAAAPDVAPAPGPAPRAPLDFRGMLRKLFSSHRFQVIIICLVVLDALLVLAELILDLKIIQPDKNNYAAMVFHYMSITILVFFMMEIIFKLFVFRLEFFHHKFEILDAVVVVVSFILDIVLLFQEHQFEALGLLILLRLWRVARIINGIIISVKTRSERQLLRLKQMNVQLAAKIQHLEFSCSEKPLD

SEQ ID NO: 39166 - protein, 214 aa, Homo sapiens
  Payload ID: 7844
  Gene Symbol: HVCN1
  Gene Name: hydrogen voltage gated channel 1
  ENSP ID: ENSP00000450106
MATWDEKAVTRRAKVAPAERMSKFLRHFTVVGDDYHAWNINYKKWENEEEEEEEEQPPPTPVSGEEGRAAAPDVAPAPGPAPRAPLDFRGMLRKLFSSHRFQVIIICLVVLDALLVLAELILDLKIIQPDKNNYAAMVFHYMSITILVFFMMEIIFKLFVFRLEFFHHKFEILDAVVVVVSFILDIVLLFQEHQFEALGLLILLRLWRVARIIN

SEQ ID NO: 39167 - protein, 273 aa, Homo sapiens; identical to SEQ ID NO: 39160
  Payload ID: 7844
  Gene Symbol: HVCN1
  Gene Name: hydrogen voltage gated channel 1
  Uniprot ID: Q96D96
  ENSP ID: ENSP00000479812

SEQ ID NO: 39168 - protein, 299 aa, Homo sapiens
  Payload ID: 7845
  Gene Symbol: HYLS1
  Gene Name: hydrolethalus syndrome 1
  Uniprot ID: Q96M11
  ENSP ID: ENSP00000348815
MEELLPDGQIWANMDPEERMLAAATAFTHICAGQGEGDVRREAQSIQYDPYSKASVAPGKRPALPVQLQYPHVESNVPSETVSEASQRLRKPVMKRKVLRRKPDGEVLVTDESIISESESGTENDQDLWDLRQRLMNVQFQEDKESSFDVSQKFNLPHEYQGISQDQLICSLQREGMGSPAYEQDLIVASRPKSFILPKLDQLSRNRGKTDRVARYFEYKRDWDSIRLPGEDHRKELRWGVREQMLCRAEPQSKPQHIYVPNNYLVPTEKKRSALRWGVRCDLANGVIPRKLPFPLSPS

SEQ ID NO: 39169 - protein, 299 aa, Homo sapiens; identical to SEQ ID NO: 39168
  Payload ID: 7845
  Gene Symbol: HYLS1
  Gene Name: hydrolethalus syndrome 1
  Uniprot ID: Q96M11
  ENSP ID: ENSP00000414884

SEQ ID NO: 39170 - protein, 299 aa, Homo sapiens; identical to SEQ ID NO: 39168
  Payload ID: 7845
  Gene Symbol: HYLS1
  Gene Name: hydrolethalus syndrome 1
  Uniprot ID: Q96M11
  ENSP ID: ENSP00000436833

SEQ ID NO: 39171 - protein, 370 aa, Homo sapiens
  Payload ID: 7846
  Gene Symbol: HAO1
  Gene Name: hydroxyacid oxidase (glycolate oxidase) 1
  Uniprot ID: Q9UJM8
  ENSP ID: ENSP00000368066
MLPRLICINDYEQHAKSVLPKSIYDYYRSGANDEETLADNIAAFSRWKLYPRMLRNVAETDLSTSVLGQRVSMPICVGATAMQRMAHVDGELATVRACQSLGTGMMLSSWATSSIEEVAEAGPEALRWLQLYIYKDREVTKKLVRQAEKMGYKAIFVTVDTPYLGNRLDDVRNRFKLPPQLRMKNFETSTLSFSPEENFGDDSGLAAYVAKAIDPSISWEDIKWLRRLTSLPIVAKGILRGDDAREAVKHGLNGILVSNHGARQLDGVPATIDVLPEIVEAVEGKVEVFLDGGVRKGTDVLKALALGAKAVFVGRPIVWGLAFQGEKGVQDVLEILKEEFRLAMALSGCQNVKVIDKTLVRKNPLAVSKI

SEQ ID NO: 39172 - protein, 351 aa, Homo sapiens
  Payload ID: 7847
  Gene Symbol: HAO2
  Gene Name: hydroxyacid oxidase 2 (long chain)
  Uniprot ID: Q9NYQ3
  ENSP ID: ENSP00000316339
MSLVCLTDFQAHAREQLSKSTRDFIEGGADDSITRDDNIAAFKRIRLRPRYLRDVSEVDTRTTIQGEEISAPICIAPTGFHCLVWPDGEMSTARAAQAAGICYITSTFASCSLEDIVIAAPEGLRWFQLYVHPDLQLNKQLIQRVESLGFKALVITLDTPVCGNRRHDIRNQLRRNLTLTDLQSPKKGNAIPYFQMTPISTSLCWNDLSWFQSITRLPIILKGILTKEDAELAVKHNVQGIIVSNHGGRQLDEVLASIDALTEVVAAVKGKIEVYLDGGVRTGNDVLKALALGAKCIFLGRPILWGLACKGEHGVKEVLNILTNEFHTSMALTGCRSVAEINRNLVQFSRL

SEQ ID NO: 39173 - protein, 364 aa, Homo sapiens
  Payload ID: 7847
  Gene Symbol: HAO2
  Gene Name: hydroxyacid oxidase 2 (long chain)
  Uniprot ID: Q9NYQ3
  ENSP ID: ENSP00000354314
MEDKMWSECEGPEMSLVCLTDFQAHAREQLSKSTRDFIEGGADDSITRDDNIAAFKRIRLRPRYLRDVSEVDTRTTIQGEEISAPICIAPTGFHCLVWPDGEMSTARAAQAAGICYITSTFASCSLEDIVIAAPEGLRWFQLYVHPDLQLNKQLIQRVESLGFKALVITLDTPVCGNRRHDIRNQLRRNLTLTDLQSPKKGNAIPYFQMTPISTSLCWNDLSWFQSITRLPIILKGILTKEDAELAVKHNVQGIIVSNHGGRQLDEVLASIDALTEVVAAVKGKIEVYLDGGVRTGNDVLKALALGAKCIFLGRPILWGLACKGEHGVKEVLNILTNEFHTSMALTGCRSVAEINRNLVQFSRL

SEQ ID NO: 39174 - protein, 186 aa, Homo sapiens
  Payload ID: 7847
  Gene Symbol: HAO2
  Gene Name: hydroxyacid oxidase 2 (long chain)
  ENSP ID: ENSP00000393955
MSLVCLTDFQAHAREQLSKSTRDFIEGGADDSITRDDNIAAFKRIRLRPRYLRDVSEVDTRTTIQGEEISAPICIAPTGFHCLVWPDGEMSTARAPEGLRWFQLYVHPDLQLNKQLIQRVESLGFKALVITLDTPVCGNRRHDIRNQLRRNLTLTDLQSPKKGNAIPYFQMTPISTSLCWNDLSWF

SEQ ID NO: 39175 - protein, 351 aa, Homo sapiens; identical to SEQ ID NO: 39172
  Payload ID: 7847
  Gene Symbol: HAO2
  Gene Name: hydroxyacid oxidase 2 (long chain)
  Uniprot ID: Q9NYQ3
  ENSP ID: ENSP00000483507

SEQ ID NO: 39176 - protein, 314 aa, Homo sapiens
  Payload ID: 7848
  Gene Symbol: HADH
  Gene Name: hydroxyacyl-CoA dehydrogenase
  Uniprot ID: Q16836
  ENSP ID: ENSP00000312288
MAFVTRQFMRSVSSSSTASASAKKIIVKHVTVIGGGLMGAGIAQVAAATGHTVVLVDQTEDILAKSKKGIEESLRKVAKKKFAENLKAGDEFVEKTLSTIATSTDAASVVHSTDLVVEAIVENLKVKNELFKRLDKFAAEHTIFASNTSSLQITSIANATTRQDRFAGLHFFNPVPVMKLVEVIKTPMTSQKTFESLVDFSKALGKHPVSCKDTPGFIVNRLLVPYLMEAIRLYERGDASKEDIDTAMKLGAGYPMGPFELLDYVGLDTTKFIVDGWHEMDAENPLHQPSPSLNKLVAENKFGKKTGEGFYKYK

SEQ ID NO: 39177 - protein, 390 aa, Homo sapiens
  Payload ID: 7848
  Gene Symbol: HADH
  Gene Name: hydroxyacyl-CoA dehydrogenase
  ENSP ID: ENSP00000385638
MGRAGLEAPPPPCGVTGTPGARGLQGRVGPRPQSLAFRGCPPRASSLPGSPRCRRRCHTMAFVTRQFMRSVSSSSTASASAKKIIVKHVTVIGGGLMGAGIAQVAAATGHTVVLVDQTEDILAKSKKGIEESLRKVAKKKFAENLKAGDEFVEKTLSTIATSTDAASVVHSTDLVVEAIVENLKVKNELFKRLDKFAAEHTIFASNTSSLQITSIANATTRQDRFAGLHFFNPVPVMKLVEVIKTPMTSQKTFESLVDFSKALGKHPVSCKDTPGFIVNRLLVPYLMEAIRLYERDFQTCGDSNSGLGFSLKGDASKEDIDTAMKLGAGYPMGPFELLDYVGLDTTKFIVDGWHEMDAENPLHQPSPSLNKLVAENKFGKKTGEGFYKYK

SEQ ID NO: 39178 - protein, 52 aa, Homo sapiens
  Payload ID: 7848
  Gene Symbol: HADH
  Gene Name: hydroxyacyl-CoA dehydrogenase
  ENSP ID: ENSP00000425254
MAFVTRQFMRSVSSSSTASASAKKIIVKHVTVIGGGLMGAGIAQERGWPQQQ

SEQ ID NO: 39179 - protein, 318 aa, Homo sapiens
  Payload ID: 7848
  Gene Symbol: HADH
  Gene Name: hydroxyacyl-CoA dehydrogenase
  ENSP ID: ENSP00000425952
MCRTALGVTTLQDLGVCWRKEHDPAEMLRVGRAELGGWKPSWEAIVKEVAAATGHTVVLVDQTEDILAKSKKGIEESLRKVAKKKFAENLKAGDEFVEKTLSTIATSTDAASVVHSTDLVVEAIVENLKVKNELFKRLDKFAAEHTIFASNTSSLQITSIANATTRQDRFAGLHFFNPVPVMKLVEVIKTPMTSQKTFESLVDFSKALGKHPVSCKDTPGFIVNRLLVPYLMEAIRLYERGDASKEDIDTAMKLGAGYPMGPFELLDYVGLDTTKFIVDGWHEMDAENPLHQPSPSLNKLVAENKFGKKTGEGFYKYK

SEQ ID NO: 39180 - protein, 331 aa, Homo sapiens
  Payload ID: 7848
  Gene Symbol: HADH
  Gene Name: hydroxyacyl-CoA dehydrogenase
  Uniprot ID: Q16836
  ENSP ID: ENSP00000474560
MAFVTRQFMRSVSSSSTASASAKKIIVKHVTVIGGGLMGAGIAQVAAATGHTVVLVDQTEDILAKSKKGIEESLRKVAKKKFAENLKAGDEFVEKTLSTIATSTDAASVVHSTDLVVEAIVENLKVKNELFKRLDKFAAEHTIFASNTSSLQITSIANATTRQDRFAGLHFFNPVPVMKLVEVIKTPMTSQKTFESLVDFSKALGKHPVSCKDTPGFIVNRLLVPYLMEAIRLYERDFQTCGDSNSGLGFSLKGDASKEDIDTAMKLGAGYPMGPFELLDYVGLDTTKFIVDGWHEMDAENPLHQPSPSLNKLVAENKFGKKTGEGFYKYK

SEQ ID NO: 39181 - protein, 318 aa, Homo sapiens; identical to SEQ ID NO: 39179
  Payload ID: 7848
  Gene Symbol: HADH
  Gene Name: hydroxyacyl-CoA dehydrogenase
  ENSP ID: ENSP00000486771

SEQ ID NO: 39182 - protein, 763 aa, Homo sapiens
  Payload ID: 7849
  Gene Symbol: HADHA
  Gene Name: hydroxyacyl-CoA dehydrogenase/3-ketoacyl-CoA thiolase/enoyl-CoA hydratase (trifunctional protein), alpha subunit
  Uniprot ID: P40939
  ENSP ID: ENSP00000370023
MVACRAIGILSRFSAFRILRSRGYICRNFTGSSALLTRTHINYGVKGDVAVVRINSPNSKVNTLSKELHSEFSEVMNEIWASDQIRSAVLISSKPGCFIAGADINMLAACKTLQEVTQLSQEAQRIVEKLEKSTKPIVAAINGSCLGGGLEVAISCQYRIATKDRKTVLGTPEVLLGALPGAGGTQRLPKMVGVPAALDMMLTGRSIRADRAKKMGLVDQLVEPLGPGLKPPEERTIEYLEEVAITFAKGLADKKISPKRDKGLVEKLTAYAMTIPFVRQQVYKKVEEKVRKQTKGLYPAPLKIIDVVKTGIEQGSDAGYLCESQKFGELVMTKESKALMGLYHGQVLCKKNKFGAPQKDVKHLAILGAGLMGAGIAQVSVDKGLKTILKDATLTALDRGQQQVFKGLNDKVKKKALTSFERDSIFSNLTGQLDYQGFEKADMVIEAVFEDLSLKHRVLKEVEAVIPDHCIFASNTSALPISEIAAVSKRPEKVIGMHYFSPVDKMQLLEIITTEKTSKDTSASAVAVGLKQGKVIIVVKDGPGFYTTRCLAPMMSEVIRILQEGVDPKKLDSLTTSFGFPVGAATLVDEVGVDVAKHVAEDLGKVFGERFGGGNPELLTQMVSKGFLGRKSGKGFYIYQEGVKRKDLNSDMDSILASLKLPPKSEVSSDEDIQFRLVTRFVNEAVMCLQEGILATPAEGDIGAVFGLGFPPCLGGPFRFVDLYGAQKIVDRLKKYEAAYGKQFTPCQLLADHANSPNKKFYQ

SEQ ID NO: 39183 - protein, 250 aa, Homo sapiens
  Payload ID: 7849
  Gene Symbol: HADHA
  Gene Name: hydroxyacyl-CoA dehydrogenase/3-ketoacyl-CoA thiolase/enoyl-CoA hydratase (trifunctional protein), alpha subunit
  ENSP ID: ENSP00000438039
EKTSKDTSASAVAVGLKQGKVIIVVKDGPGFYTTRCLAPMMSEVIRILQEGVDPKKLDSLTTSFGFPVGAATLVDEVGVDVAKHVAEDLGKVFGERFGGGNPELLTQMVSKGFLGRKSGKGFYIYQEGVKRKDLNSDMDSILASLKLPPKSEVSSDEDIQFRLVTRFVNEAVMCLQEGILATPAEGDIGAVFGLGFPPCLGGWSRRLGRKLTLAWSPCCVSFNEVLFLYSGPFRFVDLYGAQKIVDRLKK

SEQ ID NO: 39184 - protein, 474 aa, Homo sapiens
  Payload ID: 7850
  Gene Symbol: HADHB
  Gene Name: hydroxyacyl-CoA dehydrogenase/3-ketoacyl-CoA thiolase/enoyl-CoA hydratase (trifunctional protein), beta subunit
  Uniprot ID: P55084
  ENSP ID: ENSP00000325136
MTILTYPFKNLPTASKWALRFSIRPLSCSSQLRAAPAVQTKTKKTLAKPNIRNVVVVDGVRTPFLLSGTSYKDLMPHDLARAALTGLLHRTSVPKEVVDYIIFGTVIQEVKTSNVAREAALGAGFSDKTPAHTVTMACISANQAMTTGVGLIASGQCDVIVAGGVELMSDVPIRHSRKMRKLMLDLNKAKSMGQRLSLISKFRFNFLAPELPAVSEFSTSETMGHSADRLAAAFAVSRLEQDEYALRSHSLAKKAQDEGLLSDVVPFKVPGKDTVTKDNGIRPSSLEQMAKLKPAFIKPYGTVTAANSSFLTDGASAMLIMAEEKALAMGYKPKAYLRDFMYVSQDPKDQLLLGPTYATPKVLEKAGLTMNDIDAFEFHEAFSGQILANFKAMDSDWFAENYMGRKTKVGLPPLEKFNNWGGSLSLGHPFGATGCRLVMAAANRLRKEGGQYGLVAACAAGGQGHAMIVEAYPK

SEQ ID NO: 39185 - protein, 351 aa, Homo sapiens
  Payload ID: 7850
  Gene Symbol: HADHB
  Gene Name: hydroxyacyl-CoA dehydrogenase/3-ketoacyl-CoA thiolase/enoyl-CoA hydratase (trifunctional protein), beta subunit
  ENSP ID: ENSP00000385411
MTILTYPFKNLPTASKWALRFSIRPLSCSSQLRAAPAVQTKTKKTLAKPNIRNVVVVDGVRTPFLLSGTSYKDLMPHDLARAALTGLLHRTSVPKEVVDYIIFGTVIQEVKTSNVAREAALGAGFSDKTPAHTVTMACISANQAMTTGKDTVTKDNGIRPSSLEQMAKLKPAFIKPYGTVTAANSSFLTDGASAMLIMAEEKALAMGYKPKAYLRDFMYVSQDPKDQLLLGPTYATPKVLEKAGLTMNDIDAFEFHEAFSGQILANFKAMDSDWFAENYMGRKTKVGLPPLEKFNNWGGSLSLGHPFGATGCRLVMAAANRLRKEGGQYGLVAACAAGGQGHAMIVEAYPK

SEQ ID NO: 39186 - protein, 175 aa, Homo sapiens
  Payload ID: 7850
  Gene Symbol: HADHB
  Gene Name: hydroxyacyl-CoA dehydrogenase/3-ketoacyl-CoA thiolase/enoyl-CoA hydratase (trifunctional protein), beta subunit
  ENSP ID: ENSP00000404633
MTILTYPFKNLPTASKWALRFSIRPLSCSSQLRAAPAVQTKTKKTLAKPNIRNVVVVDGVRTPFLLSGTSYKDLMPHDLARAALTGLLHRTSVPKEVVDYIIFGTVIQEVKTSNVAREAALGAGFSDKTPAHTVTMACISANQAMTTGVGLIASGQCDVIVAGGVELMSDVPIRH

SEQ ID NO: 39187 - protein, 84 aa, Homo sapiens
  Payload ID: 7850
  Gene Symbol: HADHB
  Gene Name: hydroxyacyl-CoA dehydrogenase/3-ketoacyl-CoA thiolase/enoyl-CoA hydratase (trifunctional protein), beta subunit
  ENSP ID: ENSP00000413103
MTILTYPFKNLPTASKWALRFSIRPLSCSSQLRAAPAVQTKTKKTLAKPNIRNVVVVDGVRTPFLLSGTSYKDLMPHDLARAAL

SEQ ID NO: 39188 - protein, 149 aa, Homo sapiens
  Payload ID: 7850
  Gene Symbol: HADHB
  Gene Name: hydroxyacyl-CoA dehydrogenase/3-ketoacyl-CoA thiolase/enoyl-CoA hydratase (trifunctional protein), beta subunit
  ENSP ID: ENSP00000415300
MTILTYPFKNLPTASKWALRFSIRPLSCSSQLRAAPAVQTKTKKTLAKPNIRNVVVVDGVRTPFLLSGTSYKDLMPHDLARAALTGLLHRTSVPKEVVDYIIFGTVIQEVKTSNVAREAALGAGFSDKTPAHTVTMACISANQAMTTGV

SEQ ID NO: 39189 - protein, 452 aa, Homo sapiens
  Payload ID: 7850
  Gene Symbol: HADHB
  Gene Name: hydroxyacyl-CoA dehydrogenase/3-ketoacyl-CoA thiolase/enoyl-CoA hydratase (trifunctional protein), beta subunit
  Uniprot ID: P55084
  ENSP ID: ENSP00000442665
MTLVSGWLLYGWIIAVQTKTKKTLAKPNIRNVVVVDGVRTPFLLSGTSYKDLMPHDLARAALTGLLHRTSVPKEVVDYIIFGTVIQEVKTSNVAREAALGAGFSDKTPAHTVTMACISANQAMTTGVGLIASGQCDVIVAGGVELMSDVPIRHSRKMRKLMLDLNKAKSMGQRLSLISKFRFNFLAPELPAVSEFSTSETMGHSADRLAAAFAVSRLEQDEYALRSHSLAKKAQDEGLLSDVVPFKVPGKDTVTKDNGIRPSSLEQMAKLKPAFIKPYGTVTAANSSFLTDGASAMLIMAEEKALAMGYKPKAYLRDFMYVSQDPKDQLLLGPTYATPKVLEKAGLTMNDIDAFEFHEAFSGQILANFKAMDSDWFAENYMGRKTKVGLPPLEKFNNWGGSLSLGHPFGATGCRLVMAAANRLRKEGGQYGLVAACAAGGQGHAMIVEAYPK

SEQ ID NO: 39190 - protein, 459 aa, Homo sapiens
  Payload ID: 7850
  Gene Symbol: HADHB
  Gene Name: hydroxyacyl-CoA dehydrogenase/3-ketoacyl-CoA thiolase/enoyl-CoA hydratase (trifunctional protein), beta subunit
  ENSP ID: ENSP00000444295
MTILTYPFKNLPTASKWALRFSIRPLSCSSQLRAAPAVQTKTKKTLAKPNIRNVVVVDGVRTPFLLSGTSGLLHRTSVPKEVVDYIIFGTVIQEVKTSNVAREAALGAGFSDKTPAHTVTMACISANQAMTTGVGLIASGQCDVIVAGGVELMSDVPIRHSRKMRKLMLDLNKAKSMGQRLSLISKFRFNFLAPELPAVSEFSTSETMGHSADRLAAAFAVSRLEQDEYALRSHSLAKKAQDEGLLSDVVPFKVPGKDTVTKDNGIRPSSLEQMAKLKPAFIKPYGTVTAANSSFLTDGASAMLIMAEEKALAMGYKPKAYLRDFMYVSQDPKDQLLLGPTYATPKVLEKAGLTMNDIDAFEFHEAFSGQILANFKAMDSDWFAENYMGRKTKVGLPPLEKFNNWGGSLSLGHPFGATGCRLVMAAANRLRKEGGQYGLVAACAAGGQGHAMIVEAYPK

SEQ ID NO: 39191 - protein, 260 aa, Homo sapiens [sequence omitted]

SEQ ID NO: 39192 - protein, 308 aa, Homo sapiens
  Payload ID: 7851
  Gene Symbol: HAGH
  Gene Name: hydroxyacylglutathione hydrolase
  Uniprot ID: Q16775
  ENSP ID: ENSP00000380514
MVVGRGLLGRRSLAALGAACARRGLGPALLGVFCHTDLRKNLTVDEGTMKVEVLPALTDNYMYLVIDDETKEAAIVDPVQPQKVVDAARKHGVKLTTVLTTHHHWDHAGGNEKLVKLESGLKVYGGDDRIGALTHKITHLSTLQVGSLNVKCLATPCHTSGHICYFVSKPGGSEPPAVFTGDTLFVAGCGKFYEGTADEMCKALLEVLGRLPPDTRVYCGHEYTINNLKFARHVEPGNAAIREKLAWAKEKYSIGEPTVPSTLAEEFTYNPFMRVREKTVQQHAGETDPVTTMRAVRREKDQFKMPRD

SEQ ID NO: 39193 - protein, 236 aa, Homo sapiens
  Payload ID: 7851
  Gene Symbol: HAGH
  Gene Name: hydroxyacylglutathione hydrolase
  Uniprot ID: Q16775
  ENSP ID: ENSP00000406552
MVVGRGLLGRRSLAALGAACARRGLGPALLGVFCHTDLRKNLTVDEGTMKVEVLPALTDNYMYLVIDDETKEAAIVDPVQPQKVVDAARKHGVKLTTVLTTHHHWDHAGGNEKLVKLESGLKVYGGDDRIGALTHKITHLSTLQVTPCLWLAAGSSMKGLRMRCVKLCWRSWAGSPRTQESTVATSTPSTTSSLHATWSPAMPPSGRSWPGPRRSTASGSPQCHPPWQRSLPTTPS

SEQ ID NO: 39194 - protein, 239 aa, Homo sapiens
  Payload ID: 7851
  Gene Symbol: HAGH
  Gene Name: hydroxyacylglutathione hydrolase
  ENSP ID: ENSP00000455355
  MOD_RES (1)..(1): Any amino acid
XKEAAIVDPVQPQKVVDAARKHGVKLTTVLTTHHHWDHAGGNEKLVKLESGLKVYGGDDRIGALTHKITHLSTLQVGSLNVKCLATPCHTSGHICYFVSKPGGSEPPAVFTGDTLFVAGCGKFYEGTADEMCKALLEVLGRLPPDTRVYCGHEYTINNLKFARHVEPGNAAIREKLAWAKEKYSIGEPTVPSTLAEEFTYNPFMRVREKTVQQHAGETDPVTTMRAVRREKDQFKMPRD

SEQ ID NO: 39195 - protein, 258 aa, Homo sapiens
  Payload ID: 7851
  Gene Symbol: HAGH
  Gene Name: hydroxyacylglutathione hydrolase
  ENSP ID: ENSP00000455422
MKVEVLPALTDNYMYLVIDDETKEAAIVDPVQPQKVVDAARKHGVKLTTVLTTHHHWDHAGGNEKLVKLESGLKVYGGDDRIGALTHKITHLSTLQVGSLNVKCLATPCHTSGHICYFVSKPGGSEPPAVFTGDTLFVAGCGKFYEGTADEMCKALLEVLGRLPPDTRVYCGHEYTINNLKFARHVEPGNAAIREKLAWAKEKYSIGEPTVPSTLAEEFTYNPFMRVSGPGSSGGRGSAQPAARCWPPQGEDGAAARR

SEQ ID NO: 39196 - protein, 160 aa, Homo sapiens
  Payload ID: 7851
  Gene Symbol: HAGH
  Gene Name: hydroxyacylglutathione hydrolase
  ENSP ID: ENSP00000455970
MKVEVLPALTDNYMYLVIDDETKEAAIVDPVQPQKVVDAARKHGVKLTTVLTTHHHWDHAGGNEKLVKLESGLKVYGGDDRIGALTHKITHLSTLQVGSLNVKCLATPCHTSGHICYFVSKPGGSEPPAVFTGDTLFVAGCGKFYEGTADEMCKALLEVL

SEQ ID NO: 39197 - protein, 64 aa, Homo sapiens
  Payload ID: 7851
  Gene Symbol: HAGH
  Gene Name: hydroxyacylglutathione hydrolase
  ENSP ID: ENSP00000457986
LAWAKEKYSIGEPTVPSTLAEEFTYNPFMRVREKTVQQHAGETDPVTTMRAVRREKDQFKMPRD

SEQ ID NO: 39198 - protein, 290 aa, Homo sapiens
  Payload ID: 7852
  Gene Symbol: HAGHL
  Gene Name: hydroxyacylglutathione hydrolase-like
  Uniprot ID: Q6PII5
  ENSP ID: ENSP00000341952
MKVKVIPVLEDNYMYLVIEELTREAVAVDVAVPKRLLEIVGREGVSLTAVLTTHHHWDHARGNPELARLRPGLAVLGADERIFSLTRRLAHGEELRFGAIHVRCLLTPGHTAGHMSYFLWEDDCPDPPALFSGDALSVAGCGSCLEGSAQQMYQSLAELGTLPPETKVFCGHEHTLSNLEFAQKVEPCNDHVRAKLSWAKARPLSRRGKRVGGEGTGFGVGGALRQGLMVTGACGHSRRGMRMTCPLCRRLWARSASTTPSCGWREYGCCPGASTVTWTLRKASGDCVLG

SEQ ID NO: 39199 - protein, 282 aa, Homo sapiens
  Payload ID: 7852
  Gene Symbol: HAGHL
  Gene Name: hydroxyacylglutathione hydrolase-like
  Uniprot ID: Q6PII5
  ENSP ID: ENSP00000374353
MKVKVIPVLEDNYMYLVIEELTREAVAVDVAVPKRLLEIVGREGVSLTAVLTTHHHWDHARGNPELARLRPGLAVLGADERIFSLTRRLAHGEELRFGAIHVRCLLTPGHTAGHMSYFLWEDDCPDPPALFSGDALSVAGCGSCLEGSAQQMYQSLAELGTLPPETKVFCGHEHTLSNLEFAQKVEPCNDHVRAKLSWAKKRDEDDVPTVPSTLGEERLYNPFLRVAEEPVRKFTGKAVPADVLEALCKERARFEQAGEPRQPQARALLALQWGLLSAAPHD

SEQ ID NO: 39200 - protein, 202 aa, Homo sapiens
  Payload ID: 7852
  Gene Symbol: HAGHL
  Gene Name: hydroxyacylglutathione hydrolase-like
  Uniprot ID: Q6PII5
  ENSP ID: ENSP00000447170
MKVKVIPVLEDNYMYLVIEELTREAVAVDVAVPKRLLEIVGREGVSLTAVLTTHHHWDHARGNPELARLRPGLAVLGADERIFSLTRRLAHGEELRFGAIHVRCLLTPGHTAGHMSYFLWEDDCPDPPALFSGTRSAERAHPASRRPRPICSDPPSPARRRAVGGRLRLVPGGQRPADVPEPGRAGYPAPRDEGVLRPRAHA

SEQ ID NO: 39201 - protein, 84 aa, Homo sapiens
  Payload ID: 7852
  Gene Symbol: HAGHL
  Gene Name: hydroxyacylglutathione hydrolase-like
  ENSP ID: ENSP00000454712
MKVKVIPVLEDNYMYLVIEELTREAVAVDVAVPKRGPRAGKPGAGAASSRAGGAGRGRAHLLADAQAGARRGAAEGVLRPRAHA

SEQ ID NO: 39202 - protein, 192 aa, Homo sapiens
  Payload ID: 7852
  Gene Symbol: HAGHL
  Gene Name: hydroxyacylglutathione hydrolase-like
  ENSP ID: ENSP00000455616
MKVKVIPVLEDNYMYLVIEELTREAVAVDVAVPKRLLEIVGREGVSLTAVLTTHHHWDHARGNPELARLRPGLAVLGADERIFSLTRRLAHGEELRFGAIHVRCLLTPGHTAGHMSYFLWEDDCPDPPALFSGTRSAERAHPASRRPRPICSDPPSPARRRAVGGRLRLVPGGQRPADVPEPGRAGYPAPRD

SEQ ID NO: 39203 - protein, 108 aa, Homo sapiens
  Payload ID: 7852
  Gene Symbol: HAGHL
  Gene Name: hydroxyacylglutathione hydrolase-like
  ENSP ID: ENSP00000456104
MEGVGHRDRLCYRHSRPFQLLEIVGREGVSLTAVLTTHHHWDHARGNPELARLRPGLAVLGADERIFSLTRRLAHGEELRFGAIHVRCLLTPGHTAGHMSYFLWEDDC

SEQ ID NO: 39204 - protein, 227 aa, Homo sapiens
  Payload ID: 7852
  Gene Symbol: HAGHL
  Gene Name: hydroxyacylglutathione hydrolase-like
  ENSP ID: ENSP00000456390
MKVKVIPVLEDNYMYLVIEELTREAVAVDVAVPKRLLEIVGREGVSLTAVLTTHHHWDHARGNPELARLRPGLAVLGADERIFSLTRRLAHGEELRFGAIHVRCLLTPGHTAGHMSYFLWEDDCPDPPALFSGDALSVAGCGSCLEGSAQQMYQSLAELGTLPPETKVFCGHEHTLSNLEFAQKVEPCNDHVRAKLSWAKKRDEDDVPTVPSTLGEERLYNPFLRVA

SEQ ID NO: 39205 - protein, 200 aa, Homo sapiens
  Payload ID: 7852
  Gene Symbol: HAGHL
  Gene Name: hydroxyacylglutathione hydrolase-like
  ENSP ID: ENSP00000456978
MKVKVIPVLEDNYMYLVIEELTREAVAVDVAVPKRLLEIVGREGVSLTAVLTTHHHWDHARGNPELARLRPGLAVLGADERIFSLTRRLAHGEELRFGAIHVRCLLTPGHTAGHMSYFLWEDDCPDPPALFSGDALSVAGCGSCLEGSAQQMYQSLAELGTLPPETKVFCGHEHTLSNLEFAQKVEPCNDHVRAKLSWAK

SEQ ID NO: 39206 - protein, 202 aa, Homo sapiens; identical to SEQ ID NO: 39200
  Payload ID: 7852
  Gene Symbol: HAGHL
  Gene Name: hydroxyacylglutathione hydrolase-like
  Uniprot ID: Q6PII5
  ENSP ID: ENSP00000457219

SEQ ID NO: 39207 - protein, 94 aa, Homo sapiens
  Payload ID: 7852
  Gene Symbol: HAGHL
  Gene Name: hydroxyacylglutathione hydrolase-like
  ENSP ID: ENSP00000457486
GHTAGHMSYFLWEDDCPDPPALFSGTRSAERAHPASRRPRPICSDPPSPARRRAVGGRLRLVPGGQRPADVPEPGRAGYPAPRDEGVLRPRAHA

SEQ ID NO: 39208 - protein, 21 aa, Homo sapiens
  Payload ID: 7852
  Gene Symbol: HAGHL
  Gene Name: hydroxyacylglutathione hydrolase-like
  ENSP ID: ENSP00000458711
  MOD_RES (1)..(1): Any amino acid
XGRAGYPAPRDEGVLRPRAHA

SEQ ID NO: 39209 - protein, 13 aa, Homo sapiens
  Payload ID: 7852
  Gene Symbol: HAGHL
  Gene Name: hydroxyacylglutathione hydrolase-like
  ENSP ID: ENSP00000459148
MKVKVIPVLEDNY

SEQ ID NO: 39210 - protein, 172 aa, Homo sapiens
  Payload ID: 7852
  Gene Symbol: HAGHL
  Gene Name: hydroxyacylglutathione hydrolase-like
  ENSP ID: ENSP00000460451
MKVKVIPVLEDNYMYLVIEELTREAVAVDVAVPKRLLEIVGREGVSLTAVLTTHHHWDHARGNPELARLRPGLAVLGADERIFSLTRRLAHGEELRFGAIHVRCLLTPGHTAGHMSYFLWEDDCPDPPALFSGDALSVAGCGSCLEGSAQQMYQSLAELGTLPPETVSGPGP

SEQ ID NO: 39211 - protein, 76 aa, Homo sapiens
  Payload ID: 7853
  Gene Symbol:
  Gene Name: Hydroxyacyl-thioester dehydratase type 2, mitochondrial [Source:UniProtKB/Swiss-Prot
  Acc:P86397]
  ENSP ID: ENSP00000477762
MFPLISSHHLWWGGLRRTVCLNLPVLTLQHFQHMHIKVGDRAELRRAFTQTDVATFSELTGDVNPLHLNEDFAKHT

SEQ ID NO: 39212 - protein, 71 aa, Homo sapiens
  Payload ID: 7853
  Gene Symbol:
  Gene Name: Hydroxyacyl-thioester dehydratase type 2, mitochondrial [Source:UniProtKB/Swiss-Prot
  Acc:P86397]
  ENSP ID: ENSP00000478964
MFPLISSHHLWWGGLRRTVCLNLPVLTLQHFQHMHIKVGDRAELRRAFTQTDVATFSELTGDVNPLHLNED

SEQ ID NO: 39213 - protein, 168 aa, Homo sapiens [sequence omitted]

SEQ ID NO: 39214 - protein, 54 aa, Homo sapiens
  Payload ID: 7853
  Gene Symbol:
  Gene Name: Hydroxyacyl-thioester dehydratase type 2, mitochondrial [Source:UniProtKB/Swiss-Prot
  Acc:P86397]
  ENSP ID: ENSP00000481678
MFPLISSHHLWWGGLRRTVCLNLPVLTLQHFQHMHIKVGDRAELRRAFTQTDVA

SEQ ID NO: 39215 - protein, 168 aa, Homo sapiens [sequence omitted]

SEQ ID NO: 39216 - protein, 168 aa, Homo sapiens [sequence omitted]

SEQ ID NO: 39217 - protein, 346 aa, Homo sapiens
  Payload ID: 7854
  Gene Symbol: HCAR1
  Gene Name: hydroxycarboxylic acid receptor 1
  Uniprot ID: Q9BXC0
  ENSP ID: ENSP00000389255
MYNGSCCRIEGDTISQVMPPLLIVAFVLGALGNGVALCGFCFHMKTWKPSTVYLFNLAVADFLLMICLPFRTDYYLRRRHWAFGDIPCRVGLFTLAMNRAGSIVFLTVVAADRYFKVVHPHHAVNTISTRVAAGIVCTLWALVILGTVYLLLENHLCVQETAVSCESFIMESANGWHDIMFQLEFFMPLGIILFCSFKIVWSLRRRQQLARQARMKKATRFIMVVAIVFITCYLPSVSARLYFLWTVPSSACDPSVHGALHITLSFTYMNSMLDPLVYYFSSPSFPKFYNKLKICSLKPKQPGHSKTQRPEEMPISNLGRRSCISVANSFQSQSDGQWDPHIVEWH

SEQ ID NO: 39218 - protein, 363 aa, Homo sapiens [sequence omitted]

SEQ ID NO: 39219 - protein, 387 aa, Homo sapiens
  Payload ID: 7856
  Gene Symbol: HCAR3
  Gene Name: hydroxycarboxylic acid receptor 3
  Uniprot ID: P49019
  ENSP ID: ENSP00000436714
MNRHHLQDHFLEIDKKNCCVFRDDFIAKVLPPVLGLEFIFGLLGNGLALWIFCFHLKSWKSSRIFLFNLAVADFLLIICLPFVMDYYVRRSDWKFGDIPCRLVLFMFAMNRQGSIIFLTVVAVDRYFRVVHPHHALNKISNWTAAIISCLLWGITVGLTVHLLKKKLLIQNGTANVCISFSICHTFRWHEAMFLLEFFLPLGIILFCSARIIWSLRQRQMDRHAKIKRAITFIMVVAIVFVICFLPSVVVRIHIFWLLHTSGTQNCEVYRSVDLAFFITLSFTYMNSMLDPVVYYFSSPSFPNFFSTLINRCLQRKITGEPDNNRSTSVELTGDPNKTRGAPEALIANSGEPWSPSYLGPTSNNHSKKGHCHQEPASLEKQLGCCIE

SEQ ID NO: 39220 - protein, 373 aa, Homo sapiens
  Payload ID: 7857
  Gene Symbol: HSD3B1
  Gene Name: hydroxy-delta-5-steroid dehydrogenase, 3 beta- and steroid delta-isomerase 1
  Uniprot ID: P14060
  ENSP ID: ENSP00000358421
MTGWSCLVTGAGGFLGQRIIRLLVKEKELKEIRVLDKAFGPELREEFSKLQNKTKLTVLEGDILDEPFLKRACQDVSVIIHTACIIDVFGVTHRESIMNVNVKGTQLLLEACVQASVPVFIYTSSIEVAGPNSYKEIIQNGHEEEPLENTWPAPYPHSKKLAEKAVLAANGWNLKNGGTLYTCALRPMYIYGEGSRFLSASINEALNNNGILSSVGKFSTVNPVYVGNVAWAHILALRALQDPKKAPSIRGQFYYISDDTPHQSYDNLNYTLSKEFGLRLDSRWSFPLSLMYWIGFLLEIVSFLLRPIYTYRPPFNRHIVTLSNSVFTFSYKKAQRDLAYKPLYSWEEAKQKTVEWVGSLVDRHKETLKSKTQ

SEQ ID NO: 39221 - protein, 373 aa, Homo sapiens; identical to SEQ ID NO: 39220
  Payload ID: 7857
  Gene Symbol: HSD3B1
  Gene Name: hydroxy-delta-5-steroid dehydrogenase, 3 beta- and steroid delta-isomerase 1
  Uniprot ID: P14060
  ENSP ID: ENSP00000432268

SEQ ID NO: 39222 - protein, 81 aa, Homo sapiens
  Payload ID: 7857
  Gene Symbol: HSD3B1
  Gene Name: hydroxy-delta-5-steroid dehydrogenase, 3 beta- and steroid delta-isomerase 1
  ENSP ID: ENSP00000435999
MTGWSCLVTGAGGFLGQRIIRLLVKEKELKEIRVLDKAFGPELREEFSKLQNKTKLTVLEGDILDEPFLKRACQDVSVIIH

SEQ ID NO: 39223 - protein, 372 aa, Homo sapiens
  Payload ID: 7858
  Gene Symbol: HSD3B2
  Gene Name: hydroxy-delta-5-steroid dehydrogenase, 3 beta- and steroid delta-isomerase 2
  Uniprot ID: P26439
  ENSP ID: ENSP00000358424
MGWSCLVTGAGGLLGQRIVRLLVEEKELKEIRALDKAFRPELREEFSKLQNRTKLTVLEGDILDEPFLKRACQDVSVVIHTACIIDVFGVTHRESIMNVNVKGTQLLLEACVQASVPVFIYTSSIEVAGPNSYKEIIQNGHEEEPLENTWPTPYPYSKKLAEKAVLAANGWNLKNGDTLYTCALRPTYIYGEGGPFLSASINEALNNNGILSSVGKFSTVNPVYVGNVAWAHILALRALRDPKKAPSVRGQFYYISDDTPHQSYDNLNYILSKEFGLRLDSRWSLPLTLMYWIGFLLEVVSFLLSPIYSYQPPFNRHTVTLSNSVFTFSYKKAQRDLAYKPLYSWEEAKQKTVEWVGSLVDRHKETLKSKTQ

SEQ ID NO: 39224 - protein, 195 aa, Homo sapiens
  Payload ID: 7858
  Gene Symbol: HSD3B2
  Gene Name: hydroxy-delta-5-steroid dehydrogenase, 3 beta- and steroid delta-isomerase 2
  ENSP ID: ENSP00000388292
MGWSCLVTGAGGLLGQRIVRLLVEEKELKEIRALDKAFRPELREEFSKLQNRTKLTVLEGDILDEPFLKRACQDVSVVIHTACIIDVFGVTHRESIMNVNVKGTQLLLEACVQASVPVFIYTSSIEVAGPNSYKEIIQNGHEEEPLENTWPTPYPYSKKLAEKAVLAANGWNLKNGDTLYTCALRPTYIYGEGGP

SEQ ID NO: 39225 - protein, 372 aa, Homo sapiens; identical to SEQ ID NO: 39223
  Payload ID: 7858
  Gene Symbol: HSD3B2
  Gene Name: hydroxy-delta-5-steroid dehydrogenase, 3 beta- and steroid delta-isomerase 2
  Uniprot ID: P26439
  ENSP ID: ENSP00000445122

SEQ ID NO: 39226 - protein, 196 aa, Homo sapiens
  Payload ID: 7859
  Gene Symbol: HSD3B7
  Gene Name: hydroxy-delta-5-steroid dehydrogenase, 3 beta- and steroid delta-isomerase 7
  Uniprot ID: Q9H2F3
  ENSP ID: ENSP00000262520
MADSAQAQKLVYLVTGGCGFLGEHVVRMLLQREPRLGELRVFDQHLGPWLEELKTGPVRVTAIQGDVTQAHEVAAAVAGAHVVIHTAGLVDVFGRASPKTIHEVNVQGTRNVIEACVQTGTRFLVYTSSMEVVGPNTKGHPFYRGNEDTPYEAVHRHPYPCSKALAEWLVLEANGRKAMLPGCTCWQPGSWSSGQP

SEQ ID NO: 39227 - protein, 369 aa, Homo sapiens
  Payload ID: 7859
  Gene Symbol: HSD3B7
  Gene Name: hydroxy-delta-5-steroid dehydrogenase, 3 beta- and steroid delta-isomerase 7
  Uniprot ID: Q9H2F3
  ENSP ID: ENSP00000297679
MADSAQAQKLVYLVTGGCGFLGEHVVRMLLQREPRLGELRVFDQHLGPWLEELKTGPVRVTAIQGDVTQAHEVAAAVAGAHVVIHTAGLVDVFGRASPKTIHEVNVQGTRNVIEACVQTGTRFLVYTSSMEVVGPNTKGHPFYRGNEDTPYEAVHRHPYPCSKALAEWLVLEANGRKVRGGLPLVTCALRPTGIYGEGHQIMRDFYRQGLRLGGWLFRAIPASVEHGRVYVGNVAWMHVLAARELEQRATLMGGQVYFCYDGSPYRSYEDFNMEFLGPCGLRLVGARPLLPYWLLVFLAALNALLQWLLRPLVLYAPLLNPYTLAVANTTFTVSTDKAQRHFGYEPLFSWEDSRTRTILWVQAATGSAQ

SEQ ID NO: 39228 - protein, 176 aa, Homo sapiens
  Payload ID: 7859
  Gene Symbol: HSD3B7
  Gene Name: hydroxy-delta-5-steroid dehydrogenase, 3 beta- and steroid delta-isomerase 7
  ENSP ID: ENSP00000459689
MADSAQAQKLVYLVTGGCGFLGEHVVRMLLQREPRLGELRVFDQHLGPWLEELKTGPVRVTAIQGDVTQAHEVAAAVAGAHVVIHTAGLVDVFGRASPKTIHEVNVQGTRNVIEACVQTGTRFLVYTSSMEVVGPNTKGHPFYRGNEDTPYEAVHRHPYPCSKALAEWLVLEANGR

SEQ ID NO: 39229 - protein, 219 aa, Homo sapiens
  Payload ID: 7859
  Gene Symbol: HSD3B7
  Gene Name: hydroxy-delta-5-steroid dehydrogenase, 3 beta- and steroid delta-isomerase 7
  ENSP ID: ENSP00000459852
MADSAQAQKLVYLVTGGCGFLGEHVVRMLLQREPRLGELRVFDQHLGPWLEELKTGSCWGSLWWRGCGRFPNPSQAGIPTPAVEQMMLVSVHMDGSRPVRVTAIQGDVTQAHEVAAAVAGAHVVIHTAGLVDVFGRASPKTIHEVNVQGTRNVIEACVQTGTRFLVYTSSMEVVGPNTKGHPFYRGNEDTPYEAVHRHPYPCSKALAEWLVLEANGRKV

SEQ ID NO: 39230 - protein, 373 aa, Homo sapiens
  Payload ID: 7860
  Gene Symbol: HYKK
  Gene Name: hydroxylysine kinase
  Uniprot ID: A2RU49
  ENSP ID: ENSP00000373640
MSSGNYQQSEALSKPTFSEEQASALVESVFGLKVSKVRPLPSYDDQNFHVYVSKTKDGPTEYVLKISNTKASKNPDLIEVQNHIIMFLKAAGFPTASVCHTKGDNTASLVSVDSGSEIKSYLVRLLTYLPGRPIAELPVSPQLLYEIGKLAAKLDKTLQRFHHPKLSSLHRENFIWNLKNVPLLEKYLYALGQNRNREIVEHVIHLFKEEVMTKLSHFRECINHGDLNDHNILIESSKSASGNAEYQVSGILDFGDMSYGYYVFEVAITIMYMMIESKSPIQVGGHVLAGFESITPLTAVEKGALFLLVCSRFCQSLVMAAYSCQLYPENKDYLMVTAKTGWKHLQQMFDMGQKAVEEIWFETAKSYESGISM

SEQ ID NO: 39231 - protein, 220 aa, Homo sapiens
  Payload ID: 7860
  Gene Symbol: HYKK
  Gene Name: hydroxylysine kinase
  Uniprot ID: A2RU49
  ENSP ID: ENSP00000386197
MSSGNYQQSEALSKPTFSEEQASALVESVFGLKVSKVRPLPSYDDQNFHVYVSKTKDGPTEYVLKISNTKASKNPDLIEVQNHIIMFLKAAGFPTASVCHTKGDNTASLVSVDSGSEIKSYLVRLLTYLPGRPIAELPVSPQLLYEIGKLAAKLDKTLQRFHHPKLSSLHRENFIWNLKNVPLLEKYLYALGQNRNREIVEHVIHLFKEEVMTKLSHFRE

SEQ ID NO: 39232 - protein, 220 aa, Homo sapiens; identical to SEQ ID NO: 39231
  Payload ID: 7860
  Gene Symbol: HYKK
  Gene Name: hydroxylysine kinase
  Uniprot ID: A2RU49
  ENSP ID: ENSP00000454850

SEQ ID NO: 39233 - protein, 373 aa, Homo sapiens; identical to SEQ ID NO: 39230
  Payload ID: 7860
  Gene Symbol: HYKK
  Gene Name: hydroxylysine kinase
  Uniprot ID: A2RU49
  ENSP ID: ENSP00000455459

SEQ ID NO: 39234 - protein, 172 aa, Homo sapiens
  Payload ID: 7860
  Gene Symbol: HYKK
  Gene Name: hydroxylysine kinase
  Uniprot ID: A2RU49
  ENSP ID: ENSP00000456614
MSSGNYQQSEALSKPTFSEEQASALVESVFGLKVSKVRPLPSYDDQNFHVYVSKTKDGPTEYVLKISNTKASKNPDLIEVQNHIIMFLKAAGFPTASVCHTKGDNTASLVSVDSGSEIKSYLVRLLTYLPGRPIAELPVSPQLLYEIGKLAAKLDKTLQEGKPRVTPLLAKN

SEQ ID NO: 39235 - protein, 226 aa, Homo sapiens
  Payload ID: 7860
  Gene Symbol: HYKK
  Gene Name: hydroxylysine kinase
  ENSP ID: ENSP00000457154
MSSGNYQQSEALSKPTFSEEQASALVESVFGLKVSKVRPLPSYDDQNFHVYVSKTKDGPTEYVLKISNTKASKNPDLIEVQNHIIMFLKAAGFPTASVCHTKGDNTASLVSVDSGSEIKSYLVRLLTYLPGRPIAELPVSPQLLYEIGKLAAKLDKTLQRFHHPKLSSLHRENFIWNLKNVPLLEKYLYALGQNRNREIVEHVIHLFKEEVMTKLSHFRECEYSPN

SEQ ID NO: 39236 - protein, 361 aa, Homo sapiens [sequence omitted]

SEQ ID NO: 39237 - protein, 344 aa, Homo sapiens
  Payload ID: 7861
  Gene Symbol: HMBS
  Gene Name: hydroxymethylbilane synthase
  Uniprot ID: P08397
  ENSP ID: ENSP00000376584
MRVIRVGTRKSQLARIQTDSVVATLKASYPGLQFEIIAMSTTGDKILDTALSKIGEKSLFTKELEHALEKNEVDLVVHSLKDLPTVLPPGFTIGAICKRENPHDAVVFHPKFVGKTLETLPEKSVVGTSSLRRAAQLQRKFPHLEFRSIRGNLNTRLRKLDEQQEFSAIILATAGLQRMGWHNRVGQILHPEECMYAVGQGALGVEVRAKDQDILDLVGVLHDPETLLRCIAERAFLRHLEGGCSVPVAVHTAMKDGQLYLTGGVWSLDGSDSIQETMQATIHVPAQHEDGPEDDPQLVGITARNIPRGPQLAAQNLGISLANLLLSKGAKNILDVARQLNDAH

SEQ ID NO: 39238 - protein, 344 aa, Homo sapiens; identical to SEQ ID NO: 39237
  Payload ID: 7861
  Gene Symbol: HMBS
  Gene Name: hydroxymethylbilane synthase
  Uniprot ID: P08397
  ENSP ID: ENSP00000392041

SEQ ID NO: 39239 - protein, 321 aa, Homo sapiens
  Payload ID: 7861
  Gene Symbol: HMBS
  Gene Name: hydroxymethylbilane synthase
  Uniprot ID: P08397
  ENSP ID: ENSP00000438424
MSGNGNAAATAEENSPKMRVIRVGTRKSQLARIQTDSVVATLKASYPGLQFEIIAMSTTGDKILDTALSKIGEKSLFTKELEHALEKNEVDLVVHSLKDLPTVLPPGFTIGAICKRENPHDAVVFHPKFVGKTLETLPEKSVVGTSSLRRAAQLQRKFPHLEFRSIRGNLNTRLRKLDEQQEFSAIILATAGLQRMGWHNRVGQILHPEECMYAVGQEGGCSVPVAVHTAMKDGQLYLTGGVWSLDGSDSIQETMQATIHVPAQHEDGPEDDPQLVGITARNIPRGPQLAAQNLGISLANLLLSKGAKNILDVARQLNDAH

SEQ ID NO: 39240 - protein, 119 aa, Homo sapiens
  Payload ID: 7861
  Gene Symbol: HMBS
  Gene Name: hydroxymethylbilane synthase
  ENSP ID: ENSP00000438726
MSGNGNAAATAEENSPKMRVIRVGTRKSQLARIQTDSVVATLKASYPGLQFEIRDKILDTALSKIGEKSLFTKELEHALEKNEVDLVVHSLKDLPTVLPPGFTIGAICKRENPHDAVVF

SEQ ID NO: 39241 - protein, 63 aa, Homo sapiens
  Payload ID: 7861
  Gene Symbol: HMBS
  Gene Name: hydroxymethylbilane synthase
  ENSP ID: ENSP00000439904
MSGNGNAAATALARIQTDSVVATLKASYPGLQFEISEFSGKEWKLMGSPVPREERTQHFWLCL

SEQ ID NO: 39242 - protein, 187 aa, Homo sapiens
  Payload ID: 7861
  Gene Symbol: HMBS
  Gene Name: hydroxymethylbilane synthase
  ENSP ID: ENSP00000440092
MRVIRVGTRKSQLARIQTDSVVATLKASYPGLQFEIIAMSTTGDKILDTALSKIGEKSLFTKELEHALEKNEVDLVVHSLKDLPTVLPPGFTIGAICKRENPHDAVVFHPKFVGKTLETLPEKSVVGTSSLRRAAQLQRKFPHLEFRSIRGNLNTRLRKLDEQQEFSAIILATAGLQRMGWHNRVGQ

SEQ ID NO: 39243 - protein, 187 aa, Homo sapiens; identical to SEQ ID NO: 39242
  Payload ID: 7861
  Gene Symbol: HMBS
  Gene Name: hydroxymethylbilane synthase
  ENSP ID: ENSP00000442079

SEQ ID NO: 39244 - protein, 304 aa, Homo sapiens
  Payload ID: 7861
  Gene Symbol: HMBS
  Gene Name: hydroxymethylbilane synthase
  Uniprot ID: P08397
  ENSP ID: ENSP00000443058
MRVIRVGTRKSQLARIQTDSVVATLKASYPGLQFEIIAMSTTGDKILDTALSKIGEKSLFTKELEHALEKNEVDLVVHSLKDLPTVLPPGFTIGAICKRENPHDAVVFHPKFVGKTLETLPEKSVVGTSSLRRAAQLQRKFPHLEFRSIRGNLNTRLRKLDEQQEFSAIILATAGLQRMGWHNRVGQILHPEECMYAVGQEGGCSVPVAVHTAMKDGQLYLTGGVWSLDGSDSIQETMQATIHVPAQHEDGPEDDPQLVGITARNIPRGPQLAAQNLGISLANLLLSKGAKNILDVARQLNDAH

SEQ ID NO: 39245 - protein, 344 aa, Homo sapiens; identical to SEQ ID NO: 39237
  Payload ID: 7861
  Gene Symbol: HMBS
  Gene Name: hydroxymethylbilane synthase
  Uniprot ID: P08397
  ENSP ID: ENSP00000444730

SEQ ID NO: 39246 - protein, 81 aa, Homo sapiens
  Payload ID: 7861
  Gene Symbol: HMBS
  Gene Name: hydroxymethylbilane synthase
  ENSP ID: ENSP00000444817
MSGNGNAAATAVSAEPVTSTLWASGRAVQRLAPGCHPQSSIGRKQPKDESDSRGYPQEPACSHTDGQCGGNIESLVPWPAV

SEQ ID NO: 39247 - protein, 81 aa, Homo sapiens
  Payload ID: 7861
  Gene Symbol: HMBS
  Gene Name: hydroxymethylbilane synthase
  ENSP ID: ENSP00000444849
MSGNGNAAATAEENSPKMRVIRVGTRKSQLARIQTDSVVATLKASYPGLQFEISEFSGKEWKLMGSPVPREERTQHFWLCL

SEQ ID NO: 39248 - protein, 330 aa, Homo sapiens
  Payload ID: 7861
  Gene Symbol: HMBS
  Gene Name: hydroxymethylbilane synthase
  ENSP ID: ENSP00000445429
MSGNGNAAATALARIQTDSVVATLKASYPGLQFEIIAMSTTGDKILDTALSKIGEKSLFTKELEHALEKNEVDLVVHSLKDLPTVLPPGFTIGAICKRENPHDAVVFHPKFVGKTLETLPEKSVVGTSSLRRAAQLQRKFPHLEFRSIRGNLNTRLRKLDEQQEFSAIILATAGLQRMGWHNRVGQGALGVEVRAKDQDILDLVGVLHDPETLLRCIAERAFLRHLEGGCSVPVAVHTAMKDGQLYLTGGVWSLDGSDSIQETMQATIHVPAQHEDGPEDDPQLVGITARNIPRGPQLAAQNLGISLANLLLSKGAKNILDVARQLNDAH

SEQ ID NO: 39249 - protein, 191 aa, Homo sapiens
  Payload ID: 7861
  Gene Symbol: HMBS
  Gene Name: hydroxymethylbilane synthase
  ENSP ID: ENSP00000445599
MSGNGNAAATAEENSPKMRVIRVGTRKSQLARIQTDSVVATLKASYPGLQFEIIAMSTTGDKILDTALSKIGEKSLFTKELEHALEKNERENPHDAVVFHPKFVGKTLETLPEKSVVGTSSLRRAAQLQRKFPHLEFRSIRGNLNTRLRKLDEQQEFSAIILATAGLQRMGWHNRVGQILHPEECMYAVGQ

SEQ ID NO: 39250 - protein, 178 aa, Homo sapiens
  Payload ID: 7862
  Gene Symbol: HPGD
  Gene Name: hydroxyprostaglandin dehydrogenase 15-(NAD)
  Uniprot ID: P15428
  ENSP ID: ENSP00000296521
MHVNGKVALVTGAAQGIGRAFAEALLLKGAKVALVDWNLEAGVQCKAALDEQFEPQKTLFIQCDVADQQQLRDTFRKVVDHFGRLDILVNNAGVNNEKNWEKTLQINLVSVISGTYLGLDYMSKQNGGEGGIIINMSSLAGLMPVAQQPVYCASKHGIVGFTRSAAPTIDCQWIDNTH

SEQ ID NO: 39251 - protein, 266 aa, Homo sapiens [sequence omitted]

SEQ ID NO: 39252 - protein, 198 aa, Homo sapiens
  Payload ID: 7862
  Gene Symbol: HPGD
  Gene Name: hydroxyprostaglandin dehydrogenase 15-(NAD)
  Uniprot ID: P15428
  ENSP ID: ENSP00000398720
MHVNGKVALVTGAAQGIGRAFAEALLLKGAKVALVDWNLEAGVQCKAALDEQFEPQKTLFIQCDVADQQQLRGLMPVAQQPVYCASKHGIVGFTRSAALAANLMNSGVRLNAICPGFVNTAILESIEKEENMGQYIEYKDHIKDMIKYYGILDPPLIANGLITLIEDDALNGAIMKITTSKGIHFQDYDTTPFQAKTQ

SEQ ID NO: 39253 - protein, 176 aa, Homo sapiens
  Payload ID: 7862
  Gene Symbol: HPGD
  Gene Name: hydroxyprostaglandin dehydrogenase 15-(NAD)
  ENSP ID: ENSP00000420892
MHVNGKVALVTGAAQGIGRAFAEALLLKGAKVALVDWNLEAGVQCKAALDEQFEPQKTLFIQCDVADQQQLRDTFRKVVDHFGRLDILVNNAGVNNEKNWEKTLQINLVSVISGTYLGLDYMSKQNGGEGGIIINMSSLAGISSVCRHLKTWLAEVLPSSAGSSQGYFRTAGFLFL

SEQ ID NO: 39254 - protein, 145 aa, Homo sapiens
  Payload ID: 7862
  Gene Symbol: HPGD
  Gene Name: hydroxyprostaglandin dehydrogenase 15-(NAD)
  Uniprot ID: P15428
  ENSP ID: ENSP00000422418
MSKQNGGEGGIIINMSSLAGLMPVAQQPVYCASKHGIVGFTRSAALAANLMNSGVRLNAICPGFVNTAILESIEKEENMGQYIEYKDHIKDMIKYYGILDPPLIANGLITLIEDDALNGAIMKITTSKGIHFQDYDTTPFQAKTQ

SEQ ID NO: 39255 - protein, 99 aa, Homo sapiens
  Payload ID: 7862
  Gene Symbol: HPGD
  Gene Name: hydroxyprostaglandin dehydrogenase 15-(NAD)
  ENSP ID: ENSP00000423066
MSKQNGGEGGIIINMSSLAGLMPVAQQPVYCASKHGIVGFTRSAALAANLMNSGVRLNAICPGFVNTAILESIEKEENMGQYIEYKDHIKDMIKYYGIL

SEQ ID NO: 39256 - protein, 97 aa, Homo sapiens
  Payload ID: 7862
  Gene Symbol: HPGD
  Gene Name: hydroxyprostaglandin dehydrogenase 15-(NAD)
  ENSP ID: ENSP00000423110
MSKQNGGEGGIIINMSSLAGLMPVAQQPVYCASKHGIVGFTRSAALAANLMNSGVRLNAICPGFVNTAILESIEKEENMGQYIEYKDHIKDMIKYYG

SEQ ID NO: 39257 - protein, 87 aa, Homo sapiens
  Payload ID: 7862
  Gene Symbol: HPGD
  Gene Name: hydroxyprostaglandin dehydrogenase 15-(NAD)
  ENSP ID: ENSP00000425741
MHVNGKVALVTGAAQGIGRAFAEALLLKGAKVALVDWNLEAGVQCKAALDEQFEPQKTLFIQCDVADQQQLRGFCYQWNLSWFGLHE

SEQ ID NO: 39258 - protein, 37 aa, Homo sapiens
  Payload ID: 7862
  Gene Symbol: HPGD
  Gene Name: hydroxyprostaglandin dehydrogenase 15-(NAD)
  ENSP ID: ENSP00000427699
MHVNGKVALVTGAAQGIGRAFAEALLLKGAKTLLEKL

SEQ ID NO: 39259 - protein, 145 aa, Homo sapiens; identical to SEQ ID NO: 39254
  Payload ID: 7862
  Gene Symbol: HPGD
  Gene Name: hydroxyprostaglandin dehydrogenase 15-(NAD)
  Uniprot ID: P15428
  ENSP ID: ENSP00000438017

SEQ ID NO: 39260 - protein, 143 aa, Homo sapiens
  Payload ID: 7862
  Gene Symbol: HPGD
  Gene Name: hydroxyprostaglandin dehydrogenase 15-(NAD)
  Uniprot ID: P15428
  ENSP ID: ENSP00000443644
MHVNGKVALVTGAAQGIGRAFAEALLLKGAKVALVDWNLEAGVQCKAALDEQFEPQKTLFIQCDVADQQQLRDTFRKVVDHFGRLDILVNNAGVNNEKNWEKTLQINLVSVISGTYLGLDYMSKQNGGEGGIIINMSSLAAHH

SEQ ID NO: 39261 - protein, 277 aa, Homo sapiens
  Payload ID: 7863
  Gene Symbol: HYI
  Gene Name: hydroxypyruvate isomerase (putative)
  Uniprot ID: Q5T013
  ENSP ID: ENSP00000361502
MAPLRFSANLSWLFPELSGLPARVRAAGSSGFEAVEVAWPYAETPEALARAAREAGLRLVLINTPPGDQEKGEMGLGAVPGRQAAFREGLEQAVRYAKALGCPRIHLMAGRVPQGADRIAVKAEMEAVFLENLRHAAGVLAQEDLVGLLEPINTRITDPQYFLDTPQQAAAILQKVGRPNLQLQMDIFHWQIMDGNLTGNIREFLPIVGHVQVAQVPGRGEPSSPGELNFPYLFQLLEDEGYKGFVGCEYQPRGDTVEGLSWLRSYWDRRGHPEAGQ

SEQ ID NO: 39262 - protein, 238 aa, Homo sapiens
  Payload ID: 7863
  Gene Symbol: HYI
  Gene Name: hydroxypyruvate isomerase (putative)
  ENSP ID: ENSP00000361507
  MOD_RES (1)..(1): Any amino acid
XYAETPEALARAAREAGLRLVLINTPPGDQEKGEMGLGAVPGRQAAFREGLEQAVRYAKALGCPRIHLMAGRVPQGADRIAVKAEMEAVFLENLRHAAGVLAQEDLVGLLEPINTRITDPQYFLDTPQQAAAILQKVGRPNLQLQMDIFHWQIMDGNLTGNIREFLPIVGHVQVAQVPGRGEPSSPGELNFPYLFQLLEDEGYKGFVGCEYQPRGDTVEGLSWLRSYWDRRGHPEAGQ

SEQ ID NO: 39263 - protein, 247 aa, Homo sapiens
  Payload ID: 7863
  Gene Symbol: HYI
  Gene Name: hydroxypyruvate isomerase (putative)
  Uniprot ID: Q5T013
  ENSP ID: ENSP00000361509
MAPLRFSANLSWLFPELSGLPARVRAAGSSGFEAVEVAWPYAETPEALARAAREAGLRLVLINTPPGDQEKGEMGLGAVPGRQAAFREGLEQAVRYAKALGCPRIHLMAGRVPQGADRIAVKAEMEAVFLENLRHAAGVLAQEDLVGLLEPINTRITDPQYFLDTPQQAAAILQKVGRPNLQLQMDIFHWQIMDGNLTGNIREFLPIVGHVQVAQVPGRGEPSSPGELNFPYLFQLLEDEGYKGFVG

SEQ ID NO: 39264 - protein, 213 aa, Homo sapiens
  Payload ID: 7863
  Gene Symbol: HYI
  Gene Name: hydroxypyruvate isomerase (putative)
  ENSP ID: ENSP00000361510
  MOD_RES (1)..(1): Any amino acid
XAGSSGFEAVEVAWPYAETPEALARAAREAGLRLVLINTPPGDQEKGEMGLGAVPGRQAAFREGLEQAVRIHLMAGRVPQGADRIAVKAEMEAVFLENLRHAAGVLAQEDLVGLLEPINTRITDPQYFLDTPQQAAAILQKVGRPNLQLQMDIFHWQIMDGNLTGNIREFLPIVGHVQVAQVPGRGEPSSPGELNFPYLFQLLEDEGYKGFVG

SEQ ID NO: 39265 - protein, 302 aa, Homo sapiens
  Payload ID: 7863
  Gene Symbol: HYI
  Gene Name: hydroxypyruvate isomerase (putative)
  ENSP ID: ENSP00000361511
MAPLRFSANLSWLFPELSGLPARVRAAGSSGFEAVEVAWPYAETPEALARAAREAGLRLVLINTPPGDQEKGEMGLGAVPGRQAAFREGLEQAVRSGHCLMGRKLSVPCKGAVARGGLVYLAAFLRLDMIHLMAGRVPQGADRIAVKAEMEAVFLENLRHAAGVLAQEDLVGLLEPINTRITDPQYFLDTPQQAAAILQKVGRPNLQLQMDIFHWQIMDGNLTGNIREFLPIVGHVQVAQVPGRGEPSSPGELNFPYLFQLLEDEGYKGFVGCEYQPRGDTVEGLSWLRSYWDRRGHPEAGQ

SEQ ID NO: 39266 - protein, 276 aa, Homo sapiens
  Payload ID: 7863
  Gene Symbol: HYI
  Gene Name: hydroxypyruvate isomerase (putative)
  ENSP ID: ENSP00000428399
MAPLRFSANLSWLFPELSGLPARVRAAGSSGFEAVEVAWPYAETPEALARAAREAGLRLVLINTPPGDQEKGEMGLGAVPGRQAAFREGLEQAVRYAKALGCPRIHLMAGRVPQGADRIAVKAEMEAVFLENLRHAAGVLAQEDLVGLLEPINTRITDPQYFLDTPQQAAAILQKVGRPNLQLQMDIFHWQIMDGNLTGNIREFLPIVGHVQVAQVPGRGEPSSPGELNFPYLFQLLEDEGYKGFVGCEYQPRGEAWPWGRELWRDPDRGCFLLVG

SEQ ID NO: 39267 - protein, 161 aa, Homo sapiens
  Payload ID: 7863
  Gene Symbol: HYI
  Gene Name: hydroxypyruvate isomerase (putative)
  ENSP ID: ENSP00000428501
  MOD_RES (1)..(1): Any amino acid
XAVPGRQAAFREGLEQAVRYAKALGCPRIHLMAGRVPQGADRIAVKAEMEAVFLENLRHAAGVLAQEDLVGLLEPINTRITDPQYFLDTPQQAAAILQKDIFHWQIMDGNLTGNIREFLPIVGHVQVAQVPGRGEPSSPGELNFPYLFQLLEDEGYKGFVG

SEQ ID NO: 39268 - protein, 186 aa, Homo sapiens
  Payload ID: 7863
  Gene Symbol: HYI
  Gene Name: hydroxypyruvate isomerase (putative)
  ENSP ID: ENSP00000428803
  MOD_RES (1)..(1): Any amino acid
XQAAFREGLEQAVRYAKALGCPRIHLMAGRVPQGADRIAVKAEMEAVFLENLRHAAGVLAQEDLVGLLEPINTRITDPQYFLDTPQQAAAILQKDIFHWQIMDGNLTGNIREFLPIVGHVQVAQVPGRGEPSSPGELNFPYLFQLLEDEGYKGFVGCEYQPRGDTVEGLSWLRSYWDRRGHPEAGQ

SEQ ID NO: 39269 - protein, 272 aa, Homo sapiens
  Payload ID: 7863
  Gene Symbol: HYI
  Gene Name: hydroxypyruvate isomerase (putative)
  ENSP ID: ENSP00000461969
MAPLRFSANLSWLFPELSGLPARVRAAGSSGFEAVEVAWPYAETPEALARAAREAGLRLVLINTPPGDQEKGEMGLGAVPGRQAAFREGLEQAVRSGHCLMGRKLSVPCKGAVARGGLVYLAAFLRLDMIHLMAGRVPQGADRIAVKAEMEAVFLENLRHAAGVLAQEDLVGLLEPINTRITDPQYFLDTPQQAAAILQKVGRPNLQLQMDIFHWQIMDGNLTGNIREFLPIVGHVQVAQVPGRGEPSSPGELNFPYLFQLLEDEGYKGFVG

SEQ ID NO: 39270 - protein, 278 aa, Homo sapiens
  Payload ID: 7864
  Gene Symbol: HSD11B1
  Gene Name: hydroxysteroid (11-beta) dehydrogenase 1
  ENSP ID: ENSP00000261465
MAFMKKYLLPILGLFMAYYYYSANEEFRPEMLQGKKVIVTGASKGIGREMAYHLAKMGAHVVVTARSKETLQKVVSHCLELGAASAHYIAGTMEDMTFAEQFVAQAGKLMGGLDMLILNHITNTSLNLFHDDIHHVRKSMEVNFLSYVVLTVAALPMLKQSNGSIVVVSSLAGKVAYPMVAAYSASKFALDGFFSSIRKEYSVSRVNVSITLCVLGLIDTETAMKAVSGIVHMQAAPKEECALEIIKGGALRQEEVYYDSSLWTTLLIRNPCRKILEF

SEQ ID NO: 39271 - protein, 292 aa, Homo sapiens
  Payload ID: 7864
  Gene Symbol: HSD11B1
  Gene Name: hydroxysteroid (11-beta) dehydrogenase 1
  Uniprot ID: P28845
  ENSP ID: ENSP00000355994
MAFMKKYLLPILGLFMAYYYYSANEEFRPEMLQGKKVIVTGASKGIGREMAYHLAKMGAHVVVTARSKETLQKVVSHCLELGAASAHYIAGTMEDMTFAEQFVAQAGKLMGGLDMLILNHITNTSLNLFHDDIHHVRKSMEVNFLSYVVLTVAALPMLKQSNGSIVVVSSLAGKVAYPMVAAYSASKFALDGFFSSIRKEYSVSRVNVSITLCVLGLIDTETAMKAVSGIVHMQAAPKEECALEIIKGGALRQEEVYYDSSLWTTLLIRNPCRKILEFLYSTSYNMDRFINK

SEQ ID NO: 39272 - protein, 292 aa, Homo sapiens; identical to SEQ ID NO: 39271
  Payload ID: 7864
  Gene Symbol: HSD11B1
  Gene Name: hydroxysteroid (11-beta) dehydrogenase 1
  Uniprot ID: P28845
  ENSP ID: ENSP00000355995

SEQ ID NO: 39273 - protein, 182 aa, Homo sapiens
  Payload ID: 7864
  Gene Symbol: HSD11B1
  Gene Name: hydroxysteroid (11-beta) dehydrogenase 1
  ENSP ID: ENSP00000478430
MAFMKKYLLPILGLFMAYYYYSANEEFRPEMLQGKKVIVTGASKGIGREMAYHLAKMGAHVVVTARSKETLQKVVSHCLELGAASAHYIAGTMEDMTFAEQFVAQAGKLMGGLDMLILNHITNTSLNLFHDDIHHVRKSMEVNFLSYVVLTVAALPMLKQSNGSIVVVSSLAGKVAYPMVAA

SEQ ID NO: 39274 - protein, 205 aa, Homo sapiens
  Payload ID: 7865
  Gene Symbol: HSD11B1L
  Gene Name: hydroxysteroid (11-beta) dehydrogenase 1-like
  Uniprot ID: Q7Z5J1
  ENSP ID: ENSP00000301382
MKVLLLTGLGALFFAYYWDDNFDPGGLDYLVLNHIGGAPAGTRARSPQATRWLMQVNFVSYVQLTSRALPSLTDSKGSLVVVSSLLGRVPTSFSTPYSAAKFALDGFFGSLRRELDVQDVNVAITMCVLGLRDRASAAEAVRGVTRVKAAPGPKAALAVIRGGATRAAGVFYPWRFRLLCLLRRWLPRPRAWFIRQELNVTAAAA

SEQ ID NO: 39275 - protein, 286 aa, Homo sapiens
  Payload ID: 7865
  Gene Symbol: HSD11B1L
  Gene Name: hydroxysteroid (11-beta) dehydrogenase 1-like
  Uniprot ID: Q7Z5J1
  ENSP ID: ENSP00000340436
MKVLLLTGLGALFFAYYWDDNFDPASLQGARVLLTGANAGVGEELAYHYARLGSHLVLTAHTEALLQKVVGNCRKLGAPKVFYIAADMASPEAPESVVQFALDKLGGLDYLVLNHIGGAPAGTRARSPQATRWLMQVNFVSYVQLTSRALPSLTDSKGSLVVVSSLLGRVPTSFSTPYSAAKFALDGFFGSLRRELDVQDVNVAITMCVLGLRDRASAAEAVRGVTRVKAAPGPKAALAVIRGGATRAAGVFYPWRFRLLCLLRRWLPRPRAWFIRQELNVTAAAA

SEQ ID NO: 39276 - protein, 199 aa, Homo sapiens
  Payload ID: 7865
  Gene Symbol: HSD11B1L
  Gene Name: hydroxysteroid (11-beta) dehydrogenase 1-like
  Uniprot ID: Q7Z5J1
  ENSP ID: ENSP00000343451
MASPEAPESVVQFALDKLGGLDYLVLNHIGGAPAGTRARSPQATRWLMQVNFVSYVQLTSRALPSLTDSKGSLVVVSSLLGRVPTSFSTPYSAAKFALDGFFGSLRRELDVQDVNVAITMCVLGLRDRASAAEAVRGVTRVKAAPGPKAALAVIRGGATRAAGVFYPWRFRLLCLLRRWLPRPRAWFIRQELNVTAAAA

SEQ ID NO: 39277 - protein, 181 aa, Homo sapiens
  Payload ID: 7865
  Gene Symbol: HSD11B1L
  Gene Name: hydroxysteroid (11-beta) dehydrogenase 1-like
  Uniprot ID: Q7Z5J1
  ENSP ID: ENSP00000398955
MQVNFVSYVQLTSRALPSLTDSKGSLVVVSSLLGRVPTSFSTPYSAAKFALDGFFGSLRRELDVQDVNVAITMCVLGLRDRASAAEAVRSSTSRPRQPEHRGVPLQSQTAMFLPPTVPGARTLTETPLRGWPQPKMKSSRQKSKTEKNDGHLEPVTAWEVQVPRVRRLCRGLARPHLFGHD

SEQ ID NO: 39278 - protein, 315 aa, Homo sapiens
  Payload ID: 7865
  Gene Symbol: HSD11B1L
  Gene Name: hydroxysteroid (11-beta) dehydrogenase 1-like
  Uniprot ID: Q7Z5J1
  ENSP ID: ENSP00000407154
MKVLLLTGLGALFFAYYWDDNFDPASLQGARVLLTGANAGVGEELAYHYARLGSHLVLTAHTEALLQKVVGNCRKLGAPKVFYIAADMASPEAPESVVQFALDKLGGLDYLVLNHIGGAPAGTRARSPQATRWLMQVNFVSYVQLTSRALPSLTDSKGSLVVVSSLLGRVPTSFSTPYSAAKFALDGFFGSLRRELDVQDVNVAITMCVLGLRDRASAAEAVRSSTSRPRQPEHRGVPLQSQTAMFLPPTVPGARTLTETPLRGWPQPKMKSSRQKSKTEKNDGHLEPVTAWEVQVPRVRRLCRGLARPHLFGHD

SEQ ID NO: 39279 - protein, 87 aa, Homo sapiens
  Payload ID: 7865
  Gene Symbol: HSD11B1L
  Gene Name: hydroxysteroid (11-beta) dehydrogenase 1-like
  Uniprot ID: Q7Z5J1
  ENSP ID: ENSP00000409592
MKVLLLTGLGALFFAYYWDDNFDPASLQGARVLLTGANAGVGEELAYHYARLGSHLVLTAHTEALLQKARWLTLVVSTLGGRGKWIT

SEQ ID NO: 39280 - protein, 32 aa, Homo sapiens
  Payload ID: 7865
  Gene Symbol: HSD11B1L
  Gene Name: hydroxysteroid (11-beta) dehydrogenase 1-like
  ENSP ID: ENSP00000462058
MKVLLLTGLGALFFAYYWDDNFDPASRERECC

SEQ ID NO: 39281 - protein, 75 aa, Homo sapiens
  Payload ID: 7865
  Gene Symbol: HSD11B1L
  Gene Name: hydroxysteroid (11-beta) dehydrogenase 1-like
  ENSP ID: ENSP00000462113
MKVLLLTGLGALFFAYYWDDNFDPASLQGARVLLTGANAGVGEELAYHYARLGSHLVLTAHTEALLQKAGWTTSC

SEQ ID NO: 39282 - protein, 152 aa, Homo sapiens
  Payload ID: 7865
  Gene Symbol: HSD11B1L
  Gene Name: hydroxysteroid (11-beta) dehydrogenase 1-like
  Uniprot ID: Q7Z5J1
  ENSP ID: ENSP00000462586
MQVNFVSYVQLTSRALPSLTDSKGSLVVVSSLLGRVPTSFSTPYSAAKFALDGFFGSLRRELDVQDVNVAITMCVLGLRDRASAAEAVRGVTRVKAAPGPKAALAVIRGGATRAAGVFYPWRFRLLCLLRRWLPRPRAWFIRQELNVTAAAA

SEQ ID NO: 39283 - protein, 135 aa, Homo sapiens
  Payload ID: 7865
  Gene Symbol: HSD11B1L
  Gene Name: hydroxysteroid (11-beta) dehydrogenase 1-like
  ENSP ID: ENSP00000462921
  MOD_RES (1)..(1): Any amino acid
XLGALFFAYYWDDNFDPGGLDYLVLNHIGGAPAGTRARSPQATRWLMQVNFVSYVQLTSRALPSLTDSKGSLVVVSSLLGRVPTSFSTPYSAAKFALDGFFGSLRRELDVQDVNVAITMCVLGLRDRASAAEAVR

SEQ ID NO: 39284 - protein, 286 aa, Homo sapiens; identical to SEQ ID NO: 39275
  Payload ID: 7865
  Gene Symbol: HSD11B1L
  Gene Name: hydroxysteroid (11-beta) dehydrogenase 1-like
  Uniprot ID: Q7Z5J1
  ENSP ID: ENSP00000462975

SEQ ID NO: 39285 - protein, 234 aa, Homo sapiens
  Payload ID: 7865
  Gene Symbol: HSD11B1L
  Gene Name: hydroxysteroid (11-beta) dehydrogenase 1-like
  Uniprot ID: Q7Z5J1
  ENSP ID: ENSP00000463073
MKVLLLTGLGALFFAYYWDDNFDPGGLDYLVLNHIGGAPAGTRARSPQATRWLMQVNFVSYVQLTSRALPSLTDSKGSLVVVSSLLGRVPTSFSTPYSAAKFALDGFFGSLRRELDVQDVNVAITMCVLGLRDRASAAEAVRSSTSRPRQPEHRGVPLQSQTAMFLPPTVPGARTLTETPLRGWPQPKMKSSRQKSKTEKNDGHLEPVTAWEVQVPRVRRLCRGLARPHLFGHD

SEQ ID NO: 39286 - protein, 189 aa, Homo sapiens
  Payload ID: 7865
  Gene Symbol: HSD11B1L
  Gene Name: hydroxysteroid (11-beta) dehydrogenase 1-like
  ENSP ID: ENSP00000463187
MKVLLLTGLGALFFAYYWDDNFDPGKLCELRATDVAGAAQPDGQQGLPGGGVLAARPRAHVVLHSLLGGQVCAGRLLRLPAAGAGRAGRERGHHHVRPGPPRSRLRRRGSQGSHEGQGGPGAQGSPGRDPRRRHARGRRLLPVAFPPAVLAPALATAPAGLVYPPGAQRHGRGSLSTGGCPSSPRRQCS

SEQ ID NO: 39287 - protein, 47 aa, Homo sapiens
  Payload ID: 7865
  Gene Symbol: HSD11B1L
  Gene Name: hydroxysteroid (11-beta) dehydrogenase 1-like
  ENSP ID: ENSP00000463274
MKVLLLTGLGALFFAYYWDDNFDPGGRELPEAGRPQGLLHRGGHGLP

SEQ ID NO: 39288 - protein, 286 aa, Homo sapiens; identical to SEQ ID NO: 39275
  Payload ID: 7865
  Gene Symbol: HSD11B1L
  Gene Name: hydroxysteroid (11-beta) dehydrogenase 1-like
  Uniprot ID: Q7Z5J1
  ENSP ID: ENSP00000463794

SEQ ID NO: 39289 - protein, 152 aa, Homo sapiens; identical to SEQ ID NO: 39282
  Payload ID: 7865
  Gene Symbol: HSD11B1L
  Gene Name: hydroxysteroid (11-beta) dehydrogenase 1-like
  Uniprot ID: Q7Z5J1
  ENSP ID: ENSP00000464454

SEQ ID NO: 39290 - protein, 75 aa, Homo sapiens; identical to SEQ ID NO: 39281
  Payload ID: 7865
  Gene Symbol: HSD11B1L
  Gene Name: hydroxysteroid (11-beta) dehydrogenase 1-like
  ENSP ID: ENSP00000464563

SEQ ID NO: 39291 - protein, 143 aa, Homo sapiens
  Payload ID: 7865
  Gene Symbol: HSD11B1L
  Gene Name: hydroxysteroid (11-beta) dehydrogenase 1-like
  ENSP ID: ENSP00000464652
MKVLLLTGLGALFFAYYWDDNFDPASLQGARVLLTGANAGVGEELAYHYARLGSHLVLTAHTEALLQKVVGNCRKLGAPKVFYIAADMASPEAPESVVQFALDKLGGLDYLVLNHIGGAPAGTRARSPQATRWLMQVNFVSYV

SEQ ID NO: 39292 - protein, 333 aa, Homo sapiens
  Payload ID: 7865
  Gene Symbol: HSD11B1L
  Gene Name: hydroxysteroid (11-beta) dehydrogenase 1-like
  ENSP ID: ENSP00000480443
MANLGTLQLLPPRFKRFSCLSLPNIWITGMPVPATSVPCPSAGPHRTMKVLLLTGLGALFFAYYWDDNFDPASLQGARVLLTGANAGVGEELAYHYARLGSHLVLTAHTEALLQKVVGNCRKLGAPKVFYIAADMASPEAPESVVQFALDKLGGLDYLVLNHIGGAPAGTRARSPQATRWLMQVNFVSYVQLTSRALPSLTDSKGSLVVVSSLLGRVPTSFSTPYSAAKFALDGFFGSLRRELDVQDVNVAITMCVLGLRDRASAAEAVRGVTRVKAAPGPKAALAVIRGGATRAAGVFYPWRFRLLCLLRRWLPRPRAWFIRQELNVTAAAA

SEQ ID NO: 39293 - protein, 405 aa, Homo sapiens
  Payload ID: 7866
  Gene Symbol: HSD11B2
  Gene Name: hydroxysteroid (11-beta) dehydrogenase 2
  Uniprot ID: P80365
  ENSP ID: ENSP00000316786
MERWPWPSGGAWLLVAARALLQLLRSDLRLGRPLLAALALLAALDWLCQRLLPPPAALAVLAAAGWIALSRLARPQRLPVATRAVLITGCDSGFGKETAKKLDSMGFTVLATVLELNSPGAIELRTCCSPRLRLLQMDLTKPGDISRVLEFTKAHTTSTGLWGLVNNAGHNEVVADAELSPVATFRSCMEVNFFGALELTKGLLPLLRSSRGRIVTVGSPAGDMPYPCLGAYGTSKAAVALLMDTFSCELLPWGVKVSIIQPGCFKTESVRNVGQWEKRKQLLLANLPQELLQAYGKDYIEHLHGQFLHSLRLAMSDLTPVVDAITDALLAARPRRRYYPGQGLGLMYFIHYYLPEGLRRRFLQAFFISHCLPRALQPGQPGTTPPQDAAQDPNLSPGPSPAVAR

SEQ ID NO: 39294 - protein, 58 aa, Homo sapiens
  Payload ID: 7866
  Gene Symbol: HSD11B2
  Gene Name: hydroxysteroid (11-beta) dehydrogenase 2
  ENSP ID: ENSP00000473429
LLAALDWLCQRLLPPPAALAVLAAAGWIALSRLARPQRLPVATRAVLITGAWIPSRPW

SEQ ID NO: 39295 - protein, 329 aa, Homo sapiens
  Payload ID: 7867
  Gene Symbol: HSD17B1
  Gene Name: hydroxysteroid (17-beta) dehydrogenase 1
  ENSP ID: ENSP00000225929
MARTVVLITGCSSGIGLHLAVRLASDPSQSFKVYATLRDLKTQGRLWEAARALACPPGSLETLQLDVRDSKSVAAARERVTEGRVDVLVCNAGLGLLGPLEALGEDAVASVLDVNVVGTVRMLQAFLPDMKRRGSGRVLVTGSVGGLMGLPFNDVYCASKFALEGLCESLAVLLLPFGVHSLSLIECGPVHTAFMEKVLGSPEEVLDRTDIHTFHRFYQYLAHSKQVFREAAQNPEEVAEVFLTALRAPKPTLRYFTTERFLPLLRMRLDDPSGSNYVTAMHREVFGDVPAKAEAGAEAGGGAGPGAEDEAGRGAVGDPELGDPPAAPQ

SEQ ID NO: 39296 - protein, 149 aa, Homo sapiens
  Payload ID: 7867
  Gene Symbol: HSD17B1
  Gene Name: hydroxysteroid (17-beta) dehydrogenase 1
  ENSP ID: ENSP00000465128
MARTVVLITGCSSGIGLHLAVRLASDPSQSFKVYATLRDLKTQGRLWEAARALACPPGSLETLQLDVRDSKSVAAARERVTEGRVDVLVCNAGLGLLGPLEALGEDAVASVLDVNVVGTVRMLQAFLPDMKRRGSGRVLVTGSVGGLMA

SEQ ID NO: 39297 - protein, 328 aa, Homo sapiens
  Payload ID: 7867
  Gene Symbol: HSD17B1
  Gene Name: hydroxysteroid (17-beta) dehydrogenase 1
  Uniprot ID: P14061
  ENSP ID: ENSP00000466799
MARTVVLITGCSSGIGLHLAVRLASDPSQSFKVYATLRDLKTQGRLWEAARALACPPGSLETLQLDVRDSKSVAAARERVTEGRVDVLVCNAGLGLLGPLEALGEDAVASVLDVNVVGTVRMLQAFLPDMKRRGSGRVLVTGSVGGLMGLPFNDVYCASKFALEGLCESLAVLLLPFGVHLSLIECGPVHTAFMEKVLGSPEEVLDRTDIHTFHRFYQYLAHSKQVFREAAQNPEEVAEVFLTALRAPKPTLRYFTTERFLPLLRMRLDDPSGSNYVTAMHREVFGDVPAKAEAGAEAGGGAGPGAEDEAGRGAVGDPELGDPPAAPQ

SEQ ID NO: 39298 - protein, 261 aa, Homo sapiens
  Payload ID: 7868
  Gene Symbol: HSD17B10
  Gene Name: hydroxysteroid (17-beta) dehydrogenase 10
  Uniprot ID: Q99714
  ENSP ID: ENSP00000168216
MAAACRSVKGLVAVITGGASGLGLATAERLVGQGASAVLLDLPNSGGEAQAKKLGNNCVFAPADVTSEKDVQTALALAKGKFGRVDVAVNCAGIAVASKTYNLKKGQTHTLEDFQRVLDVNLMGTFNVIRLVAGEMGQNEPDQGGQRGVIINTASVAAFEGQVGQAAYSASKGGIVGMTLPIARDLAPIGIRVMTIAPGLFGTPLLTSLPEKVCNFLASQVPFPSRLGDPAEYAHLVQAIIENPFLNGEVIRLDGAIRMQP

SEQ ID NO: 39299 - protein, 169 aa, Homo sapiens
  Payload ID: 7868
  Gene Symbol: HSD17B10
  Gene Name: hydroxysteroid (17-beta) dehydrogenase 10
  ENSP ID: ENSP00000364447
MAAACRSVKGLVAVITGGASGLGLATAERLVGQGASAVLLDLPNSGGEAQAKKLGNNCVFAPADVTSEKDVQTALALAKGKFGRVDVAVNCAGIAVASKTYNLKKGQTHTLEDFQRVLDVNLMGTFNVIRLVAGEMGQNEPDQGGQRGVIINTASVAAFEGQVCLAPHC

SEQ ID NO: 39300 - protein, 252 aa, Homo sapiens
  Payload ID: 7868
  Gene Symbol: HSD17B10
  Gene Name: hydroxysteroid (17-beta) dehydrogenase 10
  Uniprot ID: Q99714
  ENSP ID: ENSP00000364453
MAAACRSVKGLVAVITGGASGLGLATAERLVGQGASAVLLDLPNSGGEAQAKKLGNNCVFAPADVTSEKDVQTALALAKGKFGRVDVAVNCAGIAVASKTYNLKKGQTHTLEDFQRVLDVNLMGTFNVIRLVAGEMGQNEPDQGGQRGVIINTASVAAFEGQVGQAAYSASKGGIVGMTLPIARDLAPIGLFGTPLLTSLPEKVCNFLASQVPFPSRLGDPAEYAHLVQAIIENPFLNGEVIRLDGAIRMQP

SEQ ID NO: 39301 - protein, 300 aa, Homo sapiens
  Payload ID: 7869
  Gene Symbol: HSD17B11
  Gene Name: hydroxysteroid (17-beta) dehydrogenase 11
  Uniprot ID: Q8NBQ5
  ENSP ID: ENSP00000351035
MKFLLDILLLLPLLIVCSLESFVKLFIPKRRKSVTGEIVLITGAGHGIGRLTAYEFAKLKSKLVLWDINKHGLEETAAKCKGLGAKVHTFVVDCSNREDIYSSAKKVKAEIGDVSILVNNAGVVYTSDLFATQDPQIEKTFEVNVLAHFWTTKAFLPAMTKNNHGHIVTVASAAGHVSVPFLLAYCSSKFAAVGFHKTLTDELAALQITGVKTTCLCPNFVNTGFIKNPSTSLGPTLEPEEVVNRLMHGILTEQKMIFIPSSIAFLTTLERILPERFLAVLKRKISVKFDAVIGYKMKAQ

SEQ ID NO: 39302 - protein, 256 aa, Homo sapiens
  Payload ID: 7869
  Gene Symbol: HSD17B11
  Gene Name: hydroxysteroid (17-beta) dehydrogenase 11
  ENSP ID: ENSP00000423775
MKFLLDILLLLPLLIVCSLESFVKLFIPKRRKSVTGEIVLITGAGHGIGRLTAYEFAKLKSKLVLWDINKHGLEETAAKCKGLGAKVHTFVVDCSNREDIYSSAKKTTKAFLPAMTKNNHGHIVTVASAAGHVSVPFLLAYCSSKFAAVGFHKTLTDELAALQITGVKTTCLCPNFVNTGFIKNPSTSLGPTLEPEEVVNRLMHGILTEQKMIFIPSSIAFLTTLERILPERFLAVLKRKISVKFDAVIGYKMKAQ

SEQ ID NO: 39303 - protein, 312 aa, Homo sapiens
  Payload ID: 7870
  Gene Symbol: HSD17B12
  Gene Name: hydroxysteroid (17-beta) dehydrogenase 12
  Uniprot ID: Q53GQ0
  ENSP ID: ENSP00000278353
MESALPAAGFLYWVGAGTVAYLALRISYSLFTALRVWGVGNEAGVGPGLGEWAVVTGSTDGIGKSYAEELAKHGMKVVLISRSKDKLDQVSSEIKEKFKVETRTIAVDFASEDIYDKIKTGLAGLEIGILVNNVGMSYEYPEYFLDVPDLDNVIKKMININILSVCKMTQLVLPGMVERSKGAILNISSGSGMLPVPLLTIYSATKTFVDFFSQCLHEEYRSKGVFVQSVLPYFVATKLAKIRKPTLDKPSPETFVKSAIKTVGLQSRTNGYLIHALMGSIISNLPSWIYLKIVMNMNKSTRAHYLKKTKKN

SEQ ID NO: 39304 - protein, 98 aa, Homo sapiens
  Payload ID: 7870
  Gene Symbol: HSD17B12
  Gene Name: hydroxysteroid (17-beta) dehydrogenase 12
  Uniprot ID: Q53GQ0
  ENSP ID: ENSP00000379052
MESALPAAGFLYWVGAGTVAYLALRISYSLFTALRVWGVGNEAGVGPGLGEWAVVTGSTDGIGKSYAEELAKHGMKVVLISRSKDKLDQVSSEISNYT

SEQ ID NO: 39305 - protein, 164 aa, Homo sapiens
  Payload ID: 7870
  Gene Symbol: HSD17B12
  Gene Name: hydroxysteroid (17-beta) dehydrogenase 12
  ENSP ID: ENSP00000436582
MESALPAAGFLYWVGAGTVAYLALRISYSLFTALRVWGVGNEAGVGPGLGEWAEEKFKVETRTIAVDFASEDIYDKIKTGLAGLEIGILVNNVGMSYEYPEYFLDVPDLDNVIKKMININILSVCKMTQLVLPGMVERSKGAILNISSGSGMLPVPLLTIYSAT

SEQ ID NO: 39306 - protein, 264 aa, Homo sapiens
  Payload ID: 7871
  Gene Symbol: HSD17B13
  Gene Name: hydroxysteroid (17-beta) dehydrogenase 13
  Uniprot ID: Q7Z5P4
  ENSP ID: ENSP00000305438
MNIILEILLLLITIIYSYLESLVKFFIPQRRKSVAGEIVLITGAGHGIGRQTTYEFAKRQSILVLWDINKVKKEVGDVTIVVNNAGTVYPADLLSTKDEEITKTFEVNILGHFWITKALLPSMMERNHGHIVTVASVCGHEGIPYLIPYCSSKFAAVGFHRGLTSELQALGKTGIKTSCLCPVFVNTGFTKNPSTRLWPVLETDEVVRSLIDGILTNKKMIFVPSYINIFLRLQKFLPERASAILNRMQNIQFEAVVGHKIKMK

SEQ ID NO: 39307 - protein, 300 aa, Homo sapiens
  Payload ID: 7871
  Gene Symbol: HSD17B13
  Gene Name: hydroxysteroid (17-beta) dehydrogenase 13
  Uniprot ID: Q7Z5P4
  ENSP ID: ENSP00000333300
MNIILEILLLLITIIYSYLESLVKFFIPQRRKSVAGEIVLITGAGHGIGRQTTYEFAKRQSILVLWDINKRGVEETAAECRKLGVTAHAYVVDCSNREEIYRSLNQVKKEVGDVTIVVNNAGTVYPADLLSTKDEEITKTFEVNILGHFWITKALLPSMMERNHGHIVTVASVCGHEGIPYLIPYCSSKFAAVGFHRGLTSELQALGKTGIKTSCLCPVFVNTGFTKNPSTRLWPVLETDEVVRSLIDGILTNKKMIFVPSYINIFLRLQKFLPERASAILNRMQNIQFEAVVGHKIKMK

SEQ ID NO: 39308 - protein, 270 aa, Homo sapiens
  Payload ID: 7872
  Gene Symbol: HSD17B14
  Gene Name: hydroxysteroid (17-beta) dehydrogenase 14
  Uniprot ID: Q9BPX1
  ENSP ID: ENSP00000263278
MATGTRYAGKVVVVTGGGRGIGAGIVRAFVNSGARVVICDKDESGGRALEQELPGAVFILCDVTQEDDVKTLVSETIRRFGRLDCVVNNAGHHPPPQRPEETSAQGFRQLLELNLLGTYTLTKLALPYLRKSQGNVINISSLVGAIGQAQAVPYVATKGAVTAMTKALALDESPYGVRVNCISPGNIWTPLWEELAALMPDPRATIREGMLAQPLGRMGQPAEVGAAAVFLASEANFCTGIELLVTGGAELGYGCKASRSTPVDAPDIPS

SEQ ID NO: 39309 - protein, 176 aa, Homo sapiens
  Payload ID: 7872
  Gene Symbol: HSD17B14
  Gene Name: hydroxysteroid (17-beta) dehydrogenase 14
  ENSP ID: ENSP00000469557
VICDKDESGGRALEQELPGAVFILCDVTQEDDVKTLVSETIRRFGRLDCVVNNAGHHPPPQRPEETSAQGFRQLLELNLLGTYTLTKLALPYLRKSQGNVINISSLVGAIGQAQAVPYVATKGAVTAMTKALALDESPYGVRVNCHWAAWASPLRSGLRQCSWPPKPTSARALNCS

SEQ ID NO: 39310 - protein, 106 aa, Homo sapiens
  Payload ID: 7872
  Gene Symbol: HSD17B14
  Gene Name: hydroxysteroid (17-beta) dehydrogenase 14
  ENSP ID: ENSP00000471631
GQAQAVPYVATKGAVTAMTKALALDESPYGVRVNCISPGNIWTPLWEELAALMPDPRATIREGMLAQVEVGFRSSHWAAWASPLRSGLRQCSWPPKPTSARALNCS

SEQ ID NO: 39311 - protein, 246 aa, Homo sapiens
  Payload ID: 7872
  Gene Symbol: HSD17B14
  Gene Name: hydroxysteroid (17-beta) dehydrogenase 14
  ENSP ID: ENSP00000472746
MATGTRYAGKVVVVTGGGRGIGAGIVRAFVNSGARVVICDKDESGGRALEQELPGAVFILCDVTQEDDVKDISFLLRPWFLRPSADLAAWIVLSTTLATLALPYLRKSQGNVINISSLVGAIGQAQAVPYVATKGAVTAMTKALALDESPYGVRVNCISPGNIWTPLWEELAALMPDPRATIREGMLAQPLGRMGQPAEVGAAAVFLASEANFCTGIELLVTGGAELGYGCKASRSTPVDAPDIPS

SEQ ID NO: 39312 - protein, 387 aa, Homo sapiens
  Payload ID: 7873
  Gene Symbol: HSD17B2
  Gene Name: hydroxysteroid (17-beta) dehydrogenase 2
  Uniprot ID: P37059
  ENSP ID: ENSP00000199936
MSTFFSDTAWICLAVPTVLCGTVFCKYKKSSGQLWSWMVCLAGLCAVCLLILSPFWGLILFSVSCFLMYTYLSGQELLPVDQKAVLVTGGDCGLGHALCKYLDELGFTVFAGVLNENGPGAEELRRTCSPRLSVLQMDITKPVQIKDAYSKVAAMLQDRGLWAVINNAGVLGFPTDGELLLMTDYKQCMAVNFFGTVEVTKTFLPLLRKSKGRLVNVSSMGGGAPMERLASYGSSKAAVTMFSSVMRLELSKWGIKVASIQPGGFLTNIAGTSDKWEKLEKDILDHLPAEVQEDYGQDYILAQRNFLLLINSLASKDFSPVLRDIQHAILAKSPFAYYTPGKGAYLWICLAHYLPIGIYDYFAKRHFGQDKPMPRALRMPNYKKKAT

SEQ ID NO: 39313 - protein, 200 aa, Homo sapiens
  Payload ID: 7873
  Gene Symbol: HSD17B2
  Gene Name: hydroxysteroid (17-beta) dehydrogenase 2
  ENSP ID: ENSP00000454931
SGQELLPVDQKAVLVTGGDCGLGHALCKYLDELGFTVFAGVLNENGPGAEELRRTCSPRLSVLQMDITKPVQIKDAYSKVAAMLQDRGLWAVINNAGVLGFPTDGELLLMTDYKQCMAVNFFGTVEVTKTFLPLLRKSKGRLVNVSSMGGESAFSHMVMGCPSQDMAHGILCGRTKMQGMQRQGWVRISQIVYTLLVLSQ

SEQ ID NO: 39314 - protein, 66 aa, Homo sapiens
  Payload ID: 7873
  Gene Symbol: HSD17B2
  Gene Name: hydroxysteroid (17-beta) dehydrogenase 2
  ENSP ID: ENSP00000455992
MDITKPVQIKDAYSKVAAMLQDRGLWAVINNAGVLGFPTDGELLLMTDYKQCMAVNFFGTVEVTKT

SEQ ID NO: 39315 - protein, 188 aa, Homo sapiens
  Payload ID: 7873
  Gene Symbol: HSD17B2
  Gene Name: hydroxysteroid (17-beta) dehydrogenase 2
  ENSP ID: ENSP00000456471
RRTCSPRLSVLQMDITKPVQIKDAYSKVAAMLQDRGLWAVINNAGVLGFPTDGELLLMTDYKQCMAVNFFGTVEVTKTFLPLLRKSKGRLVNVSSMGGGAPMERLASYGSSKAAVTMFSSVMRLELSKWGIKVASIQPGGFLTSRFLSPRTCDVHPGRNPEGPLGLTEHTLNPSLLSKMSTARDQLKG

SEQ ID NO: 39316 - protein, 220 aa, Homo sapiens
  Payload ID: 7873
  Gene Symbol: HSD17B2
  Gene Name: hydroxysteroid (17-beta) dehydrogenase 2
  ENSP ID: ENSP00000456529
MDITKPVQIKDAYSKVAAMLQDRGLWAVINNAGVLGFPTDGELLLMTDYKQCMAVNFFGTVEVTKTFLPLLRKSKGRLVNVSSMGGGAPMERLASYGSSKAAVTMFSSVMRLELSKWGIKVASIQPGGFLTNIAGTSDKWEKLEKDILDHLPAEVQEDYGQDYILAQRNFLLLINSLASKDFSPVLRDIQHAILAKSPFAYYTPGKGAYLWICLAHYLPI

SEQ ID NO: 39317 - protein, 133 aa, Homo sapiens
  Payload ID: 7873
  Gene Symbol: HSD17B2
  Gene Name: hydroxysteroid (17-beta) dehydrogenase 2
  ENSP ID: ENSP00000457943
MSTFFSDTAWICLAVPTVLCGTVFCKYKKSSGQLWSWMVCLAGLCAVCLLILSPFWGLILFSVSCFLMYTYLSGQELLPVDQKAVLVTGLWAVINNAGVLGFPTDGELLLMTDYKQCMAVNFFGTVEVTKTFL

SEQ ID NO: 39318 - protein, 260 aa, Homo sapiens
  Payload ID: 7874
  Gene Symbol: HSD17B3
  Gene Name: hydroxysteroid (17-beta) dehydrogenase 3
  Uniprot ID: P37058
  ENSP ID: ENSP00000364411
MGDVLEQFFILTGLLVCLACLAKCVRFSRCVLLNYWKVLPKSFLRSMGQWAVITGAGDGIGKAYSFELAKRGLNVVLISRTLEKLEAIATEIERTTGRSVKIIQADFTKDDIYEHIKEKLAGLEIGILVNNVGMLPNLLPSHFLNAPDEIQSLIHCNITSVVKMTQLILKHMESRQKGLILNISSGIALFPWPLYSMYSASKAFVCAFSKALQEEYKAKEVIIQAGFLSLIPAWAFYSGAFQRLLLTHYVAYLKLNTKVR

SEQ ID NO: 39319 - protein, 310 aa, Homo sapiens
  Payload ID: 7874
  Gene Symbol: HSD17B3
  Gene Name: hydroxysteroid (17-beta) dehydrogenase 3
  Uniprot ID: P37058
  ENSP ID: ENSP00000364412
MGDVLEQFFILTGLLVCLACLAKCVRFSRCVLLNYWKVLPKSFLRSMGQWAVITGAGDGIGKAYSFELAKRGLNVVLISRTLEKLEAIATEIERTTGRSVKIIQADFTKDDIYEHIKEKLAGLEIGILVNNVGMLPNLLPSHFLNAPDEIQSLIHCNITSVVKMTQLILKHMESRQKGLILNISSGIALFPWPLYSMYSASKAFVCAFSKALQEEYKAKEVIIQVLTPYAVSTAMTKYLNTNVITKTADEFVKESLNYVTIGGETCGCLAHEILAGFLSLIPAWAFYSGAFQRLLLTHYVAYLKLNTKVR

SEQ ID NO: 39320 - protein, 736 aa, Homo sapiens
  Payload ID: 7875
  Gene Symbol: HSD17B4
  Gene Name: hydroxysteroid (17-beta) dehydrogenase 4
  Uniprot ID: P51659
  ENSP ID: ENSP00000256216
MGSPLRFDGRVVLVTGAGAGLGRAYALAFAERGALVVVNDLGGDFKGVGKGSLAADKVVEEIRRRGGKAVANYDSVEEGEKVVKTALDAFGRIDVVVNNAGILRDRSFARISDEDWDIIHRVHLRGSFQVTRAAWEHMKKQKYGRIIMTSSASGIYGNFGQANYSAAKLGLLGLANSLAIEGRKSNIHCNTIAPNAGSRMTQTVMPEDLVEALKPEYVAPLVLWLCHESCEENGGLFEVGAGWIGKLRWERTLGAIVRQKNHPMTPEAVKANWKKICDFENASKPQSIQESTGSIIEVLSKIDSEGGVSANHTSRATSTATSGFAGAIGQKLPPFSYAYTELEAIMYALGVGASIKDPKDLKFIYEGSSDFSCLPTFGVIIGQKSMMGGGLAEIPGLSINFAKVLHGEQYLELYKPLPRAGKLKCEAVVADVLDKGSGVVIIMDVYSYSEKELICHNQFSLFLVGSGGFGGKRTSDKVKVAVAIPNRPPDAVLTDTTSLNQAALYRLSGDWNPLHIDPNFASLAGFDKPILHGLCTFGFSARRVLQQFADNDVSRFKAIKARFAKPVYPGQTLQTEMWKEGNRIHFQTKVQETGDIVISNAYVDLAPTSGTSAKTPSEGGKLQSTFVFEEIGRRLKDIGPEVVKKVNAVFEWHITKGGNIGAKWTIDLKSGSGKVYQGPAKGAADTTIILSDEDFMEVVLGKLDPQKAFFSGRLKARGNIMLSQKLQMILKDYAKL

SEQ ID NO: 39321 - protein, 500 aa, Homo sapiens
  Payload ID: 7875
  Gene Symbol: HSD17B4
  Gene Name: hydroxysteroid (17-beta) dehydrogenase 4
  ENSP ID: ENSP00000390208
MGSPLRFDGRVVLVTGAGAGLGRAYALAFAERGALVVVNDLGGDFKGVGKGSLAADKVVEEIRRRGGKAVANYDSVEEGEKVVKTALDAFGRIDVVVNNAGILRDRSFARISDEDWDIIHRVHLRGSFQVTRAAWEHMKKQKYGRIIMTSSASGIYGNFGQANYSAAKLGLLGLANSLAIEGRKSNIHCNTIAPNAGSRMTQTVMPEDLVEALKPEYVAPLVLWLCHESCEENGGLFEVGAGWIGKLRWERTLGAIVRQKNHPMTPEAVKANWKKICDFENASKPQSIQESTGSIIEVLSKIDSEGGVSANHTSRATSTATSGFAGAIGQKLPPFSYAYTELEAIMYALGVGASIKDPKDLKFIYEGSSDFSCLPTFGVIIGQKSMMGGGLAEIPGLSINFAKVLHGEQYLELYKPLPRAGKLKCEAVVADVLDKGSGVVIIMDVYSYSEKELICHNQFSLFLVGSGGFGGKRTSDKVKPTQCEDDEDEDLYDDLLPLTE

SEQ ID NO: 39322 - protein, 596 aa, Homo sapiens
  Payload ID: 7875
  Gene Symbol: HSD17B4
  Gene Name: hydroxysteroid (17-beta) dehydrogenase 4
  ENSP ID: ENSP00000411960
MKKQKIIMTSSASGIYGNFGQANYSAAKLGLLGLANSLAIEGRKSNIHCNTIAPNAGSRMTQTVMPEDLVEALKPEYVAPLVLWLCHESCEENGGLFEVGAGWIGKLRWERTLGAIVRQKNHPMTPEAVKANWKKICDFENASKPQSIQESTGSIIEVLSKIDSEGGVSANHTSRATSTATSGFAGAIGQKLPPFSYAYTELEAIMYALGVGASIKDPKDLKFIYEGSSDFSCLPTFGVIIGQKSMMGGGLAEIPGLSINFAKVLHGEQYLELYKPLPRAGKLKCEAVVADVLDKGSGVVIIMDVYSYSEKELICHNQFSLFLVGSGGFGGKRTSDKVKVAVAIPNRPPDAVLTDTTSLNQAALYRLSGDWNPLHIDPNFASLAGFDKPILHGLCTFGFSARRVLQQFADNDVSRFKAIKARFAKPVYPGQTLQTEMWKEGNRIHFQTKVQETGDIVISNAYVDLAPTSGTSAKTPSEGGKLQSTFVFEEIGRRLKDIGPEVVKKVNAVFEWHITKGGNIGAKWTIDLKSGSGKVYQGPAKGAADTTIILSDEDFMEVVLGKLDPQKAFFSGRLKARGNIMLSQKLQMILKDYAKL

SEQ ID NO: 39323 - protein, 761 aa, Homo sapiens
  Payload ID: 7875
  Gene Symbol: HSD17B4
  Gene Name: hydroxysteroid (17-beta) dehydrogenase 4
  Uniprot ID: P51659
  ENSP ID: ENSP00000420914
MVILEAPHLLRRKEPETPGLSSRIGPSLCPGFCRKRSVSCCFQNLCNNPMEKIISQCRFFVSMNDLGGDFKGVGKGSLAADKVVEEIRRRGGKAVANYDSVEEGEKVVKTALDAFGRIDVVVNNAGILRDRSFARISDEDWDIIHRVHLRGSFQVTRAAWEHMKKQKYGRIIMTSSASGIYGNFGQANYSAAKLGLLGLANSLAIEGRKSNIHCNTIAPNAGSRMTQTVMPEDLVEALKPEYVAPLVLWLCHESCEENGGLFEVGAGWIGKLRWERTLGAIVRQKNHPMTPEAVKANWKKICDFENASKPQSIQESTGSIIEVLSKIDSEGGVSANHTSRATSTATSGFAGAIGQKLPPFSYAYTELEAIMYALGVGASIKDPKDLKFIYEGSSDFSCLPTFGVIIGQKSMMGGGLAEIPGLSINFAKVLHGEQYLELYKPLPRAGKLKCEAVVADVLDKGSGVVIIMDVYSYSEKELICHNQFSLFLVGSGGFGGKRTSDKVKVAVAIPNRPPDAVLTDTTSLNQAALYRLSGDWNPLHIDPNFASLAGFDKPILHGLCTFGFSARRVLQQFADNDVSRFKAIKARFAKPVYPGQTLQTEMWKEGNRIHFQTKVQETGDIVISNAYVDLAPTSGTSAKTPSEGGKLQSTFVFEEIGRRLKDIGPEVVKKVNAVFEWHITKGGNIGAKWTIDLKSGSGKVYQGPAKGAADTTIILSDEDFMEVVLGKLDPQKAFFSGRLKARGNIMLSQKLQMILKDYAKL

SEQ ID NO: 39324 - protein, 718 aa, Homo sapiens
  Payload ID: 7875
  Gene Symbol: HSD17B4
  Gene Name: hydroxysteroid (17-beta) dehydrogenase 4
  Uniprot ID: P51659
  ENSP ID: ENSP00000424613
MGSPLRFDGRVVLVTGAGAVNDLGGDFKGVGKGSLAADKVVEEIRRRGGKAVANYDSVEEGEKVVKTALDAFGRIDVVVNNAGILRDRSFARISDEDWDIIHRVHLRGSFQVTRAAWEHMKKQKYGRIIMTSSASGIYGNFGQANYSAAKLGLLGLANSLAIEGRKSNIHCNTIAPNAGSRMTQTVMPEDLVEALKPEYVAPLVLWLCHESCEENGGLFEVGAGWIGKLRWERTLGAIVRQKNHPMTPEAVKANWKKICDFENASKPQSIQESTGSIIEVLSKIDSEGGVSANHTSRATSTATSGFAGAIGQKLPPFSYAYTELEAIMYALGVGASIKDPKDLKFIYEGSSDFSCLPTFGVIIGQKSMMGGGLAEIPGLSINFAKVLHGEQYLELYKPLPRAGKLKCEAVVADVLDKGSGVVIIMDVYSYSEKELICHNQFSLFLVGSGGFGGKRTSDKVKVAVAIPNRPPDAVLTDTTSLNQAALYRLSGDWNPLHIDPNFASLAGFDKPILHGLCTFGFSARRVLQQFADNDVSRFKAIKARFAKPVYPGQTLQTEMWKEGNRIHFQTKVQETGDIVISNAYVDLAPTSGTSAKTPSEGGKLQSTFVFEEIGRRLKDIGPEVVKKVNAVFEWHITKGGNIGAKWTIDLKSGSGKVYQGPAKGAADTTIILSDEDFMEVVLGKLDPQKAFFSGRLKARGNIMLSQKLQMILKDYAKL

SEQ ID NO: 39325 - protein, 712 aa, Homo sapiens
  Payload ID: 7875
  Gene Symbol: HSD17B4
  Gene Name: hydroxysteroid (17-beta) dehydrogenase 4
  ENSP ID: ENSP00000424940
MEKIISQCRFFVSMNDLGGDFKGVGKGSLAADKVVEEIRRRGGKAVANYDSVEEGEKVVKTALDAFGRIDVVVNNAGILRDRSFARISDEDWDIIHRVHLRGSFQVTRAAWEHMKKQKYGRIIMTSSASGIYGNFGQANYSAAKLGLLGLANSLAIEGRKSNIHCNTIAPNAGSRMTQTVMPEDLVEALKPEYVAPLVLWLCHESCEENGGLFEVGAGWIGKLRWERTLGAIVRQKNHPMTPEAVKANWKKICDFENASKPQSIQESTGSIIEVLSKIDSEGGVSANHTSRATSTATSGFAGAIGQKLPPFSYAYTELEAIMYALGVGASIKDPKDLKFIYEGSSDFSCLPTFGVIIGQKSMMGGGLAEIPGLSINFAKVLHGEQYLELYKPLPRAGKLKCEAVVADVLDKGSGVVIIMDVYSYSEKELICHNQFSLFLVGSGGFGGKRTSDKVKVAVAIPNRPPDAVLTDTTSLNQAALYRLSGDWNPLHIDPNFASLAGFDKPILHGLCTFGFSARRVLQQFADNDVSRFKAIKARFAKPVYPGQTLQTEMWKEGNRIHFQTKVQETGDIVISNAYVDLAPTSGTSAKTPSEGGKLQSTFVFEEIGRRLKDIGPEVVKKVNAVFEWHITKGGNIGAKWTIDLKSGSGKVYQGPAKGAADTTIILSDEDFMEVVLGKLDPQKAFFSGRLKARGNIMLSQKLQMILKDYAKL

SEQ ID NO: 39326 - protein, 599 aa, Homo sapiens
  Payload ID: 7875
  Gene Symbol: HSD17B4
  Gene Name: hydroxysteroid (17-beta) dehydrogenase 4
  ENSP ID: ENSP00000425993
MKKQKYGRIIMTSSASGIYGNFGQANYSAAKLGLLGLANSLAIEGRKSNIHCNTIAPNAGSRMTQTVMPEDLVEALKPEYVAPLVLWLCHESCEENGGLFEVGAGWIGKLRWERTLGAIVRQKNHPMTPEAVKANWKKICDFENASKPQSIQESTGSIIEVLSKIDSEGGVSANHTSRATSTATSGFAGAIGQKLPPFSYAYTELEAIMYALGVGASIKDPKDLKFIYEGSSDFSCLPTFGVIIGQKSMMGGGLAEIPGLSINFAKVLHGEQYLELYKPLPRAGKLKCEAVVADVLDKGSGVVIIMDVYSYSEKELICHNQFSLFLVGSGGFGGKRTSDKVKVAVAIPNRPPDAVLTDTTSLNQAALYRLSGDWNPLHIDPNFASLAGFDKPILHGLCTFGFSARRVLQQFADNDVSRFKAIKARFAKPVYPGQTLQTEMWKEGNRIHFQTKVQETGDIVISNAYVDLAPTSGTSAKTPSEGGKLQSTFVFEEIGRRLKDIGPEVVKKVNAVFEWHITKGGNIGAKWTIDLKSGSGKVYQGPAKGAADTTIILSDEDFMEVVLGKLDPQKAFFSGRLKARGNIMLSQKLQMILKDYAKL

SEQ ID NO: 39327 - protein, 474 aa, Homo sapiens
  Payload ID: 7875
  Gene Symbol: HSD17B4
  Gene Name: hydroxysteroid (17-beta) dehydrogenase 4
  ENSP ID: ENSP00000426272
MISAHYNLCPLGSSDSPTSASQVAGITESTGSIIEVLSKIDSEGGVSANHTSRATSTATSGFAGAIGQKLPPFSYAYTELEAIMYALGVGASIKDPKDLKFIYEGSSDFSCLPTFGVIIGQKSMMGGGLAEIPGLSINFAKVLHGEQYLELYKPLPRAGKLKCEAVVADVLDKGSGVVIIMDVYSYSEKELICHNQFSLFLVGSGGFGGKRTSDKVKVAVAIPNRPPDAVLTDTTSLNQAALYRLSGDWNPLHIDPNFASLAGFDKPILHGLCTFGFSARRVLQQFADNDVSRFKAIKARFAKPVYPGQTLQTEMWKEGNRIHFQTKVQETGDIVISNAYVDLAPTSGTSAKTPSEGGKLQSTFVFEEIGRRLKDIGPEVVKKVNAVFEWHITKGGNIGAKWTIDLKSGSGKVYQGPAKGAADTTIILSDEDFMEVVLGKLDPQKAFFSGRLKARGNIMLSQKLQMILKDYAKL

SEQ ID NO: 39328 - protein, 317 aa, Homo sapiens
  Payload ID: 7876
  Gene Symbol: HSD17B6
  Gene Name: hydroxysteroid (17-beta) dehydrogenase 6
  Uniprot ID: O14756
  ENSP ID: ENSP00000318631
MWLYLAAFVGLYYLLHWYRERQVVSHLQDKYVFITGCDSGFGNLLARQLDARGLRVLAACLTEKGAEQLRGQTSDRLETVTLDVTKMESIAAATQWVKEHVGDRGLWGLVNNAGILTPITLCEWLNTEDSMNMLKVNLIGVIQVTLSMLPLVRRARGRIVNVSSILGRVAFFVGGYCVSKYGVEAFSDILRREIQHFGVKISIVEPGYFRTGMTNMTQSLERMKQSWKEAPKHIKETYGQQYFDALYNIMKEGLLNCSTNLNLVTDCMEHALTSVHPRTRYSAGWDAKFFFIPLSYLPTSLADYILTRSWPKPAQAV

SEQ ID NO: 39329 - protein, 317 aa, Homo sapiens; identical to SEQ ID NO: 39328
  Payload ID: 7876
  Gene Symbol: HSD17B6
  Gene Name: hydroxysteroid (17-beta) dehydrogenase 6
  Uniprot ID: O14756
  ENSP ID: ENSP00000450698

SEQ ID NO: 39330 - protein, 317 aa, Homo sapiens; identical to SEQ ID NO: 39328
  Payload ID: 7876
  Gene Symbol: HSD17B6
  Gene Name: hydroxysteroid (17-beta) dehydrogenase 6
  Uniprot ID: O14756
  ENSP ID: ENSP00000451406

SEQ ID NO: 39331 - protein, 88 aa, Homo sapiens
  Payload ID: 7876
  Gene Symbol: HSD17B6
  Gene Name: hydroxysteroid (17-beta) dehydrogenase 6
  ENSP ID: ENSP00000451497
MWLYLAAFVGLYYLLHWYRERQVVSHLQDKYVFITGCDSGFGNLLARQLDARGLRVLAACLTEKGAEQLRGQTSDRLETVTLDVTKME

SEQ ID NO: 39332 - protein, 317 aa, Homo sapiens; identical to SEQ ID NO: 39328
  Payload ID: 7876
  Gene Symbol: HSD17B6
  Gene Name: hydroxysteroid (17-beta) dehydrogenase 6
  Uniprot ID: O14756
  ENSP ID: ENSP00000451753

SEQ ID NO: 39333 - protein, 75 aa, Homo sapiens
  Payload ID: 7876
  Gene Symbol: HSD17B6
  Gene Name: hydroxysteroid (17-beta) dehydrogenase 6
  ENSP ID: ENSP00000452103
MWLYLAAFVGLYYLLHWYRERQVVSHLQDKYVFITGCDSGFGNLLARQLDARGLRVLAACLTEKGAEQLRGQTSD

SEQ ID NO: 39334 - protein, 317 aa, Homo sapiens; identical to SEQ ID NO: 39328
  Payload ID: 7876
  Gene Symbol: HSD17B6
  Gene Name: hydroxysteroid (17-beta) dehydrogenase 6
  Uniprot ID: O14756
  ENSP ID: ENSP00000452273

SEQ ID NO: 39335 - protein, 341 aa, Homo sapiens
  Payload ID: 7877
  Gene Symbol: HSD17B7
  Gene Name: hydroxysteroid (17-beta) dehydrogenase 7
  Uniprot ID: P56937
  ENSP ID: ENSP00000254521
MRKVVLITGASSGIGLALCKRLLAEDDELHLCLACRNMSKAEAVCAALLASHPTAEVTIVQVDVSNLQSVFRASKELKQRFQRLDCIYLNAGIMPNPQLNIKALFFGLFSRKVIHMFSTAEGLLTQGDKITADGLQEVFETNVFGHFILIRELEPLLCHSDNPSQLIWTSSRSARKSNFSLEDFQHSKGKEPYSSSKYATDLLSVALNRNFNQQGLYSNVACPGTALTNLTYGILPPFIWTLLMPAILLLRFFANAFTLTPYNGTEALVWLFHQKPESLNPLIKYLSATTGFGRNYIMTQKMDLDEDTAEKFYQKLLELEKHIRVTIQKTDNQARLSGSCL

SEQ ID NO: 39336 - protein, 111 aa, Homo sapiens
  Payload ID: 7877
  Gene Symbol: HSD17B7
  Gene Name: hydroxysteroid (17-beta) dehydrogenase 7
  ENSP ID: ENSP00000356889
MRKVVLITGASSGIGLALCKRLLAEDDELHLCLACRNMSKAEAVCAALLASHPTAEVTIVQVDVSNLQSVFRASKELKQRFQRLDCIYLNAGIMPNPQLNIKALFFGLFSS

SEQ ID NO: 39337 - protein, 84 aa, Homo sapiens
  Payload ID: 7877
  Gene Symbol: HSD17B7
  Gene Name: hydroxysteroid (17-beta) dehydrogenase 7
  ENSP ID: ENSP00000356892
MRKVVLITGASSGIGLALCKRLLAEDDELHLCLACRNMSKAEAVCAALLASHPTAEVTIVQVDVSNLQSVFRASKELKQRYISC

SEQ ID NO: 39338 - protein, 109 aa, Homo sapiens
  Payload ID: 7877
  Gene Symbol: HSD17B7
  Gene Name: hydroxysteroid (17-beta) dehydrogenase 7
  ENSP ID: ENSP00000436334
MRKVVLITGASSGIGLALCKRLLAEDDELHLCLACRNMSKAEAVCAALLASHPTAEVTIVQVDVSNLQSVFRASKELKQRMIKKWLYVICVEDHVSEIRLYISKCWDHA

SEQ ID NO: 39339 - protein, 62 aa, Homo sapiens
  Payload ID: 7877
  Gene Symbol: HSD17B7
  Gene Name: hydroxysteroid (17-beta) dehydrogenase 7
  ENSP ID: ENSP00000476930
  MOD_RES (1)..(1): Any amino acid
XSLEDFQHSKGKEPYSSSKYATDLLSVALNRNFNQQVLYSSVYVIKYLPHYMEVGLSITIFR

SEQ ID NO: 39340 - protein, 261 aa, Homo sapiens
  Payload ID: 7878
  Gene Symbol: HSD17B8
  Gene Name: hydroxysteroid (17-beta) dehydrogenase 8
  Uniprot ID: Q92506
  ENSP ID: ENSP00000230236
MASQLQNRLRSALALVTGAGSGIGRAVSVRLAGEGATVAACDLDRAAAQETVRLLGGPGSKEGPPRGNHAAFQADVSEARAARCLLEQVQACFSRPPSVVVSCAGITQDEFLLHMSEDDWDKVIAVNLKGTFLVTQAAAQALVSNGCRGSIINISSIVGKVGNVGQTNYAASKAGVIGLTQTAARELGRHGIRCNSVLPGFIATPMTQKVPQKVVDKITEMIPMGHLGDPEDVADVVAFLASEDSGYITGTSVEVTGGLFM

SEQ ID NO: 39341 - protein, 261 aa, Homo sapiens; identical to SEQ ID NO: 39340
  Payload ID: 7878
  Gene Symbol: HSD17B8
  Gene Name: hydroxysteroid (17-beta) dehydrogenase 8
  Uniprot ID: Q92506
  ENSP ID: ENSP00000363794

SEQ ID NO: 39342 - protein, 261 aa, Homo sapiens; identical to SEQ ID NO: 39340
  Payload ID: 7878
  Gene Symbol: HSD17B8
  Gene Name: hydroxysteroid (17-beta) dehydrogenase 8
  Uniprot ID: Q92506
  ENSP ID: ENSP00000387753

SEQ ID NO: 39343 - protein, 261 aa, Homo sapiens; identical to SEQ ID NO: 39340
  Payload ID: 7878
  Gene Symbol: HSD17B8
  Gene Name: hydroxysteroid (17-beta) dehydrogenase 8
  Uniprot ID: Q92506
  ENSP ID: ENSP00000403538

SEQ ID NO: 39344 - protein, 261 aa, Homo sapiens; identical to SEQ ID NO: 39340
  Payload ID: 7878
  Gene Symbol: HSD17B8
  Gene Name: hydroxysteroid (17-beta) dehydrogenase 8
  Uniprot ID: Q92506
  ENSP ID: ENSP00000406488

SEQ ID NO: 39345 - protein, 261 aa, Homo sapiens; identical to SEQ ID NO: 39340
  Payload ID: 7878
  Gene Symbol: HSD17B8
  Gene Name: hydroxysteroid (17-beta) dehydrogenase 8
  Uniprot ID: Q92506
  ENSP ID: ENSP00000413950

SEQ ID NO: 39346 - protein, 330 aa, Homo sapiens
  Payload ID: 7879
  Gene Symbol: HSDL1
  Gene Name: hydroxysteroid dehydrogenase like 1
  Uniprot ID: Q3SXM5
  ENSP ID: ENSP00000219439
MAAVDSFYLLYREIARSCNCYMEALALVGAWYTARKSITVICDFYSLIRLHFIPRLGSRADLIKQYGRWAVVSGATDGIGKAYAEELASRGLNIILISRNEEKLQVVAKDIADTYKVETDIIVADFSSGREIYLPIREALKDKDVGILVNNVGVFYPYPQYFTQLSEDKLWDIINVNIAAASLMVHVVLPGMVERKKGAIVTISSGSCCKPTPQLAAFSASKAYLDHFSRALQYEYASKGIFVQSLIPFYVATSMTAPSNFLHRCSWLVPSPKVYAHHAVSTLGISKRTTGYWSHSIQFLFAQYMPEWLWVWGANILNRSLRKEALSCTA

SEQ ID NO: 39347 - protein, 275 aa, Homo sapiens
  Payload ID: 7879
  Gene Symbol: HSDL1
  Gene Name: hydroxysteroid dehydrogenase like 1
  Uniprot ID: Q3SXM5
  ENSP ID: ENSP00000407437
MAAVDSFYLLYREIARSCNCYMEALALVGAWYTARKSITVICDFYSLIRLHFIPRLGSRADLIKQYGRWAVVSGATDGIGKAYAEELASRGLNIILISRNEEKLQYFTQLSEDKLWDIINVNIAAASLMVHVVLPGMVERKKGAIVTISSGSCCKPTPQLAAFSASKAYLDHFSRALQYEYASKGIFVQSLIPFYVATSMTAPSNFLHRCSWLVPSPKVYAHHAVSTLGISKRTTGYWSHSIQFLFAQYMPEWLWVWGANILNRSLRKEALSCTA

SEQ ID NO: 39348 - protein, 70 aa, Homo sapiens
  Payload ID: 7879
  Gene Symbol: HSDL1
  Gene Name: hydroxysteroid dehydrogenase like 1
  ENSP ID: ENSP00000454856
MAAVDSFYLLYREIARSCNCYMEALALVGAWYTARKSITVICDFYSLIRLHFIPRLGSRADLIKQYGRWA

SEQ ID NO: 39349 - protein, 108 aa, Homo sapiens
  Payload ID: 7879
  Gene Symbol: HSDL1
  Gene Name: hydroxysteroid dehydrogenase like 1
  ENSP ID: ENSP00000455797
MAAVDSFYLLYREIARSCNCYMEALALVGAWYTARKSITVICDFYSLIRLHFIPRLGSRADLIKQYGRWAVVSGATDGIGKAYAEELASRGLNIILISRNEEKLQVVA

SEQ ID NO: 39350 - protein, 111 aa, Homo sapiens
  Payload ID: 7879
  Gene Symbol: HSDL1
  Gene Name: hydroxysteroid dehydrogenase like 1
  ENSP ID: ENSP00000457026
MAAVDSFYLLYREIARSCNCYMEALALVGAWYTARKSITVICDFYSLIRLHFIPRLGSRADLIKQYGRWAVVSGATDGIGKAYAEELASRGLNIILISRNEEKLQVVAKDI

SEQ ID NO: 39351 - protein, 345 aa, Homo sapiens
  Payload ID: 7880
  Gene Symbol: HSDL2
  Gene Name: hydroxysteroid dehydrogenase like 2
  Uniprot ID: Q6YN16
  ENSP ID: ENSP00000381783
MLPNTGRLAGCTVFITGASRGIGKAIALKAAKDGANIVIAAKTAQPHPKLLGTIYTAAEEIEAVGGKALPCIVDVRDEQQISAAVEKAIKKFGAYTIAKYGMSMYVLGMAEEFKGEIAVNALWPKTAIHTAAMDMLGGPGIESQCRKVDIIADAAYSIFQKPKSFTGNFVIDENILKEEGIENFDVYAIKPGHPLQPDFFLDEYPEAVSKKVESTGAVPEFKEEKLQLQPKPRSGAVEETFRIVKDSLSDDVVKATQAIYLFELSGEDGGTWFLDLKSKGGNVGYGEPSDQADVVMSMTTDDFVKMFSGKLKPTMAFMSGKLKIKGNMALAIKLEKLMNQMNARL

SEQ ID NO: 39352 - protein, 418 aa, Homo sapiens
  Payload ID: 7880
  Gene Symbol: HSDL2
  Gene Name: hydroxysteroid dehydrogenase like 2
  Uniprot ID: Q6YN16
  ENSP ID: ENSP00000381785
MLPNTGRLAGCTVFITGASRGIGKAIALKAAKDGANIVIAAKTAQPHPKLLGTIYTAAEEIEAVGGKALPCIVDVRDEQQISAAVEKAIKKFGGIDILVNNASAISLTNTLDTPTKRLDLMMNVNTRGTYLASKACIPYLKKSKVAHILNISPPLNLNPVWFKQHCAYTIAKYGMSMYVLGMAEEFKGEIAVNALWPKTAIHTAAMDMLGGPGIESQCRKVDIIADAAYSIFQKPKSFTGNFVIDENILKEEGIENFDVYAIKPGHPLQPDFFLDEYPEAVSKKVESTGAVPEFKEEKLQLQPKPRSGAVEETFRIVKDSLSDDVVKATQAIYLFELSGEDGGTWFLDLKSKGGNVGYGEPSDQADVVMSMTTDDFVKMFSGKLKPTMAFMSGKLKIKGNMALAIKLEKLMNQMNARL

SEQ ID NO: 39353 - protein, 733 aa, Homo sapiens
  Payload ID: 7881
  Gene Symbol: HIC1
  Gene Name: hypermethylated in cancer 1
  Uniprot ID: Q14526
  ENSP ID: ENSP00000314080
MTFPEADILLKSGECAGQTMLDTMEAPGHSRQLLLQLNNQRTKGFLCDVIIVVQNALFRAHKNVLAASSAYLKSLVVHDNLLNLDHDMVSPAVFRLVLDFIYTGRLADGAEAAAAAAVAPGAEPSLGAVLAAASYLQIPDLVALCKKRLKRHGKYCHLRGGGGGGGGYAPYGRPGRGLRAATPVIQACYPSPVGPPPPPAAEPPSGPEAAVNTHCAELYASGPGPAAALCASERRCSPLCGLDLSKKSPPGSAAPERPLAERELPPRPDSPPSAGPAAYKEPPLALPSLPPLPFQKLEEAAPPSDPFRGGSGSPGPEPPGRPDGPSLLYRWMKHEPGLGSYGDELGRERGSPSERCEERGGDAAVSPGGPPLGLAPPPRYPGSLDGPGAGGDGDDYKSSSEETGSSEDPSPPGGHLEGYPCPHLAYGEPESFGDNLYVCIPCGKGFPSSEQLNAHVEAHVEEEEALYGRAEAAEVAAGAAGLGPPFGGGGDKVAGAPGGLGELLRPYRCASCDKSYKDPATLRQHEKTHWLTRPYPCTICGKKFTQRGTMTRHMRSHLGLKPFACDACGMRFTRQYRLTEHMRIHSGEKPYECQVCGGKFAQQRNLISHMKMHAVGGAAGAAGALAGLGGLPGVPGPDGKGKLDFPEGVFAVARLTAEQLSLKQQDKAAAAELLAQTTHFLHDPKVALESLYPLAKFTAELGLSPDKAAEVLSQGAHLAAGPDGRTIDRFSPT

SEQ ID NO: 39354 - protein, 714 aa, Homo sapiens
  Payload ID: 7881
  Gene Symbol: HIC1
  Gene Name: hypermethylated in cancer 1
  Uniprot ID: Q14526
  ENSP ID: ENSP00000382742
MLDTMEAPGHSRQLLLQLNNQRTKGFLCDVIIVVQNALFRAHKNVLAASSAYLKSLVVHDNLLNLDHDMVSPAVFRLVLDFIYTGRLADGAEAAAAAAVAPGAEPSLGAVLAAASYLQIPDLVALCKKRLKRHGKYCHLRGGGGGGGGYAPYGRPGRGLRAATPVIQACYPSPVGPPPPPAAEPPSGPEAAVNTHCAELYASGPGPAAALCASERRCSPLCGLDLSKKSPPGSAAPERPLAERELPPRPDSPPSAGPAAYKEPPLALPSLPPLPFQKLEEAAPPSDPFRGGSGSPGPEPPGRPDGPSLLYRWMKHEPGLGSYGDELGRERGSPSERCEERGGDAAVSPGGPPLGLAPPPRYPGSLDGPGAGGDGDDYKSSSEETGSSEDPSPPGGHLEGYPCPHLAYGEPESFGDNLYVCIPCGKGFPSSEQLNAHVEAHVEEEEALYGRAEAAEVAAGAAGLGPPFGGGGDKVAGAPGGLGELLRPYRCASCDKSYKDPATLRQHEKTHWLTRPYPCTICGKKFTQRGTMTRHMRSHLGLKPFACDACGMRFTRQYRLTEHMRIHSGEKPYECQVCGGKFAQQRNLISHMKMHAVGGAAGAAGALAGLGGLPGVPGPDGKGKLDFPEGVFAVARLTAEQLSLKQQDKAAAAELLAQTTHFLHDPKVALESLYPLAKFTAELGLSPDKAAEVLSQGAHLAAGPDGRTIDRFSPT

SEQ ID NO: 39355 - protein, 96 aa, Homo sapiens
  Payload ID: 7881
  Gene Symbol: HIC1
  Gene Name: hypermethylated in cancer 1
  ENSP ID: ENSP00000460268
MLDTMEAPGHSRQLLLQLNNQRTKGFLCDVIIVVQNALFRAHKNVLAASSAYLKSLVVHDNLLNLDHDMVSPAVFRLVLDFIYTGRLADGAEAAAA

SEQ ID NO: 39356 - protein, 9 aa, Homo sapiens
  Payload ID: 7881
  Gene Symbol: HIC1
  Gene Name: hypermethylated in cancer 1
  ENSP ID: ENSP00000461476
MLDTMEAPG

SEQ ID NO: 39357 - protein, 84 aa, Homo sapiens
  Payload ID: 7881
  Gene Symbol: HIC1
  Gene Name: hypermethylated in cancer 1
  ENSP ID: ENSP00000467045
MLDTMEAPGHSRQLLLQLNNQRTKGFLCDVIIVVQNALFRAHKNVLAASSAYLKSLVVHDNLLNLDHDMVSPAVFRLVLDFIYT

SEQ ID NO: 39358 - protein, 66 aa, Homo sapiens
  Payload ID: 7881
  Gene Symbol: HIC1
  Gene Name: hypermethylated in cancer 1
  ENSP ID: ENSP00000476554
MLDTMEAPGHSRQLLLQLNNQRTKGFLCDVIIVVQNALFRAHKNVLAASSAYLKSLVVHDNLLNLD

SEQ ID NO: 39359 - protein, 714 aa, Homo sapiens; identical to SEQ ID NO: 39354
  Payload ID: 7881
  Gene Symbol: HIC1
  Gene Name: hypermethylated in cancer 1
  Uniprot ID: Q14526
  ENSP ID: ENSP00000477858

SEQ ID NO: 39360 - protein, 615 aa, Homo sapiens
  Payload ID: 7882
  Gene Symbol: HIC2
  Gene Name: hypermethylated in cancer 2
  Uniprot ID: Q96JB3
  ENSP ID: ENSP00000384889
MVSGPLALRWCAWAGRGDMGPDMELPSHSKQLLLQLNQQRTKGFLCDVIIMVENSIFRAHKNVLAASSIYFKSLVLHDNLINLDTDMVSSTVFQQILDFIYTGKLLPSDQPAEPNFSTLLTAASYLQLPELAALCRRKLKRAGKPFGSGRAGSTGMGRPPRSQRLSTASVIQARYQGLVDGRKGAHAPQELPQAKGSDDELFLGGSNQDSVQGLGRAVCPAGGEAGLGGCSSSTNGSSGGCEQELGLDLSKKSPPLPPATPGPHLTPDDAAQLSDSQHGSPPAASAPPVANSASYSELGGTPDEPMDLEGAEDNHLSLLEAPGGQPRKSLRHSTRKKEWGKKEPVAGSPFERREAGPKGPCPGEEGEGVGDRVPNGILASGAGPSGPYGEPPYPCKEEEENGKDASEDSAQSGSEGGSGHASAHYMYRQEGYETVSYGDNLYVCIPCAKGFPSSEQLNAHVETHTEEELFIKEEGAYETGSGGAEEEAEDLSAPSAAYTAEPRPFKCSVCEKTYKDPATLRQHEKTHWLTRPFPCNICGKMFTQRGTMTRHMRSHLGLKPFACDECGMRFTRQYRLTEHMRVHSGEKPYECQLCGGKFTQQRNLISHLRMHTSPS

SEQ ID NO: 39361 - protein, 615 aa, Homo sapiens; identical to SEQ ID NO: 39360
  Payload ID: 7882
  Gene Symbol: HIC2
  Gene Name: hypermethylated in cancer 2
  Uniprot ID: Q96JB3
  ENSP ID: ENSP00000385319

SEQ ID NO: 39362 - protein, 615 aa, Homo sapiens; identical to SEQ ID NO: 39360
  Payload ID: 7882
  Gene Symbol: HIC2
  Gene Name: hypermethylated in cancer 2
  Uniprot ID: Q96JB3
  ENSP ID: ENSP00000387757

SEQ ID NO: 39363 - protein, 890 aa, Homo sapiens
  Payload ID: 7883
  Gene Symbol: HCN1
  Gene Name: hyperpolarization activated cyclic nucleotide gated potassium channel 1
  Uniprot ID: O60741
  ENSP ID: ENSP00000307342
MEGGGKPNSSSNSRDDGNSVFPAKASATGAGPAAAEKRLGTPPGGGGAGAKEHGNSVCFKVDGGGGGGGGGGGGEEPAGGFEDAEGPRRQYGFMQRQFTSMLQPGVNKFSLRMFGSQKAVEKEQERVKTAGFWIIHPYSDFRFYWDLIMLIMMVGNLVIIPVGITFFTEQTTTPWIIFNVASDTVFLLDLIMNFRTGTVNEDSSEIILDPKVIKMNYLKSWFVVDFISSIPVDYIFLIVEKGMDSEVYKTARALRIVRFTKILSLLRLLRLSRLIRYIHQWEEIFHMTYDLASAVVRIFNLIGMMLLLCHWDGCLQFLVPLLQDFPPDCWVSLNEMVNDSWGKQYSYALFKAMSHMLCIGYGAQAPVSMSDLWITMLSMIVGATCYAMFVGHATALIQSLDSSRRQYQEKYKQVEQYMSFHKLPADMRQKIHDYYEHRYQGKIFDEENILNELNDPLREEIVNFNCRKLVATMPLFANADPNFVTAMLSKLRFEVFQPGDYIIREGAVGKKMYFIQHGVAGVITKSSKEMKLTDGSYFGEICLLTKGRRTASVRADTYCRLYSLSVDNFNEVLEEYPMMRRAFETVAIDRLDRIGKKNSILLQKFQKDLNTGVFNNQENEILKQIVKHDREMVQAIAPINYPQMTTLNSTSSTTTPTSRMRTQSPPVYTATSLSHSNLHSPSPSTQTPQPSAILSPCSYTTAVCSPPVQSPLAARTFHYASPTASQLSLMQQQPQQQVQQSQPPQTQPQQPSPQPQTPGSSTPKNEVHKSTQALHNTNLTREVRPLSASQPSLPHEVSTLISRPHPTVGESLASIPQPVTAVPGTGLQAGGRSTVPQRVTLFRQMSSGAIPPNRGVPPAPPPPAAALPRESSSVLNTDPDAEKPRFASNL

SEQ ID NO: 39364 - protein, 295 aa, Homo sapiens
  Payload ID: 7883
  Gene Symbol: HCN1
  Gene Name: hyperpolarization activated cyclic nucleotide gated potassium channel 1
  ENSP ID: ENSP00000489134
MEGGGKPNSSSNSRDDGNSVFPAKASATGAGPAAAEKRLGTPPGGGGAGAKEHGNSVCFKVDGGGGGGGGGGGGEEPAGGFEDAEGPRRQYGFMQRQFTSMLQPGVNKFSLRMFGSQKAVEKEQERVKTAGFWIIHPYSDFRFYWDLIMLIMMVGNLVIIPVGITFFTEQTTTPWIIFNVASDTVFLLDLIMNFRTGTVNEDSSEIILDPKVIKMNYLKSWFVVDFISSIPVDYIFLIVEKGMDSEVYKTARALRIVRFTKILSLLRLLRLSRLIRYIHQWEEVRCIFFFFKSIS

SEQ ID NO: 39365 - protein, 889 aa, Homo sapiens
  Payload ID: 7884
  Gene Symbol: HCN2
  Gene Name: hyperpolarization activated cyclic nucleotide gated potassium channel 2
  Uniprot ID: Q9UL51
  ENSP ID: ENSP00000251287
MDARGGGGRPGESPGATPAPGPPPPPPPAPPQQQPPPPPPPAPPPGPGPAPPQHPPRAEALPPEAADEGGPRGRLRSRDSSCGRPGTPGAASTAKGSPNGECGRGEPQCSPAGPEGPARGPKVSFSCRGAASGPAPGPGPAEEAGSEEAGPAGEPRGSQASFMQRQFGALLQPGVNKFSLRMFGSQKAVEREQERVKSAGAWIIHPYSDFRFYWDFTMLLFMVGNLIIIPVGITFFKDETTAPWIVFNVVSDTFFLMDLVLNFRTGIVIEDNTEIILDPEKIKKKYLRTWFVVDFVSSIPVDYIFLIVEKGIDSEVYKTARALRIVRFTKILSLLRLLRLSRLIRYIHQWEEIFHMTYDLASAVMRICNLISMMLLLCHWDGCLQFLVPMLQDFPRNCWVSINGMVNHSWSELYSFALFKAMSHMLCIGYGRQAPESMTDIWLTMLSMIVGATCYAMFIGHATALIQSLDSSRRQYQEKYKQVEQYMSFHKLPADFRQKIHDYYEHRYQGKMFDEDSILGELNGPLREEIVNFNCRKLVASMPLFANADPNFVTAMLTKLKFEVFQPGDYIIREGTIGKKMYFIQHGVVSVLTKGNKEMKLSDGSYFGEICLLTRGRRTASVRADTYCRLYSLSVDNFNEVLEEYPMMRRAFETVAIDRLDRIGKKNSILLHKVQHDLNSGVFNNQENAIIQEIVKYDREMVQQAELGQRVGLFPPPPPPPQVTSAIATLQQAAAMSFCPQVARPLVGPLALGSPRLVRRPPPGPAPAAASPGPPPPASPPGAPASPRAPRTSPYGGLPAAPLAGPALPARRLSRASRPLSASQPSLPHGAPGPAASTRPASSSTPRLGPTPAARAAAPSPDRRDSASPGAAGGLDPQDSARSRLSSNL

SEQ ID NO: 39366 - protein, 774 aa, Homo sapiens
  Payload ID: 7885
  Gene Symbol: HCN3
  Gene Name: hyperpolarization activated cyclic nucleotide gated potassium channel 3
  Uniprot ID: Q9P1Z3
  ENSP ID: ENSP00000357342
MEAEQRPAAGASEGATPGLEAVPPVAPPPATAASGPIPKSGPEPKRRHLGTLLQPTVNKFSLRVFGSHKAVEIEQERVKSAGAWIIHPYSDFRFYWDLIMLLLMVGNLIVLPVGITFFKEENSPPWIVFNVLSDTFFLLDLVLNFRTGIVVEEGAEILLAPRAIRTRYLRTWFLVDLISSIPVDYIFLVVELEPRLDAEVYKTARALRIVRFTKILSLLRLLRLSRLIRYIHQWEEIFHMTYDLASAVVRIFNLIGMMLLLCHWDGCLQFLVPMLQDFPPDCWVSINHMVNHSWGRQYSHALFKAMSHMLCIGYGQQAPVGMPDVWLTMLSMIVGATCYAMFIGHATALIQSLDSSRRQYQEKYKQVEQYMSFHKLPADTRQRIHEYYEHRYQGKMFDEESILGELSEPLREEIINFTCRGLVAHMPLFAHADPSFVTAVLTKLRFEVFQPGDLVVREGSVGRKMYFIQHGLLSVLARGARDTRLTDGSYFGEICLLTRGRRTASVRADTYCRLYSLSVDHFNAVLEEFPMMRRAFETVAMDRLLRIGKKNSILQRKRSEPSPGSSGGIMEQHLVQHDRDMARGVRGRAPSTGAQLSGKPVLWEPLVHAPLQAAAVTSNVAIALTHQRGPLPLSPDSPATLLARSAWRSAGSPASPLVPVRAGPWASTSRLPAPPARTLHASLSRAGRSQVSLLGPPPGGGGRRLGPRGRPLSASQPSLPQRATGDGSPGRKGSGSERLPPSGLLAKPPRTAQPPRPPVPEPATPRGLQLSANM

SEQ ID NO: 39367 - protein, 774 aa, Homo sapiens; identical to SEQ ID NO: 39366
  Payload ID: 7885
  Gene Symbol: HCN3
  Gene Name: hyperpolarization activated cyclic nucleotide gated potassium channel 3
  Uniprot ID: Q9P1Z3
  ENSP ID: ENSP00000458364

SEQ ID NO: 39368 - protein, 1203 aa, Homo sapiens
  Payload ID: 7886
  Gene Symbol: HCN4
  Gene Name: hyperpolarization activated cyclic nucleotide gated potassium channel 4
  Uniprot ID: Q9Y3Q4
  ENSP ID: ENSP00000261917
MDKLPPSMRKRLYSLPQQVGAKAWIMDEEEDAEEEGAGGRQDPSRRSIRLRPLPSPSPSAAAGGTESRSSALGAADSEGPARGAGKSSTNGDCRRFRGSLASLGSRGGGSGGTGSGSSHGHLHDSAEERRLIAEGDASPGEDRTPPGLAAEPERPGASAQPAASPPPPQQPPQPASASCEQPSVDTAIKVEGGAAAGDQILPEAEVRLGQAGFMQRQFGAMLQPGVNKFSLRMFGSQKAVEREQERVKSAGFWIIHPYSDFRFYWDLTMLLLMVGNLIIIPVGITFFKDENTTPWIVFNVVSDTFFLIDLVLNFRTGIVVEDNTEIILDPQRIKMKYLKSWFMVDFISSIPVDYIFLIVETRIDSEVYKTARALRIVRFTKILSLLRLLRLSRLIRYIHQWEEIFHMTYDLASAVVRIVNLIGMMLLLCHWDGCLQFLVPMLQDFPDDCWVSINNMVNNSWGKQYSYALFKAMSHMLCIGYGRQAPVGMSDVWLTMLSMIVGATCYAMFIGHATALIQSLDSSRRQYQEKYKQVEQYMSFHKLPPDTRQRIHDYYEHRYQGKMFDEESILGELSEPLREEIINFNCRKLVASMPLFANADPNFVTSMLTKLRFEVFQPGDYIIREGTIGKKMYFIQHGVVSVLTKGNKETKLADGSYFGEICLLTRGRRTASVRADTYCRLYSLSVDNFNEVLEEYPMMRRAFETVALDRLDRIGKKNSILLHKVQHDLNSGVFNYQENEIIQQIVQHDREMAHCAHRVQAAASATPTPTPVIWTPLIQAPLQAAAATTSVAIALTHHPRLPAAIFRPPPGSGLGNLGAGQTPRHLKRLQSLIPSALGSASPASSPSQVDTPSSSSFHIQQLAGFSAPAGLSPLLPSSSSSPPPGACGSPSAPTPSAGVAATTIAGFGHFHKALGGSLSSSDSPLLTPLQPGARSPQAAQPSPAPPGARGGLGLPEHFLPPPPSSRSPSSSPGQLGQPPGELSLGLATGPLSTPETPPRQPEPPSLVAGASGGASPVGFTPRGGLSPPGHSPGPPRTFPSAPPRASGSHGSLLLPPASSPPPPQVPQRRGTPPLTPGRLTQDLKLISASQPALPQDGAQTLRRASPHSSGESMAAFPLFPRAGGGSGGSGSSGGLGPPGRPYGAIPGQHVTLPRKTSSGSLPPPLSLFGARATSSGGPPLTAGPQREPGARPEPVRSKLPSNL

SEQ ID NO: 39369 - protein, 131 aa, Homo sapiens
  Payload ID: 7887
  Gene Symbol: HCRT
  Gene Name: hypocretin (orexin) neuropeptide precursor
  Uniprot ID: O43612
  ENSP ID: ENSP00000293330
MNLPSTKVSWAAVTLLLLLLLLPPALLSSGAAAQPLPDCCRQKTCSCRLYELLHGAGNHAAGILTLGKRRSGPPGLQGRLQRLLQASGNHAAGILTMGRRAGAEPAPRPCLGRRCSAPAAASVAPGGQSGI

SEQ ID NO: 39370 - protein, 389 aa, Homo sapiens
  Payload ID: 7888
  Gene Symbol: HCRTR1
  Gene Name: hypocretin (orexin) receptor 1
  ENSP ID: ENSP00000362809
MEPSATPGAQMGVPPGSREPSPVPPDYEDEFLRYLWRDYLYPKQYEWVLIAAYVAVFVVALVGNTLVCLAVWRNHHMRTVTNYFIVNLSLADVLVTAICLPASLLVDITESWLFGHALCKVIPYLQAVSVSVAVLTLSFIALDRWYAICHPLLFKSTARRARGSILGIWAVSLAIMVPQAAVMECSSVLPELANRTRLFSVCDERWADDLYPKIYHSCFFIVTYLAPLGLMAMAYFQIFRKLWGRQIPGTTSALVRNWKRPSDQLGDLEQGLSGEPQPRARAFLAEVKQMRARRKTAKMLMVVLLVFALCYLPISVLNVLKRVFGMFRQASDREAVYACFTFSHWLVYANSAANPIIYNFLSGCKEKSLALSCPSCPGHDPHLAAALCS

SEQ ID NO: 39371 - protein, 425 aa, Homo sapiens
  Payload ID: 7888
  Gene Symbol: HCRTR1
  Gene Name: hypocretin (orexin) receptor 1
  Uniprot ID: O43613
  ENSP ID: ENSP00000362810
MEPSATPGAQMGVPPGSREPSPVPPDYEDEFLRYLWRDYLYPKQYEWVLIAAYVAVFVVALVGNTLVCLAVWRNHHMRTVTNYFIVNLSLADVLVTAICLPASLLVDITESWLFGHALCKVIPYLQAVSVSVAVLTLSFIALDRWYAICHPLLFKSTARRARGSILGIWAVSLAIMVPQAAVMECSSVLPELANRTRLFSVCDERWADDLYPKIYHSCFFIVTYLAPLGLMAMAYFQIFRKLWGRQIPGTTSALVRNWKRPSDQLGDLEQGLSGEPQPRARAFLAEVKQMRARRKTAKMLMVVLLVFALCYLPISVLNVLKRVFGMFRQASDREAVYACFTFSHWLVYANSAANPIIYNFLSGKFREQFKAAFSCCLPGLGPCGSLKAPSPRSSASHKSLSLQSRCSISKISEHVVLTSVTTVLP

SEQ ID NO: 39372 - protein, 425 aa, Homo sapiens; identical to SEQ ID NO: 39371
  Payload ID: 7888
  Gene Symbol: HCRTR1
  Gene Name: hypocretin (orexin) receptor 1
  Uniprot ID: O43613
  ENSP ID: ENSP00000384387

SEQ ID NO: 39373 - protein, 444 aa, Homo sapiens
  Payload ID: 7889
  Gene Symbol: HCRTR2
  Gene Name: hypocretin (orexin) receptor 2
  Uniprot ID: O43614
  ENSP ID: ENSP00000359899
MSGTKLEDSPPCRNWSSASELNETQEPFLNPTDYDDEEFLRYLWREYLHPKEYEWVLIAGYIIVFVVALIGNVLVCVAVWKNHHMRTVTNYFIVNLSLADVLVTITCLPATLVVDITETWFFGQSLCKVIPYLQTVSVSVSVLTLSCIALDRWYAICHPLMFKSTAKRARNSIVIIWIVSCIIMIPQAIVMECSTVFPGLANKTTLFTVCDERWGGEIYPKMYHICFFLVTYMAPLCLMVLAYLQIFRKLWCRQIPGTSSVVQRKWKPLQPVSQPRGPGQPTKSRMSAVAAEIKQIRARRKTARMLMIVLLVFAICYLPISILNVLKRVFGMFAHTEDRETVYAWFTFSHWLVYANSAANPIIYNFLSGKFREEFKAAFSCCCLGVHHRQEDRLTRGRTSTESRKSLTTQISNFDNISKLSEQVVLTSISTLPAANGAGPLQNW

SEQ ID NO: 39374 - protein, 444 aa, Homo sapiens; identical to SEQ ID NO: 39373
  Payload ID: 7889
  Gene Symbol: HCRTR2
  Gene Name: hypocretin (orexin) receptor 2
  Uniprot ID: O43614
  ENSP ID: ENSP00000477548

SEQ ID NO: 39375 - protein, 218 aa, Homo sapiens
  Payload ID: 7890
  Gene Symbol: HPRT1
  Gene Name: hypoxanthine phosphoribosyltransferase 1
  Uniprot ID: P00492
  ENSP ID: ENSP00000298556
MATRSPGVVISDDEPGYDLDLFCIPNHYAEDLERVFIPHGLIMDRTERLARDVMKEMGGHHIVALCVLKGGYKFFADLLDYIKALNRNSDRSIPMTVDFIRLKSYCNDQSTGDIKVIGGDDLSTLTGKNVLIVEDIIDTGKTMQTLLSLVRQYNPKMVKVASLLVKRTPRSVGYKPDFVGFEIPDKFVVGYALDYNEYFRDLNHVCVISETGKAKYKA

SEQ ID NO: 39376 - protein, 735 aa, Homo sapiens
  Payload ID: 7891
  Gene Symbol: HIF1A
  Gene Name: hypoxia inducible factor 1, alpha subunit (basic helix-loop-helix transcription factor)
  Uniprot ID: Q16665
  ENSP ID: ENSP00000323326
MEGAGGANDKKKISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQLRSFDQLSPLESSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNAQRKRKMEHDGSLFQAVGII

SEQ ID NO: 39377 - protein, 826 aa, Homo sapiens
  Payload ID: 7891
  Gene Symbol: HIF1A
  Gene Name: hypoxia inducible factor 1, alpha subunit (basic helix-loop-helix transcription factor)
  Uniprot ID: Q16665
  ENSP ID: ENSP00000338018
MEGAGGANDKKKISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQLRSFDQLSPLESSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNAQRKRKMEHDGSLFQAVGIGTLLQQPDDHAATTSLSWKRVKGCKSSEQNGMEQKTIILIPSDLACRLLGQSMDESGLPQLTSYDCEVNAPIQGSRNLLQGEELLRALDQVN

SEQ ID NO: 39378 - protein, 827 aa, Homo sapiens
  Payload ID: 7891
  Gene Symbol: HIF1A
  Gene Name: hypoxia inducible factor 1, alpha subunit (basic helix-loop-helix transcription factor)
  ENSP ID: ENSP00000378446
MEGAGGANDKKNRISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQLRSFDQLSPLESSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNAQRKRKMEHDGSLFQAVGIGTLLQQPDDHAATTSLSWKRVKGCKSSEQNGMEQKTIILIPSDLACRLLGQSMDESGLPQLTSYDCEVNAPIQGSRNLLQGEELLRALDQVN

SEQ ID NO: 39379 - protein, 850 aa, Homo sapiens
  Payload ID: 7891
  Gene Symbol: HIF1A
  Gene Name: hypoxia inducible factor 1, alpha subunit (basic helix-loop-helix transcription factor)
  Uniprot ID: Q16665
  ENSP ID: ENSP00000437955
MSSQCRSLENKFVFLKEGLGNSKPEELEEIRIENGRISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQLRSFDQLSPLESSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNAQRKRKMEHDGSLFQAVGIGTLLQQPDDHAATTSLSWKRVKGCKSSEQNGMEQKTIILIPSDLACRLLGQSMDESGLPQLTSYDCEVNAPIQGSRNLLQGEELLRALDQVN

SEQ ID NO: 39380 - protein, 767 aa, Homo sapiens [sequence omitted]

SEQ ID NO: 39381 - protein, 349 aa, Homo sapiens
  Payload ID: 7892
  Gene Symbol: HIF1AN
  Gene Name: hypoxia inducible factor 1, alpha subunit inhibitor
  Uniprot ID: Q9NWT6
  ENSP ID: ENSP00000299163
MAATAAEAVASGSGEPREEAGALGPAWDESQLRSYSFPTRPIPRLSQSDPRAEELIENEEPVVLTDTNLVYPALKWDLEYLQENIGNGDFSVYSASTHKFLYYDEKKMANFQNFKPRSNREEMKFHEFVEKLQDIQQRGGEERLYLQQTLNDTVGRKIVMDFLGFNWNWINKQQGKRGWGQLTSNLLLIGMEGNVTPAHYDEQQNFFAQIKGYKRCILFPPDQFECLYPYPVHHPCDRQSQVDFDNPDYERFPNFQNVVGYETVVGPGDVLYIPMYWWHHIESLLNGGITITVNFWYKGAPTPKRIEYPLKAHQKVAIMRNIEKMLGEALGNPQEVGPLLNTMIKGRYN

SEQ ID NO: 39382 - protein, 35 aa, Homo sapiens
  Payload ID: 7892
  Gene Symbol: HIF1AN
  Gene Name: hypoxia inducible factor 1, alpha subunit inhibitor
  ENSP ID: ENSP00000432791
MAATAAEAVASGSGEPREEAGALGPAWDESQSLWC

SEQ ID NO: 39383 - protein, 191 aa, Homo sapiens
  Payload ID: 7892
  Gene Symbol: HIF1AN
  Gene Name: hypoxia inducible factor 1, alpha subunit inhibitor
  ENSP ID: ENSP00000433360
MANFQNFKPRSNREEMKFHEFVEKLQDIQQRGGEERLYLQQTLNDTVGRKIVMDFLGFNWNWINKQQGKRGWGQLTSNLLLIGMEGNVTPAHYDEQQNFFAQIKGYKRCILFPPDQFECLYPYPVHHPCDRQSQVDFDNPDYERFPNFQNVVGYETVVGPGDVLYIPMYWWHHIESLLNGGITITVNFWYK

SEQ ID NO: 39384 - protein, 600 aa, Homo sapiens
  Payload ID: 7893
  Gene Symbol: HIF3A
  Gene Name: hypoxia inducible factor 3, alpha subunit
  Uniprot ID: Q9Y2N7
  ENSP ID: ENSP00000244303
MRPAAGAARRPRCCTSWLTRCPSPAASAPTWTRPLSCASPSATCACTASAPQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPDDLIGCSAYEYIHALDSDAVSKSIHTLLSKGQAVTGQYRFLARSGGYLWTQTQATVVSGGRGPQSESIVCVHFLISQVEETGVVLSLEQTEQHSRRPIQRGAPSQKDTPNPGDSLDTPGPRILAFLHPPSLSEAALAADPRRFCSPDLRRLLGPILDGASVAATPSTPLATRHPQSPLSADLPDELPVGTENVHRLFTSGKDTEAVETDLDIAQDADALDLEMLAPYISMDDDFQLNASEQLPRAYHRPLGAVPRPRARSFHGLSPPALEPSLLPRWGSDPRLSCSSPSRGDPSASSPMAGARKRTLAQSSEDEDEGVELLGVRPPKRSPSPEHENFLLFPLSLSFLLTGGPAPGSLQDPSTPLLNLNEPLGLGPSLLSPYSDEDTTQPGGPFQPRAGSAQAD

SEQ ID NO: 39385 - protein, 667 aa, Homo sapiens
  Payload ID: 7893
  Gene Symbol: HIF3A
  Gene Name: hypoxia inducible factor 3, alpha subunit
  Uniprot ID: Q9Y2N7
  ENSP ID: ENSP00000300862
MDWQDHRSTTELRKEKSRDAARSRRSQETEVLYQLAHTLPFARGVSAHLDKASIMRLTISYLRMHRLCAAGEWNQVGAGGEPLDACYLKALEGFVMVLTAEGDMAYLSENVSKHLGLSQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPDDLIGCSAYEYIHALDSDAVSKSIHTLLSKGQAVTGQYRFLARSGGYLWTQTQATVVSGGRGPQSESIVCVHFLISQVEETGVVLSLEQTEQHSRRPIQRGAPSQKDTPNPGDSLDTPGPRILAFLHPPSLSEAALAADPRRFCSPDLRRLLGPILDGASVAATPSTPLATRHPQSPLSADLPDELPVGTENVHRLFTSGKDTEAVETDLDIAQDADALDLEMLAPYISMDDDFQLNASEQLPRAYHRPLGAVPRPRARSFHGLSPPALEPSLLPRWGSDPRLSCSSPSRGDPSASSPMAGARKRTLAQSSEDEDEGVELLGVRPPKRSPSPEHENFLLFPLSLSFLLTGGPAPGSLQDPSTPLLNLNEPLGLGPSLLSPYSDEDTTQPGGPFQPRAGSAQAD

SEQ ID NO: 39386 - protein, 669 aa, Homo sapiens
  Payload ID: 7893
  Gene Symbol: HIF3A
  Gene Name: hypoxia inducible factor 3, alpha subunit
  Uniprot ID: Q9Y2N7
  ENSP ID: ENSP00000366898
MALGLQRARSTTELRKEKSRDAARSRRSQETEVLYQLAHTLPFARGVSAHLDKASIMRLTISYLRMHRLCAAGEWNQVGAGGEPLDACYLKALEGFVMVLTAEGDMAYLSENVSKHLGLSQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPDDLIGCSAYEYIHALDSDAVSKSIHTLLSKGQAVTGQYRFLARSGGYLWTQTQATVVSGGRGPQSESIVCVHFLISQVEETGVVLSLEQTEQHSRRPIQRGAPSQKDTPNPGDSLDTPGPRILAFLHPPSLSEAALAADPRRFCSPDLRRLLGPILDGASVAATPSTPLATRHPQSPLSADLPDELPVGTENVHRLFTSGKDTEAVETDLDIAQDADALDLEMLAPYISMDDDFQLNASEQLPRAYHRPLGAVPRPRARSFHGLSPPALEPSLLPRWGSDPRLSCSSPSRGDPSASSPMAGARKRTLAQSSEDEDEGVELLGVRPPKRSPSPEHENFLLFPLSLSFLLTGGPAPGSLQDPSTPLLNLNEPLGLGPSLLSPYSDEDTTQPGGPFQPRAGSAQAD

SEQ ID NO: 39387 - protein, 69 aa, Homo sapiens
  Payload ID: 7893
  Gene Symbol: HIF3A
  Gene Name: hypoxia inducible factor 3, alpha subunit
  ENSP ID: ENSP00000432613
MRPAAGAARRPRCCTSWLTRCPSPAASAPTWTRPLSCASPSATCACTASAPQGSGTRWEQGENHWMPAT

SEQ ID NO: 39388 - protein, 81 aa, Homo sapiens
  Payload ID: 7893
  Gene Symbol: HIF3A
  Gene Name: hypoxia inducible factor 3, alpha subunit
  ENSP ID: ENSP00000432809
MALGLQRARSTTELRKEKSRDAARSRRSQETEVLYQLAHTLPFARGVSAHLDKASIMRLTISYLRMHRLCAAAGAHWTQHL

SEQ ID NO: 39389 - protein, 450 aa, Homo sapiens
  Payload ID: 7893
  Gene Symbol: HIF3A
  Gene Name: hypoxia inducible factor 3, alpha subunit
  ENSP ID: ENSP00000434653
MRPAAGAARRPRCCTSWLTRCPSPAASAPTWTRPLSCASPSATCACTASAPQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPDDLIGCSAYEYIHALDSDAVSKSIHTLLSKGQAVTGQYRFLARSGGYLWTQTQATVVSGGRGPQSESIVCVHFLISQVEETGVVLSLEQTEQHSRRPIQRGAPSQKDTPNPGDSLDTPGPRILAFLHPPSLSEAALAADPRRFCSPDLRRLLGPILDGASVAATPSTPLATRHPQSPLSADLPDELPVGTENVHRLFTSGKDTEAVETDLDIAQDPSTPLLNLNEPLGFHFVTQSGVQWHKHSSPQPRPPGLK

SEQ ID NO: 39390 - protein, 93 aa, Homo sapiens
  Payload ID: 7893
  Gene Symbol: HIF3A
  Gene Name: hypoxia inducible factor 3, alpha subunit
  ENSP ID: ENSP00000434700
  MOD_RES (1)..(1): Any amino acid
XSEPPLQCLVLICEAIPHPGSLEPPLGRGAFLSRHSLDMKFTYCDDRNGDSGFSLLECQSWLCILSQMTSPLCATISSPILWNHNRTCLVQSF

SEQ ID NO: 39391 - protein, 148 aa, Homo sapiens
  Payload ID: 7893
  Gene Symbol: HIF3A
  Gene Name: hypoxia inducible factor 3, alpha subunit
  ENSP ID: ENSP00000435200
MRPAAGAARRPRCCTSWLTRCPSPAASAPTWTRPLSCASPSATCACTASAPQATRMYPHFLGGAWEWNQVGAGGEPLDACYLKALEGFVMVLTAEGDMAYLSENVSKHLGLSQLELIGHSIFDFIHPCDQEELQDALTPQQTLSRRKV

SEQ ID NO: 39392 - protein, 69 aa, Homo sapiens; identical to SEQ ID NO: 39387
  Payload ID: 7893
  Gene Symbol: HIF3A
  Gene Name: hypoxia inducible factor 3, alpha subunit
  ENSP ID: ENSP00000435532

SEQ ID NO: 39393 - protein, 69 aa, Homo sapiens; identical to SEQ ID NO: 39387
  Payload ID: 7893
  Gene Symbol: HIF3A
  Gene Name: hypoxia inducible factor 3, alpha subunit
  ENSP ID: ENSP00000469031

SEQ ID NO: 39394 - protein, 594 aa, Homo sapiens
  Payload ID: 7893
  Gene Symbol: HIF3A
  Gene Name: hypoxia inducible factor 3, alpha subunit
  ENSP ID: ENSP00000471560
MRPAAGAARRPRCCTSWLTRCPSPAASAPTWTRPLSCASPSATCACTASAPQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPDDLIGCSAYEYIHALDSDAVSKSIHTLLSKGQAVTGQYRFLARSGGYLWTQTQATVVSGGRGPQSESIVCVHFLISQVEETGVVLSLEQTEQHSRRPIQRGAPSQKDTPNPGDSLDTPGPRILAFLHPPSLSEAALAADPRRFCSPDLRRLLGPILDGASVAATPSTPLATRHPQSPLSADLPDELPVGTENVHRLFTSGKDTEAVETDLDIAQDADALDLEMLAPYISMDDDFQLNASEQLPRAYHRPLGAVPRPRARSFHGLSPPALEPSLLPRWGSDPRLSCSSPSRGDPSASSPMAGARKRTLAQSSEDEDEGVELLGVRPPKRSPSPEHENFLLFPLSLSFLLTGGPAPGSLQDPSTPLLNLNEPLGFHFVTQSGVQWHKHSSPQPRPPGLK

SEQ ID NO: 39395 - protein, 63 aa, Homo sapiens
  Payload ID: 7894
  Gene Symbol: HILPDA
  Gene Name: hypoxia inducible lipid droplet-associated
  Uniprot ID: Q9Y5L2
  ENSP ID: ENSP00000257696
MKHVLNLYLLGVVLTLLSIFVRVMESLEGLLESPSPGTSWTTRSQLANTEPTKGLPDHPSRSM

SEQ ID NO: 39396 - protein, 63 aa, Homo sapiens; identical to SEQ ID NO: 39395
  Payload ID: 7894
  Gene Symbol: HILPDA
  Gene Name: hypoxia inducible lipid droplet-associated
  Uniprot ID: Q9Y5L2
  ENSP ID: ENSP00000388871

SEQ ID NO: 39397 - protein, 656 aa, Homo sapiens
  Payload ID: 7895
  Gene Symbol: HYOU1
  Gene Name: hypoxia up-regulated 1
  ENSP ID: ENSP00000431874
MADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPEEVLGMVLNYSRSLAEDFAEQPIKDAVITVPVFFNQAERRAVLQAARMAGLKVLQLINDNTATALSYGVFRRKDINTTAQNIMFYDMGSGSTVCTIVTYQMVKTKEAGMQPQLQIRGVGFDRTLGGLEMELRLRERLAGLFNEQRKGQRAKDVRENPRAMAKLLREANRLKTVLSANADHMAQIEGLMDDVDFKAKVTRVEFEELCADLFERVPGPVQQALQSAEMSLDEIEQVILVGGATRVPRVQEVLLKAVGKEELGKNINADEAAAMGAVYQAAALSKAFKVKPFVVRDAVVYPILVEFTREVEEEPGIHSLKHNKRVLFSRMGPYPQRKVITFNRYSHDFNFHINYGDLGFLGPEDLRVFGSQNLTTVKLKGVGDSFKKYPDYESKGIKAHFNLDESGVLSLDRVESVFETLVEDSAEEESTLTKLGNTISSLFGGGTTPDAKENGTDTVQEEEESPAEGSKDEPGEQVELKEEAEAPVEDGSQPPPPEPKGDATPEGEKATEKE

SEQ ID NO: 39398 - protein, 38 aa, Homo sapiens
  Payload ID: 7895
  Gene Symbol: HYOU1
  Gene Name: hypoxia up-regulated 1
  ENSP ID: ENSP00000442727
MADKVRRQRPRRRVCWALVAVLLADLLALSGNLGGKHR

SEQ ID NO: 39399 - protein, 224 aa, Homo sapiens
  Payload ID: 7895
  Gene Symbol: HYOU1
  Gene Name: hypoxia up-regulated 1
  ENSP ID: ENSP00000462951
MADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPEEVLGMVLNYSRSLAEDFAEQPIKDAVITVPVFFNQAERRAVLQAARMAGLKVLQLINDNTATALSYGVFRRKDINTT

SEQ ID NO: 39400 - protein, 211 aa, Homo sapiens
  Payload ID: 7895
  Gene Symbol: HYOU1
  Gene Name: hypoxia up-regulated 1
  ENSP ID: ENSP00000463318
MADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPEEVLGMVLNYSRSLAEDFAEQPIKDAVITVPVFFNQAERRAVLQAARMAGLKVLQLINDNTATAL

SEQ ID NO: 39401 - protein, 154 aa, Homo sapiens
  Payload ID: 7895
  Gene Symbol: HYOU1
  Gene Name: hypoxia up-regulated 1
  ENSP ID: ENSP00000463515
MADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPEEVLGMVL

SEQ ID NO: 39402 - protein, 149 aa, Homo sapiens
  Payload ID: 7895
  Gene Symbol: HYOU1
  Gene Name: hypoxia up-regulated 1
  ENSP ID: ENSP00000463742
MADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPEEV

SEQ ID NO: 39403 - protein, 38 aa, Homo sapiens; identical to SEQ ID NO: 39398
  Payload ID: 7895
  Gene Symbol: HYOU1
  Gene Name: hypoxia up-regulated 1
  ENSP ID: ENSP00000464026

SEQ ID NO: 39404 - protein, 678 aa, Homo sapiens
  Payload ID: 7895
  Gene Symbol: HYOU1
  Gene Name: hypoxia up-regulated 1
  ENSP ID: ENSP00000467866
MADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPEEVLGMVLNYSRSLAEDFAEQPIKDAVITVPVFFNQAERRAVLQAARMAGLKVLQLINDNTATALSYGVFRRKDINTTAQNIMFYDMGSGSTVCTIVTYQMVKTKEAGMQPQLQIRGVGFDRTLGGLEMELRLRERLAGLFNEQRKGQRAKDVRENPRAMAKLLREANRLKTVLSANADHMAQIEGLMDDVDFKAKVTRVEFEELCADLFERVPGPVQQALQSAEMSLDEIEQVILVGGATRVPRVQEVLLKAVGKEELGKNINADEAAAMGAVYQAAALSKAFKVKPFVVRDAVVYPILVEFTREVEEEPGIHSLKHNKRVLFSRMGPYPQRKVITFNRYSHDFNFHINYGDLGFLGPEDLRVFGSQNLTTVKLKGVGDSFKKYPDYESKGIKAHFNLDESGVLSLDRVESVFETLVEDSAEEESTLTKLGNTISSLFGGGTTPDAKENGTDTVQEEEESPAEGSKDEPGEQVELKEEAEAPVEDGSQPPPPEPKGDATPEGEKATEKENGDKSEAQKPVVCRASVTRFGF

SEQ ID NO: 39405 - protein, 102 aa, Homo sapiens
  Payload ID: 7895
  Gene Symbol: HYOU1
  Gene Name: hypoxia up-regulated 1
  ENSP ID: ENSP00000479845
MADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQH

SEQ ID NO: 39406 - protein, 999 aa, Homo sapiens
  Payload ID: 7895
  Gene Symbol: HYOU1
  Gene Name: hypoxia up-regulated 1
  Uniprot ID: Q9Y4L1
  ENSP ID: ENSP00000480150
MADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPEEVLGMVLNYSRSLAEDFAEQPIKDAVITVPVFFNQAERRAVLQAARMAGLKVLQLINDNTATALSYGVFRRKDINTTAQNIMFYDMGSGSTVCTIVTYQMVKTKEAGMQPQLQIRGVGFDRTLGGLEMELRLRERLAGLFNEQRKGQRAKDVRENPRAMAKLLREANRLKTVLSANADHMAQIEGLMDDVDFKAKVTRVEFEELCADLFERVPGPVQQALQSAEMSLDEIEQVILVGGATRVPRVQEVLLKAVGKEELGKNINADEAAAMGAVYQAAALSKAFKVKPFVVRDAVVYPILVEFTREVEEEPGIHSLKHNKRVLFSRMGPYPQRKVITFNRYSHDFNFHINYGDLGFLGPEDLRVFGSQNLTTVKLKGVGDSFKKYPDYESKGIKAHFNLDESGVLSLDRVESVFETLVEDSAEEESTLTKLGNTISSLFGGGTTPDAKENGTDTVQEEEESPAEGSKDEPGEQVELKEEAEAPVEDGSQPPPPEPKGDATPEGEKATEKENGDKSEAQKPSEKAEAGPEGVAPAPEGEKKQKPARKRRMVEEIGVELVVLDLPDLPEDKLAQSVQKLQDLTLRDLEKQEREKAANSLEAFIFETQDKLYQPEYQEVSTEEQREEISGKLSAASTWLEDEGVGATTVMLKEKLAELRKLCQGLFFRVEERKKWPERLSALDNLLNHSSMFLKGARLIPEMDQIFTEVEMTTLEKVINETWAWKNATLAEQAKLPATEKPVLLSKDIEAKMMALDREVQYLLNKAKFTKPRPRPKDKNGTRAEPPLNASASDQGEKVIPPAGQTEDAEPISEPEKVETGSEPGDTEPLELGGPGAEPEQKEQSTGQKRPLKNDEL

SEQ ID NO: 39407 - protein, 677 aa, Homo sapiens
  Payload ID: 7895
  Gene Symbol: HYOU1
  Gene Name: hypoxia up-regulated 1
  ENSP ID: ENSP00000480248
MADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPEEVLGMVLNYSRSLAEDFAEQPIKDAVITVPVFFNQAERRAVLQAARMAGLKVLQLINDNTATALSYGVFRRKDINTTAQNIMFYDMGSGSTVCTIVTYQMVKTKEAGMQPQLQIRGVGFDRTLGGLEMELRLRERLAGLFNEQRKGQRAKDVRENPRAMAKLLREANRLKTVLSANADHMAQIEGLMDDVDFKAKVTRVEFEELCADLFERVPGPVQQALQSAEMSLDEIEQVILVGGATRVPRVQEVLLKAVGKEELGKNINADEAAAMGAVYQAAALSKAFKVKPFVVRDAVVYPILVEFTREVEEEPGIHSLKHNKRVLFSRMGPYPQRKVITFNRYSHDFNFHINYGDLGFLGPEDLRVFGSQNLTTVKLKGVGDSFKKYPDYESKGIKAHFNLDESGVLSLDRVESVFETLVEDSAEEESTLTKLGNTISSLFGGGTTPDAKENGTDTVQEEEESPAEGSKDEPGEQVELKEEAEAPVEDGSQPPPPEPKGDATPEGEKATEKENGDKSEAQASVCRASVTRFGF

SEQ ID NO: 39408 - protein, 147 aa, Homo sapiens
  Payload ID: 7895
  Gene Symbol: HYOU1
  Gene Name: hypoxia up-regulated 1
  ENSP ID: ENSP00000482199
MADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPL

SEQ ID NO: 39409 - protein, 937 aa, Homo sapiens
  Payload ID: 7895
  Gene Symbol: HYOU1
  Gene Name: hypoxia up-regulated 1
  ENSP ID: ENSP00000483106
MADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPEEVLGMVLNYSRSLAEDFAEQPIKDAVITVPVFFNQAERRAVLQAARMAGLKVLQLINDNTATALSYGVFRRKDINTTAQNIMFYDMGSGSTVCTIVTYQMVKTKEAGMQPQLQIRGVGFDRTLGGLEMELRLRERLAGLFNEQRKGQRAKDVRENPRAMAKLLREANRLKTVLSANADHMAQIEGLMDDVDFKAKVTRVEFEELCADLFERVPGPVQQALQSAEMSLDEIEQVILVGGATRVPRVQEVLLKAVGKEELGKNINADEAAAMGAVYQAAALSKAFKVKPFVVRDAVVYPILVEFTREVEEEPGIHSLKHNKRVLFSRMGPYPQRKVITFNRYSHDFNFHINYGDLGFLGPEDLRVFGSQNLTTVKLKGVGDSFKKYPDYESKGIKAHFNLDESGVLSLDRVESVFETLVEDSAEEESTLTKLGNTISSLFGGGTTPDAKENGTDTVQKPSEKAEAGPEGVAPAPEGEKKQKPARKRRMVEEIGVELVVLDLPDLPEDKLAQSVQKLQDLTLRDLEKQEREKAANSLEAFIFETQDKLYQPEYQEVSTEEQREEISGKLSAASTWLEDEGVGATTVMLKEKLAELRKLCQGLFFRVEERKKWPERLSALDNLLNHSSMFLKGARLIPEMDQIFTEVEMTTLEKVINETWAWKNATLAEQAKLPATEKPVLLSKDIEAKMMALDREVQYLLNKAKFTKPRPRPKDKNGTRAEPPLNASASDQGEKVIPPAGQTEDAEPISEPEKVETGSEPGDTEPLELGGPGAEPEQKEQSTGQKRPLKNDEL

SEQ ID NO: 39410 - protein, 937 aa, Homo sapiens; identical to SEQ ID NO: 39409
  Payload ID: 7895
  Gene Symbol: HYOU1
  Gene Name: hypoxia up-regulated 1
  ENSP ID: ENSP00000484186

SEQ ID NO: 39411 - protein, 92 aa, Homo sapiens
  Payload ID: 7895
  Gene Symbol: HYOU1
  Gene Name: hypoxia up-regulated 1
  ENSP ID: ENSP00000484622
MADKVRRQRPRRRVCWALVAVLLADLLALSDTLAVMSVDLGSESMKVAIVKPGVPMEIVLNKESRRKTPVIVTLKENERFFGDSAASMAIKN

SEQ ID NO: 39412 - protein, 937 aa, Homo sapiens; identical to SEQ ID NO: 39409
  Payload ID: 7895
  Gene Symbol: HYOU1
  Gene Name: Hypoxia up-regulated 1
  ENSP ID: ENSP00000485827

SEQ ID NO: 39413 - protein, 38 aa, Homo sapiens; identical to SEQ ID NO: 39398
  Payload ID: 7895
  Gene Symbol: HYOU1
  Gene Name: Hypoxia up-regulated 1
  ENSP ID: ENSP00000485927

SEQ ID NO: 39414 - protein, 224 aa, Homo sapiens; identical to SEQ ID NO: 39399
  Payload ID: 7895
  Gene Symbol: HYOU1
  Gene Name: Hypoxia up-regulated 1
  ENSP ID: ENSP00000486231

SEQ ID NO: 39415 - protein, 211 aa, Homo sapiens; identical to SEQ ID NO: 39400
  Payload ID: 7895
  Gene Symbol: HYOU1
  Gene Name: Hypoxia up-regulated 1
  ENSP ID: ENSP00000486257

SEQ ID NO: 39416 - protein, 38 aa, Homo sapiens; identical to SEQ ID NO: 39398
  Payload ID: 7895
  Gene Symbol: HYOU1
  Gene Name: Hypoxia up-regulated 1
  ENSP ID: ENSP00000486396

SEQ ID NO: 39417 - protein, 147 aa, Homo sapiens; identical to SEQ ID NO: 39408
  Payload ID: 7895
  Gene Symbol: HYOU1
  Gene Name: Hypoxia up-regulated 1
  ENSP ID: ENSP00000486458

SEQ ID NO: 39418 - protein, 92 aa, Homo sapiens; identical to SEQ ID NO: 39411
  Payload ID: 7895
  Gene Symbol: HYOU1
  Gene Name: Hypoxia up-regulated 1
  ENSP ID: ENSP00000486491

SEQ ID NO: 39419 - protein, 102 aa, Homo sapiens; identical to SEQ ID NO: 39405
  Payload ID: 7895
  Gene Symbol: HYOU1
  Gene Name: Hypoxia up-regulated 1
  ENSP ID: ENSP00000486534

SEQ ID NO: 39420 - protein, 677 aa, Homo sapiens; identical to SEQ ID NO: 39407
  Payload ID: 7895
  Gene Symbol: HYOU1
  Gene Name: Hypoxia up-regulated 1
  ENSP ID: ENSP00000486718

SEQ ID NO: 39421 - protein, 154 aa, Homo sapiens; identical to SEQ ID NO: 39401
  Payload ID: 7895
  Gene Symbol: HYOU1
  Gene Name: Hypoxia up-regulated 1
  ENSP ID: ENSP00000486747

SEQ ID NO: 39422 - protein, 999 aa, Homo sapiens; identical to SEQ ID NO: 39406
  Payload ID: 7895
  Gene Symbol: HYOU1
  Gene Name: Hypoxia up-regulated 1
  ENSP ID: ENSP00000486825

SEQ ID NO: 39423 - protein, 937 aa, Homo sapiens; identical to SEQ ID NO: 39409
  Payload ID: 7895
  Gene Symbol: HYOU1
  Gene Name: Hypoxia up-regulated 1
  ENSP ID: ENSP00000486966

SEQ ID NO: 39424 - protein, 678 aa, Homo sapiens; identical to SEQ ID NO: 39404
  Payload ID: 7895
  Gene Symbol: HYOU1
  Gene Name: Hypoxia up-regulated 1
  ENSP ID: ENSP00000487018

SEQ ID NO: 39425 - protein, 149 aa, Homo sapiens; identical to SEQ ID NO: 39402
  Payload ID: 7895
  Gene Symbol: HYOU1
  Gene Name: Hypoxia up-regulated 1
  ENSP ID: ENSP00000487063

SEQ ID NO: 39426 - protein, 656 aa, Homo sapiens; identical to SEQ ID NO: 39397
  Payload ID: 7895
  Gene Symbol: HYOU1
  Gene Name: Hypoxia up-regulated 1
  ENSP ID: ENSP00000487387

SEQ ID NO: 39427 - protein, 356 aa, Homo sapiens
  Payload ID: 7896
  Gene Symbol: IBA57
  Gene Name: IBA57 homolog, iron-sulfur cluster assembly
  Uniprot ID: Q5T440
  ENSP ID: ENSP00000355672
MATAALLRGATPGRGGPVWRWRLRAAPRCRLAHSSCSPGGDPTAGAAWACFRLDGRTLLRVRGPDAAPFLLGLLTNELPLPSPAAAGAPPAARAGYAHFLNVQGRTLYDVILYGLQEHSEVSGFLLECDSSVQGALQKHLALYRIRRKVTVEPHPELRVWAVLPSSPEACGAASLQERAGAAAILIRDPRTARMGWRLLTQDEGPALVPGGRLGDLWDYHQHRYLQGVPEGVRDLPPGVALPLESNLAFMNGVSFTKGCYIGQELTARTHHMGVIRKRLFPVRFLDPLPTSGITPGATVLTASGQTVGKFRAGQGNVGLALLWSEKIKGPLHIRASEGAQVALAASVPDWWPTVSK

SEQ ID NO: 39428 - protein, 90 aa, Homo sapiens
  Payload ID: 7897
  Gene Symbol: IDNK
  Gene Name: idnK, gluconokinase homolog (E. coli)
  ENSP ID: ENSP00000365599
MAAPGALLVMGVSGSGKSTVGALLASELGWKFYDADDYHPEENRRKMGKGIPLNDQRCSLGTACGSSLFSPEENVQRHINTRKRWCSSEV

SEQ ID NO: 39429 - protein, 187 aa, Homo sapiens
  Payload ID: 7897
  Gene Symbol: IDNK
  Gene Name: idnK, gluconokinase homolog (E. coli)
  Uniprot ID: Q5T6J7
  ENSP ID: ENSP00000365601
MAAPGALLVMGVSGSGKSTVGALLASELGWKFYDADDYHPEENRRKMGKGIPLNDQDRIPWLCNLHDILLRDVASGQRVVLACSALKKTYRDILTQGKDGVALKCEESGKEAKQAEMQLLVVHLSGSFEVISGRLLKREGHFMPPELLQSQFETLEPPAAPENFIQISVDKNVSEIIATIMETLKMK

SEQ ID NO: 39430 - protein, 59 aa, Homo sapiens
  Payload ID: 7897
  Gene Symbol: IDNK
  Gene Name: idnK, gluconokinase homolog (E. coli)
  ENSP ID: ENSP00000385324
MAAPGALLVMGVSGSGNWDGNSMMLMIITRRKIEGRWEKAYRSMTRTGFHGSVTCMTFY

SEQ ID NO: 39431 - protein, 141 aa, Homo sapiens
  Payload ID: 7897
  Gene Symbol: IDNK
  Gene Name: idnK, gluconokinase homolog (E. coli)
  Uniprot ID: Q5T6J7
  ENSP ID: ENSP00000403290
MGKGIPLNDQDRIPWLCNLHDILLRDVASGQRVVLACSALKKTYRDILTQGKDGVALKCEESGKEAKQAEMQLLVVHLSGSFEVISGRLLKREGHFMPPELLQSQFETLEPPAAPENFIQISVDKNVSEIIATIMETLKMK

SEQ ID NO: 39432 - protein, 106 aa, Homo sapiens
  Payload ID: 7897
  Gene Symbol: IDNK
  Gene Name: idnK, gluconokinase homolog (E. coli)
  ENSP ID: ENSP00000434673
MAAPGALLVMGTLTLSPRLEYSGVISAHCNLCLLSSSDCHASASGVTGVTGVHHHTQLSFVFLVETGFCHVGRASPELLASSDPPASASQSAGIIGVSQGLNLTWS

SEQ ID NO: 39433 - protein, 90 aa, Homo sapiens
  Payload ID: 7897
  Gene Symbol: IDNK
  Gene Name: idnK, gluconokinase homolog (E. coli)
  ENSP ID: ENSP00000436381
MGKGIPLNDQDRIPWLCNLHDILLRDVASGQRVVLACSALKKTYRDILTQGKDGVALKCEESGKEAKQAEMQLLVVHLSGSFEVISGRLL

SEQ ID NO: 39434 - protein, 550 aa, Homo sapiens
  Payload ID: 7898
  Gene Symbol: IDS
  Gene Name: iduronate 2-sulfatase
  Uniprot ID: P22304
  ENSP ID: ENSP00000339801
MPPPRTGRGLLWLGLVLSSVCVALGSETQANSTTDALNVLLIIVDDLRPSLGCYGDKLVRSPNIDQLASHSLLFQNAFAQQAVCAPSRVSFLTGRRPDTTRLYDFNSYWRVHAGNFSTIPQYFKENGYVTMSVGKVFHPGISSNHTDDSPYSWSFPPYHPSSEKYENTKTCRGPDGELHANLLCPVDVLDVPEGTLPDKQSTEQAIQLLEKMKTSASPFFLAVGYHKPHIPFRYPKEFQKLYPLENITLAPDPEVPDGLPPVAYNPWMDIRQREDVQALNISVPYGPIPVDFQRKIRQSYFASVSYLDTQVGRLLSALDDLQLANSTIIAFTSDHGWALGEHGEWAKYSNFDVATHVPLIFYVPGRTASLPEAGEKLFPYLDPFDSASQLMEPGRQSMDLVELVSLFPTLAGLAGLQVPPRCPVPSFHVELCREGKNLLKHFRFRDLEEDPYLPGNPRELIAYSQYPRPSDIPQWNSDKPSLKDIKIMGYSIRTIDYRYTVWVGFNPDEFLANFSDIHAGELYFVDSDPLQDHNMYNDSQGGDLFQLLMP

SEQ ID NO: 39435 - protein, 343 aa, Homo sapiens
  Payload ID: 7898
  Gene Symbol: IDS
  Gene Name: iduronate 2-sulfatase
  Uniprot ID: P22304
  ENSP ID: ENSP00000359470
MPPPRTGRGLLWLGLVLSSVCVALGSETQANSTTDALNVLLIIVDDLRPSLGCYGDKLVRSPNIDQLASHSLLFQNAFAQQAVCAPSRVSFLTGRRPDTTRLYDFNSYWRVHAGNFSTIPQYFKENGYVTMSVGKVFHPGISSNHTDDSPYSWSFPPYHPSSEKYENTKTCRGPDGELHANLLCPVDVLDVPEGTLPDKQSTEQAIQLLEKMKTSASPFFLAVGYHKPHIPFRYPKEFQKLYPLENITLAPDPEVPDGLPPVAYNPWMDIRQREDVQALNISVPYGPIPVDFQRKIRQSYFASVSYLDTQVGRLLSALDDLQLANSTIIAFTSDHGFLMRTNT

SEQ ID NO: 39436 - protein, 179 aa, Homo sapiens
  Payload ID: 7898
  Gene Symbol: IDS
  Gene Name: iduronate 2-sulfatase
  ENSP ID: ENSP00000390241
MPPPRTGRGLLWLGLVLSSVCVALGSETQANSTTDALNVLLIIVDDLRPSLGCYGDKLVRSPNIDQLASHSLLFQNAFAQQAVCAPSRVSFLTGRRPDTTRLYDFNSYWRVHAGNFSTIPQYFKENGYVTMSVGKVFHPGTAPCPESGFSWFVVSESSIPILGMGLSLQSPLLAGRVPR

SEQ ID NO: 39437 - protein, 312 aa, Homo sapiens
  Payload ID: 7898
  Gene Symbol: IDS
  Gene Name: iduronate 2-sulfatase
  Uniprot ID: P22304
  ENSP ID: ENSP00000418264
MPPPRTGRGLLWLGLVLSSVCVALGSETQANSTTDALNVLLIIVDDLRPSLGCYGDKLVRSPNIDQLASHSLLFQNAFAQQAVCAPSRVSFLTGRRPDTTRLYDFNSYWRVHAGNFSTIPQYFKENGYVTMSVGKVFHPGISSNHTDDSPYSWSFPPYHPSSEKYENTKTCRGPDGELHANLLCPVDVLDVPEGTLPDKQSTEQAIQLLEKMKTSASPFFLAVGYHKPHIPFRYPKEFQKLYPLENITLAPDPEVPDGLPPVAYNPWMDIRQREDVQALNISVPYGPIPVDFQEDQSSTGFRLKTSSTRKYK

SEQ ID NO: 39438 - protein, 106 aa, Homo sapiens
  Payload ID: 7898
  Gene Symbol: IDS
  Gene Name: iduronate 2-sulfatase
  ENSP ID: ENSP00000428980
RSPNIDQLASHSLLFQNAFAQQAVCAPSRVSFLTGRRPDTTRLYDFNSYWRVHAGNFSTIPQYFKENGYVTMSVGKVFHPALVGTHFSAESLFSRPFSVSIGPASR

SEQ ID NO: 39439 - protein, 86 aa, Homo sapiens
  Payload ID: 7898
  Gene Symbol: IDS
  Gene Name: iduronate 2-sulfatase
  ENSP ID: ENSP00000429745
MPPPRTGRGLLWLGLVLSSVCVALGSETQANSTTDALNVLLIIVDDLRPSLGCYGDKLVRSPNIDQLASHSLLFQNAFAQQAVCAP

SEQ ID NO: 39440 - protein, 653 aa, Homo sapiens
  Payload ID: 7899
  Gene Symbol: IDUA
  Gene Name: iduronidase, alpha-L-
  Uniprot ID: P35475
  ENSP ID: ENSP00000247933
MRPLRPRAALLALLASLLAAPPVAPAEAPHLVHVDAARALWPLRRFWRSTGFCPPLPHSQADQYVLSWDQQLNLAYVGAVPHRGIKQVRTHWLLELVTTRGSTGRGLSYNFTHLDGYLDLLRENQLLPGFELMGSASGHFTDFEDKQQVFEWKDLVSSLARRYIGRYGLAHVSKWNFETWNEPDHHDFDNVSMTMQGFLNYYDACSEGLRAASPALRLGGPGDSFHTPPRSPLSWGLLRHCHDGTNFFTGEAGVRLDYISLHRKGARSSISILEQEKVVAQQIRQLFPKFADTPIYNDEADPLVGWSLPQPWRADVTYAAMVVKVIAQHQNLLLANTTSAFPYALLSNDNAFLSYHPHPFAQRTLTARFQVNNTRPPHVQLLRKPVLTAMGLLALLDEEQLWAEVSQAGTVLDSNHTVGVLASAHRPQGPADAWRAAVLIYASDDTRAHPNRSVAVTLRLRGVPPGPGLVYVTRYLDNGLCSPDGEWRRLGRPVFPTAEQFRRMRAAEDPVAAAPRPLPAGGRLTLRPALRLPSLLLVHVCARPEKPPGQVTRLRALPLTQGQLVLVWSDEHVGSKCLWTYEIQFSQDGKAYTPVSRKPSTFNLFVFSPDTGAVSGSYRVRALDYWARPGPFSDPVPYLEVPVPRGPPSPGNP

SEQ ID NO: 39441 - protein, 224 aa, Homo sapiens
  Payload ID: 7899
  Gene Symbol: IDUA
  Gene Name: iduronidase, alpha-L-
  ENSP ID: ENSP00000422952
MRPLRPRAALLALLASLLAAPPVAPAEAPHLVHVDAARALWPLRRFWRSTGFWGSTGRGLSYNFTHLDGYLDLLRENQLLPGFELMGSASGHFTDFEDKQQVFEWKDLVSSLARRYIGRYGLAHVSKWNFETWNEPDHHDFDNVSMTMQGFLNYYDACSEGLRAASPALRLGGPGDSFHTPPRSPLSWGLLRHCHDGTNFFTGEAGVRLDYISLHRKGARSSIS

SEQ ID NO: 39442 - protein, 232 aa, Homo sapiens
  Payload ID: 7899
  Gene Symbol: IDUA
  Gene Name: iduronidase, alpha-L-
  ENSP ID: ENSP00000423685
LAHPGPGIGAGPSPGSAGPSPLPGMDGRWALLDPESIVRGSTGRGLSYNFTHLDGYLDLLRENQLLPGFELMGSASGHFTDFEDKQQVFEWKDLVSSLARRYIGRYGLAHVSKWNFETWNEPDHHDFDNVSMTMQGFLNYYDACSEGLRAASPALRLGGPGDSFHTPPRSPLSWGLLRHCHDGTNFFTGEAGVRLDYISLHRKGARSSISILEQEKVVAQQIRQLFPKFADT

SEQ ID NO: 39443 - protein, 176 aa, Homo sapiens
  Payload ID: 7899
  Gene Symbol: IDUA
  Gene Name: iduronidase, alpha-L-
  ENSP ID: ENSP00000424227
MCLPSECHSHWTQVQASLSPAAPCPPPWLPRGSTGRGLSYNFTHLDGYLDLLRENQLLPGFELMGSASGHFTDFEDKQQVFEWKDLVSSLARRYIGRYGLAHVSKWNFETWNEPDHHDFDNVSMTMQGFLNYYDACSEGLRAASPALRLGGPGDSFHTPPRSPLSWGLLRHCHDGT

SEQ ID NO: 39444 - protein, 195 aa, Homo sapiens
  Payload ID: 7899
  Gene Symbol: IDUA
  Gene Name: iduronidase, alpha-L-
  ENSP ID: ENSP00000424847
  MOD_RES (1)..(1): Any amino acid
XVPCAPAPRCWRSWPRSWPRPRWPRPRPRTWCMWTRPARCGPCGASGGAQASAPRCHTARLTSTSSAGTSSSTSPMWAPSLTAASSRGSTGRGLSYNFTHLDGYLDLLRENQLLPGFELMGSASGHFTDFEDKQQVFEWKDLVSSLARRYIGRYGLAHVSKWNFETWNEPDHHDFDNVSMTMQGFLNYYDACSEG

SEQ ID NO: 39445 - protein, 521 aa, Homo sapiens
  Payload ID: 7899
  Gene Symbol: IDUA
  Gene Name: iduronidase, alpha-L-
  ENSP ID: ENSP00000425081
MGSASGHFTDFEDKQQVFEWKDLVSSLARRYIGRYGLAHVSKWNFETWNEPDHHDFDNVSMTMQGFLNYYDACSEGLRAASPALRLGGPGDSFHTPPRSPLSWGLLRHCHDGTNFFTGEAGVRLDYISLHRKGARSSISILEQEKVVAQQIRQLFPKFADTPIYNDEADPLVGWSLPQPWRADVTYAAMVVKVIAQHQNLLLANTTSAFPYALLSNDNAFLSYHPHPFAQRTLTARFQVNNTRPPHVQLLRKPVLTAMGLLALLDEEQLWAEVSQAGTVLDSNHTVGVLASAHRPQGPADAWRAAVLIYASDDTRAHPNRSVAVTLRLRGVPPGPGLVYVTRYLDNGLCSPDGEWRRLGRPVFPTAEQFRRMRAAEDPVAAAPRPLPAGGRLTLRPALRLPSLLLVHVCARPEKPPGQVTRLRALPLTQGQLVLVWSDEHVGSKCLWTYEIQFSQDGKAYTPVSRKPSTFNLFVFSPDTGAVSGSYRVRALDYWARPGPFSDPVPYLEVPVPRGPPSPGNP

SEQ ID NO: 39446 - protein, 53 aa, Homo sapiens
  Payload ID: 7900
  Gene Symbol: IGIP
  Gene Name: IgA-inducing protein
  Uniprot ID: A6NJ69
  ENSP ID: ENSP00000327344
MCSYYHMKKRSVSGCNITIFAVMFSHLSAGKSPCGNQANVLCISRLEFVQYQS

SEQ ID NO: 39447 - protein, 110 aa, Homo sapiens
  Payload ID: 7901
  Gene Symbol: IGFL1
  Gene Name: IGF-like family member 1
  Uniprot ID: Q6UW32
  ENSP ID: ENSP00000415823
MAPRGCIVAVFAIFCISRLLCSHGAPVAPMTPYLMLCQPHKRCGDKFYDPLQHCCYDDAVVPLARTQTCGNCTFRVCFEQCCPWTFMVKLINQNCDSARTSDDRLCRSVS

SEQ ID NO: 39448 - protein, 119 aa, Homo sapiens
  Payload ID: 7902
  Gene Symbol: IGFL2
  Gene Name: IGF-like family member 2
  Uniprot ID: Q6UWQ7
  ENSP ID: ENSP00000366922
MVPRIFAPAYVSVCLLLLCPREVIAPAGSEPWLCQPAPRCGDKIYNPLEQCCYNDAIVSLSETRQCGPPCTFWPCFELCCLDSFGLTNDFVVKLKVQGVNSQCHSSPISSKCESRRRFP

SEQ ID NO: 39449 - protein, 130 aa, Homo sapiens
  Payload ID: 7902
  Gene Symbol: IGFL2
  Gene Name: IGF-like family member 2
  Uniprot ID: Q6UWQ7
  ENSP ID: ENSP00000395219
MRFSVSGMRTDYPRSVLAPAYVSVCLLLLCPREVIAPAGSEPWLCQPAPRCGDKIYNPLEQCCYNDAIVSLSETRQCGPPCTFWPCFELCCLDSFGLTNDFVVKLKVQGVNSQCHSSPISSKCESRRRFP

SEQ ID NO: 39450 - protein, 84 aa, Homo sapiens
  Payload ID: 7902
  Gene Symbol: IGFL2
  Gene Name: IGF-like family member 2
  ENSP ID: ENSP00000471085
QPAPRCGDKIYNPLEQCCYNDAIVSLSETRQCGPPCTFWPCFELCCLDSFGLTNDFVVKLKVQGVNSQCHSSPISSKCERRRFP

SEQ ID NO: 39451 - protein, 125 aa, Homo sapiens
  Payload ID: 7903
  Gene Symbol: IGFL3
  Gene Name: IGF-like family member 3
  Uniprot ID: Q6UXB1
  ENSP ID: ENSP00000344860
MRPRCCILALVCWITVFLLQCSKGTTDAPVGSGLWLCQPTPRCGNKIYNPSEQCCYDDAILSLKETRRCGSTCTFWPCFELCCPESFGPQQKFLVKLRVLGMKSQCHLSPISRSCTRNRRHVLYP

SEQ ID NO: 39452 - protein, 124 aa, Homo sapiens
  Payload ID: 7904
  Gene Symbol: IGFL4
  Gene Name: IGF-like family member 4
  Uniprot ID: Q6B9Z1
  ENSP ID: ENSP00000366926
MVPRISAAIFIFELLGSNSEGVTDLRLWLCQPAPRCGEWTYNPLEQCCDDGVILDLNQTRLCGSSCTFWPCFQHCCLESLGSQNQTVVRFKVPGMKPDCKSSPITRICAQEYHPKSPVSRSDLI

SEQ ID NO: 39453 - protein, 30 aa, Homo sapiens
  Payload ID: 7904
  Gene Symbol: IGFL4
  Gene Name: IGF-like family member 4
  ENSP ID: ENSP00000470169
MKPDCKSSPITRICAQEYHPKSPVSRSDLI

SEQ ID NO: 39454 - protein, 355 aa, Homo sapiens
  Payload ID: 7905
  Gene Symbol: IGFLR1
  Gene Name: IGF-like family receptor 1
  Uniprot ID: Q9H665
  ENSP ID: ENSP00000246532
MGPGRCLLTALLLLALAPPPEASQYCGRLEYWNPDNKCCSSCLQRFGPPPCPDYEFRENCGLNDHGDFVTPPFRKCSSGQCNPDGAELCSPCGGGAVTPTPAAGGGRTPWRCRERPVPAKGHCPLTPGNPGAPSSQERSSPASSIAWRTPEPVPQQAWPNFLPLVVLVLLLTLAVIAILLFILLWHLCWPKEKADPYPYPGLVCGVPNTHTPSSSHLSSPGALETGDTWKEASLLPLLSRELSSLASQPLSRLLDELEVLEELIVLLDPEPGPGGGMAHGTTRHLAARYGLPAAWSTFAYSLRPSRSPLRALIEMVVAREPSASLGQLGTHLAQLGRADALRVLSKLGSSGVCWA

SEQ ID NO: 39455 - protein, 187 aa, Homo sapiens
  Payload ID: 7905
  Gene Symbol: IGFLR1
  Gene Name: IGF-like family receptor 1
  ENSP ID: ENSP00000465962
MGPGRCLLTALLLLALAPPPEASQYCGRLEYWNPDNKCCSSCLQRFGPPPCPGALETGDTWKEASLLPLLSRELSSLASQPLSRLLDELEVLEELIVLLDPEPGPGGGMAHGTTRHLAARYGLPAAWSTFAYSLRPSRSPLRALIEMVVAREPSASLGQLGTHLAQLGRADALRVLSKLGSSGVCWA

SEQ ID NO: 39456 - protein, 355 aa, Homo sapiens; identical to SEQ ID NO: 39454
  Payload ID: 7905
  Gene Symbol: IGFLR1
  Gene Name: IGF-like family receptor 1
  Uniprot ID: Q9H665
  ENSP ID: ENSP00000466181

SEQ ID NO: 39457 - protein, 167 aa, Homo sapiens
  Payload ID: 7905
  Gene Symbol: IGFLR1
  Gene Name: IGF-like family receptor 1
  Uniprot ID: Q9H665
  ENSP ID: ENSP00000467750
MGPGRCLLTALLLLALAPPPEASQYCGRLEYWNPDNKCCSSCLQRFGPPPCPELSSLASQPLSRLLDELEVLEELIVLLDPEPGPGGGMAHGTTRHLAARYGLPAAWSTFAYSLRPSRSPLRALIEMVVAREPSASLGQLGTHLAQLGRADALRVLSKLGSSGVCWA

SEQ ID NO: 39458 - protein, 16 aa, Homo sapiens
  Payload ID: 7905
  Gene Symbol: IGFLR1
  Gene Name: IGF-like family receptor 1
  ENSP ID: ENSP00000467842
MGPGRCLLTALLLLAL

SEQ ID NO: 39459 - protein, 132 aa, Homo sapiens
  Payload ID: 7905
  Gene Symbol: IGFLR1
  Gene Name: IGF-like family receptor 1
  ENSP ID: ENSP00000468545
MGPGRCLLTALLLLALAPPPEASQYCGRLEYWNPDNKCCSSCLQRFGPPPCPDYEFRENCGLNDHGDFVTPPFRKCSSGQCNPDGAELCSPCGGGAVTPTPAAGGGRTPWRCREAGPCQGALPPHTWKPRRP

SEQ ID NO: 39460 - protein, 138 aa, Homo sapiens
  Payload ID: 7905
  Gene Symbol: IGFLR1
  Gene Name: IGF-like family receptor 1
  ENSP ID: ENSP00000468644
MGPGRCLLTALLLLALAPPPEASQYCGRLEYWNPDNKCCSSCLQRFGPPPCPDYEFRENCGLNDHGDFVTPPFRKCSSGQCNPDGAELCSPCGGGAVTPTPAAGGGRTPWRCRERPVPAKGHCPLTPGNPGAPSSQER

SEQ ID NO: 39461 - protein, 60 aa, Homo sapiens
  Payload ID: 7905
  Gene Symbol: IGFLR1
  Gene Name: IGF-like family receptor 1
  ENSP ID: ENSP00000474913
  MOD_RES (1)..(1): Any amino acid
XGRLEYWNPDNKCCSSCLQRFGPPPCPGENPRPSLAWAELAEAGPCQGALPPHTWKPRRP

SEQ ID NO: 39462 - protein, 74 aa, Homo sapiens
  Payload ID: 7905
  Gene Symbol: IGFLR1
  Gene Name: IGF-like family receptor 1
  ENSP ID: ENSP00000476009
  MOD_RES (1)..(1): Any amino acid
XNCGLNDHGDFVTPPFRKCSSGQCNPDGAELCSPCGGGAVTPTPAAGGGRTPWRCREAPWRQGTHGRRPHYFHS

SEQ ID NO: 39463 - protein, 119 aa, Homo sapiens
  Payload ID: 7906
  Gene Symbol:
  Gene Name: IGHV2-70
  ENSP ID: ENSP00000375043
MDILCSTLLLLTVPSWVLSQVTLKESGPALVKPTQTLTLTCTFSGFSLSTSGMRVSWIRQPPGKALEWLARIDWDDDKFYSTSLKTRLTISKDTSKNQVVLTMTNMDPVDTATYYCARI

SEQ ID NO: 39464 - protein, 119 aa, Homo sapiens; identical to SEQ ID NO: 39463
  Payload ID: 7906
  Gene Symbol:
  Gene Name: IGHV2-70
  ENSP ID: ENSP00000488441

SEQ ID NO: 39465 - protein, 336 aa, Homo sapiens
  Payload ID: 7907
  Gene Symbol: IGLON5
  Gene Name: IgLON family member 5
  Uniprot ID: A6NGN9
  ENSP ID: ENSP00000270642
MPPPAPGARLRLLAAAALAGLAVISRGLLSQSLEFNSPADNYTVCEGDNATLSCFIDEHVTRVAWLNRSNILYAGNDRWTSDPRVRLLINTPEEFSILITEVGLGDEGLYTCSFQTRHQPYTTQVYLIVHVPARIVNISSPVTVNEGGNVNLLCLAVGRPEPTVTWRQLRDGFTSEGEILEISDIQRGQAGEYECVTHNGVNSAPDSRRVLVTVNYPPTITDVTSARTALGRAALLRCEAMAVPPADFQWYKDDRLLSSGTAEGLKVQTERTRSMLLFANVSARHYGNYTCRAANRLGASSASMRLLRPGSLENSAPRPPGLLALLSALGWLWWRM

SEQ ID NO: 39466 - protein, 557 aa, Homo sapiens
  Payload ID: 7908
  Gene Symbol: IK
  Gene Name: IK cytokine, down-regulator of HLA II
  Uniprot ID: Q13123
  ENSP ID: ENSP00000396301
MPERDSEPFSNPLAPDGHDVDDPHSFHQSKLTNEDFRKLLMTPRAAPTSAPPSKSRHHEMPREYNEDEDPAARRRKKKSYYAKLRQQEIERERELAEKYRDRAKERRDGVNKDYEETELISTTANYRAVGPTAEADKSAAEKRRQLIQESKFLGGDMEHTHLVKGLDFALLQKVRAEIASKEKEEEELMEKPQKETKKDEDPENKIEFKTRLGRNVYRMLFKSKAYERNELFLPGRMAYVVDLDDEYADTDIPTTLIRSKADCPTMEAQTTLTTNDIVISKLTQILSYLRQGTRNKKLKKKDKGKLEEKKPPEADMNIFEDIGDYVPSTTKTPRDKERERYRERERDRERDRDRDRERERERDRERERERDREREEEKKRHSYFEKPKVDDEPMDVDKGPGSTKELIKSINEKFAGSAGWEGTESLKKPEDKKQLGDFFGMSNSYAECYPATMDDMAVDSDEEVDYSKMDQGNKKGPLGRWDFDTQEEYSEYMNNKEALPKAAFQYGIKMSEGRKTRRFKETNDKAELDRQWKKISAIIEKRKKMEADGVEVKRPKY

SEQ ID NO: 39467 - protein, 73 aa, Homo sapiens
  Payload ID: 7908
  Gene Symbol: IK
  Gene Name: IK cytokine, down-regulator of HLA II
  ENSP ID: ENSP00000421930
MPERDSEPFSNPLAPDGHDVDDPHSFHQLECSGAISAHHNLRLPGSSNSPASAFRVAGITDQNSPMKTSGNFS

SEQ ID NO: 39468 - protein, 267 aa, Homo sapiens
  Payload ID: 7908
  Gene Symbol: IK
  Gene Name: IK cytokine, down-regulator of HLA II
  ENSP ID: ENSP00000422641
MPERDSEPFSNPLAPDGHDVDDPHSFHQSKLTNEDFRKLLMTPRAAPTSAPPSKSRHHEMPREYNEDEDPAARRRKKKSYYAKLRQQEIERERELAEKYRDRAKERRDGVNKDYEETELISTTANYRAVGPTAEADKSAAEKRRQLIQESKFLGGDMEHTHLVKGLDFALLQKVRAEIASKEKEEEELMEKPQKETKKDEDPENKIEFKTRLGRNVYRMLFKSKAYERNELFLPGRMAYVVDLDDEYADTDIPTTLIRSKADCPTME

SEQ ID NO: 39469 - protein, 140 aa, Homo sapiens
  Payload ID: 7908
  Gene Symbol: IK
  Gene Name: IK cytokine, down-regulator of HLA II
  ENSP ID: ENSP00000424622
MPERDSEPFSNPLAPDGHDVDDPHSFHQSKLTNEDFRKLLMTPRAAPTSAPPSKSRHHDEFLVSSRMPREYNEDEDPAARRRKKKSYYAKLRQQEIERERELAEKYRDRAKERRDGVNKDYEETELISTTANYRAVGPTA

SEQ ID NO: 39470 - protein, 107 aa, Homo sapiens
  Payload ID: 7908
  Gene Symbol: IK
  Gene Name: IK cytokine, down-regulator of HLA II
  ENSP ID: ENSP00000425564
MGEPFSNPLAPDGHDVDDPHSFHQSKLTNEDFRKLLMTPRAAPTSAPPSKSRHHEMPREYNEDEDPAARRRKKKSYYAKLRQQEIERERELAEKYRDRAKERRDGVN

SEQ ID NO: 39471 - protein, 212 aa, Homo sapiens
  Payload ID: 7908
  Gene Symbol: IK
  Gene Name: IK cytokine, down-regulator of HLA II
  ENSP ID: ENSP00000426764
MMGGFCEPFSNPLAPDGHDVDDPHSFHQSKLTNEDFRKLLMTPRAAPTSAPPSKSRHHEMPREYNEDEDPAARRRKKKSYYAKLRQQEIERERELAEKYRDRAKERRDGVNKDYEETELISTTANYRAVGPTAEADKSAAEKRRQLIQESKFLGGDMEHTHLVKGLDFALLQKVRAEIASKEKEEEELMEKPQKETKKDEDPENKIEFKTRL

SEQ ID NO: 39472 - protein, 240 aa, Homo sapiens [sequence omitted]

SEQ ID NO: 39473 - protein, 162 aa, Homo sapiens
  Payload ID: 7908
  Gene Symbol: IK
  Gene Name: IK cytokine, down-regulator of HLA II
  ENSP ID: ENSP00000481369
MNIFEDIGDYVPSTTKTPRDKERERYRERERDRERDRDRDRERERERDRERERERDREREEEKKRHSYFEKPKVDDEPMDVDKGPGSTKELIKSINEKFAGSAGWEGTESLKKPEDKKQLGDFFGMSNSYAECYPATMDDMAVDSDEEVDYSKMDQGNKKGP

SEQ ID NO: 39474 - protein, 519 aa, Homo sapiens
  Payload ID: 7909
  Gene Symbol: IKZF1
  Gene Name: IKAROS family zinc finger 1 (Ikaros)
  Uniprot ID: Q13422
  ENSP ID: ENSP00000331614
MDADEGQDMSQVSGKESPPVSDTPDEGDEPMPIPEDLSTTSGGQQSSKSDRVVASNVKVETQSDEENGRACEMNGEECAEDLRMLDASGEKMNGSHRDQGSSALSGVGGIRLPNGKLKCDICGIICIGPNVLMVHKRSHTGERPFQCNQCGASFTQKGNLLRHIKLHSGEKPFKCHLCNYACRRRDALTGHLRTHSVGKPHKCGYCGRSYKQRSSLEEHKERCHNYLESMGLPGTLYPVIKEETNHSEMAEDLCKIGSERSLVLDRLASNVAKRKSSMPQKFLGDKGLSDTPYDSSASYEKENEMMKSHVMDQAINNAINYLGAESLRPLVQTPPGGSEVVPVISPMYQLHKPLAEGTPRSNHSAQDSAVENLLLLSKAKLVPSEREASPSNSCQDSTDTESNNEEQRSGLIYLTNHIAPHARNGLSLKEEHRAYDLLRAASENSQDALRVVSTSGEQMKVYKCEHCRVLFLDHVMYTIHMGCHGFRDPFECNMCGYHSQDRYEFSSHITRGEHRFHMS

SEQ ID NO: 39475 - protein, 249 aa, Homo sapiens
  Payload ID: 7909
  Gene Symbol: IKZF1
  Gene Name: IKAROS family zinc finger 1 (Ikaros)
  ENSP ID: ENSP00000340080
MDADEGQDMSQVSGDKGLSDTPYDSSASYEKENEMMKSHVMDQAINNAINYLGAESLRPLVQTPPGGSEVVPVISPMYQLHKPLAEGTPRSNHSAQDSAVENLLLLSKAKLVPSEREASPSNSCQDSTDTESNNEEQRSGLIYLTNHIAPHARNGLSLKEEHRAYDLLRAASENSQDALRVVSTSGEQMKVYKCEHCRVLFLDHVMYTIHMGCHGFRDPFECNMCGYHSQDRYEFSSHITRGEHRFHMS

SEQ ID NO: 39476 - protein, 376 aa, Homo sapiens
  Payload ID: 7909
  Gene Symbol: IKZF1
  Gene Name: IKAROS family zinc finger 1 (Ikaros)
  Uniprot ID: Q13422
  ENSP ID: ENSP00000342485
MDADEGQDMSQVSGKESPPVSDTPDEGDEPMPIPEDLSTTSGGQQSSKSDRVVASNVKVETQSDEENGRACEMNGEECAEDLRMLDASGEKMNGSHRDQGSSALSGVGGIRLPNGKLKCDICGIICIGPNVLMVHKRSHTGDKGLSDTPYDSSASYEKENEMMKSHVMDQAINNAINYLGAESLRPLVQTPPGGSEVVPVISPMYQLHKPLAEGTPRSNHSAQDSAVENLLLLSKAKLVPSEREASPSNSCQDSTDTESNNEEQRSGLIYLTNHIAPHARNGLSLKEEHRAYDLLRAASENSQDALRVVSTSGEQMKVYKCEHCRVLFLDHVMYTIHMGCHGFRDPFECNMCGYHSQDRYEFSSHITRGEHRFHMS

SEQ ID NO: 39477 - protein, 432 aa, Homo sapiens
  Payload ID: 7909
  Gene Symbol: IKZF1
  Gene Name: IKAROS family zinc finger 1 (Ikaros)
  Uniprot ID: Q13422
  ENSP ID: ENSP00000342750
MDADEGQDMSQVSGKESPPVSDTPDEGDEPMPIPEDLSTTSGGQQSSKSDRVVGERPFQCNQCGASFTQKGNLLRHIKLHSGEKPFKCHLCNYACRRRDALTGHLRTHSVGKPHKCGYCGRSYKQRSSLEEHKERCHNYLESMGLPGTLYPVIKEETNHSEMAEDLCKIGSERSLVLDRLASNVAKRKSSMPQKFLGDKGLSDTPYDSSASYEKENEMMKSHVMDQAINNAINYLGAESLRPLVQTPPGGSEVVPVISPMYQLHKPLAEGTPRSNHSAQDSAVENLLLLSKAKLVPSEREASPSNSCQDSTDTESNNEEQRSGLIYLTNHIAPHARNGLSLKEEHRAYDLLRAASENSQDALRVVSTSGEQMKVYKCEHCRVLFLDHVMYTIHMGCHGFRDPFECNMCGYHSQDRYEFSSHITRGEHRFHMS

SEQ ID NO: 39478 - protein, 432 aa, Homo sapiens
  Payload ID: 7909
  Gene Symbol: IKZF1
  Gene Name: IKAROS family zinc finger 1 (Ikaros)
  Uniprot ID: Q13422
  ENSP ID: ENSP00000349928
MDADEGQDMSQVSGKESPPVSDTPDEGDEPMPIPEDLSTTSGGQQSSKSDRVVASNVKVETQSDEENGRACEMNGEECAEDLRMLDASGEKMNGSHRDQGSSALSGVGGIRLPNGKLKCDICGIICIGPNVLMVHKRSHTGERPFQCNQCGASFTQKGNLLRHIKLHSGEKPFKCHLCNYACRRRDALTGHLRTHSGDKGLSDTPYDSSASYEKENEMMKSHVMDQAINNAINYLGAESLRPLVQTPPGGSEVVPVISPMYQLHKPLAEGTPRSNHSAQDSAVENLLLLSKAKLVPSEREASPSNSCQDSTDTESNNEEQRSGLIYLTNHIAPHARNGLSLKEEHRAYDLLRAASENSQDALRVVSTSGEQMKVYKCEHCRVLFLDHVMYTIHMGCHGFRDPFECNMCGYHSQDRYEFSSHITRGEHRFHMS

SEQ ID NO: 39479 - protein, 477 aa, Homo sapiens
  Payload ID: 7909
  Gene Symbol: IKZF1
  Gene Name: IKAROS family zinc finger 1 (Ikaros)
  Uniprot ID: Q13422
  ENSP ID: ENSP00000352123
MDADEGQDMSQVSGKESPPVSDTPDEGDEPMPIPEDLSTTSGGQQSSKSDRVVASNVKVETQSDEENGRACEMNGEECAEDLRMLDASGEKMNGSHRDQGSSALSGVGGIRLPNGKLKCDICGIICIGPNVLMVHKRSHTGERPFQCNQCGASFTQKGNLLRHIKLHSGEKPFKCHLCNYACRRRDALTGHLRTHSVIKEETNHSEMAEDLCKIGSERSLVLDRLASNVAKRKSSMPQKFLGDKGLSDTPYDSSASYEKENEMMKSHVMDQAINNAINYLGAESLRPLVQTPPGGSEVVPVISPMYQLHKPLAEGTPRSNHSAQDSAVENLLLLSKAKLVPSEREASPSNSCQDSTDTESNNEEQRSGLIYLTNHIAPHARNGLSLKEEHRAYDLLRAASENSQDALRVVSTSGEQMKVYKCEHCRVLFLDHVMYTIHMGCHGFRDPFECNMCGYHSQDRYEFSSHITRGEHRFHMS

SEQ ID NO: 39480 - protein, 174 aa, Homo sapiens
  Payload ID: 7909
  Gene Symbol: IKZF1
  Gene Name: IKAROS family zinc finger 1 (Ikaros)
  ENSP ID: ENSP00000388478
MDADEGQDMSQVSGKESPPVSDTPDEGDEPMPIPEDLSTTSGGQQSSKSDRVVVTYGADDFRDFHAIIPKSFSRKYMPCFWKTKACLHLLSCKYRTCMFLHQPPRYIKYSLFYSLDTYHIIFGYLYHKVQNEGLGSCAVSWEHGSGVTVRVGVTVALMGLLLRRCCWTALRLLL

SEQ ID NO: 39481 - protein, 432 aa, Homo sapiens; identical to SEQ ID NO: 39477
  Payload ID: 7909
  Gene Symbol: IKZF1
  Gene Name: IKAROS family zinc finger 1 (Ikaros)
  Uniprot ID: Q13422
  ENSP ID: ENSP00000396554

SEQ ID NO: 39482 - protein, 294 aa, Homo sapiens
  Payload ID: 7909
  Gene Symbol: IKZF1
  Gene Name: IKAROS family zinc finger 1 (Ikaros)
  ENSP ID: ENSP00000401507
MDADEGQDMSQVSVIKEETNHSEMAEDLCKIGSERSLVLDRLASNVAKRKSSMPQKFLGDKGLSDTPYDSSASYEKENEMMKSHVMDQAINNAINYLGAESLRPLVQTPPGGSEVVPVISPMYQLHKPLAEGTPRSNHSAQDSAVENLLLLSKAKLVPSEREASPSNSCQDSTDTESNNEEQRSGLIYLTNHIAPHARNGLSLKEEHRAYDLLRAASENSQDALRVVSTSGEQMKVYKCEHCRVLFLDHVMYTIHMGCHGFRDPFECNMCGYHSQDRYEFSSHITRGEHRFHMS

SEQ ID NO: 39483 - protein, 67 aa, Homo sapiens
  Payload ID: 7909
  Gene Symbol: IKZF1
  Gene Name: IKAROS family zinc finger 1 (Ikaros)
  ENSP ID: ENSP00000409588
PPVSDTPDEGDEPMPIPEDLSTTSGGQQSSKSDRVVGDKGLSDTPYDSSASYEKENEMMKSHVMDQA

SEQ ID NO: 39484 - protein, 477 aa, Homo sapiens; identical to SEQ ID NO: 39479
  Payload ID: 7909
  Gene Symbol: IKZF1
  Gene Name: IKAROS family zinc finger 1 (Ikaros)
  Uniprot ID: Q13422
  ENSP ID: ENSP00000413025

SEQ ID NO: 39485 - protein, 336 aa, Homo sapiens
  Payload ID: 7909
  Gene Symbol: IKZF1
  Gene Name: IKAROS family zinc finger 1 (Ikaros)
  ENSP ID: ENSP00000478368
MDADEGQDMSQVSVGKPHKCGYCGRSYKQRSSLEEHKERCHNYLESMGLPGTLYPVIKEETNHSEMAEDLCKIGSERSLVLDRLASNVAKRKSSMPQKFLGDKGLSDTPYDSSASYEKENEMMKSHVMDQAINNAINYLGAESLRPLVQTPPGGSEVVPVISPMYQLHKPLAEGTPRSNHSAQDSAVENLLLLSKAKLVPSEREASPSNSCQDSTDTESNNEEQRSGLIYLTNHIAPHARNGLSLKEEHRAYDLLRAASENSQDALRVVSTSGEQMKVYKCEHCRVLFLDHVMYTIHMGCHGFRDPFECNMCGYHSQDRYEFSSHITRGEHRFHMS

SEQ ID NO: 39486 - protein, 268 aa, Homo sapiens
  Payload ID: 7909
  Gene Symbol: IKZF1
  Gene Name: IKAROS family zinc finger 1 (Ikaros)
  ENSP ID: ENSP00000483016
MDADEGQDMSQVSGKESPPVSDTPDEGDEPMPIPEDLSTTSGGQQSSKSDRVVVTYGADDFRDFHAIIPKSFSRERPFQCNQCGASFTQKGNLLRHIKLHKPLAEGTPRSNHSAQDSAVENLLLLSKAKLVPSEREASPSNSCQDSTDTESNNEEQRSGLIYLTNHIAPHARNGLSLKEEHRAYDLLRAASENSQDALRVVSTSGEQMKVYKCEHCRVLFLDHVMYTIHMGCHGFRDPFECNMCGYHSQDRYEFSSHITRGEHRFHMS

SEQ ID NO: 39487 - protein, 532 aa, Homo sapiens
  Payload ID: 7910
  Gene Symbol: IKZF2
  Gene Name: IKAROS family zinc finger 2 (Helios)
  ENSP ID: ENSP00000342876
MHCTLTMETEAIDGYITCDNELSPEREHSNMAIDLTSSTPNGQHASPSHMTSTNSVKLEMQSDEECDRKPLSREDEIRGHDEGSSLEEPLIESSEVADNRKVQELQGEGGIRLPNGKLKCDVCGMVCIGPNVLMVHKRSHTGERPFHCNQCGASFTQKGNLLRHIKLHSGEKPFKCPFCSYACRRRDALTGHLRTHSVGKPHKCNYCGRSYKQRSSLEEHKERCHNYLQNVSMEAAGQVMSHHVPPMEDCKEQEPIMDNNISLVPFERPAVIEKLTGNMGKRKSSTPQKFVGEKLMRFSYPDIHFDMNLTYEKEAELMQSHMMDQAINNAITYLGAEALHPLMQHPPSTIAEVAPVISSAYSQVYHPNRIERPISRETADSHENNMDGPISLIRPKSRPQEREASPSNSCLDSTDSESSHDDHQSYQGHPALNPKRKQSPAYMKEDVKALDTTKAPKGSLKDIYKVFNGEGEQIRAFKCEHCRVLFLDHVMYTIHMGCHGYRDPLECNICGYRSQDRYEFSSHIVRGEHTFH

SEQ ID NO: 39488 - protein, 500 aa, Homo sapiens
  Payload ID: 7910
  Gene Symbol: IKZF2
  Gene Name: IKAROS family zinc finger 2 (Helios)
  Uniprot ID: Q9UKS7
  ENSP ID: ENSP00000363439
METEAIDGYITCDNELSPEREHSNMAIDLTSSTPNGQHASPSHMTSTNSVKLEMQSDEECDRKPLSREDEIRGHDEGSSLEEPLIESSEVADNRKVQELQGEGGIRLPNGERPFHCNQCGASFTQKGNLLRHIKLHSGEKPFKCPFCSYACRRRDALTGHLRTHSVGKPHKCNYCGRSYKQRSSLEEHKERCHNYLQNVSMEAAGQVMSHHVPPMEDCKEQEPIMDNNISLVPFERPAVIEKLTGNMGKRKSSTPQKFVGEKLMRFSYPDIHFDMNLTYEKEAELMQSHMMDQAINNAITYLGAEALHPLMQHPPSTIAEVAPVISSAYSQVYHPNRIERPISRETADSHENNMDGPISLIRPKSRPQEREASPSNSCLDSTDSESSHDDHQSYQGHPALNPKRKQSPAYMKEDVKALDTTKAPKGSLKDIYKVFNGEGEQIRAFKCEHCRVLFLDHVMYTIHMGCHGYRDPLECNICGYRSQDRYEFSSHIVRGEHTFH

SEQ ID NO: 39489 - protein, 52 aa, Homo sapiens
  Payload ID: 7910
  Gene Symbol: IKZF2
  Gene Name: IKAROS family zinc finger 2 (Helios)
  Uniprot ID: Q9UKS7
  ENSP ID: ENSP00000363446
METEAIDGYITCDNELSPEREHSNMAIDLTSSTPNGQHASPSHMTSRSFSKI

SEQ ID NO: 39490 - protein, 148 aa, Homo sapiens
  Payload ID: 7910
  Gene Symbol: IKZF2
  Gene Name: IKAROS family zinc finger 2 (Helios)
  Uniprot ID: Q9UKS7
  ENSP ID: ENSP00000389548
METEAIDGYITCDNELSPEREHSNMAIDLTSSTPNGQHASPSHMTSTNSVKLEMQSDEECDRKPLSREDEIRGHDEGSSLEEPLIESSEVADNRKVQELQGEGGIRLPNGKLKCDVCGMVCIGPNVLMVHKRSHTGVAVVKTTFSEFC

SEQ ID NO: 39491 - protein, 92 aa, Homo sapiens
  Payload ID: 7910
  Gene Symbol: IKZF2
  Gene Name: IKAROS family zinc finger 2 (Helios)
  ENSP ID: ENSP00000390045
MHCTLTMETEAIDGYITCDNELSPEREHSNMAIDLTSSTPNGQHASPSHMTSSKSSFYDFFLCVCVSPATDFNLLGLWGPLTLWYSYCYRFC

SEQ ID NO: 39492 - protein, 409 aa, Homo sapiens
  Payload ID: 7910
  Gene Symbol: IKZF2
  Gene Name: IKAROS family zinc finger 2 (Helios)
  ENSP ID: ENSP00000395203
MTSTNSVKLEMQSDEECDRKPLSREDEIRGHDEGSSLEEPLIESSEVADNRKVQELQGEGGIRLPNGERPFHCNQCGASFTQKGNLLRHIKLHSGEKPFKCPFCSYACRRRDALTGHLRTHSVGKPHKCNYCGRSYKQRSSLEEHKERCHNYLQNVSMEAAGQVMSHHGEKLMRFSYPDIHFDMNLTYEKEAELMQSHMMDQAINNAITYLGAEALHPLMQHPPSTIAEVAPVISSAYSQVYHPNRIERPISRETADSHENNMDGPISLIRPKSRPQEREASPSNSCLDSTDSESSHDDHQSYQGHPALNPKRKQSPAYMKEDVKALDTTKAPKGSLKDIYKVFNGEGEQIRAFKCEHCRVLFLDHVMYTIHMGCHGYRDPLECNICGYRSQDRYEFSSHIVRGEHTFH

SEQ ID NO: 39493 - protein, 239 aa, Homo sapiens
  Payload ID: 7910
  Gene Symbol: IKZF2
  Gene Name: IKAROS family zinc finger 2 (Helios)
  Uniprot ID: Q9UKS7
  ENSP ID: ENSP00000396253
METEAIDGYITCDNELSPEREHSNMAIDLTSSTPNGQHASPSHMTSTNSVKLEMQSDEECDRKPLSREDEIRGHDEGSSLEEPLIESSEVADNRKVQELQGEGGIRLPNGKLKCDVCGMVCIGPNVLMVHKRSHTGERPFHCNQCGASFTQKGNLLRHIKLHSGEKPFKCPFCSYACRRRDALTGHLRTHSVGKPHKCNYCGRSYKQRSSLEEHKERCHNYLQNVSMEAAGQVMSHHDS

SEQ ID NO: 39494 - protein, 83 aa, Homo sapiens
  Payload ID: 7910
  Gene Symbol: IKZF2
  Gene Name: IKAROS family zinc finger 2 (Helios)
  ENSP ID: ENSP00000402132
METEAIDGYITCDNELSPEREHSNMAIDLTSSTPNGQHASPSHMTSTNSVKLEMQSDEECDRKPLSREDEIRGHDEGSSLEEP

SEQ ID NO: 39495 - protein, 125 aa, Homo sapiens
  Payload ID: 7910
  Gene Symbol: IKZF2
  Gene Name: IKAROS family zinc finger 2 (Helios)
  ENSP ID: ENSP00000406783
MHCTLTMETEAIDGYITCDNELSPEREHSNMAIDLTSSTPNGQHASPSHMTSTNSVKLEMQSDEECDRKPLSREDEIRGHDEGSSLEEPLIESSEVADNRKVQELQGEGGIRLPNGERPFHCNQC

SEQ ID NO: 39496 - protein, 411 aa, Homo sapiens
  Payload ID: 7910
  Gene Symbol: IKZF2
  Gene Name: IKAROS family zinc finger 2 (Helios)
  ENSP ID: ENSP00000410447
MTSTNSVKLEMQSDEECDRKPLSREDEIRGHDEGSSLEEPLIESSEVADNRKVQELQGEGGIRLPNGERPFHCNQCGASFTQKGNLLRHIKLHSGEKPFKCPFCSYACRRRDALTGHLRTHSVPPMEDCKEQEPIMDNNISLVPFERPAVIEKLTGNMGKRKSSTPQKFVGEKLMRFSYPDIHFDMNLTYEKEAELMQSHMMDQAINNAITYLGAEALHPLMQHPPSTIAEVAPVISSAYSQVYHPNRIERPISRETADSHENNMDGPISLIRPKSRPQEREASPSNSCLDSTDSESSHDDHQSYQGHPALNPKRKQSPAYMKEDVKALDTTKAPKGSLKDIYKVFNGEGEQIRAFKCEHCRVLFLDHVMYTIHMGCHGYRDPLECNICGYRSQDRYEFSSHIVRGEHTFH

SEQ ID NO: 39497 - protein, 52 aa, Homo sapiens; identical to SEQ ID NO: 39489
  Payload ID: 7910
  Gene Symbol: IKZF2
  Gene Name: IKAROS family zinc finger 2 (Helios)
  Uniprot ID: Q9UKS7
  ENSP ID: ENSP00000411444

SEQ ID NO: 39498 - protein, 526 aa, Homo sapiens [sequence omitted]

SEQ ID NO: 39499 - protein, 52 aa, Homo sapiens; identical to SEQ ID NO: 39489
  Payload ID: 7910
  Gene Symbol: IKZF2
  Gene Name: IKAROS family zinc finger 2 (Helios)
  Uniprot ID: Q9UKS7
  ENSP ID: ENSP00000413680

SEQ ID NO: 39500 - protein, 431 aa, Homo sapiens
  Payload ID: 7911
  Gene Symbol: IKZF3
  Gene Name: IKAROS family zinc finger 3 (Aiolos)
  Uniprot ID: Q9UKT9
  ENSP ID: ENSP00000341977
MEDIQTNAELKSTQEQSVPAESAAVLNDYSLTKSHEMENVDSGEGPANEDEDIGDDSMKVKDEYSERDENVLKSEPMGNAEEPEIPYSYSREYNEYENIKLERHVVSFDSSRPTSGKMNCDVCGLSCISFNVLMVHKRSHTGERPFQCNQCGASFTQKGNLLRHIKLHTGEKPFKCHLCNYACQRRDALTGHLRTHSGEKRHCFDVNYNSSYMYEKESELIQTRMMDQAINNAISYLGAEALRPLVQTPPAPTSEMVPVISSMYPIALTRAEMSNGAPQELEKKSIHLPEKSVPSERGLSPNNSGHDSTDTDSNHEERQNHIYQQNHMVLSRARNGMPLLKEVPRSYELLKPPPICPRDSVKVINKEGEVMDVYRCDHCRVLFLDYVMFTIHMGCHGFRDPFECNMCGYRSHDRYEFSSHIARGEHRALLK

SEQ ID NO: 39501 - protein, 470 aa, Homo sapiens
  Payload ID: 7911
  Gene Symbol: IKZF3
  Gene Name: IKAROS family zinc finger 3 (Aiolos)
  Uniprot ID: Q9UKT9
  ENSP ID: ENSP00000344471
MEDIQTNAELKSTQEQSVPAESAAVLNDYSLTKSHEMENVDSGEGPANEDEDIGDDSMKVKDEYSERDENVLKSEPMGNAEEPEIPYSYSREYNEYENIKLERHVVSFDSSRPTSGKMNCDVCGLSCISFNVLMVHKRSHTGERPFQCNQCGASFTQKGNLLRHIKLHTGEKPFKCHLCNYACQRRDALTGHLRTHSVEKPYKCEFCGRSYKQRSSLEEHKERCRTFLQSTDPGDTGEKRHCFDVNYNSSYMYEKESELIQTRMMDQAINNAISYLGAEALRPLVQTPPAPTSEMVPVISSMYPIALTRAEMSNGAPQELEKKSIHLPEKSVPSERGLSPNNSGHDSTDTDSNHEERQNHIYQQNHMVLSRARNGMPLLKEVPRSYELLKPPPICPRDSVKVINKEGEVMDVYRCDHCRVLFLDYVMFTIHMGCHGFRDPFECNMCGYRSHDRYEFSSHIARGEHRALLK

SEQ ID NO: 39502 - protein, 509 aa, Homo sapiens
  Payload ID: 7911
  Gene Symbol: IKZF3
  Gene Name: IKAROS family zinc finger 3 (Aiolos)
  Uniprot ID: Q9UKT9
  ENSP ID: ENSP00000344544
MEDIQTNAELKSTQEQSVPAESAAVLNDYSLTKSHEMENVDSGEGPANEDEDIGDDSMKVKDEYSERDENVLKSEPMGNAEEPEIPYSYSREYNEYENIKLERHVVSFDSSRPTSGKMNCDVCGLSCISFNVLMVHKRSHTGERPFQCNQCGASFTQKGNLLRHIKLHTGEKPFKCHLCNYACQRRDALTGHLRTHSVEKPYKCEFCGRSYKQRSSLEEHKERCRTFLQSTDPGDTASAEARHIKAEMGSERALVLDRLASNVAKRKSSMPQKFIGEKRHCFDVNYNSSYMYEKESELIQTRMMDQAINNAISYLGAEALRPLVQTPPAPTSEMVPVISSMYPIALTRAEMSNGAPQELEKKSIHLPEKSVPSERGLSPNNSGHDSTDTDSNHEERQNHIYQQNHMVLSRARNGMPLLKEVPRSYELLKPPPICPRDSVKVINKEGEVMDVYRCDHCRVLFLDYVMFTIHMGCHGFRDPFECNMCGYRSHDRYEFSSHIARGEHRALLK

SEQ ID NO: 39503 - protein, 470 aa, Homo sapiens
  Payload ID: 7911
  Gene Symbol: IKZF3
  Gene Name: IKAROS family zinc finger 3 (Aiolos)
  Uniprot ID: Q9UKT9
  ENSP ID: ENSP00000345622
MEDIQTNAELKSTQEQSVPAESAAVLNDYSLTKSHEMENVDSGEGPANEDEDIGDDSMKVKDEYSERDENVLKSEPMGNAEEPEIPYSYSREYNEYENIKLERHVVSFDSSRPTSGKMNCDVCGLSCISFNVLMVHKRSHTGERPFQCNQCGASFTQKGNLLRHIKLHTGEKPFKCHLCNYACQRRDALTGHLRTHSASAEARHIKAEMGSERALVLDRLASNVAKRKSSMPQKFIGEKRHCFDVNYNSSYMYEKESELIQTRMMDQAINNAISYLGAEALRPLVQTPPAPTSEMVPVISSMYPIALTRAEMSNGAPQELEKKSIHLPEKSVPSERGLSPNNSGHDSTDTDSNHEERQNHIYQQNHMVLSRARNGMPLLKEVPRSYELLKPPPICPRDSVKVINKEGEVMDVYRCDHCRVLFLDYVMFTIHMGCHGFRDPFECNMCGYRSHDRYEFSSHIARGEHRALLK

SEQ ID NO: 39504 - protein, 366 aa, Homo sapiens
  Payload ID: 7911
  Gene Symbol: IKZF3
  Gene Name: IKAROS family zinc finger 3 (Aiolos)
  Uniprot ID: Q9UKT9
  ENSP ID: ENSP00000367179
MEDIQTNAELKSTQEQSVPAESAAVLNDYSLTKSHEMENVDSGEGPANEDEDIGVEKPYKCEFCGRSYKQRSSLEEHKERCRTFLQSTDPGDTASAEARHIKAEMGSERALVLDRLASNVAKRKSSMPQKFIGEKRHCFDVNYNSSYMYEKESELIQTRMMDQAINNAISYLGAEALRPLVQTPPAPTSEMVPVISSMYPIALTRAEMSNGAPQELEKKSIHLPEKSVPSERGLSPNNSGHDSTDTDSNHEERQNHIYQQNHMVLSRARNGMPLLKEVPRSYELLKPPPICPRDSVKVINKEGEVMDVYRCDHCRVLFLDYVMFTIHMGCHGFRDPFECNMCGYRSHDRYEFSSHIARGEHRALLK

SEQ ID NO: 39505 - protein, 375 aa, Homo sapiens
  Payload ID: 7911
  Gene Symbol: IKZF3
  Gene Name: IKAROS family zinc finger 3 (Aiolos)
  Uniprot ID: Q9UKT9
  ENSP ID: ENSP00000367180
MEDIQTNAELKSTQEQSVPAESAAVLNDYSLTKSHEMENVDSGEGPANEDEDIGDDSMKVKDEYSERDENVLKSEPMGNAEEPEIPYSYSREYNEYENIKLERHVVSFDSSRPTSGKMNCDVCGLSCISFNVLMVHKRSHTGEKRHCFDVNYNSSYMYEKESELIQTRMMDQAINNAISYLGAEALRPLVQTPPAPTSEMVPVISSMYPIALTRAEMSNGAPQELEKKSIHLPEKSVPSERGLSPNNSGHDSTDTDSNHEERQNHIYQQNHMVLSRARNGMPLLKEVPRSYELLKPPPICPRDSVKVINKEGEVMDVYRCDHCRVLFLDYVMFTIHMGCHGFRDPFECNMCGYRSHDRYEFSSHIARGEHRALLK

SEQ ID NO: 39506 - protein, 288 aa, Homo sapiens
  Payload ID: 7911
  Gene Symbol: IKZF3
  Gene Name: IKAROS family zinc finger 3 (Aiolos)
  Uniprot ID: Q9UKT9
  ENSP ID: ENSP00000367188
MEDIQTNAELKSTQEQSVPAESAAVLNDYSLTKSHEMENVDSGEGPANEDEDIGGEKRHCFDVNYNSSYMYEKESELIQTRMMDQAINNAISYLGAEALRPLVQTPPAPTSEMVPVISSMYPIALTRAEMSNGAPQELEKKSIHLPEKSVPSERGLSPNNSGHDSTDTDSNHEERQNHIYQQNHMVLSRARNGMPLLKEVPRSYELLKPPPICPRDSVKVINKEGEVMDVYRCDHCRVLFLDYVMFTIHMGCHGFRDPFECNMCGYRSHDRYEFSSHIARGEHRALLK

SEQ ID NO: 39507 - protein, 422 aa, Homo sapiens
  Payload ID: 7911
  Gene Symbol: IKZF3
  Gene Name: IKAROS family zinc finger 3 (Aiolos)
  Uniprot ID: Q9UKT9
  ENSP ID: ENSP00000367194
MEDIQTNAELKSTQEQSVPAESAAVLNDYSLTKSHEMENVDSGEGPANEDEDIGGERPFQCNQCGASFTQKGNLLRHIKLHTGEKPFKCHLCNYACQRRDALTGHLRTHSVEKPYKCEFCGRSYKQRSSLEEHKERCRTFLQSTDPGDTASAEARHIKAEMGSERALVLDRLASNVAKRKSSMPQKFIGEKRHCFDVNYNSSYMYEKESELIQTRMMDQAINNAISYLGAEALRPLVQTPPAPTSEMVPVISSMYPIALTRAEMSNGAPQELEKKSIHLPEKSVPSERGLSPNNSGHDSTDTDSNHEERQNHIYQQNHMVLSRARNGMPLLKEVPRSYELLKPPPICPRDSVKVINKEGEVMDVYRCDHCRVLFLDYVMFTIHMGCHGFRDPFECNMCGYRSHDRYEFSSHIARGEHRALLK

SEQ ID NO: 39508 - protein, 327 aa, Homo sapiens
  Payload ID: 7911
  Gene Symbol: IKZF3
  Gene Name: IKAROS family zinc finger 3 (Aiolos)
  Uniprot ID: Q9UKT9
  ENSP ID: ENSP00000377741
MEDIQTNAELKSTQEQSVPAESAAVLNDYSLTKSHEMENVDSGEGPANEDEDIGASAEARHIKAEMGSERALVLDRLASNVAKRKSSMPQKFIGEKRHCFDVNYNSSYMYEKESELIQTRMMDQAINNAISYLGAEALRPLVQTPPAPTSEMVPVISSMYPIALTRAEMSNGAPQELEKKSIHLPEKSVPSERGLSPNNSGHDSTDTDSNHEERQNHIYQQNHMVLSRARNGMPLLKEVPRSYELLKPPPICPRDSVKVINKEGEVMDVYRCDHCRVLFLDYVMFTIHMGCHGFRDPFECNMCGYRSHDRYEFSSHIARGEHRALLK

SEQ ID NO: 39509 - protein, 414 aa, Homo sapiens
  Payload ID: 7911
  Gene Symbol: IKZF3
  Gene Name: IKAROS family zinc finger 3 (Aiolos)
  Uniprot ID: Q9UKT9
  ENSP ID: ENSP00000403027
MEDIQTNAELKSTQEQSVPAESAAVLNDYSLTKSHEMENVDSGEGPANEDEDIGDDSMKVKDEYSERDENVLKSEPMGNAEEPEIPYSYSREYNEYENIKLERHVVSFDSSRPTSGKMNCDVCGLSCISFNVLMVHKRSHTASAEARHIKAEMGSERALVLDRLASNVAKRKSSMPQKFIGEKRHCFDVNYNSSYMYEKESELIQTRMMDQAINNAISYLGAEALRPLVQTPPAPTSEMVPVISSMYPIALTRAEMSNGAPQELEKKSIHLPEKSVPSERGLSPNNSGHDSTDTDSNHEERQNHIYQQNHMVLSRARNGMPLLKEVPRSYELLKPPPICPRDSVKVINKEGEVMDVYRCDHCRVLFLDYVMFTIHMGCHGFRDPFECNMCGYRSHDRYEFSSHIARGEHRALLK

SEQ ID NO: 39510 - protein, 436 aa, Homo sapiens
  Payload ID: 7911
  Gene Symbol: IKZF3
  Gene Name: IKAROS family zinc finger 3 (Aiolos)
  Uniprot ID: Q9UKT9
  ENSP ID: ENSP00000403776
MEDIQTNAELKSTQEQSVPADDSMKVKDEYSERDENVLKSEPMGNAEEPEIPYSYSREYNEYENIKLERHVVSFDSSRPTSGKMNCDVCGLSCISFNVLMVHKRSHTGERPFQCNQCGASFTQKGNLLRHIKLHTGEKPFKCHLCNYACQRRDALTGHLRTHSASAEARHIKAEMGSERALVLDRLASNVAKRKSSMPQKFIGEKRHCFDVNYNSSYMYEKESELIQTRMMDQAINNAISYLGAEALRPLVQTPPAPTSEMVPVISSMYPIALTRAEMSNGAPQELEKKSIHLPEKSVPSERGLSPNNSGHDSTDTDSNHEERQNHIYQQNHMVLSRARNGMPLLKEVPRSYELLKPPPICPRDSVKVINKEGEVMDVYRCDHCRVLFLDYVMFTIHMGCHGFRDPFECNMCGYRSHDRYEFSSHIARGEHRALLK

SEQ ID NO: 39511 - protein, 453 aa, Homo sapiens
  Payload ID: 7911
  Gene Symbol: IKZF3
  Gene Name: IKAROS family zinc finger 3 (Aiolos)
  Uniprot ID: Q9UKT9
  ENSP ID: ENSP00000420463
MEDIQTNAELKSTQEQSVPAESAAVLNDYSLTKSHEMENVDSGEGPANEDEDIGDDSMKVKDEYSERDENVLKSEPMGNAEEPEIPYSYSREYNEYENIKLERHVVSFDSSRPTSGKMNCDVCGLSCISFNVLMVHKRSHTVEKPYKCEFCGRSYKQRSSLEEHKERCRTFLQSTDPGDTASAEARHIKAEMGSERALVLDRLASNVAKRKSSMPQKFIGEKRHCFDVNYNSSYMYEKESELIQTRMMDQAINNAISYLGAEALRPLVQTPPAPTSEMVPVISSMYPIALTRAEMSNGAPQELEKKSIHLPEKSVPSERGLSPNNSGHDSTDTDSNHEERQNHIYQQNHMVLSRARNGMPLLKEVPRSYELLKPPPICPRDSVKVINKEGEVMDVYRCDHCRVLFLDYVMFTIHMGCHGFRDPFECNMCGYRSHDRYEFSSHIARGEHRALLK

SEQ ID NO: 39512 - protein, 475 aa, Homo sapiens
  Payload ID: 7911
  Gene Symbol: IKZF3
  Gene Name: IKAROS family zinc finger 3 (Aiolos)
  Uniprot ID: Q9UKT9
  ENSP ID: ENSP00000438972
MEDIQTNAELKSTQEQSVPADDSMKVKDEYSERDENVLKSEPMGNAEEPEIPYSYSREYNEYENIKLERHVVSFDSSRPTSGKMNCDVCGLSCISFNVLMVHKRSHTGERPFQCNQCGASFTQKGNLLRHIKLHTGEKPFKCHLCNYACQRRDALTGHLRTHSVEKPYKCEFCGRSYKQRSSLEEHKERCRTFLQSTDPGDTASAEARHIKAEMGSERALVLDRLASNVAKRKSSMPQKFIGEKRHCFDVNYNSSYMYEKESELIQTRMMDQAINNAISYLGAEALRPLVQTPPAPTSEMVPVISSMYPIALTRAEMSNGAPQELEKKSIHLPEKSVPSERGLSPNNSGHDSTDTDSNHEERQNHIYQQNHMVLSRARNGMPLLKEVPRSYELLKPPPICPRDSVKVINKEGEVMDVYRCDHCRVLFLDYVMFTIHMGCHGFRDPFECNMCGYRSHDRYEFSSHIARGEHRALLK

SEQ ID NO: 39513 - protein, 262 aa, Homo sapiens
  Payload ID: 7911
  Gene Symbol: IKZF3
  Gene Name: IKAROS family zinc finger 3 (Aiolos)
  Uniprot ID: Q9UKT9
  ENSP ID: ENSP00000462452
MGSERALVLDRLASNVAKRKSSMPQKFIGEKRHCFDVNYNSSYMYEKESELIQTRMMDQAINNAISYLGAEALRPLVQTPPAPTSEMVPVISSMYPIALTRAEMSNGAPQELEKKSIHLPEKSVPSERGLSPNNSGHDSTDTDSNHEERQNHIYQQNHMVLSRARNGMPLLKEVPRSYELLKPPPICPRDSVKVINKEGEVMDVYRCDHCRVLFLDYVMFTIHMGCHGFRDPFECNMCGYRSHDRYEFSSHIARGEHRALLK

SEQ ID NO: 39514 - protein, 263 aa, Homo sapiens
  Payload ID: 7911
  Gene Symbol: IKZF3
  Gene Name: IKAROS family zinc finger 3 (Aiolos)
  Uniprot ID: Q9UKT9
  ENSP ID: ENSP00000462791
MEDIQTNAELKSTQEQSVPAESAAVLNDYSLTKSHEMENVDSGEGPANEDEDIGDDSMKVKDEYSERDENVLKSEPMGNAEEPEIPYSYSREYNEYENIKLERHVVSFDSSRPTSGKMNCDVCGLSCISFNVLMVHKRSHTGERPFQCNQCGASFTQKGNLLRHIKLHTGEKPFKCHLCNYACQRRDALTGHLRTHSVEKPYKCEFCGRSYKQRSSLEEHKERCRTFLQSTDPGDTGTGWGWVELSHLGIRLQDLNVPWCRLH

SEQ ID NO: 39515 - protein, 207 aa, Homo sapiens
  Payload ID: 7911
  Gene Symbol: IKZF3
  Gene Name: IKAROS family zinc finger 3 (Aiolos)
  ENSP ID: ENSP00000463505
MEDIQTNAELKSTQEQSVPAESAAVLNDYSLTKSHEMENVDSGEGPANEDEDIGDDSMKVKDEYSERDENVLKSEPMGNAEEPEIPYSYSREYNEYENIKLERHVVSFDSSRPTSGKMNCDVCGLSCISFNVLMVHKRSHTVEKPYKCEFCGRSYKQRSSLEEHKERCRTFLQSTDPGDTGTGWGWVELSHLGIRLQDLNVPWCRLH

SEQ ID NO: 39516 - protein, 262 aa, Homo sapiens; identical to SEQ ID NO: 39513
  Payload ID: 7911
  Gene Symbol: IKZF3
  Gene Name: IKAROS family zinc finger 3 (Aiolos)
  Uniprot ID: Q9UKT9
  ENSP ID: ENSP00000485515

SEQ ID NO: 39517 - protein, 585 aa, Homo sapiens
  Payload ID: 7912
  Gene Symbol: IKZF4
  Gene Name: IKAROS family zinc finger 4 (Eos)
  Uniprot ID: Q9H2S9
  ENSP ID: ENSP00000262032
MHTPPALPRRFQGGGRVRTPGSHRQGKDNLERDPSGGCVPDFLPQAQDSNHFIMESLFCESSGDSSLEKEFLGAPVGPSVSTPNSQHSSPSRSLSANSIKVEMYSDEESSRLLGPDERLLEKDDSVIVEDSLSEPLGYCDGSGPEPHSPGGIRLPNGKLKCDVCGMVCIGPNVLMVHKRSHTGERPFHCNQCGASFTQKGNLLRHIKLHSGEKPFKCPFCNYACRRRDALTGHLRTHSVSSPTVGKPYKCNYCGRSYKQQSTLEEHKERCHNYLQSLSTEAQALAGQPGDEIRDLEMVPDSMLHSSSERPTFIDRLANSLTKRKRSTPQKFVGEKQMRFSLSDLPYDVNSGGYEKDVELVAHHSLEPGFGSSLAFVGAEHLRPLRLPPTNCISELTPVISSVYTQMQPLPGRLELPGSREAGEGPEDLADGGPLLYRPRGPLTDPGASPSNGCQDSTDTESNHEDRVAGVVSLPQGPPPQPPPTIVVGRHSPAYAKEDPKPQEGLLRGTPGPSKEVLRVVGESGEPVKAFKCEHCRILFLDHVMFTIHMGCHGFRDPFECNICGYHSQDRYEFSSHIVRGEHKVG

SEQ ID NO: 39518 - protein, 585 aa, Homo sapiens; identical to SEQ ID NO: 39517
  Payload ID: 7912
  Gene Symbol: IKZF4
  Gene Name: IKAROS family zinc finger 4 (Eos)
  Uniprot ID: Q9H2S9
  ENSP ID: ENSP00000412101

SEQ ID NO: 39519 - protein, 585 aa, Homo sapiens; identical to SEQ ID NO: 39517
  Payload ID: 7912
  Gene Symbol: IKZF4
  Gene Name: IKAROS family zinc finger 4 (Eos)
  Uniprot ID: Q9H2S9
  ENSP ID: ENSP00000448419

SEQ ID NO: 39520 - protein, 10 aa, Homo sapiens
  Payload ID: 7912
  Gene Symbol: IKZF4
  Gene Name: IKAROS family zinc finger 4 (Eos)
  ENSP ID: ENSP00000449168
MHTPPALPRR

SEQ ID NO: 39521 - protein, 48 aa, Homo sapiens
  Payload ID: 7912
  Gene Symbol: IKZF4
  Gene Name: IKAROS family zinc finger 4 (Eos)
  ENSP ID: ENSP00000449857
MHTPPALPRRFQGGGRVRTPGSHRQGKDNVAGTHLWRRSSSGPQWGPR

SEQ ID NO: 39522 - protein, 540 aa, Homo sapiens
  Payload ID: 7912
  Gene Symbol: IKZF4
  Gene Name: IKAROS family zinc finger 4 (Eos)
  ENSP ID: ENSP00000450020
MTAVPLTSRNPRFLEGSGDSSLEKEFLGAPVGPSVSTPNSQHSSPSRSLSANSIKVEMYSDEESSRLLGPDERLLEKDDSVIVEDSLSEPLGYCDGSGPEPHSPGGIRLPNGKLKCDVCGMVCIGPNVLMVHKRSHTGERPFHCNQCGASFTQKGNLLRHIKLHSGEKPFKCPFCNYACRRRDALTGHLRTHSVSSPTVGKPYKCNYCGRSYKQQSTLEEHKERCHNYLQSLSTEAQALAGQPGDEIRDLEMVPDSMLHSSSERPTFIDRLANSLTKRKRSTPQKFVGEKQMRFSLSDLPYDVNSGGYEKDVELVAHHSLEPGFGSSLAFVGAEHLRPLRLPPTNCISELTPVISSVYTQMQPLPGRLELPGSREAGEGPEDLADGGPLLYRPRGPLTDPGASPSNGCQDSTDTESNHEDRVAGVVSLPQGPPPQPPPTIVVGRHSPAYAKEDPKPQEGLLRGTPGPSKEVLRVVGESGEPVKAFKCEHCRILFLDHVMFTIHMGCHGFRDPFECNICGYHSQDRYEFSSHIVRGEHKVG

SEQ ID NO: 39523 - protein, 419 aa, Homo sapiens
  Payload ID: 7913
  Gene Symbol: IKZF5
  Gene Name: IKAROS family zinc finger 5 (Pegasus)
  Uniprot ID: Q9H5V7
  ENSP ID: ENSP00000357881
MGEKKPEPLDFVKDFQEYLTQQTHHVNMISGSVSGDKEAEALQGAGTDGDQNGLDHPSVEVSLDENSGMLVDGFERTFDGKLKCRYCNYASKGTARLIEHIRIHTGEKPHRCHLCPFASAYERHLEAHMRSHTGEKPYKCELCSFRCSDRSNLSHHRRRKHKMVPIKGTRSSLSSKKMWGVLQKKTSNLGYSRRALINLSPPSMVVQKPDYLNDFTHEIPNIQTDSYESMAKTTPTGGLPRDPQELMVDNPLNQLSTLAGQLSSLPPENQNPASPDVVPCPDEKPFMIQQPSTQAVVSAVSASIPQSSSPTSPEPRPSHSQRNYSPVAGPSSEPSAHTSTPSIGNSQPSTPAPALPVQDPQLLHHCQHCDMYFADNILYTIHMGCHGYENPFQCNICGCKCKNKYDFACHFARGQHNQH

SEQ ID NO: 39524 - protein, 419 aa, Homo sapiens; identical to SEQ ID NO: 39523
  Payload ID: 7913
  Gene Symbol: IKZF5
  Gene Name: IKAROS family zinc finger 5 (Pegasus)
  Uniprot ID: Q9H5V7
  ENSP ID: ENSP00000478056

SEQ ID NO: 39525 - protein, 377 aa, Homo sapiens
  Payload ID: 7914
  Gene Symbol: IKBIP
  Gene Name: IKBKB interacting protein
  Uniprot ID: Q70UQ0
  ENSP ID: ENSP00000299157
MSEVKSRKKSGPKGAPAAEPGKRSEGGKTPVARSSGGGGWADPRTCLSLLSLGTCLGLAWFVFQQSEKFAKVENQYQLLKLETNEFQQLQSKISLISEKLESTESILQEATSSMSLMTQFEQEVSNLQDIMHDIQNNEEVLTQRMQSLNEKFQNITDFWKRSLEEMNINTDIFKSEAKHIHSQVTVQINSAEQEIKLLTERLKDLEDSTLRNIRTVKRQEEEDLLRVEEQLGSDTKAIEKLEEEQHALFARDEDLTNKLSDYEPKVEECKTHLPTIESAIHSVLRVSQDLIETEKKMEDLTMQMFNMEDDMLKAVSEIMEMQKTLEGIQYDNSILKMQNELDILKEKVHDFIAYSSTGEKGTLKEYNIENKGIGGDF

SEQ ID NO: 39526 - protein, 350 aa, Homo sapiens
  Payload ID: 7914
  Gene Symbol: IKBIP
  Gene Name: IKBKB interacting protein
  Uniprot ID: Q70UQ0
  ENSP ID: ENSP00000343471
MSEVKSRKKSGPKGAPAAEPGKRSEGGKTPVARSSGGGGWADPRTCLSLLSLGTCLGLAWFVFQQSEKFAKVENQYQLLKLETNEFQQLQSKISLISEKWQKSEAIMEQLKSFQIIAHLKRLQEEINEVKTWSNRITEKQDILNNSLTTLSQDITKVDQSTTSMAKDVGLKITSVKTDIRRISGLVTDVISLTDSVQELENKIEKVEKNTVKNIGDLLSSSIDRTATLRKTASENSQRINSVKKTLTELKSDFDKHTDRFLSLEGDRAKVLKTVTFANDLKPKVYNLKKDFSRLEPLVNDLTLRIGRLVTDLLQREKEIAFLSEKISNLTIVQAEIKDIKDEIAHISDMN

SEQ ID NO: 39527 - protein, 70 aa, Homo sapiens
  Payload ID: 7914
  Gene Symbol: IKBIP
  Gene Name: IKBKB interacting protein
  Uniprot ID: Q70UQ0
  ENSP ID: ENSP00000376762
MSEVKSRKKSGPKGAPAAEPGKRSEGGKTPVARSSGGGGWADPRTCLSLLSLGTCLGLACGRNLKLSWNN

SEQ ID NO: 39528 - protein, 620 aa, Homo sapiens
  Payload ID: 7915
  Gene Symbol: ITK
  Gene Name: IL2-inducible T-cell kinase
  Uniprot ID: Q08881
  ENSP ID: ENSP00000398655
MNNFILLEEQLIKKSQQKRRTSPSNFKVRFFVLTKASLAYFEDRHGKKRTLKGSIELSRIKCVEIVKSDISIPCHYKYPFQVVHDNYLLYVFAPDRESRQRWVLALKEETRNNNSLVPKYHPNFWMDGKWRCCSQLEKLATGCAQYDPTKNASKKPLPPTPEDNRRPLWEPEETVVIALYDYQTNDPQELALRRNEEYCLLDSSEIHWWRVQDRNGHEGYVPSSYLVEKSPNNLETYEWYNKSISRDKAEKLLLDTGKEGAFMVRDSRTAGTYTVSVFTKAVVSENNPCIKHYHIKETNDNPKRYYVAEKYVFDSIPLLINYHQHNGGGLVTRLRYPVCFGRQKAPVTAGLRYGKWVIDPSELTFVQEIGSGQFGLVHLGYWLNKDKVAIKTIREGAMSEEDFIEEAEVMMKLSHPKLVQLYGVCLEQAPICLVFEFMEHGCLSDYLRTQRGLFAAETLLGMCLDVCEGMAYLEEACVIHRDLAARNCLVGENQVIKVSDFGMTRFVLDDQYTSSTGTKFPVKWASPEVFSFSRYSSKSDVWSFGVLMWEVFSEGKIPYENRSNSEVVEDISTGFRLYKPRLASTHVYQIMNHCWKERPEDRPAFSRLLRQLAEIAESGL

SEQ ID NO: 39529 - protein, 73 aa, Homo sapiens
  Payload ID: 7915
  Gene Symbol: ITK
  Gene Name: IL2-inducible T-cell kinase
  ENSP ID: ENSP00000430327
MDGKWRCCSQLEKLATGCAQYDPTKNASKKPLPPTPEDNRRPLWEPEETVVIALYDYQTNDPQELALRRNEEY

SEQ ID NO: 39530 - protein, 116 aa, Homo sapiens
  Payload ID: 7915
  Gene Symbol: ITK
  Gene Name: IL2-inducible T-cell kinase
  ENSP ID: ENSP00000431054
MNNFILLEEQLIKKSQQKRRTSPSNFKVRFFVLTKASLAYFEDRHGKKRTLKGSIELSRIKCVEIVKSDISIPCHYKYPFQVVHDNYLLYVFAPDRESRQRWVLALKEEKGSRYVA

SEQ ID NO: 39531 - protein, 632 aa, Homo sapiens
  Payload ID: 7916
  Gene Symbol: ILVBL
  Gene Name: ilvB (bacterial acetolactate synthase)-like
  Uniprot ID: A1L0T0
  ENSP ID: ENSP00000263383
METPAAAAPAGSLFPSFLLLACGTLVAALLGAAHRLGLFYQLLHKVDKASVRHGGENVAAVLRAHGVRFIFTLVGGHISPLLVACEKLGIRVVDTRHEVTAVFAADAMARLSGTVGVAAVTAGPGLTNTVTAVKNAQMAQSPILLLGGAASTLLQNRGALQAVDQLSLFRPLCKFCVSVRRVRDIVPTLRAAMAAAQSGTPGPVFVELPVDVLYPYFMVQKEMVPAKPPKGLVGRVVSWYLENYLANLFAGAWEPQPEGPLPLDIPQASPQQVQRCVEILSRAKRPLMVLGSQALLTPTSADKLRAAVETLGVPCFLGGMARGLLGRNHPLHIRENRSAALKKADVIVLAGTVCDFRLSYGRVLSHSSKIIIVNRNREEMLLNSDIFWKPQEAVQGDVGSFVLKLVEGLQGQTWAPDWVEELREADRQKEQTFREKAAMPVAQHLNPVQVLQLVEETLPDNSILVVDGGDFVGTAAHLVQPRGPLRWLDPGAFGTLGVGAGFALGAKLCRPDAEVWCLFGDGAFGYSLIEFDTFVRHKIPVMALVGNDAGWTQISREQVPSLGSNVACGLAYTDYHKAAMGLGARGLLLSRENEDQVVKVLHDAQQQCRDGHPVVVNILIGRTDFRDGSIAV

SEQ ID NO: 39532 - protein, 166 aa, Homo sapiens
  Payload ID: 7916
  Gene Symbol: ILVBL
  Gene Name: ilvB (bacterial acetolactate synthase)-like
  ENSP ID: ENSP00000433355
METPAAAAPAGSLFPSFLLLACGTLVAALLGAAHRLGLFYQLLHKVDKASVRHGGENVAAVLRAHGVRFIFTLVGGHISPLLVACEKLGIRVVDTRHEVTAVFAADAMARLSGTVGVAAVTAGPGLTNTVTAVKNAQMAQSPILLLGGAASTLLQNRGALQAVDQL

SEQ ID NO: 39533 - protein, 52 aa, Homo sapiens
  Payload ID: 7916
  Gene Symbol: ILVBL
  Gene Name: ilvB (bacterial acetolactate synthase)-like
  ENSP ID: ENSP00000434734
METPAAAAPAGSLFPSFLLLACGTLVAALLGAAHRLGLFYQLLHKGRWAWRQ

SEQ ID NO: 39534 - protein, 262 aa, Homo sapiens
  Payload ID: 7916
  Gene Symbol: ILVBL
  Gene Name: ilvB (bacterial acetolactate synthase)-like
  ENSP ID: ENSP00000435516
METPAAAAPAGSLFPSFLLLACGTLVAALLGAAHRLGLFYQLLHKVDKASVRHGGENVAAVLRAHGVRFIFTLVGGHISPLLVACEKLGIRVVDTRHEVTAVFAADAMARLSGTVGVAAVTAGPGLTNTVTAVKNAQMAQSPILLLGGAASTLLQNRGALQAVDQLSLFRPLCKFCVSVRRVRDIVPTLRAAMAAAQSGTPGPVFVELPVDVLYPYFMVQKEMVPAKPPKGLVGRVVSWYLENYLANLFAGAWEPQPEGPLP

SEQ ID NO: 39535 - protein, 229 aa, Homo sapiens
  Payload ID: 7916
  Gene Symbol: ILVBL
  Gene Name: ilvB (bacterial acetolactate synthase)-like
  ENSP ID: ENSP00000470834
MVQKEMVPAKPPKGLVGRVVSWYLENYLANLFAGAWEPQPEGPLPLDIPQASPQQVQRCVEILSRAKRPLMVLGSQALLTPTSADKLRAAVETLGVPCFLGGMARGLLGRNHPLHIRENRSAALKKADVIVLAGTVCDFRLSYGRVLSHSSKIIIVNRNREEMLLNSDIFWKPQEAVQGDVGSFVLKLVEGLQGQTWAPDWVEELREADRQKEQTFREKAAMPVAQHLN

SEQ ID NO: 39536 - protein, 525 aa, Homo sapiens
  Payload ID: 7916
  Gene Symbol: ILVBL
  Gene Name: ilvB (bacterial acetolactate synthase)-like
  ENSP ID: ENSP00000470942
MARLSGTVGVAAVTAGPGLTNTVTAVKNAQMAQSPILLLGGAASTLLQNRGALQAVDQLSLFRPLCKFCVSVRRVRDIVPTLRAAMAAAQSGTPGPVFVELPVDVLYPYFMVQKEMVPAKPPKGLVGRVVSWYLENYLANLFAGAWEPQPEGPLPLDIPQASPQQVQRCVEILSRAKRPLMVLGSQALLTPTSADKLRAAVETLGVPCFLGGMARGLLGRNHPLHIRENRSAALKKADVIVLAGTVCDFRLSYGRVLSHSSKIIIVNRNREEMLLNSDIFWKPQEAVQGDVGSFVLKLVEGLQGQTWAPDWVEELREADRQKEQTFREKAAMPVAQHLNPVQVLQLVEETLPDNSILVVDGGDFVGTAAHLVQPRGPLRWLDPGAFGTLGVGAGFALGAKLCRPDAEVWCLFGDGAFGYSLIEFDTFVRHKIPVMALVGNDAGWTQISREQVPSLGSNVACGLAYTDYHKAAMGLGARGLLLSRENEDQVVKVLHDAQQQCRDGHPVVVNILIGRTDFRDGSIAV

SEQ ID NO: 39537 - protein, 165 aa, Homo sapiens
  Payload ID: 7916
  Gene Symbol: ILVBL
  Gene Name: ilvB (bacterial acetolactate synthase)-like
  ENSP ID: ENSP00000471762
MARLSGTVGVAAVTAGPGLTNTVTAVKNAQMAQSPILLLGGAASTLLQNRGALQAVDQLSLFRPLCKFCVSVRRVRDIVPTLRAAMAAAQSGTPGPVFVELPVDVLYPYFMVQKEMVPAKPPKGLVGRVVSWYLENYLANLFAGAWEPQPEGPLPLDIPQASPQQ

SEQ ID NO: 39538 - protein, 206 aa, Homo sapiens
  Payload ID: 7917
  Gene Symbol: ICT1
  Gene Name: immature colon carcinoma transcript 1
  Uniprot ID: Q14197
  ENSP ID: ENSP00000301585
MAATRCLRWGLSRAGVWLLPPPARCPRRALHKQKDGTEFKSIYSLDKLYPESQGSDTAWRVPNGAKQADSDIPLDRLTISYCRSSGPGGQNVNKVNSKAEVRFHLATAEWIAEPVRQKIAITHKNKINRLGELILTSESSRYQFRNLADCLQKIRDMITEASQTPKEPTKEDVKLHRIRIENMNRERLRQKRIHSAVKTSRRVDMD

SEQ ID NO: 39539 - protein, 192 aa, Homo sapiens
  Payload ID: 7917
  Gene Symbol: ICT1
  Gene Name: immature colon carcinoma transcript 1
  ENSP ID: ENSP00000462256
MAATRCLRWGLSRAGVWLLPPPARCPRRALHKQKDGTEFKSIYSLDKLYPESQGSDTAWRVPNGAKQADSDIPLDRLTISYCRSSGPGGQNVNKVNSKAEVRFHLATAEWIAEPVRQKIAITFFICSLQHKNKINRLGELILTSESSRYQFRNLADCLQKIRDMITEASQTPKEPTKEDVKLHRIRIENMNR

SEQ ID NO: 39540 - protein, 71 aa, Homo sapiens
  Payload ID: 7917
  Gene Symbol: ICT1
  Gene Name: immature colon carcinoma transcript 1
  ENSP ID: ENSP00000464192
  MOD_RES (1)..(1): Any amino acid
XLLPPPARCPRRALHKQKDGTEFKSIYSLDKLYPESQGSDTAWRVPNGAKQADSDIPLERYLYLKGTPWIQ

SEQ ID NO: 39541 - protein, 223 aa, Homo sapiens
  Payload ID: 7918
  Gene Symbol: IER2
  Gene Name: immediate early response 2
  Uniprot ID: Q9BTL4
  ENSP ID: ENSP00000292433
MEVQKEAQRIMTLSVWKMYHSRMQRGGLRLHRSLQLSLVMRSARELYLSAKVEALEPEVSLPAALPSDPRLHPPREAESTAETATPDGEHPFPEPMDTQEAPTAEETSACCAPRPAKVSRKRRSSSLSDGGDAGLVPSKKARLEEKEEEEGASSEVADRLQPPPAQAEGAFPNLARVLQRRFSGLLNCSPAAPPTAPPACEAKPACRPADSMLNVLVRAVVAF

SEQ ID NO: 39542 - protein, 223 aa, Homo sapiens; identical to SEQ ID NO: 39541
  Payload ID: 7918
  Gene Symbol: IER2
  Gene Name: immediate early response 2
  Uniprot ID: Q9BTL4
  ENSP ID: ENSP00000465617

SEQ ID NO: 39543 - protein, 223 aa, Homo sapiens; identical to SEQ ID NO: 39541
  Payload ID: 7918
  Gene Symbol: IER2
  Gene Name: immediate early response 2
  Uniprot ID: Q9BTL4
  ENSP ID: ENSP00000467294

SEQ ID NO: 39544 - protein, 156 aa, Homo sapiens
  Payload ID: 7919
  Gene Symbol: IER3
  Gene Name: immediate early response 3
  Uniprot ID: P46695
  ENSP ID: ENSP00000259874
MCHSRSCHPTMTILQAPTPAPSTIPGPRRGSGPEIFTFDPLPEPAAAPAGRPSASRGHRKRSRRVLYPRVVRRQLPVEEPNPAKRLLFLLLTIVFCQILMAEEGVPAPLPPEDAPNAASLAPTPVSAVLEPFNLTSEPSDYALDLSTFLQQHPAAF

SEQ ID NO: 39545 - protein, 138 aa, Homo sapiens
  Payload ID: 7919
  Gene Symbol: IER3
  Gene Name: immediate early response 3
  ENSP ID: ENSP00000365557
MCHSRSCHPTMTILQAPTPAPSTIPGPRRGSGPEIFTFDPLPEPAAAPAGRPSASRGHRKRSRRVLYPRVVSIAEVGIRGVRCPGVTGERPDSRGLDLTCLLFCLPLGPAPAASRGTEPSQKASLSAAHHRLLPDPDG

SEQ ID NO: 39546 - protein, 156 aa, Homo sapiens
  Payload ID: 7919
  Gene Symbol: IER3
  Gene Name: immediate early response 3
  Uniprot ID: P46695
  ENSP ID: ENSP00000373054
MCHSRSCHPTMTILQAPTPAPSTIPGPRRGSGPEIFTFDPLPEPAAAPAGRPSASRGHRKRSRRVLYPRVVRRQLPVEEPNPAKRLLFLLLTIVFCQILMAEEGVPAPLPPEDAPNAASLAPTPVSPVLEPFNLTSEPSDYALDLSTFLQQHPAAF

SEQ ID NO: 39547 - protein, 138 aa, Homo sapiens; identical to SEQ ID NO: 39545
  Payload ID: 7919
  Gene Symbol: IER3
  Gene Name: immediate early response 3
  ENSP ID: ENSP00000383354

SEQ ID NO: 39548 - protein, 138 aa, Homo sapiens; identical to SEQ ID NO: 39545
  Payload ID: 7919
  Gene Symbol: IER3
  Gene Name: immediate early response 3
  ENSP ID: ENSP00000394148

SEQ ID NO: 39549 - protein, 156 aa, Homo sapiens; identical to SEQ ID NO: 39546
  Payload ID: 7919
  Gene Symbol: IER3
  Gene Name: immediate early response 3
  Uniprot ID: P46695
  ENSP ID: ENSP00000397956

SEQ ID NO: 39550 - protein, 138 aa, Homo sapiens; identical to SEQ ID NO: 39545
  Payload ID: 7919
  Gene Symbol: IER3
  Gene Name: immediate early response 3
  ENSP ID: ENSP00000398052

SEQ ID NO: 39551 - protein, 156 aa, Homo sapiens; identical to SEQ ID NO: 39546
  Payload ID: 7919
  Gene Symbol: IER3
  Gene Name: immediate early response 3
  Uniprot ID: P46695
  ENSP ID: ENSP00000398139

SEQ ID NO: 39552 - protein, 156 aa, Homo sapiens; identical to SEQ ID NO: 39546
  Payload ID: 7919
  Gene Symbol: IER3
  Gene Name: immediate early response 3
  Uniprot ID: P46695
  ENSP ID: ENSP00000406245

SEQ ID NO: 39553 - protein, 138 aa, Homo sapiens; identical to SEQ ID NO: 39545
  Payload ID: 7919
  Gene Symbol: IER3
  Gene Name: immediate early response 3
  ENSP ID: ENSP00000411106

SEQ ID NO: 39554 - protein, 156 aa, Homo sapiens; identical to SEQ ID NO: 39546
  Payload ID: 7919
  Gene Symbol: IER3
  Gene Name: immediate early response 3
  Uniprot ID: P46695
  ENSP ID: ENSP00000412283

SEQ ID NO: 39555 - protein, 138 aa, Homo sapiens; identical to SEQ ID NO: 39545
  Payload ID: 7919
  Gene Symbol: IER3
  Gene Name: immediate early response 3
  ENSP ID: ENSP00000412861

SEQ ID NO: 39556 - protein, 82 aa, Homo sapiens
  Payload ID: 7920
  Gene Symbol: IER3IP1
  Gene Name: immediate early response 3 interacting protein 1
  Uniprot ID: Q9Y5U9
  ENSP ID: ENSP00000256433
MAFTLYSLLQAALLCVNAIAVLHEERFLKNIGWGTDQGIGGFGEEPGIKSQLMNLIRSVRTVMRVPLIIVNSIAIVLLLLFG

SEQ ID NO: 39557 - protein, 327 aa, Homo sapiens
  Payload ID: 7921
  Gene Symbol: IER5
  Gene Name: immediate early response 5
  Uniprot ID: Q5VY09
  ENSP ID: ENSP00000356549
MEFKLEAHRIVSISLGKIYNSRVQRGGIKLHKNLLVSLVLRSARQVYLSDPCPGLYLAGPAGTPAPPPQQQPGEPAAGPPAGWGEPPPPAARASWPETEPQPERSSVSDAPRVGDEVPVATVTGVGDVFQGGEADATEAAWSRVEGPRQAAAREAEGTAGGWGVFPEVSRAARRPCGCPLGGEDPPGTPAATPRAACCCAPQPAEDEPPAPPAVCPRKRCAAGVGGGPAGCPAPGSTPLKKPRRNLEQPPSGGEDDDAEEMETGNVANLISIFGSSFSGLLRKSPGGGREEEEGEESGPEAAEPGQICCDKPVLRDMNPWSTAIVAF

SEQ ID NO: 39558 - protein, 404 aa, Homo sapiens
  Payload ID: 7922
  Gene Symbol: IER5L
  Gene Name: immediate early response 5-like
  Uniprot ID: Q5T953
  ENSP ID: ENSP00000361569
MECALDAQSLISISLRKIHSSRTQRGGIKLHKNLLVSYVLRNARQLYLSERYAELYRRQQQQQQQQPPHHQHQHLAYAAPGMPASAADFGPLQLGGGGDAEAREPAARHQLHQLHQLHQLHLQQQLHQHQHPAPRGCAAAAAAGAPAGGAGALSELPGCAALQPPHGAPHRGQPLEPLQPGPAPLPLPLPPPAPAALCPRDPRAPAACSAPPGAAPPAAAASPPASPAPASSPGFYRGAYPTPSDFGLHCSSQTTVLDLDTHVVTTVENGYLHQDCCASAHCPCCGQGAPGPGLASAAGCKRKYYPGQEEEEDDEEDAGGLGAEPPGGAPFAPCKRARFEDFCPDSSPDASNISNLISIFGSGFSGLVSRQPDSSEQPPPLNGQLCAKQALASLGAWTRAIVAF

SEQ ID NO: 39559 - protein, 463 aa, Homo sapiens
  Payload ID: 7923
  Gene Symbol: IRGC
  Gene Name: immunity-related GTPase family, cinema
  Uniprot ID: Q6NXR0
  ENSP ID: ENSP00000244314
MATSKLPVVPGEEENTILMAKERLEALRTAFESGDLPQAASHLQELLASTESIRLEVGVTGESGAGKSSLINALRGLEAEDPGAALTGVMETTMQPSPYPHPQFPDVTLWDLPGAGSPGCPADKYLKQVDFSRYDFFLLVSPRRCGAVETRLAAEILCQGKKFYFVRTKVDEDLAATRTQRPSGFREAAVLQEIRDHCAERLREAGVADPRIFLVSNLSPARYDFPTLVSTWEHDLPSHRRHAGLLSLPDISLEALQKKKAMLQEQVLKTALVLGVIQALPVPGLAAAYDDALLIHSLRGYHRSFGLDDDSLAKLAEQVGKQAGDLRSVIRSPLANEVSPETVLRLYSQSSDGAMRVARAFERGIPVFGTLVAGGISFGAVYTMLQGCLNEMAEDAQRVRIKALEDDEPQPEVSLEVASDNGVEKGGSGEGGGEEAPLSTCRKLGLLLKYILDSWKKHDSEEK

SEQ ID NO: 39560 - protein, 275 aa, Homo sapiens
  Payload ID: 7923
  Gene Symbol: IRGC
  Gene Name: immunity-related GTPase family, cinema
  ENSP ID: ENSP00000471425
MPRPRRCEWLPSPLQALRITHPVTLPCPPPPSEPLATMATSKLPVVPGEEENTILMAKERLEALRTAFESGDLPQAASHLQELLASTESIRLEVGVTGESGAGKSSLINALRGLEAEDPGAALTGVMETTMQPSPYPHPQFPDVTLWDLPGAGSPGCPADKYLKQVDFSRYDFFLLVSPRRCGAVETRLAAEILCQGKKFYFVRTKVDEDLAATRTQRPSGFREAAVLQEIRDHCAERLREAGVADPRIFLVSNLSPARYDFPTLVSTWEHDLPS

SEQ ID NO: 39561 - protein, 181 aa, Homo sapiens
  Payload ID: 7924
  Gene Symbol: IRGM
  Gene Name: immunity-related GTPase family, M
  Uniprot ID: A1A4Y4
  ENSP ID: ENSP00000428220
MEAMNVEKASADGNLPEVISNIKETLKIVSRTPVNITMAGDSGNGMSTFISALRNTGHEGKASPPTELVKATQRCASYFSSHFSNVVLWDLPGTGSATTTLENYLMEMQFNRYDFIMVASAQFSMNHVMLAKTAEDMGKKFYIVWTKLDMDLSTGALPEVQLLQIRENVLENLQKERVCEY

SEQ ID NO: 39562 - protein, 71 aa, Homo sapiens
  Payload ID: 7924
  Gene Symbol: IRGM
  Gene Name: immunity-related GTPase family, M
  ENSP ID: ENSP00000429819
  MOD_RES (1)..(1): Any amino acid
XNHVMLAKTAEDMGKKFYIVWTKLDMDLSTGALPEVQLLQIRENVLENLQKERSSRNQQVYPNHSHVPLAC

SEQ ID NO: 39563 - protein, 623 aa, Homo sapiens
  Payload ID: 7925
  Gene Symbol: IRGQ
  Gene Name: immunity-related GTPase family, Q
  Uniprot ID: Q8WZA9
  ENSP ID: ENSP00000387535
MPPPQGDVTALFLGPPGLGKSALIAALCDKDVETLEAPEGRPDSGVPSLRAAGPGLFLGELSCPPAAPGPWAAEANVLVLVLPGPEGNGEPLAPALGEAALAALARGTPLLAVRNLRPGDSQTAAQARDQTAALLNSAGLGAADLFVLPANCGSSDGCEELERLRAALQSQAEALRRLLPPAQDGFEVLGAAELEAVREAFETGGLEAALSWVRSGLERLGSARLDLAVAGKADVGLVVDMLLGLDPGDPGAAPASVPTAPTPFPAPERPNVVLWTVPLGHTGTATTAAAASHPTHYDALILVTPGAPTEKDWAQVQALLLPDAPLVCVRTDGEGEDPECLGEGKMENPKGESLKNAGGGGLENALSKGREKCSAGSQKAGSGEGPGKAGSEGLQQVVGMKKSGGGDSERAAALSPEDETWEVLEEAPPPVFPLRPGGLPGLCEWLRRALPPAQAGALLLALPPASPSAARTKAAALRAGAWRPALLASLAAAAAPLPGLGWACDVALLRGQLAEWRRGLGLEPTALARRERALGLASGELAARAHFPGPVTRAEVEARLGAWAGEGTAGGAALGALSFLWPAGGAAATGGLGYRAAHGVLLQALDEMRADAEAVLAPPEPAQ

SEQ ID NO: 39564 - protein, 136 aa, Homo sapiens
  Payload ID: 7925
  Gene Symbol: IRGQ
  Gene Name: immunity-related GTPase family, Q
  ENSP ID: ENSP00000470686
MPPPQGDVTALFLGPPGLGKSALIAALCDKDVETLEAPEGRPDSGVPSLRAAGPGLFLGELSCPPAAPGPWAAEANVLVLVLPGPEGNGEPLAPALGEAALAALARGTPLLAVRNLRPGDSQTAAQARDQTAALLN

SEQ ID NO: 39565 - protein, 623 aa, Homo sapiens; identical to SEQ ID NO: 39563
  Payload ID: 7925
  Gene Symbol: IRGQ
  Gene Name: immunity-related GTPase family, Q
  Uniprot ID: Q8WZA9
  ENSP ID: ENSP00000472250

SEQ ID NO: 39566 - protein, 467 aa, Homo sapiens
  Payload ID: 7926
  Gene Symbol: IGSF21
  Gene Name: immunoglobin superfamily, member 21
  Uniprot ID: Q96ID5
  ENSP ID: ENSP00000251296
MRTAPSLRRCVCLLLAAILDLARGYLTVNIEPLPPVVAGDAVTLKCNFKTDGRMREIVWYRVTDGGTIKQKIFTFDAMFSTNYSHMENYRKREDLVYQSTVRLPEVRISDNGPYECHVGIYDRATREKVVLASGNIFLNVMAPPTSIEVVAADTPAPFSRYQAQNFTLVCIVSGGKPAPMVYFKRDGEPIDAVPLSEPPAASSGPLQDSRPFRSLLHRDLDDTKMQKSLSLLDAENRGGRPYTERPSRGLTPDPNILLQPTTENIPETVVSREFPRWVHSAEPTYFLRHSRTPSSDGTVEVRALLTWTLNPQIDNEALFSCEVKHPALSMPMQAEVTLVAPKGPKIVMTPSRARVGDTVRILVHGFQNEVFPEPMFTWTRVGSRLLDGSAEFDGKELVLERVPAELNGSMYRCTAQNPLGSTDTHTRLIVFENPNIPRGTEDSNGSIGPTGARLTLVLALTVILELT

SEQ ID NO: 39567 - protein, 339 aa, Homo sapiens
  Payload ID: 7927
  Gene Symbol: IGBP1
  Gene Name: immunoglobulin (CD79A) binding protein 1
  Uniprot ID: P78318
  ENSP ID: ENSP00000348784
MAAEDELQLPRLPELFETGRQLLDEVEVATEPAGSRIVQEKVFKGLDLLEKAAEMLSQLDLFSRNEDLEEIASTDLKYLLVPAFQGALTMKQVNPSKRLDHLQRAREHFINYLTQCHCYHVAEFELPKTMNNSAENHTANSSMAYPSLVAMASQRQAKIQRYKQKKELEHRLSAMKSAVESGQADDERVREYYLLHLQRWIDISLEEIESIDQEIKILRERDSSREASTSNSSRQERPPVKPFILTRNMAQAKVFGAGYPSLPTMTVSDWYEQHRKYGALPDQGIAKAAPEEFRKAAQQQEEQEEKEEEDDEQTLHRAREWDDWKDTHPRGYGNRQNMG

SEQ ID NO: 39568 - protein, 339 aa, Homo sapiens; identical to SEQ ID NO: 39567
  Payload ID: 7927
  Gene Symbol: IGBP1
  Gene Name: immunoglobulin (CD79A) binding protein 1
  Uniprot ID: P78318
  ENSP ID: ENSP00000363661

SEQ ID NO: 39569 - protein, 353 aa, Homo sapiens
  Payload ID: 7928
  Gene Symbol: IGHA1
  Gene Name: immunoglobulin heavy constant alpha 1
  Uniprot ID: P01876
  ENSP ID: ENSP00000374989
ASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCPVPSTPPTPSPSTPPTPSPSCCHPRLSLHRPALEDLLLGSEANLTCTLTGLRDASGVTFTWTPSSGKSAVQGPPERDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVDGTCY

SEQ ID NO: 39570 - protein, 353 aa, Homo sapiens; identical to SEQ ID NO: 39569
  Payload ID: 7928
  Gene Symbol: IGHA1
  Gene Name: immunoglobulin heavy constant alpha 1
  Uniprot ID: P01876
  ENSP ID: ENSP00000488021

SEQ ID NO: 39571 - protein, 340 aa, Homo sapiens
  Payload ID: 7929
  Gene Symbol: IGHA2
  Gene Name: immunoglobulin heavy constant alpha 2 (A2m marker)
  ENSP ID: ENSP00000374981
ASPTSPKVFPLSLDSTPQDGNVVVACLVQGFFPQEPLSVTWSESGQNVTARNFPPSQDASGDLYTTSSQLTLPATQCPDGKSVTCHVKHYTNSSQDVTVPCRVPPPPPCCHPRLSLHRPALEDLLLGSEANLTCTLTGLRDASGATFTWTPSSGKSAVQGPPERDLCGCYSVSSVLPGCAQPWNHGETFTCTAAHPELKTPLTANITKSGNTFRPEVHLLPPPSEELALNELVTLTCLARGFSPKDVLVRWLQGSQELPREKYLTWASRQEPSQGTTTYAVTSILRVAAEDWKKGETFSCMVGHEALPLAFTQKTIDRMAGKPTHINVSVVMAEADGTCY

SEQ ID NO: 39572 - protein, 340 aa, Homo sapiens
  Payload ID: 7929
  Gene Symbol: IGHA2
  Gene Name: immunoglobulin heavy constant alpha 2 (A2m marker)
  ENSP ID: ENSP00000478870
ASPTSPKVFPLSLDSTPQDGNVVVACLVQGFFPQEPLSVTWSESGQNVTARNFPPSQDASGDLYTTSSQLTLPATQCPDGKSVTCHVKHYTNPSQDVTVPCPVPPPPPCCHPRLSLHRPALEDLLLGSEANLTCTLTGLRDASGATFTWTPSSGKSAVQGPPERDLCGCYSVSSVLPGCAQPWNHGETFTCTAAHPELKTPLTANITKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVDGTCY

SEQ ID NO: 39573 - protein, 430 aa, Homo sapiens
  Payload ID: 7930
  Gene Symbol: IGHD
  Gene Name: immunoglobulin heavy constant delta
  ENSP ID: ENSP00000374998
  MOD_RES (1)..(1): Any amino acid
XPTKAPDVFPIISGCRHPKDNSPVVLACLITGYHPTSVTVTWYMGTQSQPQRTFPEIQRRDSYYMTSSQLSTPLQQWRQGEYKCVVQHTASKSKKEIFRWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLNHPSLPPQRLMALREPAAQAPVKLSLNLLASSDPPEAASWLLCEVSGFSPPNILLMWLEDQREVNTSGFAPARPPPQPRSTTFWAWSVLRVPAPPSPQPATYTCVVSHEDSRTLLNASRSLEVSYLAMTPLIPQSKDENSDDYTTFDDVGSLWTTLSTFVALFILTLLYSGIVTFIKVK

SEQ ID NO: 39574 - protein, 384 aa, Homo sapiens
  Payload ID: 7930
  Gene Symbol: IGHD
  Gene Name: immunoglobulin heavy constant delta
  ENSP ID: ENSP00000478571
APTKAPDVFPIISGCRHPKDNSPVVLACLITGYHPTSVTVTWYMGTQSQPQRTFPEIQRRDSYYMTSSQLSTPLQQWRQGEYKCVVQHTASKSKKEIFRWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLNHPSLPPQRLMALREPAAQAPVKLSLNLLASSDPPEAASWLLCEVSGFSPPNILLMWLEDQREVNTSGFAPARPPPQPRSTTFWAWSVLRVPAPPSPQPATYTCVVSHEDSRTLLNASRSLEVSYVTDHGPMK

SEQ ID NO: 39575 - protein, 384 aa, Homo sapiens; identical to SEQ ID NO: 39574
  Payload ID: 7930
  Gene Symbol: IGHD
  Gene Name: immunoglobulin heavy constant delta
  ENSP ID: ENSP00000478893

SEQ ID NO: 39576 - protein, 430 aa, Homo sapiens; identical to SEQ ID NO: 39573
  Payload ID: 7930
  Gene Symbol: IGHD
  Gene Name: immunoglobulin heavy constant delta
  ENSP ID: ENSP00000488303
  MOD_RES (1)..(1): Any amino acid

SEQ ID NO: 39577 - protein, 428 aa, Homo sapiens
  Payload ID: 7931
  Gene Symbol: IGHE
  Gene Name: immunoglobulin heavy constant epsilon
  Uniprot ID: P01854
  ENSP ID: ENSP00000374983
ASTQSPSVFPLTRCCKNIPSNATSVTLGCLATGYFPEPVMVTWDTGSLNGTTMTLPATTLTLSGHYATISLLTVSGAWAKQMFTCRVAHTPSSTDWVDNKTFSVCSRDFTPPTVKILQSSCDGGGHFPPTIQLLCLVSGYTPGTINITWLEDGQVMDVDLSTASTTQEGELASTQSELTLSQKHWLSDRTYTCQVTYQGHTFEDSTKKCADSNPRGVSAYLSRPSPFDLFIRKSPTITCLVVDLAPSKGTVNLTWSRASGKPVNHSTRKEEKQRNGTLTVTSTLPVGTRDWIEGETYQCRVTHPHLPRALMRSTTKTSGPRAAPEVYAFATPEWPGSRDKRTLACLIQNFMPEDISVQWLHNEVQLPDARHSTTQPRKTKGSGFFVFSRLEVTRAEWEQKDEFICRAVHEAASPSQTVQRAVSVNPGK

SEQ ID NO: 39578 - protein, 428 aa, Homo sapiens; identical to SEQ ID NO: 39577
  Payload ID: 7931
  Gene Symbol: IGHE
  Gene Name: immunoglobulin heavy constant epsilon
  Uniprot ID: P01854
  ENSP ID: ENSP00000481089

SEQ ID NO: 39579 - protein, 295 aa, Homo sapiens
  Payload ID: 7932
  Gene Symbol: IGHG1
  Gene Name: immunoglobulin heavy constant gamma 1 (G1m marker)
  ENSP ID: ENSP00000374984
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 39580 - protein, 399 aa, Homo sapiens
  Payload ID: 7932
  Gene Symbol: IGHG1
  Gene Name: immunoglobulin heavy constant gamma 1 (G1m marker)
  ENSP ID: ENSP00000374990
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPELQLEESCAEAQDGELDGLWTTITIFITLFLLSVCYSATVTFFKVKWIFSSVVDLKQTIIPDYRNMIGQGA

SEQ ID NO: 39581 - protein, 330 aa, Homo sapiens [sequence omitted]

SEQ ID NO: 39582 - protein, 462 aa, Homo sapiens
  Payload ID: 7932
  Gene Symbol: IGHG1
  Gene Name: immunoglobulin heavy constant gamma 1 (G1m marker)
  ENSP ID: ENSP00000478578
MKHLWFFLLLVAAPRWVLSQVQLQESGPGLVKPSGTLSLTCAVSGGSISSSNWWSWVRQPPGKGLEWIGEIYHSGSTNYNPSLKSRVTISVDKSKNQFSLKLSSVTAADTAVSQCDNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 39583 - protein, 473 aa, Homo sapiens
  Payload ID: 7932
  Gene Symbol: IGHG1
  Gene Name: immunoglobulin heavy constant gamma 1 (G1m marker)
  ENSP ID: ENSP00000478845
MEFGLSWVFLVAILKGVQCEVQLVESGGGVVRPGGSLRLSFAASGFTFDDYGMSWVRQAPGKGLEWVSGINWNGGSTDYVDSVKGRFTISRDNAKNSLYLQMNSLRAEDTAVYYCARDTVRGSQYYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 39584 - protein, 464 aa, Homo sapiens
  Payload ID: 7932
  Gene Symbol: IGHG1
  Gene Name: immunoglobulin heavy constant gamma 1 (G1m marker)
  ENSP ID: ENSP00000481569
MEFGLSWVFLVAILKGVQCEVQLVESGGGLVQPGGSLRLSCAASGFTFSSYWMSWVRQAPGKGLEWVPVISGSGSTMYYADSVKGRFTISRDNTKNSLYLQMNRLRAEDAAAYDCERYDYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 39585 - protein, 475 aa, Homo sapiens
  Payload ID: 7932
  Gene Symbol: IGHG1
  Gene Name: immunoglobulin heavy constant gamma 1 (G1m marker)
  ENSP ID: ENSP00000483341
MDWTWRILFLVAAATGAHSQVQLVQSGAEVKKPGASVKVSCKASGYTFTGYYMHWVRQAPGQGLEWMGWINPNSGGTNYAQKFQGWVTMTRDTSISTAYMELSRLRSDDTAVYYCAREDGHSAIDYYYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 39586 - protein, 466 aa, Homo sapiens
  Payload ID: 7932
  Gene Symbol: IGHG1
  Gene Name: immunoglobulin heavy constant gamma 1 (G1m marker)
  ENSP ID: ENSP00000483889
MELGLSWVFLVAILEGVQCEVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARECDNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 39587 - protein, 399 aa, Homo sapiens; identical to SEQ ID NO: 39580
  Payload ID: 7932
  Gene Symbol: IGHG1
  Gene Name: immunoglobulin heavy constant gamma 1 (G1m marker)
  ENSP ID: ENSP00000487867

SEQ ID NO: 39588 - protein, 330 aa, Homo sapiens [sequence omitted]

SEQ ID NO: 39589 - protein, 295 aa, Homo sapiens; identical to SEQ ID NO: 39579
  Payload ID: 7932
  Gene Symbol: IGHG1
  Gene Name: immunoglobulin heavy constant gamma 1 (G1m marker)
  ENSP ID: ENSP00000488811

SEQ ID NO: 39590 - protein, 326 aa, Homo sapiens
  Payload ID: 7933
  Gene Symbol: IGHG2
  Gene Name: immunoglobulin heavy constant gamma 2 (G2m marker)
  Uniprot ID: P01859
  ENSP ID: ENSP00000374987
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGK

SEQ ID NO: 39591 - protein, 326 aa, Homo sapiens; identical to SEQ ID NO: 39590
  Payload ID: 7933
  Gene Symbol: IGHG2
  Gene Name: immunoglobulin heavy constant gamma 2 (G2m marker)
  Uniprot ID: P01859
  ENSP ID: ENSP00000480351

SEQ ID NO: 39592 - protein, 377 aa, Homo sapiens
  Payload ID: 7934
  Gene Symbol: IGHG3
  Gene Name: immunoglobulin heavy constant gamma 3 (G3m marker)
  ENSP ID: ENSP00000374993
  MOD_RES (1)..(1): Any amino acid
XSTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 39593 - protein, 521 aa, Homo sapiens
  Payload ID: 7934
  Gene Symbol: IGHG3
  Gene Name: immunoglobulin heavy constant gamma 3 (G3m marker)
  ENSP ID: ENSP00000479626
MDTLCSTLLLLTIPSWVLSQITLKESGPTLVKPTQTLTLTCTFSGFSLSTSGVGVGWIRQPPGKALEWLALIYWDDDKRYSPSLKSRLTITKDTSKNQVVLTMTNMDPVDTATYYCAHRPQRHSGTSSWLNTSWGQGTLVTVSSASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 39594 - protein, 517 aa, Homo sapiens
  Payload ID: 7934
  Gene Symbol: IGHG3
  Gene Name: immunoglobulin heavy constant gamma 3 (G3m marker)
  ENSP ID: ENSP00000483967
MDWTWRILFLVAAATGAHSQVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARHSVKTHCDYFDYWGQGTLVTVSSASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 39595 - protein, 377 aa, Homo sapiens; identical to SEQ ID NO: 39592
  Payload ID: 7934
  Gene Symbol: IGHG3
  Gene Name: immunoglobulin heavy constant gamma 3 (G3m marker)
  ENSP ID: ENSP00000487823
  MOD_RES (1)..(1): Any amino acid

SEQ ID NO: 39596 - protein, 327 aa, Homo sapiens
  Payload ID: 7935
  Gene Symbol: IGHG4
  Gene Name: immunoglobulin heavy constant gamma 4 (G4m marker)
  Uniprot ID: P01861
  ENSP ID: ENSP00000374985
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 39597 - protein, 327 aa, Homo sapiens; identical to SEQ ID NO: 39596
  Payload ID: 7935
  Gene Symbol: IGHG4
  Gene Name: immunoglobulin heavy constant gamma 4 (G4m marker)
  Uniprot ID: P01861
  ENSP ID: ENSP00000483393

SEQ ID NO: 39598 - protein, 453 aa, Homo sapiens
  Payload ID: 7936
  Gene Symbol: IGHM
  Gene Name: immunoglobulin heavy constant mu
  ENSP ID: ENSP00000375001
GSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLGQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 39599 - protein, 599 aa, Homo sapiens
  Payload ID: 7936
  Gene Symbol: IGHM
  Gene Name: immunoglobulin heavy constant mu
  ENSP ID: ENSP00000477756
MSVSFLIFLPVLGLPWGVLSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREYYYGSGSDNWFDPWGQGTLVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLGQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 39600 - protein, 588 aa, Homo sapiens
  Payload ID: 7936
  Gene Symbol: IGHM
  Gene Name: immunoglobulin heavy constant mu
  ENSP ID: ENSP00000479328
MELGLRWVFLVAILEGVQCEVQLVESGGGLVKPGGSLRLSCAASGFTFSSYSMNWVRQAPGKGLEWVSYISSSSSYTNYADSVKGRFTISRDNAKNSLYLQMNSLRAEDTAVYYCARDTVRGGQWGQGTLVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLGQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 39601 - protein, 453 aa, Homo sapiens; identical to SEQ ID NO: 39598
  Payload ID: 7936
  Gene Symbol: IGHM
  Gene Name: immunoglobulin heavy constant mu
  ENSP ID: ENSP00000485962

SEQ ID NO: 39602 - protein, 5 aa, Homo sapiens
  Payload ID: 7937
  Gene Symbol: IGHD1OR15-1A
  Gene Name: immunoglobulin heavy diversity 1/OR15-1A (non-functional)
  ENSP ID: ENSP00000473787
GITGT

SEQ ID NO: 39603 - protein, 5 aa, Homo sapiens
  Payload ID: 7938
  Gene Symbol: IGHD1OR15-1B
  Gene Name: immunoglobulin heavy diversity 1/OR15-1B (non-functional)
  ENSP ID: ENSP00000474222
GITGT

SEQ ID NO: 39604 - protein, 5 aa, Homo sapiens
  Payload ID: 7939
  Gene Symbol: IGHD1-1
  Gene Name: immunoglobulin heavy diversity 1-1
  ENSP ID: ENSP00000418625
GTTGT

SEQ ID NO: 39605 - protein, 5 aa, Homo sapiens
  Payload ID: 7939
  Gene Symbol: IGHD1-1
  Gene Name: immunoglobulin heavy diversity 1-1
  ENSP ID: ENSP00000488840
GTTGT

SEQ ID NO: 39606 - protein, 5 aa, Homo sapiens
  Payload ID: 7940
  Gene Symbol: IGHD1-14
  Gene Name: immunoglobulin heavy diversity 1-14 (non-functional)
  ENSP ID: ENSP00000418765
GITGT

SEQ ID NO: 39607 - protein, 5 aa, Homo sapiens
  Payload ID: 7940
  Gene Symbol: IGHD1-14
  Gene Name: immunoglobulin heavy diversity 1-14 (non-functional)
  ENSP ID: ENSP00000488522
GITGT

SEQ ID NO: 39608 - protein, 5 aa, Homo sapiens
  Payload ID: 7941
  Gene Symbol: IGHD1-20
  Gene Name: immunoglobulin heavy diversity 1-20
  ENSP ID: ENSP00000420556
GITGT

SEQ ID NO: 39609 - protein, 5 aa, Homo sapiens
  Payload ID: 7941
  Gene Symbol: IGHD1-20
  Gene Name: immunoglobulin heavy diversity 1-20
  ENSP ID: ENSP00000487812
GITGT

SEQ ID NO: 39610 - protein, 6 aa, Homo sapiens
  Payload ID: 7942
  Gene Symbol: IGHD1-26
  Gene Name: immunoglobulin heavy diversity 1-26
  ENSP ID: ENSP00000420733
GIVGAT

SEQ ID NO: 39611 - protein, 6 aa, Homo sapiens
  Payload ID: 7942
  Gene Symbol: IGHD1-26
  Gene Name: immunoglobulin heavy diversity 1-26
  ENSP ID: ENSP00000488000
GIVGAT

SEQ ID NO: 39612 - protein, 5 aa, Homo sapiens
  Payload ID: 7943
  Gene Symbol: IGHD1-7
  Gene Name: immunoglobulin heavy diversity 1-7
  ENSP ID: ENSP00000420794
GITGT

SEQ ID NO: 39613 - protein, 5 aa, Homo sapiens
  Payload ID: 7943
  Gene Symbol: IGHD1-7
  Gene Name: immunoglobulin heavy diversity 1-7
  ENSP ID: ENSP00000488720
GITGT

SEQ ID NO: 39614 - protein, 8 aa, Homo sapiens
  Payload ID: 7944
  Gene Symbol: IGHD2OR15-2A
  Gene Name: immunoglobulin heavy diversity 2/OR15-2A (non-functional)
  ENSP ID: ENSP00000474065
RILYYFLC

SEQ ID NO: 39615 - protein, 8 aa, Homo sapiens
  Payload ID: 7945
  Gene Symbol: IGHD2OR15-2B
  Gene Name: immunoglobulin heavy diversity 2/OR15-2B (non-functional)
  ENSP ID: ENSP00000474017
RILYYFLC

SEQ ID NO: 39616 - protein, 8 aa, Homo sapiens
  Payload ID: 7946
  Gene Symbol: IGHD2-15
  Gene Name: immunoglobulin heavy diversity 2-15
  ENSP ID: ENSP00000427969
RILWWLLL

SEQ ID NO: 39617 - protein, 8 aa, Homo sapiens
  Payload ID: 7946
  Gene Symbol: IGHD2-15
  Gene Name: immunoglobulin heavy diversity 2-15
  ENSP ID: ENSP00000487993
RILWWLLL

SEQ ID NO: 39618 - protein, 8 aa, Homo sapiens
  Payload ID: 7947
  Gene Symbol: IGHD2-2
  Gene Name: immunoglobulin heavy diversity 2-2
  ENSP ID: ENSP00000430788
RILYQLLC

SEQ ID NO: 39619 - protein, 8 aa, Homo sapiens
  Payload ID: 7947
  Gene Symbol: IGHD2-2
  Gene Name: immunoglobulin heavy diversity 2-2
  ENSP ID: ENSP00000487604
RILYQLLC

SEQ ID NO: 39620 - protein, 8 aa, Homo sapiens
  Payload ID: 7948
  Gene Symbol: IGHD2-21
  Gene Name: immunoglobulin heavy diversity 2-21
  ENSP ID: ENSP00000429324
SILWWLLF

SEQ ID NO: 39621 - protein, 8 aa, Homo sapiens
  Payload ID: 7948
  Gene Symbol: IGHD2-21
  Gene Name: immunoglobulin heavy diversity 2-21
  ENSP ID: ENSP00000487599
SILWWLLF

SEQ ID NO: 39622 - protein, 9 aa, Homo sapiens
  Payload ID: 7949
  Gene Symbol: IGHD2-8
  Gene Name: immunoglobulin heavy diversity 2-8
  ENSP ID: ENSP00000428616
RILYWCMLY

SEQ ID NO: 39623 - protein, 9 aa, Homo sapiens
  Payload ID: 7949
  Gene Symbol: IGHD2-8
  Gene Name: immunoglobulin heavy diversity 2-8
  ENSP ID: ENSP00000488083
RILYWCMLY

SEQ ID NO: 39624 - protein, 9 aa, Homo sapiens
  Payload ID: 7950
  Gene Symbol: IGHD3OR15-3A
  Gene Name: immunoglobulin heavy diversity 3/OR15-3A (non-functional)
  ENSP ID: ENSP00000474133
VLFLDWLLY

SEQ ID NO: 39625 - protein, 9 aa, Homo sapiens
  Payload ID: 7951
  Gene Symbol: IGHD3OR15-3B
  Gene Name: immunoglobulin heavy diversity 3/OR15-3B (non-functional)
  ENSP ID: ENSP00000474573
VLFLDWLLY

SEQ ID NO: 39626 - protein, 9 aa, Homo sapiens
  Payload ID: 7952
  Gene Symbol: IGHD3-10
  Gene Name: immunoglobulin heavy diversity 3-10
  ENSP ID: ENSP00000419773
VLLWFGELL

SEQ ID NO: 39627 - protein, 9 aa, Homo sapiens
  Payload ID: 7952
  Gene Symbol: IGHD3-10
  Gene Name: immunoglobulin heavy diversity 3-10
  ENSP ID: ENSP00000488475
VLLWFGELL

SEQ ID NO: 39628 - protein, 11 aa, Homo sapiens
  Payload ID: 7953
  Gene Symbol: IGHD3-16
  Gene Name: immunoglobulin heavy diversity 3-16
  ENSP ID: ENSP00000428366
VLLRLGELSLY

SEQ ID NO: 39629 - protein, 11 aa, Homo sapiens
  Payload ID: 7953
  Gene Symbol: IGHD3-16
  Gene Name: immunoglobulin heavy diversity 3-16
  ENSP ID: ENSP00000487787
VLLRLGELSLY

SEQ ID NO: 39630 - protein, 7 aa, Homo sapiens
  Payload ID: 7954
  Gene Symbol: IGHD3-22
  Gene Name: immunoglobulin heavy diversity 3-22
  ENSP ID: ENSP00000429952
VLLWLLL

SEQ ID NO: 39631 - protein, 7 aa, Homo sapiens
  Payload ID: 7954
  Gene Symbol: IGHD3-22
  Gene Name: immunoglobulin heavy diversity 3-22
  ENSP ID: ENSP00000488711
VLLWLLL

SEQ ID NO: 39632 - protein, 10 aa, Homo sapiens
  Payload ID: 7955
  Gene Symbol: IGHD3-3
  Gene Name: immunoglobulin heavy diversity 3-3
  ENSP ID: ENSP00000420442
VLRFLEWLLY

SEQ ID NO: 39633 - protein, 10 aa, Homo sapiens
  Payload ID: 7955
  Gene Symbol: IGHD3-3
  Gene Name: immunoglobulin heavy diversity 3-3
  ENSP ID: ENSP00000487903
VLRFLEWLLY

SEQ ID NO: 39634 - protein, 9 aa, Homo sapiens
  Payload ID: 7956
  Gene Symbol: IGHD3-9
  Gene Name: immunoglobulin heavy diversity 3-9
  ENSP ID: ENSP00000419583
VLRYFDWLL

SEQ ID NO: 39635 - protein, 9 aa, Homo sapiens
  Payload ID: 7956
  Gene Symbol: IGHD3-9
  Gene Name: immunoglobulin heavy diversity 3-9
  ENSP ID: ENSP00000487775
VLRYFDWLL

SEQ ID NO: 39636 - protein, 4 aa, Homo sapiens
  Payload ID: 7957
  Gene Symbol: IGHD4OR15-4A
  Gene Name: immunoglobulin heavy diversity 4/OR15-4A (non-functional)
  ENSP ID: ENSP00000474693
LWCL

SEQ ID NO: 39637 - protein, 4 aa, Homo sapiens
  Payload ID: 7958
  Gene Symbol: IGHD4OR15-4B
  Gene Name: immunoglobulin heavy diversity 4/OR15-4B (non-functional)
  ENSP ID: ENSP00000475053
LWCL

SEQ ID NO: 39638 - protein, 3 aa, Homo sapiens
  Payload ID: 7959
  Gene Symbol: IGHD4-11
  Gene Name: immunoglobulin heavy diversity 4-11 (non-functional)
  ENSP ID: ENSP00000430034
LQL

SEQ ID NO: 39639 - protein, 3 aa, Homo sapiens
  Payload ID: 7959
  Gene Symbol: IGHD4-11
  Gene Name: immunoglobulin heavy diversity 4-11 (non-functional)
  ENSP ID: ENSP00000488735
LQL

SEQ ID NO: 39640 - protein, 3 aa, Homo sapiens
  Payload ID: 7960
  Gene Symbol: IGHD4-17
  Gene Name: immunoglobulin heavy diversity 4-17
  ENSP ID: ENSP00000431089
LRL

SEQ ID NO: 39641 - protein, 3 aa, Homo sapiens
  Payload ID: 7960
  Gene Symbol: IGHD4-17
  Gene Name: immunoglobulin heavy diversity 4-17
  ENSP ID: ENSP00000488261
LRL

SEQ ID NO: 39642 - protein, 4 aa, Homo sapiens
  Payload ID: 7961
  Gene Symbol: IGHD4-23
  Gene Name: immunoglobulin heavy diversity 4-23 (non-functional)
  ENSP ID: ENSP00000430248
LRWL

SEQ ID NO: 39643 - protein, 4 aa, Homo sapiens
  Payload ID: 7961
  Gene Symbol: IGHD4-23
  Gene Name: immunoglobulin heavy diversity 4-23 (non-functional)
  ENSP ID: ENSP00000488168
LRWL

SEQ ID NO: 39644 - protein, 3 aa, Homo sapiens
  Payload ID: 7962
  Gene Symbol: IGHD4-4
  Gene Name: immunoglobulin heavy diversity 4-4
  ENSP ID: ENSP00000428393
LQL

SEQ ID NO: 39645 - protein, 3 aa, Homo sapiens
  Payload ID: 7962
  Gene Symbol: IGHD4-4
  Gene Name: immunoglobulin heavy diversity 4-4
  ENSP ID: ENSP00000488889
LQL

SEQ ID NO: 39646 - protein, 7 aa, Homo sapiens
  Payload ID: 7963
  Gene Symbol: IGHD5OR15-5A
  Gene Name: immunoglobulin heavy diversity 5/OR15-5A (non-functional)
  ENSP ID: ENSP00000473849
VDIVSTI

SEQ ID NO: 39647 - protein, 7 aa, Homo sapiens
  Payload ID: 7964
  Gene Symbol: IGHD5OR15-5B
  Gene Name: immunoglobulin heavy diversity 5/OR15-5B (non-functional)
  ENSP ID: ENSP00000473700
VDIVSTI

SEQ ID NO: 39648 - protein, 7 aa, Homo sapiens
  Payload ID: 7965
  Gene Symbol: IGHD5-12
  Gene Name: immunoglobulin heavy diversity 5-12
  ENSP ID: ENSP00000419283
VDIVATI

SEQ ID NO: 39649 - protein, 7 aa, Homo sapiens
  Payload ID: 7965
  Gene Symbol: IGHD5-12
  Gene Name: immunoglobulin heavy diversity 5-12
  ENSP ID: ENSP00000487922
VDIVATI

SEQ ID NO: 39650 - protein, 6 aa, Homo sapiens
  Payload ID: 7966
  Gene Symbol: IGHD5-18
  Gene Name: immunoglobulin heavy diversity 5-18
  ENSP ID: ENSP00000417555
VDTAMV

SEQ ID NO: 39651 - protein, 6 aa, Homo sapiens
  Payload ID: 7966
  Gene Symbol: IGHD5-18
  Gene Name: immunoglobulin heavy diversity 5-18
  ENSP ID: ENSP00000488201
VDTAMV

SEQ ID NO: 39652 - protein, 6 aa, Homo sapiens
  Payload ID: 7967
  Gene Symbol: IGHD5-24
  Gene Name: immunoglobulin heavy diversity 5-24 (non-functional)
  ENSP ID: ENSP00000419139
VEMATI

SEQ ID NO: 39653 - protein, 6 aa, Homo sapiens
  Payload ID: 7967
  Gene Symbol: IGHD5-24
  Gene Name: immunoglobulin heavy diversity 5-24 (non-functional)
  ENSP ID: ENSP00000488113
VEMATI

SEQ ID NO: 39654 - protein, 6 aa, Homo sapiens
  Payload ID: 7968
  Gene Symbol: IGHD5-5
  Gene Name: immunoglobulin heavy diversity 5-5
  ENSP ID: ENSP00000417892
VDTAMV

SEQ ID NO: 39655 - protein, 6 aa, Homo sapiens
  Payload ID: 7968
  Gene Symbol: IGHD5-5
  Gene Name: immunoglobulin heavy diversity 5-5
  ENSP ID: ENSP00000487937
VDTAMV

SEQ ID NO: 39656 - protein, 7 aa, Homo sapiens
  Payload ID: 7969
  Gene Symbol: IGHD6-13
  Gene Name: immunoglobulin heavy diversity 6-13
  ENSP ID: ENSP00000419564
GYSSSWY

SEQ ID NO: 39657 - protein, 7 aa, Homo sapiens
  Payload ID: 7969
  Gene Symbol: IGHD6-13
  Gene Name: immunoglobulin heavy diversity 6-13
  ENSP ID: ENSP00000488592
GYSSSWY

SEQ ID NO: 39658 - protein, 7 aa, Homo sapiens
  Payload ID: 7970
  Gene Symbol: IGHD6-19
  Gene Name: immunoglobulin heavy diversity 6-19
  ENSP ID: ENSP00000418010
GYSSGWY

SEQ ID NO: 39659 - protein, 7 aa, Homo sapiens
  Payload ID: 7970
  Gene Symbol: IGHD6-19
  Gene Name: immunoglobulin heavy diversity 6-19
  ENSP ID: ENSP00000487789
GYSSGWY

SEQ ID NO: 39660 - protein, 6 aa, Homo sapiens
  Payload ID: 7971
  Gene Symbol: IGHD6-25
  Gene Name: immunoglobulin heavy diversity 6-25
  ENSP ID: ENSP00000417751
GYSSGY

SEQ ID NO: 39661 - protein, 6 aa, Homo sapiens
  Payload ID: 7971
  Gene Symbol: IGHD6-25
  Gene Name: immunoglobulin heavy diversity 6-25
  ENSP ID: ENSP00000488392
GYSSGY

SEQ ID NO: 39662 - protein, 6 aa, Homo sapiens
  Payload ID: 7972
  Gene Symbol: IGHD6-6
  Gene Name: immunoglobulin heavy diversity 6-6
  ENSP ID: ENSP00000418151
EYSSSS

SEQ ID NO: 39663 - protein, 6 aa, Homo sapiens
  Payload ID: 7972
  Gene Symbol: IGHD6-6
  Gene Name: immunoglobulin heavy diversity 6-6
  ENSP ID: ENSP00000488589
EYSSSS

SEQ ID NO: 39664 - protein, 3 aa, Homo sapiens
  Payload ID: 7973
  Gene Symbol: IGHD7-27
  Gene Name: immunoglobulin heavy diversity 7-27
  ENSP ID: ENSP00000418639
LTG

SEQ ID NO: 39665 - protein, 3 aa, Homo sapiens
  Payload ID: 7973
  Gene Symbol: IGHD7-27
  Gene Name: immunoglobulin heavy diversity 7-27
  ENSP ID: ENSP00000488695
LTG

SEQ ID NO: 39666 - protein, 17 aa, Homo sapiens
  Payload ID: 7974
  Gene Symbol: IGHJ1
  Gene Name: immunoglobulin heavy joining 1
  ENSP ID: ENSP00000418050
AEYFQHWGQGTLVTVSS

SEQ ID NO: 39667 - protein, 17 aa, Homo sapiens
  Payload ID: 7974
  Gene Symbol: IGHJ1
  Gene Name: immunoglobulin heavy joining 1
  ENSP ID: ENSP00000488542
AEYFQHWGQGTLVTVSS

SEQ ID NO: 39668 - protein, 17 aa, Homo sapiens
  Payload ID: 7975
  Gene Symbol: IGHJ2
  Gene Name: immunoglobulin heavy joining 2
  ENSP ID: ENSP00000419748
YWYFDLWGRGTLVTVSS

SEQ ID NO: 39669 - protein, 18 aa, Homo sapiens
  Payload ID: 7975
  Gene Symbol: IGHJ2
  Gene Name: immunoglobulin heavy joining 2
  ENSP ID: ENSP00000488041
  MOD_RES (1)..(1): Any amino acid
XYWYFDLWGRGTLVTVSS

SEQ ID NO: 39670 - protein, 16 aa, Homo sapiens
  Payload ID: 7976
  Gene Symbol: IGHJ3
  Gene Name: immunoglobulin heavy joining 3
  ENSP ID: ENSP00000420517
DAFDIWGQGTMVTVSS

SEQ ID NO: 39671 - protein, 17 aa, Homo sapiens
  Payload ID: 7976
  Gene Symbol: IGHJ3
  Gene Name: immunoglobulin heavy joining 3
  ENSP ID: ENSP00000487765
  MOD_RES (1)..(1): Any amino acid
XDAFDIWGQGTMVTVSS

SEQ ID NO: 39672 - protein, 15 aa, Homo sapiens
  Payload ID: 7977
  Gene Symbol: IGHJ4
  Gene Name: immunoglobulin heavy joining 4
  ENSP ID: ENSP00000419074
YFDYWGQGTLVTVSS

SEQ ID NO: 39673 - protein, 16 aa, Homo sapiens
  Payload ID: 7977
  Gene Symbol: IGHJ4
  Gene Name: immunoglobulin heavy joining 4
  ENSP ID: ENSP00000487646
  MOD_RES (1)..(1): Any amino acid
XYFDYWGQGTLVTVSS

SEQ ID NO: 39674 - protein, 16 aa, Homo sapiens
  Payload ID: 7978
  Gene Symbol: IGHJ5
  Gene Name: immunoglobulin heavy joining 5
  ENSP ID: ENSP00000418164
NWFDPWGQGTLVTVSS

SEQ ID NO: 39675 - protein, 17 aa, Homo sapiens
  Payload ID: 7978
  Gene Symbol: IGHJ5
  Gene Name: immunoglobulin heavy joining 5
  ENSP ID: ENSP00000487618
  MOD_RES (1)..(1): Any amino acid
XNWFDPWGQGTLVTVSS

SEQ ID NO: 39676 - protein, 20 aa, Homo sapiens
  Payload ID: 7979
  Gene Symbol: IGHJ6
  Gene Name: immunoglobulin heavy joining 6
  ENSP ID: ENSP00000419223
YYYYYYMDVWGKGTTVTVSS

SEQ ID NO: 39677 - protein, 21 aa, Homo sapiens
  Payload ID: 7979
  Gene Symbol: IGHJ6
  Gene Name: immunoglobulin heavy joining 6
  ENSP ID: ENSP00000487609
  MOD_RES (1)..(1): Any amino acid
XYYYYYYMDVWGKGTTVTVSS

SEQ ID NO: 39678 - protein, 117 aa, Homo sapiens
  Payload ID: 7980
  Gene Symbol: IGHV1OR15-1
  Gene Name: immunoglobulin heavy variable 1/OR15-1 (non-functional)
  ENSP ID: ENSP00000474284
MDWTWRILFLVAAATGAHSQVQLVQSGAEVKKPGASVKVSCKASGYIFTDYYMHWVRQAPGQELGWMGRINPNSGGTNYAQKFQGRVTMTRDTSISTAYTELSSLRSEDTATYYCAR

SEQ ID NO: 39679 - protein, 117 aa, Homo sapiens
  Payload ID: 7981
  Gene Symbol: IGHV1OR15-9
  Gene Name: immunoglobulin heavy variable 1/OR15-9 (non-functional)
  ENSP ID: ENSP00000474639
MGWTWRILFLVVIAAGAQSQVQLMQSGAEVKKPGASVRISCKASGYTFTSYCMHWVCQAHAQGLEWMGLVCPSDGSTSYAQKFQGRVTITRDTSMGTAYMELSSLRSEDTAMYYCVR

SEQ ID NO: 39680 - protein, 117 aa, Homo sapiens
  Payload ID: 7982
  Gene Symbol: IGHV1OR21-1
  Gene Name: immunoglobulin heavy variable 1/OR21-1 (non-functional)
  ENSP ID: ENSP00000481738
MDWNWRILFLVVIAAGAQSQVQLVQSGAEVKKPGASVKVSCKASGYTITSYCMHWVHQVHAQGLEWMGLVCPSDGSTSYAQKFQARVTITRDTSMSTAYMELSSLRSEDTAMYYCVR

SEQ ID NO: 39681 - protein, 117 aa, Homo sapiens
  Payload ID: 7983
  Gene Symbol: IGHV1-18
  Gene Name: immunoglobulin heavy variable 1-18
  ENSP ID: ENSP00000375014
MDWTWSILFLVAAATGAHSQVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCAR

SEQ ID NO: 39682 - protein, 117 aa, Homo sapiens; identical to SEQ ID NO: 39681
  Payload ID: 7983
  Gene Symbol: IGHV1-18
  Gene Name: immunoglobulin heavy variable 1-18
  ENSP ID: ENSP00000488395

SEQ ID NO: 39683 - protein, 117 aa, Homo sapiens
  Payload ID: 7984
  Gene Symbol: IGHV1-2
  Gene Name: immunoglobulin heavy variable 1-2
  ENSP ID: ENSP00000375003
MDWTWRILFLVAAATGAHSQVQLVQSGAEVKKPGASVKVSCKASGYTFTGYYMHWVRQAPGQGLEWMGWINPNSGGTNYAQKFQGWVTMTRDTSISTAYMELSRLRSDDTAVYYCAR

SEQ ID NO: 39684 - protein, 117 aa, Homo sapiens; identical to SEQ ID NO: 39683
  Payload ID: 7984
  Gene Symbol: IGHV1-2
  Gene Name: immunoglobulin heavy variable 1-2
  ENSP ID: ENSP00000488290

SEQ ID NO: 39685 - protein, 117 aa, Homo sapiens
  Payload ID: 7985
  Gene Symbol: IGHV1-24
  Gene Name: immunoglobulin heavy variable 1-24
  ENSP ID: ENSP00000375019
MDCTWRILFLVAAATGTHAQVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCAT

SEQ ID NO: 39686 - protein, 117 aa, Homo sapiens; identical to SEQ ID NO: 39685
  Payload ID: 7985
  Gene Symbol: IGHV1-24
  Gene Name: immunoglobulin heavy variable 1-24
  ENSP ID: ENSP00000488412

SEQ ID NO: 39687 - protein, 117 aa, Homo sapiens
  Payload ID: 7986
  Gene Symbol: IGHV1-3
  Gene Name: immunoglobulin heavy variable 1-3
  ENSP ID: ENSP00000375004
MDWTWRILFLVAAATGAHSQVQLVQSGAEVKKPGASVKVSCKASGYTFTSYAMHWVRQAPGQRLEWMGWINAGNGNTKYSQKFQGRVTITRDTSASTAYMELSSLRSEDTAVYYCAR

SEQ ID NO: 39688 - protein, 117 aa, Homo sapiens; identical to SEQ ID NO: 39687
  Payload ID: 7986
  Gene Symbol: IGHV1-3
  Gene Name: immunoglobulin heavy variable 1-3
  ENSP ID: ENSP00000487722

SEQ ID NO: 39689 - protein, 117 aa, Homo sapiens
  Payload ID: 7987
  Gene Symbol: IGHV1-45
  Gene Name: immunoglobulin heavy variable 1-45
  ENSP ID: ENSP00000375030
MDWTWRILFLVAAVTDAYSQMQLVQSGAEVKKTGSSVKVSCKASGYTFTYRYLHWVRQAPGQALEWMGWITPFNGNTNYAQKFQDRVTITRDRSMSTAYMELSSLRSEDTAMYYCAR

SEQ ID NO: 39690 - protein, 117 aa, Homo sapiens; identical to SEQ ID NO: 39689
  Payload ID: 7987
  Gene Symbol: IGHV1-45
  Gene Name: immunoglobulin heavy variable 1-45
  ENSP ID: ENSP00000488436

SEQ ID NO: 39691 - protein, 117 aa, Homo sapiens
  Payload ID: 7988
  Gene Symbol: IGHV1-46
  Gene Name: immunoglobulin heavy variable 1-46
  ENSP ID: ENSP00000375031
MDWTWRVFCLLAVAPGAHSQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAR

SEQ ID NO: 39692 - protein, 117 aa, Homo sapiens; identical to SEQ ID NO: 39691
  Payload ID: 7988
  Gene Symbol: IGHV1-46
  Gene Name: immunoglobulin heavy variable 1-46
  ENSP ID: ENSP00000488713

SEQ ID NO: 39693 - protein, 117 aa, Homo sapiens
  Payload ID: 7989
  Gene Symbol: IGHV1-58
  Gene Name: immunoglobulin heavy variable 1-58
  ENSP ID: ENSP00000375037
MDWIWRILFLVGAATGAHSQMQLVQSGPEVKKPGTSVKVSCKASGFTFTSSAVQWVRQARGQRLEWIGWIVVGSGNTNYAQKFQERVTITRDMSTSTAYMELSSLRSEDTAVYYCAA

SEQ ID NO: 39694 - protein, 117 aa, Homo sapiens; identical to SEQ ID NO: 39693
  Payload ID: 7989
  Gene Symbol: IGHV1-58
  Gene Name: immunoglobulin heavy variable 1-58
  ENSP ID: ENSP00000488516

SEQ ID NO: 39695 - protein, 117 aa, Homo sapiens
  Payload ID: 7990
  Gene Symbol: IGHV1-69
  Gene Name: immunoglobulin heavy variable 1-69
  ENSP ID: ENSP00000375042
MDWTWRFLFVVAAATGVQSQVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAR

SEQ ID NO: 39696 - protein, 117 aa, Homo sapiens; identical to SEQ ID NO: 39695
  Payload ID: 7990
  Gene Symbol: IGHV1-69
  Gene Name: immunoglobulin heavy variable 1-69
  ENSP ID: ENSP00000488090

SEQ ID NO: 39697 - protein, 117 aa, Homo sapiens
  Payload ID: 7991
  Gene Symbol: IGHV1-69-2
  Gene Name: immunoglobulin heavy variable 1-69-2
  ENSP ID: ENSP00000485152
MDWTWRFLFVVAAATGVQSQVQLVQSGAEVKKPGSSVKVSCKASGGTFSSYAISWVRQAPGQGLEWMGGIIPIFGTANYAQKFQGRVTITADESTSTAYMELSSLRSEDTAVYYCAR

SEQ ID NO: 39698 - protein, 117 aa, Homo sapiens; identical to SEQ ID NO: 39697
  Payload ID: 7991
  Gene Symbol: IGHV1-69-2
  Gene Name: immunoglobulin heavy variable 1-69-2
  ENSP ID: ENSP00000488097

SEQ ID NO: 39699 - protein, 119 aa, Homo sapiens
  Payload ID: 7992
  Gene Symbol: IGHV2OR16-5
  Gene Name: immunoglobulin heavy variable 2/OR16-5 (non-functional)
  ENSP ID: ENSP00000474384
MDTFCSTLLLLTTPSWVLSQVTLKESGPALVKPTETLTLTCTLSGFSLSTSGMGMSWIRQPPGKALEWLAHIFLNDKKSYSTSLKNRLIISKDTSKSQVVLTMTNMDPVDTATYYCAWR

SEQ ID NO: 39700 - protein, 119 aa, Homo sapiens
  Payload ID: 7993
  Gene Symbol: IGHV2-26
  Gene Name: immunoglobulin heavy variable 2-26
  ENSP ID: ENSP00000375020
MDTLCYTLLLLTTPSWVLSQVTLKESGPVLVKPTETLTLTCTVSGFSLSNARMGVSWIRQPPGKALEWLAHIFSNDEKSYSTSLKSRLTISKDTSKSQVVLTMTNMDPVDTATYYCARI

SEQ ID NO: 39701 - protein, 119 aa, Homo sapiens; identical to SEQ ID NO: 39700
  Payload ID: 7993
  Gene Symbol: IGHV2-26
  Gene Name: immunoglobulin heavy variable 2-26
  ENSP ID: ENSP00000487857

SEQ ID NO: 39702 - protein, 119 aa, Homo sapiens
  Payload ID: 7994
  Gene Symbol: IGHV2-5
  Gene Name: immunoglobulin heavy variable 2-5
  ENSP ID: ENSP00000375006
MDTLCSTLLLLTIPSWVLSQITLKESGPTLVKPTQTLTLTCTFSGFSLSTSGVGVGWIRQPPGKALEWLALIYWDDDKRYSPSLKSRLTITKDTSKNQVVLTMTNMDPVDTATYYCAHR

SEQ ID NO: 39703 - protein, 119 aa, Homo sapiens; identical to SEQ ID NO: 39702
  Payload ID: 7994
  Gene Symbol: IGHV2-5
  Gene Name: immunoglobulin heavy variable 2-5
  ENSP ID: ENSP00000473889

SEQ ID NO: 39704 - protein, 119 aa, Homo sapiens
  Payload ID: 7995
  Gene Symbol: IGHV2-70
  Gene Name: immunoglobulin heavy variable 2-70
  ENSP ID: ENSP00000485200
MDILCSTLLLLTVPSWVLSQVTLRESGPALVKPTQTLTLTCTFSGFSLSTSGMCVSWIRQPPGKALEWLALIDWDDDKYYSTSLKTRLTISKDTSKNQVVLTMTNMDPVDTATYYCARI

SEQ ID NO: 39705 - protein, 119 aa, Homo sapiens
  Payload ID: 7995
  Gene Symbol: IGHV2-70
  Gene Name: immunoglobulin heavy variable 2-70
  ENSP ID: ENSP00000487677
MDMLCSMLLLLTVPSWVLSQVTLKESGPALVKPTQTLTLTCTFSGFSLSTTGMRVSWIRRPPGKALEWLARIDWDDDKYCSTSLKTRLTISKDTSKNQVVLTMTNMDPVDTATYYCARI

SEQ ID NO: 39706 - protein, 119 aa, Homo sapiens
  Payload ID: 7996
  Gene Symbol: IGHV3OR15-7
  Gene Name: immunoglobulin heavy variable 3/OR15-7 (pseudogene)
  ENSP ID: ENSP00000474509
MEFGLSWVFLVAILKGVQCEVQLVESGGGLVQPGGSLRLSCAASGFTFSDHYMSWVRQAQGKGLELVGLIRNKANSYTTEYAASVKGRLTISREDSKNTLYLQMSNLKTEDLAVYYCAR

SEQ ID NO: 39707 - protein, 116 aa, Homo sapiens
  Payload ID: 7997
  Gene Symbol: IGHV3OR16-10
  Gene Name: immunoglobulin heavy variable 3/OR16-10 (non-functional)
  ENSP ID: ENSP00000474941
MEFVLSWVFLVAILKGVQCEVQLVQSGGGLVHPGGSLRLSCAGSGFTFSSYAMHWVRQAPGKGLEWVSAIGTGGGTYYADSVKGRFTISRDNAKNSLYLQMNSLRAEDMAVYYCAR

SEQ ID NO: 39708 - protein, 117 aa, Homo sapiens
  Payload ID: 7998
  Gene Symbol: IGHV3OR16-12
  Gene Name: immunoglobulin heavy variable 3/OR16-12 (non-functional)
  ENSP ID: ENSP00000474013
MEFELSWVFLVAILQGVHCEVQLVESGRGLAQPGGYLKLSGAASGFTVGSWYMSWIHQAPGKGLEWVSYISSSGCSTNYADSVKGRFTISTDNSKNTLYLQMNSLRVEDTAVYYCAR

SEQ ID NO: 39709 - protein, 117 aa, Homo sapiens
  Payload ID: 7999
  Gene Symbol: IGHV3OR16-13
  Gene Name: immunoglobulin heavy variable 3/OR16-13 (non-functional)
  ENSP ID: ENSP00000474814
MEFGLSWVFLVAILKGVQCEVQLVESGGGLVQPGGSLRLSCAASGFTFSSYWMHWVRQAPGKGLVWVSRINSDGSSTSYADSMKGQFTISRDNAKNTLYLQMNSLRAEDMAVYYCTR

SEQ ID NO: 39710 - protein, 116 aa, Homo sapiens
  Payload ID: 8000
  Gene Symbol: IGHV3OR16-8
  Gene Name: immunoglobulin heavy variable 3/OR16-8 (non-functional)
  ENSP ID: ENSP00000474964
MEFGLNWVFLVAIIKGAQCEVQLVESGGGLVQPGGSLRLSCPASGFTFSNHYMSWVRQAPGKGLEWVSYISGDSGYTNYADSVKGRFTISRDNANNSPYLQMNSLRAEDTAVYYCV

SEQ ID NO: 39711 - protein, 98 aa, Homo sapiens
  Payload ID: 8001
  Gene Symbol: IGHV3OR16-9
  Gene Name: immunoglobulin heavy variable 3/OR16-9 (non-functional)
  ENSP ID: ENSP00000474363
EVQLVESGGGLVQPGGSLRLSCAASGFTFSNHYTSWVRQAPGKGLEWVSYSSGNSGYTNYADSVKGRFTISRDNAKNSLYLQMNSLRAEDTAVYYCVK

SEQ ID NO: 39712 - protein, 96 aa, Homo sapiens
  Payload ID: 8001
  Gene Symbol: IGHV3OR16-9
  Gene Name: immunoglobulin heavy variable 3/OR16-9 (non-functional)
  ENSP ID: ENSP00000475107
EVQLVESGGGLVQPGGSLRLSCAASGFTFSNHYTSWVRQAPGKGLEWVSYSSGNSGYTNYADSVKGRFTISRDNAKNSLYLQMNSLRAEDTAVYYC

SEQ ID NO: 39713 - protein, 117 aa, Homo sapiens
  Payload ID: 8002
  Gene Symbol: IGHV3-11
  Gene Name: immunoglobulin heavy variable 3-11 (gene/pseudogene)
  ENSP ID: ENSP00000375010
MEFGLSWVFLVAIIKGVQCQVQLVESGGGLVKPGGSLRLSCAASGFTFSDYYMSWIRQAPGKGLEWVSYISSSSSYTNYADSVKGRFTISRDNAKNSLYLQMNSLRAEDTAVYYCAR

SEQ ID NO: 39714 - protein, 117 aa, Homo sapiens; identical to SEQ ID NO: 39713
  Payload ID: 8002
  Gene Symbol: IGHV3-11
  Gene Name: immunoglobulin heavy variable 3-11 (gene/pseudogene)
  ENSP ID: ENSP00000488236

SEQ ID NO: 39715 - protein, 116 aa, Homo sapiens
  Payload ID: 8003
  Gene Symbol: IGHV3-13
  Gene Name: immunoglobulin heavy variable 3-13
  ENSP ID: ENSP00000375011
MELGLSWVFLVAILEGVQCEVQLVESGGGLVQPGGSLRLSCAASGFTFSSYDMHWVRQATGKGLEWVSAIGTAGDPYYPGSVKGRFTISRENAKNSLYLQMNSLRAGDTAVYYCAR

SEQ ID NO: 39716 - protein, 116 aa, Homo sapiens; identical to SEQ ID NO: 39715
  Payload ID: 8003
  Gene Symbol: IGHV3-13
  Gene Name: immunoglobulin heavy variable 3-13
  ENSP ID: ENSP00000488851

SEQ ID NO: 39717 - protein, 119 aa, Homo sapiens
  Payload ID: 8004
  Gene Symbol: IGHV3-15
  Gene Name: immunoglobulin heavy variable 3-15
  ENSP ID: ENSP00000375012
MEFGLSWIFLAAILKGVQCEVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTT

SEQ ID NO: 39718 - protein, 119 aa, Homo sapiens; identical to SEQ ID NO: 39717
  Payload ID: 8004
  Gene Symbol: IGHV3-15
  Gene Name: immunoglobulin heavy variable 3-15
  ENSP ID: ENSP00000488894

SEQ ID NO: 39719 - protein, 117 aa, Homo sapiens
  Payload ID: 8005
  Gene Symbol: IGHV3-16
  Gene Name: immunoglobulin heavy variable 3-16 (non-functional)
  ENSP ID: ENSP00000375013
MEFGLSWVFLAGILKGVQCEVQLVESGGGLVQPGGSLRLSCAASGFTFSNSDMNWARKAPGKGLEWVSGVSWNGSRTHYVDSVKRRFIISRDNSRNSLYLQKNRRRAEDMAVYYCVR

SEQ ID NO: 39720 - protein, 117 aa, Homo sapiens; identical to SEQ ID NO: 39719
  Payload ID: 8005
  Gene Symbol: IGHV3-16
  Gene Name: immunoglobulin heavy variable 3-16 (non-functional)
  ENSP ID: ENSP00000487809

SEQ ID NO: 39721 - protein, 117 aa, Homo sapiens
  Payload ID: 8006
  Gene Symbol: IGHV3-20
  Gene Name: immunoglobulin heavy variable 3-20
  ENSP ID: ENSP00000375015
MEFGLSWVFLVAILKGVQCEVQLVESGGGVVRPGGSLRLSFAASGFTFDDYGMSWVRQAPGKGLEWVSGINWNGGSTGYADSVKGRFTISRDNAKNSLYLQMNSLRAEDTALYHCAR

SEQ ID NO: 39722 - protein, 117 aa, Homo sapiens; identical to SEQ ID NO: 39721
  Payload ID: 8006
  Gene Symbol: IGHV3-20
  Gene Name: immunoglobulin heavy variable 3-20
  ENSP ID: ENSP00000488747

SEQ ID NO: 39723 - protein, 117 aa, Homo sapiens
  Payload ID: 8007
  Gene Symbol: IGHV3-21
  Gene Name: immunoglobulin heavy variable 3-21
  ENSP ID: ENSP00000375016
MELGLRWVFLVAILEGVQCEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAR

SEQ ID NO: 39724 - protein, 117 aa, Homo sapiens; identical to SEQ ID NO: 39723
  Payload ID: 8007
  Gene Symbol: IGHV3-21
  Gene Name: immunoglobulin heavy variable 3-21
  ENSP ID: ENSP00000487805

SEQ ID NO: 39725 - protein, 117 aa, Homo sapiens
  Payload ID: 8008
  Gene Symbol: IGHV3-23
  Gene Name: immunoglobulin heavy variable 3-23
  Uniprot ID: P01764
  ENSP ID: ENSP00000375018
MEFGLSWLFLVAILKGVQCEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAK

SEQ ID NO: 39726 - protein, 117 aa, Homo sapiens; identical to SEQ ID NO: 39725
  Payload ID: 8008
  Gene Symbol: IGHV3-23
  Gene Name: immunoglobulin heavy variable 3-23
  Uniprot ID: P01764
  ENSP ID: ENSP00000487761

SEQ ID NO: 39727 - protein, 117 aa, Homo sapiens
  Payload ID: 8009
  Gene Symbol: IGHV3-30
  Gene Name: immunoglobulin heavy variable 3-30
  ENSP ID: ENSP00000474524
MEFGLSWVFLVALLRGVQCQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAK

SEQ ID NO: 39728 - protein, 117 aa, Homo sapiens; identical to SEQ ID NO: 39727
  Payload ID: 8009
  Gene Symbol: IGHV3-30
  Gene Name: immunoglobulin heavy variable 3-30
  ENSP ID: ENSP00000488205

SEQ ID NO: 39729 - protein, 117 aa, Homo sapiens
  Payload ID: 8010
  Gene Symbol: IGHV3-33
  Gene Name: immunoglobulin heavy variable 3-33
  ENSP ID: ENSP00000375024
MEFGLSWVFLVALLRGVQCQVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCAR

SEQ ID NO: 39730 - protein, 117 aa, Homo sapiens
  Payload ID: 8010
  Gene Symbol: IGHV3-33
  Gene Name: immunoglobulin heavy variable 3-33
  ENSP ID: ENSP00000487655
MEFGLSWVFLVALLRGVQCQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAR

SEQ ID NO: 39731 - protein, 117 aa, Homo sapiens
  Payload ID: 8011
  Gene Symbol: IGHV3-35
  Gene Name: immunoglobulin heavy variable 3-35 (non-functional)
  ENSP ID: ENSP00000375026
MEFGLSWVFLAAILKGVQCEVQLVESGGGLVQPGGSLRLSCAASGFTFSNSDMNWVHQAPGKGLEWVSGVSWNGSRTHYADSVKGRFIISRDNSRNTLYLQTNSLRAEDTAVYYCVR

SEQ ID NO: 39732 - protein, 117 aa, Homo sapiens; identical to SEQ ID NO: 39731
  Payload ID: 8011
  Gene Symbol: IGHV3-35
  Gene Name: immunoglobulin heavy variable 3-35 (non-functional)
  ENSP ID: ENSP00000488667

SEQ ID NO: 39733 - protein, 116 aa, Homo sapiens
  Payload ID: 8012
  Gene Symbol: IGHV3-38
  Gene Name: immunoglobulin heavy variable 3-38 (non-functional)
  ENSP ID: ENSP00000375027
MQFVLSWVFLVGILKGVQCEVQLVESGGGLVQPRGSLRLSCAASGFTVSSNEMSWIRQAPGKGLEWVSSISGGSTYYADSRKGRFTISRDNSKNTLYLQMNNLRAEGTAVYYCARY

SEQ ID NO: 39734 - protein, 116 aa, Homo sapiens; identical to SEQ ID NO: 39733
  Payload ID: 8012
  Gene Symbol: IGHV3-38
  Gene Name: immunoglobulin heavy variable 3-38 (non-functional)
  ENSP ID: ENSP00000487804

SEQ ID NO: 39735 - protein, 118 aa, Homo sapiens
  Payload ID: 8013
  Gene Symbol: IGHV3-43
  Gene Name: immunoglobulin heavy variable 3-43
  ENSP ID: ENSP00000399826
MEFGLSWVFLVAILKGVQCEVQLVESGGVVVQPGGSLRLSCAASGFTFDDYTMHWVRQAPGKGLEWVSLISWDGGSTYYADSVKGRFTISRDNSKNSLYLQMNSLRTEDTALYYCAKD

SEQ ID NO: 39736 - protein, 118 aa, Homo sapiens; identical to SEQ ID NO: 39735
  Payload ID: 8013
  Gene Symbol: IGHV3-43
  Gene Name: immunoglobulin heavy variable 3-43
  ENSP ID: ENSP00000487611

SEQ ID NO: 39737 - protein, 117 aa, Homo sapiens
  Payload ID: 8014
  Gene Symbol: IGHV3-48
  Gene Name: immunoglobulin heavy variable 3-48
  ENSP ID: ENSP00000375033
MELGLCWVFLVAILEGVQCEVQLVESGGGLVQPGGSLRLSCAASGFTFSSYEMNWVRQAPGKGLEWVSYISSSGSTIYYADSVKGRFTISRDNAKNSLYLQMNSLRAEDTAVYYCAR

SEQ ID NO: 39738 - protein, 117 aa, Homo sapiens; identical to SEQ ID NO: 39737
  Payload ID: 8014
  Gene Symbol: IGHV3-48
  Gene Name: immunoglobulin heavy variable 3-48
  ENSP ID: ENSP00000487990

SEQ ID NO: 39739 - protein, 119 aa, Homo sapiens
  Payload ID: 8015
  Gene Symbol: IGHV3-49
  Gene Name: immunoglobulin heavy variable 3-49
  ENSP ID: ENSP00000375034
MEFGLSWVFLVAILKGVQCEVQLVESGGGLVQPGRSLRLSCTASGFTFGDYAMSWVRQAPGKGLEWVGFIRSKAYGGTTEYAASVKGRFTISRDDSKSIAYLQMNSLKTEDTAVYYCTR

SEQ ID NO: 39740 - protein, 114 aa, Homo sapiens
  Payload ID: 8015
  Gene Symbol: IGHV3-49
  Gene Name: immunoglobulin heavy variable 3-49
  ENSP ID: ENSP00000478467
AILKGVQCEVQLVESGGGLVQPGRSLRLSCTASGFTFGDYAMSWVRQAPGKGLEWVGFIRSKAYGGTTEYAASVKGRFTISRDDSKSIAYLQMNSLKTEDTAVYYCTRDTVRGG

SEQ ID NO: 39741 - protein, 114 aa, Homo sapiens; identical to SEQ ID NO: 39740
  Payload ID: 8015
  Gene Symbol: IGHV3-49
  Gene Name: immunoglobulin heavy variable 3-49
  ENSP ID: ENSP00000484690

SEQ ID NO: 39742 - protein, 119 aa, Homo sapiens; identical to SEQ ID NO: 39739
  Payload ID: 8015
  Gene Symbol: IGHV3-49
  Gene Name: immunoglobulin heavy variable 3-49
  ENSP ID: ENSP00000488069

SEQ ID NO: 39743 - protein, 116 aa, Homo sapiens
  Payload ID: 8016
  Gene Symbol: IGHV3-53
  Gene Name: immunoglobulin heavy variable 3-53
  ENSP ID: ENSP00000375036
MEFWLSWVFLVAISKGVQCEVQLVETGGGLIQPGGSLRLSCAASGFTVSSNYMSWVRQAPGKGLEWVSVIYSGGSTYYADSVKGRFTISRDNSKNTLYLQMNSLRAEDTAVYYCAR

SEQ ID NO: 39744 - protein, 116 aa, Homo sapiens; identical to SEQ ID NO: 39743
  Payload ID: 8016
  Gene Symbol: IGHV3-53
  Gene Name: immunoglobulin heavy variable 3-53
  ENSP ID: ENSP00000488526

SEQ ID NO: 39745 - protein, 118 aa, Homo sapiens
  Payload ID: 8017
  Gene Symbol: IGHV3-64
  Gene Name: immunoglobulin heavy variable 3-64
  ENSP ID: ENSP00000401707
MMEFGLSWVFLVAIFKGVQCEVQLVESGEGLVQPGGSLRLSCAASGFTFSSYAMHWVRQAPGKGLEYVSAISSNGGSTYYADSVKGRFTISRDNSKNTLYLQMGSLRAEDMAVYYCAR

SEQ ID NO: 39746 - protein, 75 aa, Homo sapiens
  Payload ID: 8017
  Gene Symbol: IGHV3-64
  Gene Name: immunoglobulin heavy variable 3-64
  ENSP ID: ENSP00000480175
ASGFTFSSYAMHWVRQAPGKGLEYVSAISSNGGSTYYADSVKGRFTISRDNAQNSLYLQMNSLRADDMAVYYCVK

SEQ ID NO: 39747 - protein, 75 aa, Homo sapiens; identical to SEQ ID NO: 39746
  Payload ID: 8017
  Gene Symbol: IGHV3-64
  Gene Name: immunoglobulin heavy variable 3-64
  ENSP ID: ENSP00000483769

SEQ ID NO: 39748 - protein, 118 aa, Homo sapiens; identical to SEQ ID NO: 39745
  Payload ID: 8017
  Gene Symbol: IGHV3-64
  Gene Name: immunoglobulin heavy variable 3-64
  ENSP ID: ENSP00000488676

SEQ ID NO: 39749 - protein, 116 aa, Homo sapiens
  Payload ID: 8018
  Gene Symbol: IGHV3-66
  Gene Name: immunoglobulin heavy variable 3-66
  ENSP ID: ENSP00000375041
MEFGLSWVFLVAILKGVQCEVQLVESGGGLIQPGGSLRLSCAASGFTVSSNYMSWVRQAPGKGLEWVSVIYSCGSTYYADSVKGRFTISRDNSKNTLYLQMNSLRAEDTAVYYCAR

SEQ ID NO: 39750 - protein, 116 aa, Homo sapiens; identical to SEQ ID NO: 39749
  Payload ID: 8018
  Gene Symbol: IGHV3-66
  Gene Name: immunoglobulin heavy variable 3-66
  ENSP ID: ENSP00000487902

SEQ ID NO: 39751 - protein, 117 aa, Homo sapiens
  Payload ID: 8019
  Gene Symbol: IGHV3-7
  Gene Name: immunoglobulin heavy variable 3-7
  ENSP ID: ENSP00000375007
MELGLSWVFLVAILEGVQCEVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCAR

SEQ ID NO: 39752 - protein, 117 aa, Homo sapiens; identical to SEQ ID NO: 39751
  Payload ID: 8019
  Gene Symbol: IGHV3-7
  Gene Name: immunoglobulin heavy variable 3-7
  ENSP ID: ENSP00000487659

SEQ ID NO: 39753 - protein, 119 aa, Homo sapiens
  Payload ID: 8020
  Gene Symbol: IGHV3-72
  Gene Name: immunoglobulin heavy variable 3-72
  ENSP ID: ENSP00000416201
MEFGLSWVFLVVILQGVQCEVQLVESGGGLVQPGGSLRLSCAASGFTFSDHYMDWVRQAPGKGLEWVGRTRNKANSYTTEYAASVKGRFTISRDDSKNSLYLQMNSLKTEDTAVYYCAR

SEQ ID NO: 39754 - protein, 101 aa, Homo sapiens
  Payload ID: 8020
  Gene Symbol: IGHV3-72
  Gene Name: immunoglobulin heavy variable 3-72
  ENSP ID: ENSP00000480035
EVQLVESGGGLVQPGGSLRLSCAASGFTFSDHYMDWVRQAPGKGLEWVGRTRNKANSYTTEYAASVKGRFTISRDDSKNSLYLQMNSLKTEDTAVYYCARD

SEQ ID NO: 39755 - protein, 101 aa, Homo sapiens; identical to SEQ ID NO: 39754
  Payload ID: 8020
  Gene Symbol: IGHV3-72
  Gene Name: immunoglobulin heavy variable 3-72
  ENSP ID: ENSP00000480183

SEQ ID NO: 39756 - protein, 119 aa, Homo sapiens; identical to SEQ ID NO: 39753
  Payload ID: 8020
  Gene Symbol: IGHV3-72
  Gene Name: immunoglobulin heavy variable 3-72
  ENSP ID: ENSP00000488019

SEQ ID NO: 39757 - protein, 119 aa, Homo sapiens
  Payload ID: 8021
  Gene Symbol: IGHV3-73
  Gene Name: immunoglobulin heavy variable 3-73
  ENSP ID: ENSP00000375045
MEFGLSWVFLVAILKGVQCEVQLVESGGGLVQPGGSLKLSCAASGFTFSGSAMHWVRQASGKGLEWVGRIRSKANSYATAYAASVKGRFTISRDDSKNTAYLQMNSLKTEDTAVYYCTR

SEQ ID NO: 39758 - protein, 83 aa, Homo sapiens
  Payload ID: 8021
  Gene Symbol: IGHV3-73
  Gene Name: immunoglobulin heavy variable 3-73
  ENSP ID: ENSP00000480695
SLRLSCAASGFTFSSYWMHWVRQAPGKGLEWVGRIRSKANSYATAYAASVKGRFTISRDDSKNTAYLQMNSLKTEDTAVYYCT

SEQ ID NO: 39759 - protein, 119 aa, Homo sapiens; identical to SEQ ID NO: 39757
  Payload ID: 8021
  Gene Symbol: IGHV3-73
  Gene Name: immunoglobulin heavy variable 3-73
  ENSP ID: ENSP00000488432

SEQ ID NO: 39760 - protein, 117 aa, Homo sapiens
  Payload ID: 8022
  Gene Symbol: IGHV3-74
  Gene Name: immunoglobulin heavy variable 3-74
  ENSP ID: ENSP00000394447
MEFGLSWVFLVAILKGVQCEVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCAR

SEQ ID NO: 39761 - protein, 117 aa, Homo sapiens; identical to SEQ ID NO: 39760
  Payload ID: 8022
  Gene Symbol: IGHV3-74
  Gene Name: immunoglobulin heavy variable 3-74
  ENSP ID: ENSP00000488600

SEQ ID NO: 39762 - protein, 117 aa, Homo sapiens
  Payload ID: 8023
  Gene Symbol: IGHV4OR15-8
  Gene Name: immunoglobulin heavy variable 4/OR15-8 (non-functional)
  ENSP ID: ENSP00000473987
MKHLWFFLLLVAAPRWVLSQVQLQESGPGLVKPSETLSLTCVVSGGSISSSNWWSWVRQPPGKGLEWIGEIYHSGSPNYNPSLKSRVTISVDKSKNQFSLKLSSVTAADRAVYYCAR

SEQ ID NO: 39763 - protein, 117 aa, Homo sapiens
  Payload ID: 8024
  Gene Symbol: IGHV4-28
  Gene Name: immunoglobulin heavy variable 4-28
  ENSP ID: ENSP00000375021
MKHLWFFLLLVAAPRWVLSQVQLQESGPGLVKPSDTLSLTCAVSGYSISSSNWWGWIRQPPGKGLEWIGYIYYSGSTYYNPSLKSRVTMSVDTSKNQFSLKLSSVTAVDTAVYYCAR

SEQ ID NO: 39764 - protein, 117 aa, Homo sapiens; identical to SEQ ID NO: 39763
  Payload ID: 8024
  Gene Symbol: IGHV4-28
  Gene Name: immunoglobulin heavy variable 4-28
  ENSP ID: ENSP00000488402

SEQ ID NO: 39765 - protein, 118 aa, Homo sapiens
  Payload ID: 8025
  Gene Symbol: IGHV4-31
  Gene Name: immunoglobulin heavy variable 4-31
  ENSP ID: ENSP00000395656
MKHLWFFLLLVAAPRWVLSQLQLQESGSGLVKPSQTLSLTCAVSGGSISSGGYSWSWIRQPPGKGLEWIGYIYHSGSTYYNPSLKSRVTISVDRSKNQFSLKLSSVTAADTAVYYCAR

SEQ ID NO: 39766 - protein, 118 aa, Homo sapiens; identical to SEQ ID NO: 39765
  Payload ID: 8025
  Gene Symbol: IGHV4-31
  Gene Name: immunoglobulin heavy variable 4-31
  ENSP ID: ENSP00000487658

SEQ ID NO: 39767 - protein, 123 aa, Homo sapiens
  Payload ID: 8026
  Gene Symbol: IGHV4-34
  Gene Name: immunoglobulin heavy variable 4-34
  ENSP ID: ENSP00000375025
MDLLHKNMKHLWFFLLLVAAPRWVLSQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAR

SEQ ID NO: 39768 - protein, 123 aa, Homo sapiens; identical to SEQ ID NO: 39767
  Payload ID: 8026
  Gene Symbol: IGHV4-34
  Gene Name: immunoglobulin heavy variable 4-34
  ENSP ID: ENSP00000482820

SEQ ID NO: 39769 - protein, 125 aa, Homo sapiens
  Payload ID: 8027
  Gene Symbol: IGHV4-39
  Gene Name: immunoglobulin heavy variable 4-39
  ENSP ID: ENSP00000375028
MDLMCKKMKHLWFFLLLVAAPRWVLSQLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCAR

SEQ ID NO: 39770 - protein, 125 aa, Homo sapiens; identical to SEQ ID NO: 39769
  Payload ID: 8027
  Gene Symbol: IGHV4-39
  Gene Name: immunoglobulin heavy variable 4-39
  ENSP ID: ENSP00000488798

SEQ ID NO: 39771 - protein, 117 aa, Homo sapiens
  Payload ID: 8028
  Gene Symbol: IGHV4-4
  Gene Name: immunoglobulin heavy variable 4-4
  ENSP ID: ENSP00000410711
MKHLWFFLLLVAAPRWVLSQVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCAR

SEQ ID NO: 39772 - protein, 117 aa, Homo sapiens; identical to SEQ ID NO: 39771
  Payload ID: 8028
  Gene Symbol: IGHV4-4
  Gene Name: immunoglobulin heavy variable 4-4
  ENSP ID: ENSP00000487977

SEQ ID NO: 39773 - protein, 116 aa, Homo sapiens
  Payload ID: 8029
  Gene Symbol: IGHV4-59
  Gene Name: immunoglobulin heavy variable 4-59
  ENSP ID: ENSP00000375038
MKHLWFFLLLVAAPRWVLSQVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAR

SEQ ID NO: 39774 - protein, 116 aa, Homo sapiens; identical to SEQ ID NO: 39773
  Payload ID: 8029
  Gene Symbol: IGHV4-59
  Gene Name: immunoglobulin heavy variable 4-59
  ENSP ID: ENSP00000484250

SEQ ID NO: 39775 - protein, 118 aa, Homo sapiens
  Payload ID: 8030
  Gene Symbol: IGHV4-61
  Gene Name: immunoglobulin heavy variable 4-61
  ENSP ID: ENSP00000375039
MKHLWFFLLLVAAPRWVLSQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAR

SEQ ID NO: 39776 - protein, 118 aa, Homo sapiens; identical to SEQ ID NO: 39775
  Payload ID: 8030
  Gene Symbol: IGHV4-61
  Gene Name: immunoglobulin heavy variable 4-61
  ENSP ID: ENSP00000487694

SEQ ID NO: 39777 - protein, 117 aa, Homo sapiens
  Payload ID: 8031
  Gene Symbol: IGHV5-51
  Gene Name: immunoglobulin heavy variable 5-51
  ENSP ID: ENSP00000375035
MGSTAILALLLAVLQGVCAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCAR

SEQ ID NO: 39778 - protein, 117 aa, Homo sapiens; identical to SEQ ID NO: 39777
  Payload ID: 8031
  Gene Symbol: IGHV5-51
  Gene Name: immunoglobulin heavy variable 5-51
  ENSP ID: ENSP00000483207

SEQ ID NO: 39779 - protein, 121 aa, Homo sapiens
  Payload ID: 8032
  Gene Symbol: IGHV6-1
  Gene Name: immunoglobulin heavy variable 6-1
  ENSP ID: ENSP00000375002
MSVSFLIFLPVLGLPWGVLSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAR

SEQ ID NO: 39780 - protein, 121 aa, Homo sapiens; identical to SEQ ID NO: 39779
  Payload ID: 8032
  Gene Symbol: IGHV6-1
  Gene Name: immunoglobulin heavy variable 6-1
  ENSP ID: ENSP00000488134

SEQ ID NO: 39781 - protein, 117 aa, Homo sapiens
  Payload ID: 8033
  Gene Symbol: IGHV7-81
  Gene Name: immunoglobulin heavy variable 7-81 (non-functional)
  ENSP ID: ENSP00000375048
MDWTWSILFLVAAATGTYSQVQLVQSGHEVKQPGASVKVSCKASGYSFTTYGMNWVPQAPGQGLEWMGWFNTYTGNPTYAQGFTGRFVFSMDTSASTAYLQISSLKAEDMAMYYCAR

SEQ ID NO: 39782 - protein, 107 aa, Homo sapiens
  Payload ID: 8034
  Gene Symbol: IGKC
  Gene Name: immunoglobulin kappa constant
  ENSP ID: ENSP00000374777
  MOD_RES (1)..(1): Any amino acid
XTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 39783 - protein, 239 aa, Homo sapiens
  Payload ID: 8034
  Gene Symbol: IGKC
  Gene Name: immunoglobulin kappa constant
  ENSP ID: ENSP00000478196
VRLPAQLLGLLMLWVPGSSGDIVMTQHLLSLPIPLGEPASISCRSSQSLLHSDGNTYLDWYLQKPGQSPQLLIYTISNKFYGVPNKFSGSRSGTGFTLKFSKVEAEDVGVYCCEQGLQAPSIFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 39784 - protein, 119 aa, Homo sapiens
  Payload ID: 8034
  Gene Symbol: IGKC
  Gene Name: immunoglobulin kappa constant
  ENSP ID: ENSP00000481923
LTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 39785 - protein, 119 aa, Homo sapiens; identical to SEQ ID NO: 39784
  Payload ID: 8034
  Gene Symbol: IGKC
  Gene Name: immunoglobulin kappa constant
  ENSP ID: ENSP00000482934

SEQ ID NO: 39786 - protein, 107 aa, Homo sapiens; identical to SEQ ID NO: 39782
  Payload ID: 8034
  Gene Symbol: IGKC
  Gene Name: immunoglobulin kappa constant
  ENSP ID: ENSP00000483856
  MOD_RES (1)..(1): Any amino acid

SEQ ID NO: 39787 - protein, 239 aa, Homo sapiens; identical to SEQ ID NO: 39783
  Payload ID: 8034
  Gene Symbol: IGKC
  Gene Name: immunoglobulin kappa constant
  ENSP ID: ENSP00000484499

SEQ ID NO: 39788 - protein, 13 aa, Homo sapiens
  Payload ID: 8035
  Gene Symbol: IGKJ1
  Gene Name: immunoglobulin kappa joining 1
  ENSP ID: ENSP00000419111
  MOD_RES (1)..(1): Any amino acid
XWTFGQGTKVEIK

SEQ ID NO: 39789 - protein, 13 aa, Homo sapiens
  Payload ID: 8036
  Gene Symbol: IGKJ2
  Gene Name: immunoglobulin kappa joining 2
  ENSP ID: ENSP00000418768
  MOD_RES (1)..(1): Any amino acid
XCSFGQGTKLEIK

SEQ ID NO: 39790 - protein, 13 aa, Homo sapiens
  Payload ID: 8037
  Gene Symbol: IGKJ3
  Gene Name: immunoglobulin kappa joining 3
  ENSP ID: ENSP00000419518
  MOD_RES (1)..(1): Any amino acid
XFTFGPGTKVDIK

SEQ ID NO: 39791 - protein, 12 aa, Homo sapiens
  Payload ID: 8038
  Gene Symbol: IGKJ4
  Gene Name: immunoglobulin kappa joining 4
  ENSP ID: ENSP00000417097
LTFGGGTKVEIK

SEQ ID NO: 39792 - protein, 13 aa, Homo sapiens
  Payload ID: 8039
  Gene Symbol: IGKJ5
  Gene Name: immunoglobulin kappa joining 5
  ENSP ID: ENSP00000420166
  MOD_RES (1)..(1): Any amino acid
XITFGQGTRLEIK

SEQ ID NO: 39793 - protein, 117 aa, Homo sapiens
  Payload ID: 8040
  Gene Symbol: IGKV1OR2-108
  Gene Name: immunoglobulin kappa variable 1/OR2-108 (non-functional)
  ENSP ID: ENSP00000474395
MEMRVPAQLLGLLLLWLRGARCDIQVTQSPSSLSASVGDRVTITCRASQGISNGLSWYQQKPGQAPTLLIYAASSLQSGVPSRFSGSGSGTDFTLTISSLQPEDVATYYCLQDYTTP

SEQ ID NO: 39794 - protein, 117 aa, Homo sapiens
  Payload ID: 8041
  Gene Symbol: IGKV1-12
  Gene Name: immunoglobulin kappa variable 1-12
  ENSP ID: ENSP00000420576
MDMRVPAQLLGLLLLWFPGSRCDIQMTQSPSSVSASVGDRVTITCRASQGISSWLAWYQQKPGKAPKLLIYAASSLQSGVPSRFSGSGSGTDFTLTISSLQPEDFATYYCQQANSFP

SEQ ID NO: 39795 - protein, 185 aa, Homo sapiens
  Payload ID: 8041
  Gene Symbol: IGKV1-12
  Gene Name: immunoglobulin kappa variable 1-12
  ENSP ID: ENSP00000480537
MDMRVPAQLLGLLLLWFPGSRCDIQMTQSPSSVSASVGDRVTITCRASQGISSWLAWYQQKPGKAPKLLIYAASSLQSGVPSRFSGSGSGTDFTLTISSLQPEDFATYYCQQVESSHCTFGQGTKVEIKRTVAAPSVFIFPPSDEQLKSGTASVVCLLNNFYPREAKVQWKVDNALQSGNSQESV

SEQ ID NO: 39796 - protein, 117 aa, Homo sapiens; identical to SEQ ID NO: 39794
  Payload ID: 8041
  Gene Symbol: IGKV1-12
  Gene Name: immunoglobulin kappa variable 1-12
  ENSP ID: ENSP00000488148

SEQ ID NO: 39797 - protein, 185 aa, Homo sapiens; identical to SEQ ID NO: 39795
  Payload ID: 8041
  Gene Symbol: IGKV1-12
  Gene Name: immunoglobulin kappa variable 1-12
  ENSP ID: ENSP00000489568

SEQ ID NO: 39798 - protein, 117 aa, Homo sapiens
  Payload ID: 8042
  Gene Symbol: IGKV1-16
  Gene Name: immunoglobulin kappa variable 1-16
  ENSP ID: ENSP00000417344
MDMRVLAQLLGLLLLCFPGARCDIQMTQSPSSLSASVGDRVTITCRASQGISNYLAWFQQKPGKAPKSLIYAASSLQSGVPSKFSGSGSGTDFTLTISSLQPEDFATYYCQQYNSYP

SEQ ID NO: 39799 - protein, 117 aa, Homo sapiens; identical to SEQ ID NO: 39798
  Payload ID: 8042
  Gene Symbol: IGKV1-16
  Gene Name: immunoglobulin kappa variable 1-16
  ENSP ID: ENSP00000488377

SEQ ID NO: 39800 - protein, 117 aa, Homo sapiens
  Payload ID: 8043
  Gene Symbol: IGKV1-17
  Gene Name: immunoglobulin kappa variable 1-17
  ENSP ID: ENSP00000418357
MDMRVPAQLLGLLLLWFPGARCDIQMTQSPSSLSASVGDRVTITCRASQGIRNDLGWYQQKPGKAPKRLIYAASSLQSGVPSRFSGSGSGTEFTLTISSLQPEDFATYYCLQHNSYP

SEQ ID NO: 39801 - protein, 117 aa, Homo sapiens; identical to SEQ ID NO: 39800
  Payload ID: 8043
  Gene Symbol: IGKV1-17
  Gene Name: immunoglobulin kappa variable 1-17
  ENSP ID: ENSP00000488092

SEQ ID NO: 39802 - protein, 117 aa, Homo sapiens
  Payload ID: 8044
  Gene Symbol: IGKV1-27
  Gene Name: immunoglobulin kappa variable 1-27
  ENSP ID: ENSP00000418903
MDMRVPAQLLGLLLLWLPDTRCDIQMTQSPSSLSASVGDRVTITCRASQGISNYLAWYQQKPGKVPKLLIYAASTLQSGVPSRFSGSGSGTDFTLTISSLQPEDVATYYCQKYNSAP

SEQ ID NO: 39803 - protein, 117 aa, Homo sapiens; identical to SEQ ID NO: 39802
  Payload ID: 8044
  Gene Symbol: IGKV1-27
  Gene Name: immunoglobulin kappa variable 1-27
  ENSP ID: ENSP00000488456

SEQ ID NO: 39804 - protein, 117 aa, Homo sapiens
  Payload ID: 8045
  Gene Symbol: IGKV1-33
  Gene Name: immunoglobulin kappa variable 1-33
  ENSP ID: ENSP00000420020
MDMRVPAQLLGLLLLWLSGARCDIQMTQSPSSLSASVGDRVTITCQASQDISNYLNWYQQKPGKAPKLLIYDASNLETGVPSRFSGSGSGTDFTFTISSLQPEDIATYYCQQYDNLP

SEQ ID NO: 39805 - protein, 108 aa, Homo sapiens
  Payload ID: 8045
  Gene Symbol: IGKV1-33
  Gene Name: immunoglobulin kappa variable 1-33
  ENSP ID: ENSP00000479032
DIQMTQSPSSLSASVGDRVTITCQASQDISNYLNWYQQKPGKAPKLLIYDASNLETGVPSRFSGSGSGTDFTFTISSLQPEDIATYYCQQYDNLPPTVGKGHEQTLKR

SEQ ID NO: 39806 - protein, 117 aa, Homo sapiens; identical to SEQ ID NO: 39804
  Payload ID: 8045
  Gene Symbol: IGKV1-33
  Gene Name: immunoglobulin kappa variable 1-33
  ENSP ID: ENSP00000487732

SEQ ID NO: 39807 - protein, 108 aa, Homo sapiens; identical to SEQ ID NO: 39805
  Payload ID: 8045
  Gene Symbol: IGKV1-33
  Gene Name: immunoglobulin kappa variable 1-33
  ENSP ID: ENSP00000488818

SEQ ID NO: 39808 - protein, 117 aa, Homo sapiens
  Payload ID: 8046
  Gene Symbol: IGKV1-37
  Gene Name: immunoglobulin kappa variable 1-37 (non-functional)
  ENSP ID: ENSP00000417427
MDMRVPAQLLGLLLLWVPGARCDIQLTQSPSSLSASVGDRVTITCRVSQGISSYLNWYRQKPGKVPKLLIYSASNLQSGVPSRFSGSGSGTDFTLTISSLQPEDVATYYGQRTYNAP

SEQ ID NO: 39809 - protein, 117 aa, Homo sapiens; identical to SEQ ID NO: 39808
  Payload ID: 8046
  Gene Symbol: IGKV1-37
  Gene Name: immunoglobulin kappa variable 1-37 (non-functional)
  ENSP ID: ENSP00000487793

SEQ ID NO: 39810 - protein, 117 aa, Homo sapiens
  Payload ID: 8047
  Gene Symbol: IGKV1-39
  Gene Name: immunoglobulin kappa variable 1-39 (gene/pseudogene)
  ENSP ID: ENSP00000419058
MDMRVPAQLLGLLLLWLRGARCDIQMTQSPSSLSASVGDRVTITCRASQSISSYLNWYQQKPGKAPKLLIYAASSLQSGVPSRFSGSGSGTDFTLTISSLQPEDFATYYCQQSYSTP

SEQ ID NO: 39811 - protein, 117 aa, Homo sapiens; identical to SEQ ID NO: 39810
  Payload ID: 8047
  Gene Symbol: IGKV1-39
  Gene Name: immunoglobulin kappa variable 1-39 (gene/pseudogene)
  ENSP ID: ENSP00000488680

SEQ ID NO: 39812 - protein, 117 aa, Homo sapiens
  Payload ID: 8048
  Gene Symbol: IGKV1-5
  Gene Name: immunoglobulin kappa variable 1-5
  Uniprot ID: P01602
  ENSP ID: ENSP00000420436
MDMRVPAQLLGLLLLWLPGAKCDIQMTQSPSTLSASVGDRVTITCRASQSISSWLAWYQQKPGKAPKLLIYKASSLESGVPSRFSGSGSGTEFTLTISSLQPDDFATYYCQQYNSYS

SEQ ID NO: 39813 - protein, 117 aa, Homo sapiens; identical to SEQ ID NO: 39812
  Payload ID: 8048
  Gene Symbol: IGKV1-5
  Gene Name: immunoglobulin kappa variable 1-5
  Uniprot ID: P01602
  ENSP ID: ENSP00000488639

SEQ ID NO: 39814 - protein, 117 aa, Homo sapiens
  Payload ID: 8049
  Gene Symbol: IGKV1-6
  Gene Name: immunoglobulin kappa variable 1-6
  ENSP ID: ENSP00000420361
MDMRVPAQLLGLLLLWLPGARCAIQMTQSPSSLSASVGDRVTITCRASQGIRNDLGWYQQKPGKAPKLLIYAASSLQSGVPSRFSGSGSGTDFTLTISSLQPEDFATYYCLQDYNYP

SEQ ID NO: 39815 - protein, 117 aa, Homo sapiens; identical to SEQ ID NO: 39814
  Payload ID: 8049
  Gene Symbol: IGKV1-6
  Gene Name: immunoglobulin kappa variable 1-6
  ENSP ID: ENSP00000488804

SEQ ID NO: 39816 - protein, 115 aa, Homo sapiens
  Payload ID: 8050
  Gene Symbol: IGKV1-8
  Gene Name: immunoglobulin kappa variable 1-8
  ENSP ID: ENSP00000419211
MRVPAQLLGLLLLWLPGARCAIRMTQSPSSFSASTGDRVTITCRASQGISSYLAWYQQKPGKAPKLLIYAASTLQSGVPSRFSGSGSGTDFTLTISCLQSEDFATYYCQQYYSYP

SEQ ID NO: 39817 - protein, 115 aa, Homo sapiens; identical to SEQ ID NO: 39816
  Payload ID: 8050
  Gene Symbol: IGKV1-8
  Gene Name: immunoglobulin kappa variable 1-8
  ENSP ID: ENSP00000488413

SEQ ID NO: 39818 - protein, 183 aa, Homo sapiens
  Payload ID: 8050
  Gene Symbol: IGKV1-8
  Gene Name: immunoglobulin kappa variable 1-8
  ENSP ID: ENSP00000488963
MRVPAQLLGLLLLWLPGARCDIQLTQSPSFLSASVGDRVTITCRASQGISSYLAWYQQKPGKAPKLLIYAASTLQSGVPSRFSGSGSGTDFTLTISCLQSEDFATYYCQQYYSYPPTFGQGTKLEIKRTVAAPSVFIFPPSDEQLKSGTASVVCLLNNFYPREAKVQWKVDNALQSGNSQESV

SEQ ID NO: 39819 - protein, 183 aa, Homo sapiens; identical to SEQ ID NO: 39818
  Payload ID: 8050
  Gene Symbol: IGKV1-8
  Gene Name: immunoglobulin kappa variable 1-8
  ENSP ID: ENSP00000489500

SEQ ID NO: 39820 - protein, 117 aa, Homo sapiens
  Payload ID: 8051
  Gene Symbol: IGKV1-9
  Gene Name: immunoglobulin kappa variable 1-9
  ENSP ID: ENSP00000419598
MDMRVPAQLLGLLLLWLPGARCDIQLTQSPSFLSASVGDRVTITCRASQGISSYLAWYQQKPGKAPKLLIYAASTLQSGVPSRFSGSGSGTEFTLTISSLQPEDFATYYCQQLNSYP

SEQ ID NO: 39821 - protein, 117 aa, Homo sapiens; identical to SEQ ID NO: 39820
  Payload ID: 8051
  Gene Symbol: IGKV1-9
  Gene Name: immunoglobulin kappa variable 1-9
  ENSP ID: ENSP00000488384

SEQ ID NO: 39822 - protein, 117 aa, Homo sapiens
  Payload ID: 8052
  Gene Symbol: IGKV1D-12
  Gene Name: immunoglobulin kappa variable 1D-12
  ENSP ID: ENSP00000482464
MDMMVPAQLLGLLLLWFPGSRCDIQMTQSPSSVSASVGDRVTITCRASQGISSWLAWYQQKPGKAPKLLIYAASSLQSGVPSRFSGSGSGTDFTLTISSLQPEDFATYYCQQANSFP

SEQ ID NO: 39823 - protein, 117 aa, Homo sapiens
  Payload ID: 8053
  Gene Symbol: IGKV1D-13
  Gene Name: immunoglobulin kappa variable 1D-13
  ENSP ID: ENSP00000480959
MDMRVPAQLLGLLLLWLPGARCAIQLTQSPSSLSASVGDRVTITCRASQGISSALAWYQQKPGKAPKLLIYDASSLESGVPSRFSGSGSGTDFTLTISSLQPEDFATYYCQQFNSYP

SEQ ID NO: 39824 - protein, 117 aa, Homo sapiens
  Payload ID: 8054
  Gene Symbol: IGKV1D-16
  Gene Name: immunoglobulin kappa variable 1D-16
  Uniprot ID: P01601
  ENSP ID: ENSP00000418200
MDMRVLAQLLGLLLLCFPGARCDIQMTQSPSSLSASVGDRVTITCRASQGISSWLAWYQQKPEKAPKSLIYAASSLQSGVPSRFSGSGSGTDFTLTISSLQPEDFATYYCQQYNSYP

SEQ ID NO: 39825 - protein, 117 aa, Homo sapiens
  Payload ID: 8055
  Gene Symbol: IGKV1D-17
  Gene Name: immunoglobulin kappa variable 1D-17
  ENSP ID: ENSP00000418292
MDMRVPAQLLGLLLLWFPGARCNIQMTQSPSAMSASVGDRVTITCRARQGISNYLAWFQQKPGKVPKHLIYAASSLQSGVPSRFSGSGSGTEFTLTISSLQPEDFATYYCLQHNSYP

SEQ ID NO: 39826 - protein, 117 aa, Homo sapiens; identical to SEQ ID NO: 39804
  Payload ID: 8056
  Gene Symbol: IGKV1D-33
  Gene Name: immunoglobulin kappa variable 1D-33
  ENSP ID: ENSP00000374800

SEQ ID NO: 39827 - protein, 108 aa, Homo sapiens; identical to SEQ ID NO: 39805
  Payload ID: 8056
  Gene Symbol: IGKV1D-33
  Gene Name: immunoglobulin kappa variable 1D-33
  ENSP ID: ENSP00000482678

SEQ ID NO: 39828 - protein, 117 aa, Homo sapiens; identical to SEQ ID NO: 39808
  Payload ID: 8057
  Gene Symbol: IGKV1D-37
  Gene Name: immunoglobulin kappa variable 1D-37 (non-functional)
  ENSP ID: ENSP00000425962

SEQ ID NO: 39829 - protein, 117 aa, Homo sapiens; identical to SEQ ID NO: 39810
  Payload ID: 8058
  Gene Symbol: IGKV1D-39
  Gene Name: immunoglobulin kappa variable 1D-39
  ENSP ID: ENSP00000406382

SEQ ID NO: 39830 - protein, 117 aa, Homo sapiens
  Payload ID: 8059
  Gene Symbol: IGKV1D-42
  Gene Name: immunoglobulin kappa variable 1D-42 (non-functional)
  ENSP ID: ENSP00000374813
MDMRVPAQLLGLLLLWLPGVRFDIQMTQSPSFLSASVGDRVSIICWASEGISSNLAWYLQKPGKSPKLFLYDAKDLHPGVSSRFSGRGSGTDFTLTIISLKPEDFAAYYCKQDFSYP

SEQ ID NO: 39831 - protein, 117 aa, Homo sapiens
  Payload ID: 8060
  Gene Symbol: IGKV1D-43
  Gene Name: immunoglobulin kappa variable 1D-43
  ENSP ID: ENSP00000417961
MDMRVPAQRLGLLLLWFPGARCAIRMTQSPFSLSASVGDRVTITCWASQGISSYLAWYQQKPAKAPKLFIYYASSLQSGVPSRFSGSGSGTDYTLTISSLQPEDFATYYCQQYYSTP

SEQ ID NO: 39832 - protein, 117 aa, Homo sapiens
  Payload ID: 8061
  Gene Symbol: IGKV1D-8
  Gene Name: immunoglobulin kappa variable 1D-8
  ENSP ID: ENSP00000420285
MDMRVPAQLLGLLLLWLPGARCAIWMTQSPSLLSASTGDRVTISCRMSQGISSYLAWYQQKPGKAPELLIYAASTLQSGVPSRFSGSGSGTDFTLTISCLQSEDFATYYCQQYYSFP

SEQ ID NO: 39833 - protein, 117 aa, Homo sapiens
  Payload ID: 8061
  Gene Symbol: IGKV1D-8
  Gene Name: immunoglobulin kappa variable 1D-8
  ENSP ID: ENSP00000485892
MDMRVPAQLLGLLLLWLPGARCVIWMTQSPSLLSASTGDRVTISCRMSQGISSYLAWYQQKPGKAPELLIYAASTLQSGVPSRFSGSGSGTDFTLTISCLQSEDFATYYCQQYYSFP

SEQ ID NO: 39834 - protein, 120 aa, Homo sapiens
  Payload ID: 8062
  Gene Symbol: IGKV2-24
  Gene Name: immunoglobulin kappa variable 2-24
  ENSP ID: ENSP00000419300
MRLLAQLLGLLMLWVPGSSGDIVMTQTPLSSPVTLGQPASISCRSSQSLVHSDGNTYLSWLQQRPGQPPRLLIYKISNRFSGVPDRFSGSGAGTDFTLKISRVEAEDVGVYYCMQATQFP

SEQ ID NO: 39835 - protein, 120 aa, Homo sapiens; identical to SEQ ID NO: 39834
  Payload ID: 8062
  Gene Symbol: IGKV2-24
  Gene Name: immunoglobulin kappa variable 2-24
  ENSP ID: ENSP00000488087

SEQ ID NO: 39836 - protein, 120 aa, Homo sapiens
  Payload ID: 8063
  Gene Symbol: IGKV2-28
  Gene Name: immunoglobulin kappa variable 2-28
  ENSP ID: ENSP00000419353
MRLPAQLLGLLMLWVSGSSGDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTP

SEQ ID NO: 39837 - protein, 120 aa, Homo sapiens; identical to SEQ ID NO: 39836
  Payload ID: 8063
  Gene Symbol: IGKV2-28
  Gene Name: immunoglobulin kappa variable 2-28
  ENSP ID: ENSP00000487690

SEQ ID NO: 39838 - protein, 120 aa, Homo sapiens
  Payload ID: 8064
  Gene Symbol: IGKV2-30
  Gene Name: immunoglobulin kappa variable 2-30
  ENSP ID: ENSP00000418138
MRLPAQLLGLLMLWVPGSSGDVVMTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWP

SEQ ID NO: 39839 - protein, 120 aa, Homo sapiens; identical to SEQ ID NO: 39838
  Payload ID: 8064
  Gene Symbol: IGKV2-30
  Gene Name: immunoglobulin kappa variable 2-30
  ENSP ID: ENSP00000488685

SEQ ID NO: 39840 - protein, 105 aa, Homo sapiens
  Payload ID: 8065
  Gene Symbol: IGKV2-40
  Gene Name: immunoglobulin kappa variable 2-40
  ENSP ID: ENSP00000480029
  MOD_RES (1)..(1): Any amino acid
XSSEDIVMTQTPLSLPVTPGEPASISCRSSQSLLDSDDGNTYLDWYLQKPGQSPQLLIYTLSYRASGVPDRFSGSGSGTDFTLKISRVEAEDVGVYYCMQRIEFP

SEQ ID NO: 39841 - protein, 104 aa, Homo sapiens
  Payload ID: 8065
  Gene Symbol: IGKV2-40
  Gene Name: immunoglobulin kappa variable 2-40
  ENSP ID: ENSP00000483585
EDIVMTQTPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPST

SEQ ID NO: 39842 - protein, 105 aa, Homo sapiens; identical to SEQ ID NO: 39840
  Payload ID: 8065
  Gene Symbol: IGKV2-40
  Gene Name: immunoglobulin kappa variable 2-40
  ENSP ID: ENSP00000487928
  MOD_RES (1)..(1): Any amino acid

SEQ ID NO: 39843 - protein, 104 aa, Homo sapiens; identical to SEQ ID NO: 39841
  Payload ID: 8065
  Gene Symbol: IGKV2-40
  Gene Name: immunoglobulin kappa variable 2-40
  ENSP ID: ENSP00000488763

SEQ ID NO: 39844 - protein, 120 aa, Homo sapiens
  Payload ID: 8066
  Gene Symbol: IGKV2D-24
  Gene Name: immunoglobulin kappa variable 2D-24 (non-functional)
  ENSP ID: ENSP00000417136
MRLLAQLLGLLMLWVPGSSGDIVMTQTPLSSPVTLGQPASISFRSSQSLVHSDGNTYLSWLQQRPGQPPRLLIYKVSNRFSGVPDRFSGSGAGTDFTLKISRVEAEDVGVYYCTQATQFP

SEQ ID NO: 39845 - protein, 120 aa, Homo sapiens
  Payload ID: 8067
  Gene Symbol: IGKV2D-26
  Gene Name: immunoglobulin kappa variable 2D-26
  ENSP ID: ENSP00000374803
MRLPAQLLGLLMLWVPGSSAEIVMTQTPLSLSITPGEQASMSCRSSQSLLHSDGYTYLYWFLQKARPVSTLLIYEVSNRFSGVPDRFSGSGSGTDFTLKISRVEAEDFGVYYCMQDAQDP

SEQ ID NO: 39846 - protein, 120 aa, Homo sapiens; identical to SEQ ID NO: 39836
  Payload ID: 8068
  Gene Symbol: IGKV2D-28
  Gene Name: immunoglobulin kappa variable 2D-28
  ENSP ID: ENSP00000393492

SEQ ID NO: 39847 - protein, 102 aa, Homo sapiens
  Payload ID: 8068
  Gene Symbol: IGKV2D-28
  Gene Name: immunoglobulin kappa variable 2D-28
  ENSP ID: ENSP00000452662
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPPT

SEQ ID NO: 39848 - protein, 120 aa, Homo sapiens
  Payload ID: 8069
  Gene Symbol: IGKV2D-29
  Gene Name: immunoglobulin kappa variable 2D-29
  ENSP ID: ENSP00000417637
MRLPAQLLGLLMLWIPGSSADIVMTQTPLSLSVTPGQPASISCKSSQSLLHSDGKTYLYWYLQKPGQPPQLLIYEVSNRFSGVPDRFSGSGSGTDFTLKISRVEAEDVGVYYCMQSIQLP

SEQ ID NO: 39849 - protein, 102 aa, Homo sapiens
  Payload ID: 8069
  Gene Symbol: IGKV2D-29
  Gene Name: immunoglobulin kappa variable 2D-29
  ENSP ID: ENSP00000483567
DIVMTQTPLSLSVTPGQPASISCKSSQSLLHSDGKTYLYWYLQKPGQPPQLLIYEVSNRFSGVPDRFSGSGSGTDFTLKISRVEAEDVGVYYCMQSIQLPPT

SEQ ID NO: 39850 - protein, 120 aa, Homo sapiens
  Payload ID: 8070
  Gene Symbol: IGKV2D-30
  Gene Name: immunoglobulin kappa variable 2D-30
  ENSP ID: ENSP00000418948
MRLPAQLLGLLMLWVPGSSGDVVMTQSPLSLPVTLGQPASISCRSSQSLVYSDGNTYLNWFQQRPGQSPRRLIYKVSNWDSGVPDRFSGSGSGTDFTLKISRVEAEDVGVYYCMQGTHWP

SEQ ID NO: 39851 - protein, 110 aa, Homo sapiens
  Payload ID: 8071
  Gene Symbol: IGKV2D-40
  Gene Name: immunoglobulin kappa variable 2D-40
  ENSP ID: ENSP00000409413
MLWVPGSSEDIVMTQTPLSLPVTPGEPASISCRSSQSLLDSDDGNTYLDWYLQKPGQSPQLLIYTLSYRASGVPDRFSGSGSGTDFTLKISRVEAEDVGVYYCMQRIEFP

SEQ ID NO: 39852 - protein, 104 aa, Homo sapiens; identical to SEQ ID NO: 39841
  Payload ID: 8071
  Gene Symbol: IGKV2D-40
  Gene Name: immunoglobulin kappa variable 2D-40
  ENSP ID: ENSP00000452747

SEQ ID NO: 39853 - protein, 116 aa, Homo sapiens
  Payload ID: 8072
  Gene Symbol: IGKV3OR2-268
  Gene Name: immunoglobulin kappa variable 3/OR2-268 (non-functional)
  ENSP ID: ENSP00000474297
MEAPAQLLFLLLLWLPDTTGEIVMTQSPATLSLSPGERATLSCRASQSVSSSYLSWYQQKPGQAPRLLIYGASTRATGIPARFSGSGSGTDFTLTISSLQPEDFAVYYCQQDYNLP

SEQ ID NO: 39854 - protein, 115 aa, Homo sapiens
  Payload ID: 8073
  Gene Symbol: IGKV3-11
  Gene Name: immunoglobulin kappa variable 3-11
  Uniprot ID: P04433
  ENSP ID: ENSP00000420118
MEAPAQLLFLLLLWLPDTTGEIVLTQSPATLSLSPGERATLSCRASQSVSSYLAWYQQKPGQAPRLLIYDASNRATGIPARFSGSGSGTDFTLTISSLEPEDFAVYYCQQRSNWP

SEQ ID NO: 39855 - protein, 115 aa, Homo sapiens; identical to SEQ ID NO: 39854
  Payload ID: 8073
  Gene Symbol: IGKV3-11
  Gene Name: immunoglobulin kappa variable 3-11
  Uniprot ID: P04433
  ENSP ID: ENSP00000487987

SEQ ID NO: 39856 - protein, 115 aa, Homo sapiens
  Payload ID: 8074
  Gene Symbol: IGKV3-15
  Gene Name: immunoglobulin kappa variable 3-15
  ENSP ID: ENSP00000374787
MEAPAQLLFLLLLWLPDTTGEIVMTQSPATLSVSPGERATLSCRASQSVSSNLAWYQQKPGQAPRLLIYGASTRATGIPARFSGSGSGTEFTLTISSLQSEDFAVYYCQQYNNWP

SEQ ID NO: 39857 - protein, 115 aa, Homo sapiens; identical to SEQ ID NO: 39856
  Payload ID: 8074
  Gene Symbol: IGKV3-15
  Gene Name: immunoglobulin kappa variable 3-15
  ENSP ID: ENSP00000488086

SEQ ID NO: 39858 - protein, 116 aa, Homo sapiens
  Payload ID: 8075
  Gene Symbol: IGKV3-20
  Gene Name: immunoglobulin kappa variable 3-20
  ENSP ID: ENSP00000418649
METPAQLLFLLLLWLPDTTGEIVLTQSPGTLSLSPGERATLSCRASQSVSSSYLAWYQQKPGQAPRLLIYGASSRATGIPDRFSGSGSGTDFTLTISRLEPEDFAVYYCQQYGSSP

SEQ ID NO: 39859 - protein, 116 aa, Homo sapiens; identical to SEQ ID NO: 39858
  Payload ID: 8075
  Gene Symbol: IGKV3-20
  Gene Name: immunoglobulin kappa variable 3-20
  ENSP ID: ENSP00000487628

SEQ ID NO: 39860 - protein, 116 aa, Homo sapiens
  Payload ID: 8076
  Gene Symbol: IGKV3-7
  Gene Name: immunoglobulin kappa variable 3-7 (non-functional)
  ENSP ID: ENSP00000374782
MEAPAQLLFLLLLWLPDTTREIVMTQSPPTLSLSPGERVTLSCRASQSVSSSYLTWYQQKPGQAPRLLIYGASTRATSIPARFSGSGSGTDFTLTISSLQPEDFAVYYCQQDYNLP

SEQ ID NO: 39861 - protein, 116 aa, Homo sapiens; identical to SEQ ID NO: 39860
  Payload ID: 8076
  Gene Symbol: IGKV3-7
  Gene Name: immunoglobulin kappa variable 3-7 (non-functional)
  ENSP ID: ENSP00000487957

SEQ ID NO: 39862 - protein, 115 aa, Homo sapiens
  Payload ID: 8077
  Gene Symbol: IGKV3D-11
  Gene Name: immunoglobulin kappa variable 3D-11
  ENSP ID: ENSP00000374812
MEAPAQLLFLLLLWLPDTTGEIVLTQSPATLSLSPGERATLSCRASQSVSSYLAWYQQKPGQAPRLLIYDASNRATGIPARFSGSGPGTDFTLTISSLEPEDFAVYYCQQRSNWH

SEQ ID NO: 39863 - protein, 108 aa, Homo sapiens
  Payload ID: 8077
  Gene Symbol: IGKV3D-11
  Gene Name: immunoglobulin kappa variable 3D-11
  ENSP ID: ENSP00000478879
QLLFLLLLWLPDTTGEIVLTQSPATLSLSPGERATLSCRASQSVSSYLAWYQQKPGQAPRLLIYDASNRATGIPARFSGSGPGTDFTLTISSLEPEDFAVYYCQQRSN

SEQ ID NO: 39864 - protein, 115 aa, Homo sapiens
  Payload ID: 8078
  Gene Symbol: IGKV3D-15
  Gene Name: immunoglobulin kappa variable 3D-15 (gene/pseudogene)
  ENSP ID: ENSP00000403672
MEAPAQLLFLLLLWLPDTTGEIVMTQSPATLSVSPGERATLSCRASQSVSSNLAWYQQKPGQAPRLLIYGASIRATGIPARFSGSGSGTEFTLTISILQSEDFAVYYCQQYNNWP

SEQ ID NO: 39865 - protein, 116 aa, Homo sapiens
  Payload ID: 8079
  Gene Symbol: IGKV3D-20
  Gene Name: immunoglobulin kappa variable 3D-20
  ENSP ID: ENSP00000374805
METPAQLLFLLLLWLPDTTGEIVLTQSPATLSLSPGERATLSCGASQSVSSSYLAWYQQKPGLAPRLLIYDASSRATGIPDRFSGSGSGTDFTLTISRLEPEDFAVYYCQQYGSSP

SEQ ID NO: 39866 - protein, 119 aa, Homo sapiens
  Payload ID: 8080
  Gene Symbol: IGKV3D-7
  Gene Name: immunoglobulin kappa variable 3D-7
  ENSP ID: ENSP00000402914
MEPWKPQHSFFFLLLLWLPDTTGEIVMTQSPATLSLSPGERATLSCRASQSVSSSYLSWYQQKPGQAPRLLIYGASTRATGIPARFSGSGSGTDFTLTISSLQPEDFAVYYCQQDYNLP

SEQ ID NO: 39867 - protein, 111 aa, Homo sapiens
  Payload ID: 8080
  Gene Symbol: IGKV3D-7
  Gene Name: immunoglobulin kappa variable 3D-7
  ENSP ID: ENSP00000480023
QLLFLLLLWLPDTTGEIVMTQSPATLSLSPGERATLSCRASQSVSSSYLSWYQQKPGQAPRLLIYGASTRATGIPARFSGSGSGTDFTLTISSLQPEDFAVYYCQQDYNLP

SEQ ID NO: 39868 - protein, 119 aa, Homo sapiens; identical to SEQ ID NO: 39866
  Payload ID: 8080
  Gene Symbol: IGKV3D-7
  Gene Name: immunoglobulin kappa variable 3D-7
  ENSP ID: ENSP00000487088

SEQ ID NO: 39869 - protein, 121 aa, Homo sapiens
  Payload ID: 8081
  Gene Symbol: IGKV4-1
  Gene Name: immunoglobulin kappa variable 4-1
  Uniprot ID: P06312
  ENSP ID: ENSP00000374778
MVLQTQVFISLLLWISGAYGDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTP

SEQ ID NO: 39870 - protein, 115 aa, Homo sapiens
  Payload ID: 8082
  Gene Symbol: IGKV5-2
  Gene Name: immunoglobulin kappa variable 5-2
  Uniprot ID: P06315
  ENSP ID: ENSP00000374779
MGSQVHLLSFLLLWISDTRAETTLTQSPAFMSATPGDKVNISCKASQDIDDDMNWYQQKPGEAAIFIIQEATTLVPGIPPRFSGSGYGTDFTLTINNIESEDAAYYFCLQHDNFP

SEQ ID NO: 39871 - protein, 115 aa, Homo sapiens; identical to SEQ ID NO: 39870
  Payload ID: 8082
  Gene Symbol: IGKV5-2
  Gene Name: immunoglobulin kappa variable 5-2
  Uniprot ID: P06315
  ENSP ID: ENSP00000487796

SEQ ID NO: 39872 - protein, 114 aa, Homo sapiens
  Payload ID: 8083
  Gene Symbol: IGKV6-21
  Gene Name: immunoglobulin kappa variable 6-21 (non-functional)
  ENSP ID: ENSP00000374791
MLPSQLIGFLLLWVPASRGEIVLTQSPDFQSVTPKEKVTITCRASQSIGSSLHWYQQKPDQSPKLLIKYASQSFSGVPSRFSGSGSGTDFTLTINSLEAEDAATYYCHQSSSLP

SEQ ID NO: 39873 - protein, 114 aa, Homo sapiens; identical to SEQ ID NO: 39872
  Payload ID: 8083
  Gene Symbol: IGKV6-21
  Gene Name: immunoglobulin kappa variable 6-21 (non-functional)
  ENSP ID: ENSP00000488349

SEQ ID NO: 39874 - protein, 114 aa, Homo sapiens
  Payload ID: 8084
  Gene Symbol: IGKV6D-21
  Gene Name: immunoglobulin kappa variable 6D-21 (non-functional)
  ENSP ID: ENSP00000413304
MSPSQLIGFLLLWVPASRGEIVLTQSPDFQSVTPKEKVTITCRASQSIGSSLHWYQQKPDQSPKLLIKYASQSISGVPSRFSGSGSGTDFTLTINSLEAEDAAAYYCHQSSSLP

SEQ ID NO: 39875 - protein, 115 aa, Homo sapiens
  Payload ID: 8085
  Gene Symbol: IGKV6D-41
  Gene Name: immunoglobulin kappa variable 6D-41 (non-functional)
  ENSP ID: ENSP00000374806
MVSPLQFLRLLLLWVPASRGDVVMTQSPAFLSVTPGEKVTITCQASEGIGNYLYWYQQKPDQAPKLLIKYASQSISGVPSRFSGSGSGTDFTFTISSLEAEDAATYYCQQGNKHP

SEQ ID NO: 39876 - protein, 106 aa, Homo sapiens
  Payload ID: 8086
  Gene Symbol: IGLC1
  Gene Name: immunoglobulin lambda constant 1 (Mcg marker)
  ENSP ID: ENSP00000374855
  MOD_RES (1)..(1): Any amino acid
XQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 39877 - protein, 106 aa, Homo sapiens
  Payload ID: 8087
  Gene Symbol: IGLC2
  Gene Name: immunoglobulin lambda constant 2 (Kern-Oz- marker)
  ENSP ID: ENSP00000374856
  MOD_RES (1)..(1): Any amino acid
XQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 39878 - protein, 106 aa, Homo sapiens
  Payload ID: 8088
  Gene Symbol: IGLC3
  Gene Name: immunoglobulin lambda constant 3 (Kern-Oz+ marker)
  ENSP ID: ENSP00000374857
  MOD_RES (1)..(1): Any amino acid
XQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 39879 - protein, 106 aa, Homo sapiens
  Payload ID: 8089
  Gene Symbol: IGLC7
  Gene Name: immunoglobulin lambda constant 7
  ENSP ID: ENSP00000374859
  MOD_RES (1)..(1): Any amino acid
XQPKAAPSVTLFPPSSEELQANKATLVCLVSDFNPGAVTVAWKADGSPVKVGVETTKPSKQSNNKYAASSYLSLTPEQWKSHRSYSCRVTHEGSTVEKTVAPAECS

SEQ ID NO: 39880 - protein, 42 aa, Homo sapiens
  Payload ID: 8090
  Gene Symbol: IGLJ1
  Gene Name: immunoglobulin lambda joining 1
  ENSP ID: ENSP00000417505
PSRLLLQPSPQRADPRCWPRGFWSEPQSLCYVFGTGTKVTVL

SEQ ID NO: 39881 - protein, 47 aa, Homo sapiens
  Payload ID: 8091
  Gene Symbol: IGLJ2
  Gene Name: immunoglobulin lambda joining 2
  ENSP ID: ENSP00000418274
MPPGPLAPASSFTAAVGAGAGASQGGFLYEPVSQCVVFGGGTKLTVL

SEQ ID NO: 39882 - protein, 50 aa, Homo sapiens
  Payload ID: 8092
  Gene Symbol: IGLJ3
  Gene Name: immunoglobulin lambda joining 3
  ENSP ID: ENSP00000419781
MSRCHQDHWSQLPPSQLQWGLGLGASQGGFLYEPVSQCWVFGGGTKLTVL

SEQ ID NO: 39883 - protein, 11 aa, Homo sapiens
  Payload ID: 8093
  Gene Symbol: IGLJ4
  Gene Name: immunoglobulin lambda joining 4 (non-functional)
  ENSP ID: ENSP00000419997
VFGGGTQLIIL

SEQ ID NO: 39884 - protein, 24 aa, Homo sapiens
  Payload ID: 8094
  Gene Symbol: IGLJ5
  Gene Name: immunoglobulin lambda joining 5 (non-functional)
  ENSP ID: ENSP00000418818
QRGFLYEPVSQHWVFGEGTELTVL

SEQ ID NO: 39885 - protein, 23 aa, Homo sapiens
  Payload ID: 8095
  Gene Symbol: IGLJ6
  Gene Name: immunoglobulin lambda joining 6
  ENSP ID: ENSP00000419267
GGFVCRVISQCNVFGSGTKVTVL

SEQ ID NO: 39886 - protein, 15 aa, Homo sapiens
  Payload ID: 8096
  Gene Symbol: IGLJ7
  Gene Name: immunoglobulin lambda joining 7
  ENSP ID: ENSP00000419233
SLCAVFGGGTQLTVL

SEQ ID NO: 39887 - protein, 117 aa, Homo sapiens
  Payload ID: 8097
  Gene Symbol: IGLV10-54
  Gene Name: immunoglobulin lambda variable 10-54
  ENSP ID: ENSP00000374822
MPWALLLLTLLTHSAVSVVQAGLTQPPSVSKGLRQTATLTCTGNSNIVGNQGAAWLQQHQGHPPKLLSYRNNNRPSGISERFSASRSGNTASLTITGLQPEDEADYYCSALDSSLSA

SEQ ID NO: 39888 - protein, 137 aa, Homo sapiens
  Payload ID: 8098
  Gene Symbol: IGLV11-55
  Gene Name: immunoglobulin lambda variable 11-55 (non-functional)
  ENSP ID: ENSP00000374821
MALTPLLLLLLSHCTGSLSRPVLTQPPSLSASPGATARLPCTLSSDLSVGGKNMFWYQQKLGSSPRLFLYHYSDSDKQLGPGVPSRVSGSKETSSNTAFLLISGLQPEDEADYYCQVYESSANHSETDEEVGQKPRF

SEQ ID NO: 39889 - protein, 117 aa, Homo sapiens
  Payload ID: 8099
  Gene Symbol: IGLV1-36
  Gene Name: immunoglobulin lambda variable 1-36
  ENSP ID: ENSP00000374836
MAWSPLFLTLITHCAGSWAQSVLTQPPSVSEAPRQRVTISCSGSSSNIGNNAVNWYQQLPGKAPKLLIYYDDLLPSGVSDRFSGSKSGTSASLAISGLQSEDEADYYCAAWDDSLNG

SEQ ID NO: 39890 - protein, 117 aa, Homo sapiens
  Payload ID: 8099
  Gene Symbol: IGLV1-36
  Gene Name: immunoglobulin lambda variable 1-36
  ENSP ID: ENSP00000477718
MTCSPLLLTLLIHCTGSWAQSVLTQPPSVSEAPRQRVTISCSGSSSNIGNNAVNWYQQLPGKAPKLLIYYDDLLPSGVSDRFSGSKSGTSASLAISGLQSEDEADYYCAAWDDSLNG

SEQ ID NO: 39891 - protein, 117 aa, Homo sapiens; identical to SEQ ID NO: 39889
  Payload ID: 8099
  Gene Symbol: IGLV1-36
  Gene Name: immunoglobulin lambda variable 1-36
  ENSP ID: ENSP00000479309

SEQ ID NO: 39892 - protein, 118 aa, Homo sapiens
  Payload ID: 8100
  Gene Symbol: IGLV1-40
  Gene Name: immunoglobulin lambda variable 1-40
  ENSP ID: ENSP00000374834
MAWSPLLLTLLAHCTGSWAQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSG

SEQ ID NO: 39893 - protein, 118 aa, Homo sapiens; identical to SEQ ID NO: 39892
  Payload ID: 8100
  Gene Symbol: IGLV1-40
  Gene Name: immunoglobulin lambda variable 1-40
  ENSP ID: ENSP00000479659

SEQ ID NO: 39894 - protein, 117 aa, Homo sapiens
  Payload ID: 8101
  Gene Symbol: IGLV1-44
  Gene Name: immunoglobulin lambda variable 1-44
  ENSP ID: ENSP00000374832
MASFPLLLTLLTHCAGSWAQSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNG

SEQ ID NO: 39895 - protein, 117 aa, Homo sapiens; identical to SEQ ID NO: 39894
  Payload ID: 8101
  Gene Symbol: IGLV1-44
  Gene Name: immunoglobulin lambda variable 1-44
  ENSP ID: ENSP00000485735

SEQ ID NO: 39896 - protein, 117 aa, Homo sapiens
  Payload ID: 8102
  Gene Symbol: IGLV1-47
  Gene Name: immunoglobulin lambda variable 1-47
  ENSP ID: ENSP00000374829
MAGFPLLLTLLTHCAGSWAQSVLTQPPSASGTPGQRVTISCSGSSSNIGSNYVYWYQQLPGTAPKLLIYSNNQRPSGVPDRFSGSKSGTSASLAISGLRSEDEADYYCAAWDDSLSG

SEQ ID NO: 39897 - protein, 118 aa, Homo sapiens
  Payload ID: 8103
  Gene Symbol: IGLV1-50
  Gene Name: immunoglobulin lambda variable 1-50 (non-functional)
  ENSP ID: ENSP00000374826
MAWSSLLLTLLAHCTGSWAQSVLTQPPSVSGAPGQRVTISCTGSSSNIGAGYVVHWYQQLPGTAPKLLIYGNSNRPSGVPDQFSGSKSGTSASLAITGLQSEDEADYYCKAWDNSLNA

SEQ ID NO: 39898 - protein, 121 aa, Homo sapiens
  Payload ID: 8104
  Gene Symbol: IGLV1-51
  Gene Name: immunoglobulin lambda variable 1-51
  ENSP ID: ENSP00000374825
MTCSPLLLTLLIHCTGSWAQSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGTVL

SEQ ID NO: 39899 - protein, 119 aa, Homo sapiens
  Payload ID: 8105
  Gene Symbol: IGLV2-11
  Gene Name: immunoglobulin lambda variable 2-11
  ENSP ID: ENSP00000374849
MAWALLLLSLLTQGTGSWAQSALTQPRSVSGSPGQSVTISCTGTSSDVGGYNYVSWYQQHPGKAPKLMIYDVSKRPSGVPDRFSGSKSGNTASLTISGLQAEDEADYYCCSYAGSYTFH

SEQ ID NO: 39900 - protein, 120 aa, Homo sapiens
  Payload ID: 8106
  Gene Symbol: IGLV2-14
  Gene Name: immunoglobulin lambda variable 2-14
  ENSP ID: ENSP00000374847
MAWALLLLTLLTQGTGSWAQSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLHS

SEQ ID NO: 39901 - protein, 120 aa, Homo sapiens [sequence omitted]

SEQ ID NO: 39902 - protein, 113 aa, Homo sapiens
  Payload ID: 8108
  Gene Symbol: IGLV2-23
  Gene Name: immunoglobulin lambda variable 2-23
  ENSP ID: ENSP00000374841
MAWALLLLTLLTQDTGSWAQSALTQPASVSGSPGQSITISCTGTSSDVGSYNLVSWYQQHPGKAPKLMIYEGSKRPSGVSNRFSGSKSGNTASLTISGLQAEDEADYYCCSYA

SEQ ID NO: 39903 - protein, 118 aa, Homo sapiens
  Payload ID: 8109
  Gene Symbol: IGLV2-33
  Gene Name: immunoglobulin lambda variable 2-33 (non-functional)
  ENSP ID: ENSP00000374837
MAWALLLLTLLTQGTGSWAQSALTQPPFVSGAPGQSVTISCTGTSSDVGDYDHVFWYQKRLSTTSRLLIYNVNTRPSGISDLFSGSKSGNMASLTISGLKSEVEANYHCSLYSSSYTF

SEQ ID NO: 39904 - protein, 118 aa, Homo sapiens; identical to SEQ ID NO: 39903
  Payload ID: 8109
  Gene Symbol: IGLV2-33
  Gene Name: immunoglobulin lambda variable 2-33 (non-functional)
  ENSP ID: ENSP00000486583

SEQ ID NO: 39905 - protein, 157 aa, Homo sapiens
  Payload ID: 8110
  Gene Symbol: IGLV2-8
  Gene Name: immunoglobulin lambda variable 2-8
  ENSP ID: ENSP00000482937
MQICMEVPPFSEAEGIRQGWGQAQCWGLRRQRSQDVTTMAWALLLLTLLTQGTGSWAQSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNFH

SEQ ID NO: 39906 - protein, 115 aa, Homo sapiens
  Payload ID: 8111
  Gene Symbol: IGLV3-1
  Gene Name: immunoglobulin lambda variable 3-1
  ENSP ID: ENSP00000374854
MAWIPLFLGVLAYCTGSVASYELTQPPSVSVSPGQTASITCSGDKLGDKYACWYQQKPGQSPVLVIYQDSKRPSGIPERFSGSNSGNTATLTISGTQAMDEADYYCQAWDSSTAH

SEQ ID NO: 39907 - protein, 117 aa, Homo sapiens [sequence omitted]

SEQ ID NO: 39908 - protein, 117 aa, Homo sapiens [sequence omitted]

SEQ ID NO: 39909 - protein, 112 aa, Homo sapiens
  Payload ID: 8114
  Gene Symbol: IGLV3-16
  Gene Name: immunoglobulin lambda variable 3-16
  ENSP ID: ENSP00000374846
MAWIPLLLPLLTLCTGSEASYELTQPPSVSVSLGQMARITCSGEALPKKYAYWYQQKPGQFPVLVIYKDSERPSGIPERFSGSSSGTIVTLTISGVQAEDEADYYCLSADSS

SEQ ID NO: 39910 - protein, 112 aa, Homo sapiens
  Payload ID: 8115
  Gene Symbol: IGLV3-19
  Gene Name: immunoglobulin lambda variable 3-19
  ENSP ID: ENSP00000374844
MAWTPLWLTLLTLCIGSVVSSELTQDPAVSVALGQTVRITCQGDSLRSYYASWYQQKPGQAPVLVIYGKNNRPSGIPDRFSGSSSGNTASLTITGAQAEDEADYYCNSRDSS

SEQ ID NO: 39911 - protein, 117 aa, Homo sapiens
  Payload ID: 8116
  Gene Symbol: IGLV3-21
  Gene Name: immunoglobulin lambda variable 3-21
  ENSP ID: ENSP00000374843
MAWTVLLLGLLSHCTGSVTSYVLTQPPSVSVAPGQTARITCGGNNIGSKSVHWYQQKPGQAPVLVVYDDSDRPSGIPERFSGSNSGNTATLTISRVEAGDEADYYCQVWDSSSDHPT

SEQ ID NO: 39912 - protein, 115 aa, Homo sapiens
  Payload ID: 8117
  Gene Symbol: IGLV3-22
  Gene Name: immunoglobulin lambda variable 3-22 (gene/pseudogene)
  ENSP ID: ENSP00000374842
MAWATLLLPLLNLYTGSVASYELTQLPSVSVSPGQTARITCSGDVLGENYADWYQQKPGQAPELVIYEDSERYPGIPERFSGSTSGNTTTLTISRVLTEDEADYYCLSGDEDNPS

SEQ ID NO: 39913 - protein, 112 aa, Homo sapiens
  Payload ID: 8118
  Gene Symbol: IGLV3-25
  Gene Name: immunoglobulin lambda variable 3-25
  ENSP ID: ENSP00000374840
MAWIPLLLPLLTLCTGSEASYELTQPPSVSVSPGQTARITCSGDALPKQYAYWYQQKPGQAPVLVIYKDSERPSGIPERFSGSSSGTTVTLTISGVQAEDEADYYCQSADSS

SEQ ID NO: 39914 - protein, 113 aa, Homo sapiens
  Payload ID: 8119
  Gene Symbol: IGLV3-27
  Gene Name: immunoglobulin lambda variable 3-27
  ENSP ID: ENSP00000374839
MAWIPLLLPLLILCTVSVASYELTQPSSVSVSPGQTARITCSGDVLAKKYARWFQQKPGQAPVLVIYKDSERPSGIPERFSGSSSGTTVTLTISGAQVEDEADYYCYSAADNN

SEQ ID NO: 39915 - protein, 114 aa, Homo sapiens
  Payload ID: 8120
  Gene Symbol: IGLV3-32
  Gene Name: immunoglobulin lambda variable 3-32 (non-functional)
  ENSP ID: ENSP00000374838
MAWTPPLLVLTLCTGSVISSGPTQVPAVSVALGQMARITCQGDSMEGSYEHWYQQKPGQAPVLVIYDSSDRPSRIPERFSGSKSGNTTTLTITGAQAEDEADYYYQLIDNHATQ

SEQ ID NO: 39916 - protein, 114 aa, Homo sapiens; identical to SEQ ID NO: 39915
  Payload ID: 8120
  Gene Symbol: IGLV3-32
  Gene Name: immunoglobulin lambda variable 3-32 (non-functional)
  ENSP ID: ENSP00000485820

SEQ ID NO: 39917 - protein, 115 aa, Homo sapiens
  Payload ID: 8121
  Gene Symbol: IGLV3-9
  Gene Name: immunoglobulin lambda variable 3-9 (gene/pseudogene)
  ENSP ID: ENSP00000374851
MAWTALLLSLLAHFTGSVASYELTQPLSVSVALGQTARITCGGNNIGSKNVHWYQQKPGQAPVLVIYRDSNRPSGIPERFSGSNSGNTATLTISRAQAGDEADYYCQVWDSSTAH

SEQ ID NO: 39918 - protein, 122 aa, Homo sapiens
  Payload ID: 8122
  Gene Symbol: IGLV4-3
  Gene Name: immunoglobulin lambda variable 4-3
  ENSP ID: ENSP00000374853
MAWVSFYLLPFIFSTGLCALPVLTQPPSASALLGASIKLTCTLSSEHSTYTIEWYQQRPGRSPQYIMKVKSDGSHSKGDGIPDRFMGSSSGADRYLTFSNLQSDDEAEYHCGESHTIDGQVG

SEQ ID NO: 39919 - protein, 120 aa, Homo sapiens
  Payload ID: 8123
  Gene Symbol: IGLV4-60
  Gene Name: immunoglobulin lambda variable 4-60
  ENSP ID: ENSP00000374819
MAWTPLLLLFPLLLHCTGSLSQPVLTQSSSASASLGSSVKLTCTLSSGHSSYIIAWHQQQPGKAPRYLMKLEGSGSYNKGSGVPDRFSGSSSGADRYLTISNLQFEDEADYYCETWDSNT

SEQ ID NO: 39920 - protein, 119 aa, Homo sapiens
  Payload ID: 8124
  Gene Symbol: IGLV4-69
  Gene Name: immunoglobulin lambda variable 4-69
  ENSP ID: ENSP00000374817
MAWTPLLFLTLLLHCTGSLSQLVLTQSPSASASLGASVKLTCTLSSGHSSYAIAWHQQQPEKGPRYLMKLNSDGSHSKGDGIPDRFSGSSSGAERYLTISSLQSEDEADYYCQTWGTGI

SEQ ID NO: 39921 - protein, 123 aa, Homo sapiens
  Payload ID: 8125
  Gene Symbol: IGLV5-37
  Gene Name: immunoglobulin lambda variable 5-37
  ENSP ID: ENSP00000374835
MAWTPLLLLLLSHCTGSLSQPVLTQPPSSSASPGESARLTCTLPSDINVGSYNIYWYQQKPGSPPRYLLYYYSDSDKGQGSGVPSRFSGSKDASANTGILLISGLQSEDEADYYCMIWPSNAS

SEQ ID NO: 39922 - protein, 123 aa, Homo sapiens; identical to SEQ ID NO: 39921
  Payload ID: 8125
  Gene Symbol: IGLV5-37
  Gene Name: immunoglobulin lambda variable 5-37
  ENSP ID: ENSP00000487591

SEQ ID NO: 39923 - protein, 123 aa, Homo sapiens
  Payload ID: 8126
  Gene Symbol: IGLV5-45
  Gene Name: immunoglobulin lambda variable 5-45
  ENSP ID: ENSP00000374831
MAWTPLLLLFLSHCTGSLSQAVLTQPSSLSASPGASASLTCTLCSGINVGTYRIYWYQQKPGSPPQYLLRYKSDSDKQQGSGVPSRFSGSKDASANAGILLISGLQSEDEADYYCMIWHSSAS

SEQ ID NO: 39924 - protein, 123 aa, Homo sapiens
  Payload ID: 8126
  Gene Symbol: IGLV5-45
  Gene Name: immunoglobulin lambda variable 5-45
  ENSP ID: ENSP00000487513
MAWTPLLLLFLSHCTGSLSQAVLTQPSSLSASPGASASLTCTLRSGINVGTYRIYWYQQKPGSPPQYLLRYKSDSDKQQGSGVPSRFSGSKDASANAGILLISGLQSEDEADYYCMIWHSSAS

SEQ ID NO: 39925 - protein, 105 aa, Homo sapiens
  Payload ID: 8127
  Gene Symbol: IGLV5-48
  Gene Name: immunoglobulin lambda variable 5-48 (non-functional)
  ENSP ID: ENSP00000374828
MAWTPLLLLFLSHCTGSLSQAVLTQPTSLSASPGASARLTCTLRSGISVGSYRIYWYQQKPGSPPRYLLNYYSDSDKHQGSGVPSRFSGSKDASTNAGILFISGL

SEQ ID NO: 39926 - protein, 124 aa, Homo sapiens
  Payload ID: 8128
  Gene Symbol: IGLV5-52
  Gene Name: immunoglobulin lambda variable 5-52
  ENSP ID: ENSP00000374824
MAWTLLLLVLLSHCTGSLSQPVLTQPSSHSASSGASVRLTCMLSSGFSVGDFWIRWYQQKPGNPPRYLLYYHSDSNKGQGSGVPSRFSGSNDASANAGILRISGLQPEDEADYYCGTWHSNSKT

SEQ ID NO: 39927 - protein, 148 aa, Homo sapiens
  Payload ID: 8129
  Gene Symbol: IGLV6-57
  Gene Name: immunoglobulin lambda variable 6-57
  ENSP ID: ENSP00000374820
MAWAPLLLTLLAHCTGSWANFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNHTVLQTHGEVRQKLPRASLPGPVSACLHRRG

SEQ ID NO: 39928 - protein, 117 aa, Homo sapiens
  Payload ID: 8130
  Gene Symbol: IGLV7-43
  Gene Name: immunoglobulin lambda variable 7-43
  ENSP ID: ENSP00000374833
MAWTPLFLFLLTCCPGSNSQTVVTQEPSLTVSPGGTVTLTCASSTGAVTSGYYPNWFQQKPGQAPRALIYSTSNKHSWTPARFSGSLLGGKAALTLSGVQPEDEAEYYCLLYYGGAQ

SEQ ID NO: 39929 - protein, 117 aa, Homo sapiens; identical to SEQ ID NO: 39928
  Payload ID: 8130
  Gene Symbol: IGLV7-43
  Gene Name: immunoglobulin lambda variable 7-43
  ENSP ID: ENSP00000480490

SEQ ID NO: 39930 - protein, 117 aa, Homo sapiens
  Payload ID: 8131
  Gene Symbol: IGLV7-46
  Gene Name: immunoglobulin lambda variable 7-46 (gene/pseudogene)
  ENSP ID: ENSP00000374830
MAWTPLFLFLLTCCPGSNSQAVVTQEPSLTVSPGGTVTLTCGSSTGAVTSGHYPYWFQQKPGQAPRTLIYDTSNKHSWTPARFSGSLLGGKAALTLLGAQPEDEAEYYCLLSYSGAR

SEQ ID NO: 39931 - protein, 122 aa, Homo sapiens
  Payload ID: 8132
  Gene Symbol: IGLV8-61
  Gene Name: immunoglobulin lambda variable 8-61
  ENSP ID: ENSP00000374818
MSVPTMAWMMLLLGLLAYGSGVDSQTVVTQEPSFSVSPGGTVTLTCGLSSGSVSTSYYPSWYQQTPGQAPRTLIYSTNTRSSGVPDRFSGSILGNKAALTITGAQADDESDYYCVLYMGSGI

SEQ ID NO: 39932 - protein, 123 aa, Homo sapiens
  Payload ID: 8133
  Gene Symbol: IGLV9-49
  Gene Name: immunoglobulin lambda variable 9-49
  ENSP ID: ENSP00000414456
MAWAPLLLTLLSLLTGSLSQPVLTQPPSASASLGASVTLTCTLSSGYSNYKVDWYQQRPGKGPRFVMRVGTGGIVGSKGDGIPDRFSVLGSGLNRYLTIKNIQEEDESDYHCGADHGSGSNFV

SEQ ID NO: 39933 - protein, 84 aa, Homo sapiens
  Payload ID: 8134
  Gene Symbol: IGLL1
  Gene Name: immunoglobulin lambda-like polypeptide 1
  Uniprot ID: P15814
  ENSP ID: ENSP00000249053
MRPGTGQGGLEAPGEPGPNLRQRWPLLLLGLAVVTHGLLRPTAASQSRALGPGAPGGSSRSSLRSRWGRSAQGHPLGHSVPAVL

SEQ ID NO: 39934 - protein, 213 aa, Homo sapiens
  Payload ID: 8134
  Gene Symbol: IGLL1
  Gene Name: immunoglobulin lambda-like polypeptide 1
  Uniprot ID: P15814
  ENSP ID: ENSP00000329312
MRPGTGQGGLEAPGEPGPNLRQRWPLLLLGLAVVTHGLLRPTAASQSRALGPGAPGGSSRSSLRSRWGRFLLQRGSWTGPRCWPRGFQSKHNSVTHVFGSGTQLTVLSQPKATPSVTLFPPSSEELQANKATLVCLMNDFYPGILTVTWKADGTPITQGVEMTTPSKQSNNKYAASSYLSLTPEQWRSRRSYSCQVMHEGSTVEKTVAPAECS

SEQ ID NO: 39935 - protein, 180 aa, Homo sapiens
  Payload ID: 8134
  Gene Symbol: IGLL1
  Gene Name: immunoglobulin lambda-like polypeptide 1
  ENSP ID: ENSP00000403391
MRPGTGQGGLEAPGEPGPNLRQRWPLLLLGLAVVTHGLLRPTAASQSRALGPGAPGGSSRSSLRSRWGSRFLLQRGSWTGPRCWPRGFQSKHNSVTHVFGSGTQLTVLSQPKATPSVTLFPPSSEELQANKATLVCLMNDFYPGILTVTWKADGTPITQGVEMTTPSKQSNNKYAASSYL

SEQ ID NO: 39936 - protein, 214 aa, Homo sapiens
  Payload ID: 8135
  Gene Symbol: IGLL5
  Gene Name: immunoglobulin lambda-like polypeptide 5
  Uniprot ID: B9A064
  ENSP ID: ENSP00000431254
MRPKTGQVGCETPEELGPGPRQRWPLLLLGLAMVAHGLLRPMVAPQSGDPDPGASVGSSRSSLRSLWGRLLLQPSPQRADPRCWPRGFWSEPQSLCYVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 39937 - protein, 84 aa, Homo sapiens
  Payload ID: 8135
  Gene Symbol: IGLL5
  Gene Name: immunoglobulin lambda-like polypeptide 5
  Uniprot ID: B9A064
  ENSP ID: ENSP00000434368
MRPKTGQVGCETPEELGPGPRQRWPLLLLGLAMVAHGLLRPMVAPQSGDPDPGASVGSSRSSLRSLWGRSAQGQPHCHSVPALL

SEQ ID NO: 39938 - protein, 215 aa, Homo sapiens
  Payload ID: 8135
  Gene Symbol: IGLL5
  Gene Name: immunoglobulin lambda-like polypeptide 5
  ENSP ID: ENSP00000436353
MRPKTGQVGCETPEELGPGPRQRWPLLLLGLAMVAHGLLRPMVAPQSGDPDPGASVGSSRSSLRSLWGSRLLLQPSPQRADPRCWPRGFWSEPQSLCYVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 39939 - protein, 993 aa, Homo sapiens
  Payload ID: 8136
  Gene Symbol: IGHMBP2
  Gene Name: immunoglobulin mu binding protein 2
  Uniprot ID: P38935
  ENSP ID: ENSP00000255078
MASAAVESFVTKQLDLLELERDAEVEERRSWQENISLKELQSRGVCLLKLQVSSQRTGLYGRLLVTFEPRRYGSAAALPSNSFTSGDIVGLYDAANEGSQLATGILTRVTQKSVTVAFDESHDFQLSLDRENSYRLLKLANDVTYRRLKKALIALKKYHSGPASSLIEVLFGRSAPSPASEIHPLTFFNTCLDTSQKEAVLFALSQKELAIIHGPPGTGKTTTVVEIILQAVKQGLKVLCCAPSNIAVDNLVERLALCKQRILRLGHPARLLESIQQHSLDAVLARSDSAQIVADIRKDIDQVFVKNKKTQDKREKSNFRNEIKLLRKELKEREEAAMLESLTSANVVLATNTGASADGPLKLLPESYFDVVVIDECAQALEASCWIPLLKARKCILAGDHKQLPPTTVSHKAALAGLSLSLMERLAEEYGARVVRTLTVQYRMHQAIMRWASDTMYLGQLTAHSSVARHLLRDLPGVAATEETGVPLLLVDTAGCGLFELEEEDEQSKGNPGEVRLVSLHIQALVDAGVPARDIAVVSPYNLQVDLLRQSLVHRHPELEIKSVDGFQGREKEAVILSFVRSNRKGEVGFLAEDRRINVAVTRARRHVAVICDSRTVNNHAFLKTLVEYFTQHGEVRTAFEYLDDIVPENYSHENSQGSSHAATKPQGPATSTRTGSQRQEGGQEAAAPARQGRKKPAGKSLASEAPSQPSLNGGSPEGVESQDGVDHFRAMIVEFMASKKMQLEFPPSLNSHDRLRVHQIAEEHGLRHDSSGEGKRRFITVSKRAPRPRAALGPPAGTGGPAPLQPVPPTPAQTEQPPREQRGPDQPDLRTLHLERLQRVRSAQGQPASKEQQASGQQKLPEKKKKKAKGHPATDLPTEEDFEALVSAAVKADNTCGFAKCTAGVTTLGQFCQLCSRRYCLSHHLPEIHGCGERARAHARQRISREGVLYAGSGTKNGSLDPAKRAQLQRRLDKKLSELSNQRTSRRKERGT

SEQ ID NO: 39940 - protein, 192 aa, Homo sapiens
  Payload ID: 8136
  Gene Symbol: IGHMBP2
  Gene Name: immunoglobulin mu binding protein 2
  ENSP ID: ENSP00000440465
MASAAVESFVTKQLDLLELERDAEVEERRSWQENISLKELQSRGVCLLKLQVSSQRTGLYGRLLVTFEPRRYGSAAALPSNSFTSGDIVGLYDAANEGSQLATGILTRVTQKSVTVAFDESHDFQLSLDRENSYRLLKLANDVTYRRLKKPADILQHLPGHLPERSGFICAVSERTCHHPWTSWHWENHDCG

SEQ ID NO: 39941 - protein, 29 aa, Homo sapiens
  Payload ID: 8136
  Gene Symbol: IGHMBP2
  Gene Name: immunoglobulin mu binding protein 2
  ENSP ID: ENSP00000443343
MASAAVESFVTKQLDLLELERDAEVEERR

SEQ ID NO: 39942 - protein, 91 aa, Homo sapiens
  Payload ID: 8136
  Gene Symbol: IGHMBP2
  Gene Name: immunoglobulin mu binding protein 2
  ENSP ID: ENSP00000456366
MASAAVESFVTKQLDLLELERDAEVEERRSWQENISLKELQSRGVCLLKLQVSSQRTGLYGRLLVTFEPRRYGSAAALPSNSFTSGVCVLT

SEQ ID NO: 39943 - protein, 428 aa, Homo sapiens
  Payload ID: 8137
  Gene Symbol: ISLR
  Gene Name: immunoglobulin superfamily containing leucine-rich repeat
  Uniprot ID: O14498
  ENSP ID: ENSP00000249842
MQELHLLWWALLLGLAQACPEPCDCGEKYGFQIADCAYRDLESVPPGFPANVTTLSLSANRLPGLPEGAFREVPLLQSLWLAHNEIRTVAAGALASLSHLKSLDLSHNLISDFAWSDLHNLSALQLLKMDSNELTFIPRDAFRSLRALRSLQLNHNRLHTLAEGTFTPLTALSHLQINENPFDCTCGIVWLKTWALTTAVSIPEQDNIACTSPHVLKGTPLSRLPPLPCSAPSVQLSYQPSQDGAELRPGFVLALHCDVDGQPAPQLHWHIQIPSGIVEITSPNVGTDGRALPGTPVASSQPRFQAFANGSLLIPDFGKLEEGTYSCLATNELGSAESSVDVALATPGEGGEDTLGRRFHGKAVEGKGCYTVDNEVQPSGPEDNVVIIYLSRAGNPEAAVAEGVPGQLPPGLLLLGQSLLLFFFLTSF

SEQ ID NO: 39944 - protein, 428 aa, Homo sapiens; identical to SEQ ID NO: 39943
  Payload ID: 8137
  Gene Symbol: ISLR
  Gene Name: immunoglobulin superfamily containing leucine-rich repeat
  Uniprot ID: O14498
  ENSP ID: ENSP00000378550

SEQ ID NO: 39945 - protein, 183 aa, Homo sapiens
  Payload ID: 8137
  Gene Symbol: ISLR
  Gene Name: immunoglobulin superfamily containing leucine-rich repeat
  ENSP ID: ENSP00000453105
MQELHLLWWALLLGLAQACPEPCDCGEKYGFQIADCAYRDLESVPPGFPANVTTLSLSANRLPGLPEGAFREVPLLQSLWLAHNEIRTVAAGALASLSHLKSLDLSHNLISDFAWSDLHNLSALQLLKMDSNELTFIPRDAFRSLRALRSLQLNHNRLHTLAEGTFTPLTALSHLQINENPFD

SEQ ID NO: 39946 - protein, 147 aa, Homo sapiens
  Payload ID: 8137
  Gene Symbol: ISLR
  Gene Name: immunoglobulin superfamily containing leucine-rich repeat
  ENSP ID: ENSP00000453884
MQELHLLWWALLLGLAQACPEPCDCGEKYGFQIADCAYRDLESVPPGFPANVTTLSLSANRLPGLPEGAFREVPLLQSLWLAHNEIRTVAAGALASLSHLKSLDLSHNLISDFAWSDLHNLSALQLLKMDSNELTFIPRDAFRSLRA

SEQ ID NO: 39947 - protein, 745 aa, Homo sapiens
  Payload ID: 8138
  Gene Symbol: ISLR2
  Gene Name: immunoglobulin superfamily containing leucine-rich repeat 2
  Uniprot ID: Q6UXK2
  ENSP ID: ENSP00000355402
MFPLRALWLVWALLGVAGSCPEPCACVDKYAHQFADCAYKELREVPEGLPANVTTLSLSANKITVLRRGAFADVTQVTSLWLAHNEVRTVEPGALAVLSQLKNLDLSHNFISSFPWSDLRNLSALQLLKMNHNRLGSLPRDALGALPDLRSLRINNNRLRTLAPGTFDALSALSHLQLYHNPFHCGCGLVWLQAWAASTRVSLPEPDSIACASPPALQGVPVYRLPALPCAPPSVHLSAEPPLEAPGTPLRAGLAFVLHCIADGHPTPRLQWQLQIPGGTVVLEPPVLSGEDDGVGAEEGEGEGDGDLLTQTQAQTPTPAPAWPAPPATPRFLALANGSLLVPLLSAKEAGVYTCRAHNELGANSTSIRVAVAATGPPKHAPGAGGEPDGQAPTSERKSTAKGRGNSVLPSKPEGKIKGQGLAKVSILGETETEPEEDTSEGEEAEDQILADPAEEQRCGNGDPSRYVSNHAFNQSAELKPHVFELGVIALDVAEREARVQLTPLAARWGPGPGGAGGAPRPGRRPLRLLYLCPAGGGAAVQWSRVEEGVNAYWFRGLRPGTNYSVCLALAGEACHVQVVFSTKKELPSLLVIVAVSVFLLVLATVPLLGAACCHLLAKHPGKPYRLILRPQAPDPMEKRIAADFDPRASYLESEKSYPAGGEAGGEEPEDVQGEGLDEDAEQGDPSGDLQREESLAACSLVESQSKANQEEFEAGSEYSDRLPLGAEAVNIAQEINGNYRQTAG

SEQ ID NO: 39948 - protein, 334 aa, Homo sapiens
  Payload ID: 8138
  Gene Symbol: ISLR2
  Gene Name: immunoglobulin superfamily containing leucine-rich repeat 2
  ENSP ID: ENSP00000408872
MFPLRALWLVWALLGVAGSCPEPCACVDKYAHQFADCAYKELREVPEGLPANVTTLSLSANKITVLRRGAFADVTQVTSLWLAHNEVRTVEPGALAVLSQLKNLDLSHNFISSFPWSDLRNLSALQLLKMNHNRLGSLPRDALGALPDLRSLRINNNRLAGEACHVQVVFSTKKELPSLLVIVAVSVFLLVLATVPLLGAACCHLLAKHPGKPYRLILRPQAPDPMEKRIAADFDPRASYLESEKSYPAGGEAGGEEPEDVQGEGLDEDAEQGDPSGDLQREESLAACSLVESQSKANQEEFEAGSEYSDRLPLGAEAVNIAQEINGNYRQTAG

SEQ ID NO: 39949 - protein, 745 aa, Homo sapiens; identical to SEQ ID NO: 39947
  Payload ID: 8138
  Gene Symbol: ISLR2
  Gene Name: immunoglobulin superfamily containing leucine-rich repeat 2
  Uniprot ID: Q6UXK2
  ENSP ID: ENSP00000411443

SEQ ID NO: 39950 - protein, 745 aa, Homo sapiens; identical to SEQ ID NO: 39947
  Payload ID: 8138
  Gene Symbol: ISLR2
  Gene Name: immunoglobulin superfamily containing leucine-rich repeat 2
  Uniprot ID: Q6UXK2
  ENSP ID: ENSP00000411834

SEQ ID NO: 39951 - protein, 114 aa, Homo sapiens
  Payload ID: 8138
  Gene Symbol: ISLR2
  Gene Name: immunoglobulin superfamily containing leucine-rich repeat 2
  ENSP ID: ENSP00000454259
MFPLRALWLVWALLGVAGSCPEPCACVDKYAHQFADCAYKELREVPEGLPANVTTLSLSANKITVLRRGAFADVTQVTSLWLAHNEVRTVEPGALAVLSQLKNLDLSHNFISSF

SEQ ID NO: 39952 - protein, 89 aa, Homo sapiens
  Payload ID: 8138
  Gene Symbol: ISLR2
  Gene Name: immunoglobulin superfamily containing leucine-rich repeat 2
  ENSP ID: ENSP00000454287
MFPLRALWLVWALLGVAGSCPEPCACVDKYAHQFADCAYKELREVPEGLPANVTTLSLSANKITVLRRGAFADVTQVTSLWLAHNEVRT

SEQ ID NO: 39953 - protein, 5 aa, Homo sapiens
  Payload ID: 8138
  Gene Symbol: ISLR2
  Gene Name: immunoglobulin superfamily containing leucine-rich repeat 2
  ENSP ID: ENSP00000454859
MFPLR

SEQ ID NO: 39954 - protein, 138 aa, Homo sapiens
  Payload ID: 8138
  Gene Symbol: ISLR2
  Gene Name: immunoglobulin superfamily containing leucine-rich repeat 2
  ENSP ID: ENSP00000455076
MFPLRALWLVWALLGVAGSCPEPCACVDKYAHQFADCAYKELREVPEGLPANVTTLSLSANKITVLRRGAFADVTQVTSLWLAHNEVRTVEPGALAVLSQLKNLDLSHNFISSFPWSDLRNLSALQLLKMNHNRLGSL

SEQ ID NO: 39955 - protein, 745 aa, Homo sapiens; identical to SEQ ID NO: 39947
  Payload ID: 8138
  Gene Symbol: ISLR2
  Gene Name: immunoglobulin superfamily containing leucine-rich repeat 2
  Uniprot ID: Q6UXK2
  ENSP ID: ENSP00000455531

SEQ ID NO: 39956 - protein, 745 aa, Homo sapiens; identical to SEQ ID NO: 39947
  Payload ID: 8138
  Gene Symbol: ISLR2
  Gene Name: immunoglobulin superfamily containing leucine-rich repeat 2
  Uniprot ID: Q6UXK2
  ENSP ID: ENSP00000458080

SEQ ID NO: 39957 - protein, 814 aa, Homo sapiens
  Payload ID: 8139
  Gene Symbol: IGDCC3
  Gene Name: immunoglobulin superfamily, DCC subclass, member 3
  Uniprot ID: Q8IVU1
  ENSP ID: ENSP00000332773
MAVQRAASPRRPPAPLWPRLLLPLLLLLLPAPSEGLGHSAELAFAVEPSDDVAVPGQPIVLDCRVEGTPPVRITWRKNGVELPESTHSTLLANGSLMIRHFRLEPGGSPSDEGDYECVAQNRFGLVVSRKARIQAATMSDFHVHPQATVGEEGGVARFQCQIHGLPKPLITWEKNRVPIDTDNERYTLLPKGVLQITGLRAEDGGIFHCVASNIASIRISHGARLTVSGSGSGAYKEPAILVGPENLTLTVHQTAVLECVATGNPRPIVSWSRLDGRPIGVEGIQVLGTGNLIISDVTVQHSGVYVCAANRPGTRVRRTAQGRLVVQAPAEFVQHPQSISRPAGTTAMFTCQAQGEPPPHVTWLKNGQVLGPGGHVRLKNNNSTLTISGIGPEDEAIYQCVAENSAGSSQASARLTVLWAEGLPGPPRNVRAVSVSSTEVRVSWSEPLANTKEIIGYVLHIRKAADPPELEYQEAVSKSTFQHLVSDLEPSTAYSFYIKAYTPRGASSASVPTLASTLGEAPAPPPLSVRVLGSSSLQLLWEPWPRLAQHEGGFKLFYRPASKTSFTGPILLPGTVSSYNLSQLDPTAVYEVKLLAYNQHGDGNATVRFVSLRGASERTALSPPCDCRKEEAANQTSTTGIVIGIHIGVTCIIFCVLFLLFGQRGRVLLCKDVENQLSPPQGPRSQRDPGILALNGARRGQRGQLGRDEKRVDMKELEQLFPPASAAGQPDPRPTQDPAAPAPCEETQLSVLPLQGCGLMEGKTTEAKTTEATAPCAGLAAAPPPPDGGPGLLSEGQASRPAAARVTQPAHSEQ

SEQ ID NO: 39958 - protein, 137 aa, Homo sapiens
  Payload ID: 8139
  Gene Symbol: IGDCC3
  Gene Name: immunoglobulin superfamily, DCC subclass, member 3
  ENSP ID: ENSP00000452838
MPDSLIHPRWCERAMSDFHVHPQATVGEEGGVARFQCQIHGLPKPLITWEKNRVPIDTDNERYTLLPKGVLQITGLRAEDGGIFHCVASNIASIRISHGARLTVSGSGSGAYKEPAILVGPENLTLTVHQTAVLECV

SEQ ID NO: 39959 - protein, 535 aa, Homo sapiens
  Payload ID: 8139
  Gene Symbol: IGDCC3
  Gene Name: immunoglobulin superfamily, DCC subclass, member 3
  ENSP ID: ENSP00000454105
MSDFHVHPQATVGEEGGVARFQCQIHGLPKPLITWEKNRVPIDTDNERYTLLPKGVLQITGLRAEDGGIFHCVASNIASIRISHGARLTVSGSGSGAYKEPAILVGPENLTLTVHQTAVLECVATGNPRPIVSWSRLDGRPIGVEGIQVLGTGNLIISDVTVQHSGVYVCAANRPGTRVRRTAQGRLVVQAPAEFVQHPQSISRPAGTTAMFTCQAQGEPPPHVTWLKNGQVLGPGGHVRLKNNNSTLTISGIGPEDEAIYQCVAENSAGSSQASARLTVLWAEGLPGPPRNVRAVSVSSTEVRVSWSEPLANTKEIIGYVLHIRKAADPPELEYQEAVSKSTFQHLVSDLEPSTAYSFYIKAYTPRGASSASVPTLASTLGEAPAPPPLSVRVLGSSSLQLLWEPWPRLAQHEGGFKLFYRPASKTSFTGPILLPGTVSSYNLSQLDPTAVYEVKLLAYNQHGDGNATVRFVSLRGASERTALSPPCDCRKEEAANQTSTTGIVIGIHIGVTCIIFCVLFLLFGQRGRVLLCKD

SEQ ID NO: 39960 - protein, 1250 aa, Homo sapiens
  Payload ID: 8140
  Gene Symbol: IGDCC4
  Gene Name: immunoglobulin superfamily, DCC subclass, member 4
  Uniprot ID: Q8TDY8
  ENSP ID: ENSP00000319623
MARGDAGRGRGLLALTFCLLAARGELLLPQETTVELSCGVGPLQVILGPEQAAVLNCSLGAAAAGPPTRVTWSKDGDTLLEHDHLHLLPNGSLWLSQPLAPNGSDESVPEAVGVIEGNYSCLAHGPLGVLASQTAVVKLATLADFSLHPESQTVEENGTARFECHIEGLPAPIITWEKDQVTLPEEPRLIVLPNGVLQILDVQESDAGPYRCVATNSARQHFSQEALLSVAHRGSLASTRGQDVVIVAAPENTTVVSGQSVVMECVASADPTPFVSWVRQDGKPISTDVIVLGRTNLLIANAQPWHSGVYVCRANKPRTRDFATAAAELRVLAAPAITQAPEALSRTRASTARFVCRASGEPRPALRWLHNGAPLRPNGRVKVQGGGGSLVITQIGLQDAGYYQCVAENSAGMACAAASLAVVVREGLPSAPTRVTATPLSSSAVLVAWERPEMHSEQIIGFSLHYQKARGMDNVEYQFAVNNDTTELQVRDLEPNTDYEFYVVAYSQLGASRTSTPALVHTLDDVPSAAPQLSLSSPNPSDIRVAWLPLPPSLSNGQVVKYKIEYGLGKEDQIFSTEVRGNETQLMLNSLQPNKVYRVRISAGTAAGFGAPSQWMHHRTPSMHNQSHVPFAPAELKVQAKMESLVVSWQPPPHPTQISGYKLYWREVGAEEEANGDRLPGGRGDQAWDVGPVRLKKKVKQYELTQLVPGRLYEVKLVAFNKHEDGYAAVWKGKTEKAPAPDMPIQRGPPLPPAHVHAESNSSTSIWLRWKKPDFTTVKIVNYTVRFSPWGLRNASLVTYYTSSGEDILIGGLKPFTKYEFAVQSHGVDMDGPFGSVVERSTLPDRPSTPPSDLRLSPLTPSTVRLHWCPPTEPNGEIVEYLILYSSNHTQPEHQWTLLTTQGNIFSAEVHGLESDTRYFFKMGARTEVGPGPFSRLQDVITLQEKLSDSLDMHSVTGIIVGVCLGLLCLLACMCAGLRRSPHRESLPGLSSTATPGNPALYSRARLGPPSPPAAHELESLVHPHPQDWSPPPSDVEDRAEVHSLMGGGVSEGRSHSKRKISWAQPSGLSWAGSWAGCELPQAGPRPALTRALLPPAGTGQTLLLQALVYDAIKGNGRKKSPPACRNQVEAEVIVHSDFSASNGNPDLHLQDLEPEDPLPPEAPDLISGVGDPGQGAAWLDRELGGCELAAPGPDRLTCLPEAASASCSYPDLQPGEVLEETPGDSCQLKSPCPLGASPGLPRSPVSSSA

SEQ ID NO: 39961 - protein, 1336 aa, Homo sapiens
  Payload ID: 8141
  Gene Symbol: IGSF1
  Gene Name: immunoglobulin superfamily, member 1
  Uniprot ID: Q8N6C5
  ENSP ID: ENSP00000355010
MTLDRPGEGATMLKTFTVLLFCIRMSLGMTSIVMDPQPELWIESNYPQAPWENITLWCRSPSRISSKFLLLKDKTQMTWIRPSHKTFQVSFLIGALTESNAGLYRCCYWKETGWSKPSKVLELEAPGQLPKPIFWIQAETPALPGCNVNILCHGWLQDLVFMLFKEGYAEPVDYQVPTGTMAIFSIDNLTPEDEGVYICRTHIQMLPTLWSEPSNPLKLVVAGLYPKPTLTAHPGPIMAPGESLNLRCQGPIYGMTFALMRVEDLEKSFYHKKTIKNEANFFFQSLKIQDTGHYLCFYYDASYRGSLLSDVLKIWVTDTFPKTWLLARPSAVVQMGQNVSLRCRGPVDGVGLALYKKGEDKPLQFLDATSIDDNTSFFLNNVTYSDTGIYSCHYLLTWKTSIRMPSHNTVELMVVDKPPKPSLSAWPSTVFKLGKAITLQCRVSHPVLEFSLEWEERETFQKFSVNGDFIISNVDGKGTGTYSCSYRVETHPNIWSHRSEPLKLMGPAGYLTWNYVLNEAIRLSLIMQLVALLLVVLWIRWKCRRLRIREAWLLGTAQGVTMLFIVTALLCCGLCNGVLIEETEIVMPTPKPELWAETNFPLAPWKNLTLWCRSPSGSTKEFVLLKDGTGWIATRPASEQVRAAFPLGALTQSHTGSYHCHSWEEMAVSEPSEALELVGTDILPKPVISASPTIRGQELQLRCKGWLAGMGFALYKEGEQEPVQQLGAVGREAFFTIQRMEDKDEGNYSCRTHTEKRPFKWSEPSEPLELVIKEMYPKPFFKTWASPVVTPGARVTFNCSTPHQHMSFILYKDGSEIASSDRSWASPGASAAHFLIISVGIGDGGNYSCRYYDFSIWSEPSDPVELVVTEFYPKPTLLAQPGPVVFPGKSVILRCQGTFQGMRFALLQEGAHVPLQFRSVSGNSADFLLHTVGAEDSGNYSCIYYETTMSNRGSYLSMPLMIWVTDTFPKPWLFAEPSSVVPMGQNVTLWCRGPVHGVGYILHKEGEATSMQLWGSTSNDGAFPITNISGTSMGRYSCCYHPDWTSSIKIQPSNTLELLVTGLLPKPSLLAQPGPMVAPGENMTLQCQGELPDSTFVLLKEGAQEPLEQQRPSGYRADFWMPAVRGEDSGIYSCVYYLDSTPFAASNHSDSLEIWVTDKPPKPSLSAWPSTMFKLGKDITLQCRGPLPGVEFVLEHDGEEAPQQFSEDGDFVINNVEGKGIGNYSCSYRLQAYPDIWSEPSDPLELVGAAGPVAQECTVGNIVRSSLIVVVVVALGVVLAIEWKKWPRLRTRGSETDGRDQTIALEECNQEGEPGTPANSPSSTSQRISVELPVPI

SEQ ID NO: 39962 - protein, 242 aa, Homo sapiens
  Payload ID: 8141
  Gene Symbol: IGSF1
  Gene Name: immunoglobulin superfamily, member 1
  Uniprot ID: Q8N6C5
  ENSP ID: ENSP00000359937
MTLDRPGEGATMLKTFTVLLFCIRMSLGMTSIVMDPQPELWIESNYPQAPWENITLWCRSPSRISSKFLLLKDKTQMTWIRPSHKTFQVSFLIGALTESNAGLYRCCYWKETGWSKPSKVLELEAPGQLPKPIFWIQAETPALPGCNVNILCHGWLQDLVFMLFKEGYAEPVDYQVPTGTMAIFSIDNLTPEDEGVYICRTHIQMLPTLWSEPSNPLKLVVAGGCGYGCWHLAIVVPGIMAG

SEQ ID NO: 39963 - protein, 242 aa, Homo sapiens; identical to SEQ ID NO: 39962
  Payload ID: 8141
  Gene Symbol: IGSF1
  Gene Name: immunoglobulin superfamily, member 1
  Uniprot ID: Q8N6C5
  ENSP ID: ENSP00000359938

SEQ ID NO: 39964 - protein, 1341 aa, Homo sapiens
  Payload ID: 8141
  Gene Symbol: IGSF1
  Gene Name: immunoglobulin superfamily, member 1
  Uniprot ID: Q8N6C5
  ENSP ID: ENSP00000359940
MTLDRPGEGATMLKTFTVLLFCIRMSLGMTSIVMDPQPELWIESNYPQAPWENITLWCRSPSRISSKFLLLKDKTQMTWIRPSHKTFQVSFLIGALTESNAGLYRCCYWKETGWSKPSKVLELEAPGQLPKPIFWIQAETPALPGCNVNILCHGWLQDLVFMLFKEGYAEPVDYQVPTGTMAIFSIDNLTPEDEGVYICRTHIQMLPTLWSEPSNPLKLVVAGLYPKPTLTAHPGPIMAPGESLNLRCQGPIYGMTFALMRVEDLEKSFYHKKTIKNEANFFFQSLKIQDTGHYLCFYYDASYRGSLLSDVLKIWVTDTFPKTWLLARPSAVVQMGQNVSLRCRGPVDGVGLALYKKGEDKPLQFLDATSIDDNTSFFLNNVTYSDTGIYSCHYLLTWKTSIRMPSHNTVELMVVDKPPKPSLSAWPSTVFKLGKAITLQCRVSHPVLEFSLEWEERETFQKFSVNGDFIISNVDGKGTGTYSCSYRVETHPNIWSHRSEPLKLMGPAGYLTWNYVLNEAIRLSLIMQLVALLLVVLWIRWKCRRLRIREAWLLGTAQGVTMLFIVTALLCCAISFAGLCNGVLIEETEIVMPTPKPELWAETNFPLAPWKNLTLWCRSPSGSTKEFVLLKDGTGWIATRPASEQVRAAFPLGALTQSHTGSYHCHSWEEMAVSEPSEALELVGTDILPKPVISASPTIRGQELQLRCKGWLAGMGFALYKEGEQEPVQQLGAVGREAFFTIQRMEDKDEGNYSCRTHTEKRPFKWSEPSEPLELVIKEMYPKPFFKTWASPVVTPGARVTFNCSTPHQHMSFILYKDGSEIASSDRSWASPGASAAHFLIISVGIGDGGNYSCRYYDFSIWSEPSDPVELVVTEFYPKPTLLAQPGPVVFPGKSVILRCQGTFQGMRFALLQEGAHVPLQFRSVSGNSADFLLHTVGAEDSGNYSCIYYETTMSNRGSYLSMPLMIWVTDTFPKPWLFAEPSSVVPMGQNVTLWCRGPVHGVGYILHKEGEATSMQLWGSTSNDGAFPITNISGTSMGRYSCCYHPDWTSSIKIQPSNTLELLVTGLLPKPSLLAQPGPMVAPGENMTLQCQGELPDSTFVLLKEGAQEPLEQQRPSGYRADFWMPAVRGEDSGIYSCVYYLDSTPFAASNHSDSLEIWVTDKPPKPSLSAWPSTMFKLGKDITLQCRGPLPGVEFVLEHDGEEAPQQFSEDGDFVINNVEGKGIGNYSCSYRLQAYPDIWSEPSDPLELVGAAGPVAQECTVGNIVRSSLIVVVVVALGVVLAIEWKKWPRLRTRGSETDGRDQTIALEECNQEGEPGTPANSPSSTSQRISVELPVPI

SEQ ID NO: 39965 - protein, 1327 aa, Homo sapiens
  Payload ID: 8141
  Gene Symbol: IGSF1
  Gene Name: immunoglobulin superfamily, member 1
  Uniprot ID: Q8N6C5
  ENSP ID: ENSP00000359941
MTLDRPGEGATMLKTFTVLLFCILMDPQPELWIESNYPQAPWENITLWCRSPSRISSKFLLLKDKTQMTWIRPSHKTFQVSFLIGALTESNAGLYRCCYWKETGWSKPSKVLELEAPGQLPKPIFWIQAETPALPGCNVNILCHGWLQDLVFMLFKEGYAEPVDYQVPTGTMAIFSIDNLTPEDEGVYICRTHIQMLPTLWSEPSNPLKLVVAGLYPKPTLTAHPGPIMAPGESLNLRCQGPIYGMTFALMRVEDLEKSFYHKKTIKNEANFFFQSLKIQDTGHYLCFYYDASYRGSLLSDVLKIWVTDTFPKTWLLARPSAVVQMGQNVSLRCRGPVDGVGLALYKKGEDKPLQFLDATSIDDNTSFFLNNVTYSDTGIYSCHYLLTWKTSIRMPSHNTVELMVVDKPPKPSLSAWPSTVFKLGKAITLQCRVSHPVLEFSLEWEERETFQKFSVNGDFIISNVDGKGTGTYSCSYRVETHPNIWSHRSEPLKLMGPAGYLTWNYVLNEAIRLSLIMQLVALLLVVLWIRWKCRRLRIREAWLLGTAQGVTMLFIVTALLCCGLCNGVLIEETEIVMPTPKPELWAETNFPLAPWKNLTLWCRSPSGSTKEFVLLKDGTGWIATRPASEQVRAAFPLGALTQSHTGSYHCHSWEEMAVSEPSEALELVGTDILPKPVISASPTIRGQELQLRCKGWLAGMGFALYKEGEQEPVQQLGAVGREAFFTIQRMEDKDEGNYSCRTHTEKRPFKWSEPSEPLELVIKEMYPKPFFKTWASPVVTPGARVTFNCSTPHQHMSFILYKDGSEIASSDRSWASPGASAAHFLIISVGIGDGGNYSCRYYDFSIWSEPSDPVELVVTEFYPKPTLLAQPGPVVFPGKSVILRCQGTFQGMRFALLQEGAHVPLQFRSVSGNSADFLLHTVGAEDSGNYSCIYYETTMSNRGSYLSMPLMIWVTDTFPKPWLFAEPSSVVPMGQNVTLWCRGPVHGVGYILHKEGEATSMQLWGSTSNDGAFPITNISGTSMGRYSCCYHPDWTSSIKIQPSNTLELLVTGLLPKPSLLAQPGPMVAPGENMTLQCQGELPDSTFVLLKEGAQEPLEQQRPSGYRADFWMPAVRGEDSGIYSCVYYLDSTPFAASNHSDSLEIWVTDKPPKPSLSAWPSTMFKLGKDITLQCRGPLPGVEFVLEHDGEEAPQQFSEDGDFVINNVEGKGIGNYSCSYRLQAYPDIWSEPSDPLELVGAAGPVAQECTVGNIVRSSLIVVVVVALGVVLAIEWKKWPRLRTRGSETDGRDQTIALEECNQEGEPGTPANSPSSTSQRISVELPVPI

SEQ ID NO: 39966 - protein, 1327 aa, Homo sapiens; identical to SEQ ID NO: 39965
  Payload ID: 8141
  Gene Symbol: IGSF1
  Gene Name: immunoglobulin superfamily, member 1
  Uniprot ID: Q8N6C5
  ENSP ID: ENSP00000359947

SEQ ID NO: 39967 - protein, 2623 aa, Homo sapiens
  Payload ID: 8142
  Gene Symbol: IGSF10
  Gene Name: immunoglobulin superfamily, member 10
  Uniprot ID: Q6WRI0
  ENSP ID: ENSP00000282466
MKVKGRGITCLLVSFAVICLVATPGGKACPRRCACYMPTEVHCTFRYLTSIPDSIPPNVERINLGYNSLVRLMETDFSGLTKLELLMLHSNGIHTIPDKTFSDLQALQVLKMSYNKVRKLQKDTFYGLRSLTRLHMDHNNIEFINPEVFYGLNFLRLVHLEGNQLTKLHPDTFVSLSYLQIFKISFIKFLYLSDNFLTSLPQEMVSYMPDLDSLYLHGNPWTCDCHLKWLSDWIQEKPDVIKCKKDRSPSSAQQCPLCMNPRTSKGKPLAMVSAAAFQCAKPTIDSSLKSKSLTILEDSSSAFISPQGFMAPFGSLTLNMTDQSGNEANMVCSIQKPSRTSPIAFTEENDYIVLNTSFSTFLVCNIDYGHIQPVWQILALYSDSPLILERSHLLSETPQLYYKYKQVAPKPEDIFTNIEADLRADPSWLMQDQISLQLNRTATTFSTLQIQYSSDAQITLPRAEMRPVKHKWTMISRDNNTKLEHTVLVGGTVGLNCPGQGDPTPHVDWLLADGSKVRAPYVSEDGRILIDKSGKLELQMADSFDTGVYHCISSNYDDADILTYRITVVEPLVEAYQENGIHHTVFIGETLDLPCHSTGIPDASISWVIPGNNVLYQSSRDKKVLNNGTLRILQVTPKDQGYYRCVAANPSGVDFLIFQVSVKMKGQRPLEHDGETEGSGLDESNPIAHLKEPPGAQLRTSALMEAEVGKHTSSTSKRHNYRELTLQRRGDSTHRRFRENRRHFPPSARRIDPQHWAALLEKAKKNAMPDKRENTTVSPPPVVTQLPNIPGEEDDSSGMLALHEEFMVPATKALNLPARTVTADSRTISDSPMTNINYGTEFSPVVNSQILPPEEPTDFKLSTAIKTTAMSKNINPTMSSQIQGTTNQHSSTVFPLLLGATEFQDSDQMGRGREHFQSRPPITVRTMIKDVNVKMLSSTTNKLLLESVNTTNSHQTSVREVSEPRHNHFYSHTTQILSTSTFPSDPHTAAHSQFPIPRNSTVNIPLFRRFGRQRKIGGRGRIISPYRTPVLRRHRYSIFRSTTRGSSEKSTTAFSATVLNVTCLSCLPRERLTTATAALSFPSAAPITFPKADIARVPSEESTTLVQNPLLLLENKPSVEKTTPTIKYFRTEISQVTPTGAVMTYAPTSIPMEKTHKVNASYPRVSSTNEAKRDSVITSSLSGAITKPPMTIIAITRFSRRKIPWQQNFVNNHNPKGRLRNQHKVSLQKSTAVMLPKTSPALPRDKVSPFHFTTLSTSVMQIPSNTLTTAHHTTTKTHNPGSLPTKKELPFPPLNPMLPSIISKDSSTKSIISTQTAIPATTPTFPASVITYETQTERSRAQTIQREQEPQKKNRTDPNISPDQSSGFTTPTAMTPPVLTTAETSVKPSVSAFTHSPPENTTGISSTISFHSRTLNLTDVIEELAQASTQTLKSTIASETTLSSKSHQSTTTRKAIIRHSTIPPFLSSSATLMPVPISPPFTQRAVTDNVATPISGLMTNTVVKLHESSRHNAKPQQLVAEVATSPKVHPNAKFTIGTTHFIYSNLLHSTPMPALTTVKSQNSKLTPSPWAENQFWHKPYSEIAEKGKKPEVSMLATTGLSEATTLVSDWDGQKNTKKSDFDKKPVQEATTSKLLPFDSLSRYIFEKPRIVGGKAASFTIPANSDAFLPCEAVGNPLPTIHWTRVPSGLDLSKRKQNSRVQVLPNGTLSIQRVEIQDRGQYLCSASNLFGTDHLHVTLSVVSYPPRILERRTKEITVHSGSTVELKCRAEGRPSPTVTWILANQTVVSESSQGSRQAVVTVDGTLVLHNLSIYDRGFYKCVASNPGGQDSLLVKIQVIAAPPVILEQRRQVIVGTWGESLKLPCTAKGTPQPSVYWVLSDGTEVKPLQFTNSKLFLFSNGTLYIRNLASSDRGTYECIATSSTGSERRVVMLTMEERVTSPRIEAASQKRTEVNFGDKLLLNCSATGEPKPQIMWRLPSKAVVDQQHRVGSWIHVYPNGSLFIGSVTEKDSGVYLCVARNKMGDDLILMHVSLRLKPAKIDHKQYFRKQVLHGKDFQVDCKASGSPVPEISWSLPDGTMINNAMQADDSGHRTRRYTLFNNGTLYFNKVGVAEEGDYTCYAQNTLGKDEMKVHLTVITAAPRIRQSNKTNKRIKAGDTAVLDCEVTGDPKPKIFWLLPSNDMISFSIDRYTFHANGSLTINKVKLLDSGEYVCVARNPSGDDTKMYKLDVVSKPPLINGLYTNRTVIKATAVRHSKKHFDCRAEGTPSPEVMWIMPDNIFLTAPYYGSRITVHKNGTLEIRNVRLSDSADFICVARNEGGESVLVVQLEVLEMLRRPTFRNPFNEKIVAQLGKSTALNCSVDGNPPPEIIWILPNGTRFSNGPQSYQYLIASNGSFIISKTTREDAGKYRCAARNKVGYIEKLVILEIGQKPVILTYAPGTVKGISGESLSLHCVSDGIPKPNIKWTMPSGYVVDRPQINGKYILHDNGTLVIKEATAYDRGNYICKAQNSVGHTLITVPVMIVAYPPRITNRPPRSIVTRTGAAFQLHCVALGVPKPEITWEMPDHSLLSTASKERTHGSEQLHLQGTLVIQNPQTSDSGIYKCTAKNPLGSDYAATYIQVI

SEQ ID NO: 39968 - protein, 86 aa, Homo sapiens
  Payload ID: 8142
  Gene Symbol: IGSF10
  Gene Name: immunoglobulin superfamily, member 10
  ENSP ID: ENSP00000417627
TMEERVTSPRIEAASQKRTEVNFGDKLLLNCSATGEPKPQIMWRLPSKAVVDQQHRILDFYFSEAEAMPCSCCNHKTEYPAYYCQV

SEQ ID NO: 39969 - protein, 430 aa, Homo sapiens
  Payload ID: 8143
  Gene Symbol: IGSF11
  Gene Name: immunoglobulin superfamily, member 11
  Uniprot ID: Q5DX21
  ENSP ID: ENSP00000346700
MSLVELLLWWNCFSRTGVAASLEVSESPGSIQVARGQPAVLPCTFTTSAALINLNVIWMVTPLSNANQPEQVILYQGGQMFDGAPRFHGRVGFTGTMPATNVSIFINNTQLSDTGTYQCLVNNLPDIGGRNIGVTGLTVLVPPSAPHCQIQGSQDIGSDVILLCSSEEGIPRPTYLWEKLDNTLKLPPTATQDQVQGTVTIRNISALSSGLYQCVASNAIGTSTCLLDLQVISPQPRNIGLIAGAIGTGAVIIIFCIALILGAFFYWRSKNKEEEEEEIPNEIREDDLPPKCSSAKAFHTEISSSDNNTLTSSNAYNSRYWSNNPKVHRNTESVSHFSDLGQSFSFHSGNANIPSIYANGTHLVPGQHKTLVVTANRGSSPQVMSRSNGSVSRKPRPPHTHSYTISHATLERIGAVPVMVPAQSRAGSLV

SEQ ID NO: 39970 - protein, 431 aa, Homo sapiens
  Payload ID: 8143
  Gene Symbol: IGSF11
  Gene Name: immunoglobulin superfamily, member 11
  Uniprot ID: Q5DX21
  ENSP ID: ENSP00000377370
MTSQRSPLAPLLLLSLHGVAASLEVSESPGSIQVARGQPAVLPCTFTTSAALINLNVIWMVTPLSNANQPEQVILYQGGQMFDGAPRFHGRVGFTGTMPATNVSIFINNTQLSDTGTYQCLVNNLPDIGGRNIGVTGLTVLVPPSAPHCQIQGSQDIGSDVILLCSSEEGIPRPTYLWEKLDNTLKLPPTATQDQVQGTVTIRNISALSSGLYQCVASNAIGTSTCLLDLQVISPQPRNIGLIAGAIGTGAVIIIFCIALILGAFFYWRSKNKEEEEEEIPNEIREDDLPPKCSSAKAFHTEISSSDNNTLTSSNAYNSRYWSNNPKVHRNTESVSHFSDLGQSFSFHSGNANIPSIYANGTHLVPGQHKTLVVTANRGSSPQVMSRSNGSVSRKPRPPHTHSYTISHATLERIGAVPVMVPAQSRAGSLV

SEQ ID NO: 39971 - protein, 406 aa, Homo sapiens
  Payload ID: 8143
  Gene Symbol: IGSF11
  Gene Name: immunoglobulin superfamily, member 11
  Uniprot ID: Q5DX21
  ENSP ID: ENSP00000401240
MSLVELLLWWNCFSRTGVAASLEVSESPGSIQVARGQPAVLPCTFTTSAALINLNVIWMVTPLSNANQPEQVILYQGGQMFDGAPRFHGRVGFTGTMPATNVSIFINNTQLSDTGTYQCLVNNLPDIGGRNIGVTGLTVLVPPSAPHCQIQGSQDIGSDVILLCSSEEGIPRPTYLWEKLDNTLKLPPTATQDQVQGTVTIRNISALSSAQPRNIGLIAGAIGTGAVIIIFCIALILGAFFYWRSKNKEEEEEEIPNEIREDDLPPKCSSAKAFHTEISSSDNNTLTSSNAYNSRYWSNNPKVHRNTESVSHFSDLGQSFSFHSGNANIPSIYANGTHLVPGQHKTLVVTANRGSSPQVMSRSNGSVSRKPRPPHTHSYTISHATLERIGAVPVMVPAQSRAGSLV

SEQ ID NO: 39972 - protein, 430 aa, Homo sapiens; identical to SEQ ID NO: 39969
  Payload ID: 8143
  Gene Symbol: IGSF11
  Gene Name: immunoglobulin superfamily, member 11
  Uniprot ID: Q5DX21
  ENSP ID: ENSP00000406092

SEQ ID NO: 39973 - protein, 403 aa, Homo sapiens
  Payload ID: 8143
  Gene Symbol: IGSF11
  Gene Name: immunoglobulin superfamily, member 11
  ENSP ID: ENSP00000417413
MTSQRSPLAPLLLLSLHGVAASLEVSESPGSIQVARGQPAVLPCTFTTSAALINLNVIWMVTPLSNANQPEQVILYQGGQMFDGAPRFHGRVGFTGTMPATNVSIFINNTQLSDTGTYQCLVNNLPDIGGRNIGVTGLTVLVPPSAPHCQIQGSQDIGSDVILLCSSEEGIPRPTYLWEKLDNTLKLPPTATQDQVQGTVTIRNISALSSGLYQCVASNAIGTSTCLLDLQVISRAFFYWRSKNKEEEEEEIPNEIREDDLPPKCSSAKAFHTEISSSDNNTLTSSNAYNSRYWSNNPKVHRNTESVSHFSDLGQSFSFHSGNANIPSIYANGTHLVPGQHKTLVVTANRGSSPQVMSRSNGSVSRKPRPPHTHSYTISHATLERIGAVPVMVPAQSRAGSLV

SEQ ID NO: 39974 - protein, 32 aa, Homo sapiens
  Payload ID: 8143
  Gene Symbol: IGSF11
  Gene Name: immunoglobulin superfamily, member 11
  ENSP ID: ENSP00000418047
MVTPLSNANQPEQVILYQGGQMFDGAPRFHGR

SEQ ID NO: 39975 - protein, 59 aa, Homo sapiens
  Payload ID: 8143
  Gene Symbol: IGSF11
  Gene Name: immunoglobulin superfamily, member 11
  ENSP ID: ENSP00000418976
MVTPLSNANQPEQVILYQGGQMFDGAPRFHGRVGFTGTMPATNVSIFINNTQLSDTGTY

SEQ ID NO: 39976 - protein, 407 aa, Homo sapiens
  Payload ID: 8143
  Gene Symbol: IGSF11
  Gene Name: immunoglobulin superfamily, member 11
  ENSP ID: ENSP00000420486
MTSQRSPLAPLLLLSLHGVAASLEVSESPGSIQVARGQPAVLPCTFTTSAALINLNVIWMVTPLSNANQPEQVILYQGGQMFDGAPRFHGRVGFTGTMPATNVSIFINNTQLSDTGTYQCLVNNLPDIGGRNIGVTGLTVLVPPSAPHCQIQGSQDIGSDVILLCSSEEGIPRPTYLWEKLDNTLKLPPTATQDQVQGTVTIRNISALSSAQPRNIGLIAGAIGTGAVIIIFCIALILGAFFYWRSKNKEEEEEEIPNEIREDDLPPKCSSAKAFHTEISSSDNNTLTSSNAYNSRYWSNNPKVHRNTESVSHFSDLGQSFSFHSGNANIPSIYANGTHLVPGQHKTLVVTANRGSSPQVMSRSNGSVSRKPRPPHTHSYTISHATLERIGAVPVMVPAQSRAGSLV

SEQ ID NO: 39977 - protein, 903 aa, Homo sapiens
  Payload ID: 8144
  Gene Symbol: IGSF22
  Gene Name: immunoglobulin superfamily, member 22
  Uniprot ID: Q8N9C0
  ENSP ID: ENSP00000322422
MTTIHSRQMLQEHVSMEFSSSTTHVQTFSQTTKIVGEEVVRRKSSSIVEFFSLVTRSSNIPAGDSVPEFVEKPQPVTAPEGDKAVFRARVQGNAKPHISWKRESGIPIKESAKIFYDSINKEHVLKLEPLTSDDSDNYKCIASNDHADAIYTVSLLVTEGQEKMDFKKMLKKRAPPAPKKKQKKVANEKEMLEILSKVPKKDFEKVCMEYGFTDFRGLLRKLKEMKKKVEVEAIRILKPLEDKETKVDTTVVFDCIMELKDPNVKMIWIKGTEPLRIQYSLGKYDVKQMGTKYMLVISNVNMNDAGIYSLSVGDKRMSAELTVLDEPLKFLGEMKPVKVTERQTAVFEIRLSKKEPNFVWKFNGKELKRDDKYEITVSEDGLTHTLKIKDARLSDSGEFSAEAGNLVQKAQLTVDRIPIKFVSNLKNVRVKERSRACLECELTSKDVTLRWKKDGQLLMHGTKYSMNHEGKRAELIIEDAQLSDGGEYTVVAMQDGDPTEYYSTAIVTVEERLATVKSGMSDVHAATGSPAELCVVLNDEKVEGVWLKDGKEITDLPGMQIVKQGAVHKLIFPSMGPEHEGKYTFRAKGTESEASVFIADPPTIDPSVLEALAAHAITVKVGHTAHIKVPFRGKPLPKVTWYKDGMEVTEEERVSMERGEDQALLTISNCVREDSGLILLKLKNDHGSATATLHLSVLEPPGFASQPQVTDVTKEAVTITWNAPTQDGGAPVLGYIVERRKKGSNLWVPVNKDPIQGTKCTVDGLLEDTEYEFRVIAVNKAGPGQPSVPSSSVVAKDPVKPPGLVQDLHVSDSSNSSISLAWREPAEGDPPSGYILEMRAEDTKEWSKCTKIPISGTCYTVGGLIERQKYFFRIRAVNEAGVGEPVELDKGVRAMPPPGLTTT

SEQ ID NO: 39978 - protein, 1326 aa, Homo sapiens
  Payload ID: 8144
  Gene Symbol: IGSF22
  Gene Name: immunoglobulin superfamily, member 22
  Uniprot ID: Q8N9C0
  ENSP ID: ENSP00000421191
MTTIHSRQMLQEHVSMEFSSSTTHVQTFSQTTKIVGEEVVRRKSSSIVEFFSLVTRSSNIPAGDSVPEFVEKPQPVTAPEGDKAVFRARVQGNAKPHISWKRESGIPIKESAKIFYDSINKEHVLKLEPLTSDDSDNYKCIASNDHADAIYTVSLLVTEGQEKMDFKKMLKKRAPPAPKKKQKKVANEKEMLEILSKVPKKDFEKVCMEYGFTDFRGLLRKLKEMKKKVEVEAIRILKPLEDKETKVDTTVVFDCIMELKDPNVKMIWIKGTEPLRIQYSLGKYDVKQMGTKYMLVISNVNMNDAGIYSLSVGDKRMSAELTVLDEPLKFLGEMKPVKVTERQTAVFEIRLSKKEPNFVWKFNGKELKRDDKYEITVSEDGLTHTLKIKDARLSDSGEFSAEAGNLVQKAQLTVDRIPIKFVSNLKNVRVKERSRACLECELTSKDVTLRWKKDGQLLMHGTKYSMNHEGKRAELIIEDAQLSDGGEYTVVAMQDGDPTEYYSTAIVTVEERLATVKSGMSDVHAATGSPAELCVVLNDEKVEGVWLKDGKEITDLPGMQIVKQGAVHKLIFPSMGPEHEGKYTFRAKGTESEASVFIADPPTIDPSVLEALAAHAITVKVGHTAHIKVPFRGKPLPKVTWYKDGMEVTEEERVSMERGEDQALLTISNCVREDSGLILLKLKNDHGSATATLHLSVLDRPKPPQGRVEFLELSGSCVHMKWKAPKDNGGRPVTQFIVERRAVGKKSWIKIGEVDGKVTNFSTNKVEEGKAYQFRILAVNSEGVSDPLETEEVFAGNPIEPPGFASQPQVTDVTKEAVTITWNAPTQDGGAPVLGYIVERRKKGSNLWVPVNKDPIQGTKCTVDGLLEDTEYEFRVIAVNKAGPGQPSVPSSSVVAKDPVKPPGLVQDLHVSDSSNSSISLAWREPAEGDPPSGYILEMRAEDTKEWSKCTKIPISGTCYTVGGLIERQKYFFRIRAVNEAGVGEPVELDKGVRAMPPPAAPKFDLSARLKSHMVVRAGTALCIHAAFSGSPPPDVIWQKDGVPTKGRETITKSKNHSQFLINSTKRSDSGVYRILLQNEFGEARYDIHVRVADFPRPPTNLRLFEEVPNTVTLTWNHSPDVQEDGEAHYIIMKRDASTATWYTAAERVFSNKYTVTGLLPGRKYYFRVVARNEIGDSEPLDSRDTWLINKDQIQDLSAKLKPYEKKDWRHAPRFVTPLKPHTVLRGQDCTMTCAFLGNPRPTVTLYKGDVNITANSKFWYNSTSGVCTLVIPTCTLKDSGDYSVLVENELGKDRSSCTLTVYDKDDKSVVASITESLQKKSKHLM

SEQ ID NO: 39979 - protein, 192 aa, Homo sapiens
  Payload ID: 8145
  Gene Symbol: IGSF23
  Gene Name: immunoglobulin superfamily, member 23
  Uniprot ID: A1L1A6
  ENSP ID: ENSP00000385592
MRAKPQSPLPRNPVPAWSPPTTTTDPMLEKDAAGGDFPANLVLQLMPLKTFPAAIRGVIQSELNYSVILQWVVTMDPEPVLSWTFSGVPCGMGEKLFIRRLSCEQLGTYMCIATNSKKQLVSEPVTISLPKPIMQPTEAEPMEPDPTLSLSGGSAIGLLAAGILGAGALIAGMCFIIIQSLRTDRQRIGICS

SEQ ID NO: 39980 - protein, 138 aa, Homo sapiens
  Payload ID: 8145
  Gene Symbol: IGSF23
  Gene Name: immunoglobulin superfamily, member 23
  ENSP ID: ENSP00000407344
  MOD_RES (1)..(1): Any amino acid
XRGVIQSELNYSVILQWVVTMDPEPVLSWTFSGVPCGMGEKLFIRRLSCEQLGTYMCIATNSKKQLVSEPVTISLPKPIMQPTEAEPMEPDPTLSLSGGSAIGLLAAGILGAGALIAGMCFIIIQSLRTDRQRIGICS

SEQ ID NO: 39981 - protein, 212 aa, Homo sapiens
  Payload ID: 8145
  Gene Symbol: IGSF23
  Gene Name: immunoglobulin superfamily, member 23
  ENSP ID: ENSP00000410629
  MOD_RES (1)..(1): Any amino acid
XRGPLDVSSSHTPTWRKLLLTGALLTSCTCSAFSELPFSAQLNTLTEGASVHLPVPGRLEDSLQLMPLKTFPAAIRGVIQSELNYSVILQWVVTMDPEPVLSWTFSGVPCGMGEKLFIRRLSCEQLGTYMCIATNSKKQLVSEPVTISLPKPIMQPTEAEPMEPDPTLSLSGGSAIGLLAAGILGAGALIAGMCFIIIQSLRTDRQRIGICS

SEQ ID NO: 39982 - protein, 66 aa, Homo sapiens
  Payload ID: 8145
  Gene Symbol: IGSF23
  Gene Name: immunoglobulin superfamily, member 23
  ENSP ID: ENSP00000465887
MKTPCVMRRPSLHSPWTEHEMRGPLDVSSSHTPTWRKLLLTDSLQLMPLKTFPAAIRGVIQSELNY

SEQ ID NO: 39983 - protein, 1214 aa, Homo sapiens
  Payload ID: 8146
  Gene Symbol: IGSF3
  Gene Name: immunoglobulin superfamily, member 3
  Uniprot ID: O75054
  ENSP ID: ENSP00000321184
MKCFFPVLSCLAVLGVVSAQRQVTVQEGPLYRTEGSHITIWCNVSGYQGPSEQNFQWSIYLPSSPEREVQIVSTMDSSFPYAIYTQRVRGGKIFIERVQGNSTLLHITDLQARDAGEYECHTPSTDKQYFGSYSAKMNLVVIPDSLQTTAMPQTLHRVEQDPLELTCEVASETIQHSHLSVAWLRQKVGEKPVEVISLSRDFMLHSSSEYAQRQSLGEVRLDKLGRTTFRLTIFHLQPSDQGEFYCEAAEWIQDPDGSWYAMTRKRSEGAVVNVQPTDKEFTVRLETEKRLHTVGEPVEFRCILEAQNVPDRYFAVSWAFNSSLIATMGPNAVPVLNSEFAHREARGQLKVAKESDSVFVLKIYHLRQEDSGKYNCRVTEREKTVTGEFIDKESKRPKNIPIIVLPLTDNWVVKVPQHHQLLSQGHLESSISVEVASNASVILEGEDLRFSCSVRTAGRPQGRFSVIWQLVDRQNRRSNIMWLDRDGTVQPGSSYWERSSFGGVQMEQVQPNSFSLGIFNSRKEDEGQYECHVTEWVRAVDGEWQIVGERRASTPISITALEMGFAVTAISRTPGVTYSDSFDLQCIIKPHYPAWVPVSVTWRFQPVGTVEFHDLVTFTRDGGVQWGDRSSSFRTRTAIEKAESSNNVRLSISRASDTEAGKYQCVAELWRKNYNNTWTRLAERTSNLLEIRVLQPVTKLQVSKSKRTLTLVENKPIQLNCSVKSQTSQNSHFAVLWYVHKPSDADGKLILKTTHNSAFEYGTYAEEEGLRARLQFERHVSGGLFSLTVQRAEVSDSGSYYCHVEEWLLSPNYAWYKLAEEVSGRTEVTVKQPDSRLRLSQAQGNLSVLETRQVQLECVVLNRTSITSQLMVEWFVWKPNHPERETVARLSRDATFHYGEQAAKNNLKGRLHLESPSPGVYRLFIQNVAVQDSGTYSCHVEEWLPSPSGMWYKRAEDTAGQTALTVMRPDASLQVDTVVPNATVSEKAAFQLDCSIVSRSSQDSRFAVAWYSLRTKAGGKRSSPGLEEQEEEREEEEEEDDDDDDDPTERTALLSVGPDAVFGPEGSPWEGRLRFQRLSPVLYRLTVLQASPQDTGNYSCHVEEWLPSPQKEWYRLTEEESAPIGIRVLDTSPTLQSIICSNDALFYFVFFYPFPIFGILIITILLVRFKSRNSSKNSDGKNGVPLLWIKEPHLNYSPTCLEPPVLSIHPGAID

SEQ ID NO: 39984 - protein, 1214 aa, Homo sapiens; identical to SEQ ID NO: 39983
  Payload ID: 8146
  Gene Symbol: IGSF3
  Gene Name: immunoglobulin superfamily, member 3
  Uniprot ID: O75054
  ENSP ID: ENSP00000358495

SEQ ID NO: 39985 - protein, 1194 aa, Homo sapiens
  Payload ID: 8146
  Gene Symbol: IGSF3
  Gene Name: immunoglobulin superfamily, member 3
  Uniprot ID: O75054
  ENSP ID: ENSP00000358498
MKCFFPVLSCLAVLGVVSAQRQVTVQEGPLYRTEGSHITIWCNVSGYQGPSEQNFQWSIYLPSSPEREVQIVSTMDSSFPYAIYTQRVRGGKIFIERVQGNSTLLHITDLQARDAGEYECHTPSTDKQYFGSYSAKMNLVVIPDSLQTTAMPQTLHRVEQDPLELTCEVASETIQHSHLSVAWLRQKVGEKPVEVISLSRDFMLHSSSEYAQRQSLGEVRLDKLGRTTFRLTIFHLQPSDQGEFYCEAAEWIQDPDGSWYAMTRKRSEGAVVNVQPTDKEFTVRLETEKRLHTVGEPVEFRCILEAQNVPDRYFAVSWAFNSSLIATMGPNAVPVLNSEFAHREARGQLKVAKESDSVFVLKIYHLRQEDSGKYNCRVTEREKTVTGEFIDKESKRPKNIPIIVLPLKSSISVEVASNASVILEGEDLRFSCSVRTAGRPQGRFSVIWQLVDRQNRRSNIMWLDRDGTVQPGSSYWERSSFGGVQMEQVQPNSFSLGIFNSRKEDEGQYECHVTEWVRAVDGEWQIVGERRASTPISITALEMGFAVTAISRTPGVTYSDSFDLQCIIKPHYPAWVPVSVTWRFQPVGTVEFHDLVTFTRDGGVQWGDRSSSFRTRTAIEKAESSNNVRLSISRASDTEAGKYQCVAELWRKNYNNTWTRLAERTSNLLEIRVLQPVTKLQVSKSKRTLTLVENKPIQLNCSVKSQTSQNSHFAVLWYVHKPSDADGKLILKTTHNSAFEYGTYAEEEGLRARLQFERHVSGGLFSLTVQRAEVSDSGSYYCHVEEWLLSPNYAWYKLAEEVSGRTEVTVKQPDSRLRLSQAQGNLSVLETRQVQLECVVLNRTSITSQLMVEWFVWKPNHPERETVARLSRDATFHYGEQAAKNNLKGRLHLESPSPGVYRLFIQNVAVQDSGTYSCHVEEWLPSPSGMWYKRAEDTAGQTALTVMRPDASLQVDTVVPNATVSEKAAFQLDCSIVSRSSQDSRFAVAWYSLRTKAGGKRSSPGLEEQEEEREEEEEEDDDDDDDPTERTALLSVGPDAVFGPEGSPWEGRLRFQRLSPVLYRLTVLQASPQDTGNYSCHVEEWLPSPQKEWYRLTEEESAPIGIRVLDTSPTLQSIICSNDALFYFVFFYPFPIFGILIITILLVRFKSRNSSKNSDGKNGVPLLWIKEPHLNYSPTCLEPPVLSIHPGAID

SEQ ID NO: 39986 - protein, 5 aa, Homo sapiens
  Payload ID: 8146
  Gene Symbol: IGSF3
  Gene Name: immunoglobulin superfamily, member 3
  ENSP ID: ENSP00000474657
MDSSF

SEQ ID NO: 39987 - protein, 407 aa, Homo sapiens
  Payload ID: 8147
  Gene Symbol: IGSF5
  Gene Name: immunoglobulin superfamily, member 5
  Uniprot ID: Q9NSI5
  ENSP ID: ENSP00000369962
MGQKERSTADTLPDLEEWKSAAGLRWWQTAVVDGSGSGNEVIEGPQNARVLKGSQARFNCTVSQGWKLIMWALSDMVVLSVRPMEPIITNDRFTSQRYDQGGNFTSEMIIHNVEPSDSGNIRCSLQNSRLHGSAYLTVQVMGELFIPSVNLVVAENEPCEVTCLPSHWTRLPDISWELGLLVSHSSYYFVPEPSDLQSAVSILALTPQSNGTLTCVATWKSLKARKSATVNLTVIRCPQDTGGGINIPGVLSSLPSLGFSLPTWGKVGLGLAGTMLLTPTCTLTIRCCCCRRRCCGCNCCCRCCFCCRRKRGFRIQFQKKSEKEKTNKETETESGNENSGYNSDEQKTTDTASLPPKSCESSDPEQRNSSCGPPHQRADQRPPRPASHPQASFNLASPEKVSNTTVV

SEQ ID NO: 39988 - protein, 241 aa, Homo sapiens
  Payload ID: 8148
  Gene Symbol: IGSF6
  Gene Name: immunoglobulin superfamily, member 6
  Uniprot ID: O95976
  ENSP ID: ENSP00000268389
MGTASRSNIARHLQTNLILFCVGAVGACTLSVTQPWYLEVDYTHEAVTIKCTFSATGCPSEQPTCLWFRYGAHQPENLCLDGCKSEADKFTVREALKENQVSLTVNRVTSNDSAIYICGIAFPSVPEARAKQTGGGTTLVVREIKLLSKELRSFLTALVSLLSVYVTGVCVAFILLSKSKSNPLRNKEIKEDSQKKKSARRIFQEIAQELYHKRHVETNQQSEKDNNTYENRRVLSNYERP

SEQ ID NO: 39989 - protein, 120 aa, Homo sapiens
  Payload ID: 8148
  Gene Symbol: IGSF6
  Gene Name: immunoglobulin superfamily, member 6
  ENSP ID: ENSP00000454916
MGTASRSNIARHLQTNLILFCVGAVGACTLSVTQPWYLEVDYTHEAVTIKCTFSATGCPSEQPTCLWFRYGAHQPENLCLDGCKKIKLLSKELRSFLTALVSLLSVYVTGVCVAFILLSK

SEQ ID NO: 39990 - protein, 613 aa, Homo sapiens
  Payload ID: 8149
  Gene Symbol: IGSF8
  Gene Name: immunoglobulin superfamily, member 8
  Uniprot ID: Q969P0
  ENSP ID: ENSP00000316664
MGALRPTLLPPSLPLLLLLMLGMGCWAREVLVPEGPLYRVAGTAVSISCNVTGYEGPAQQNFEWFLYRPEAPDTALGIVSTKDTQFSYAVFKSRVVAGEVQVQRLQGDAVVLKIARLQAQDAGIYECHTPSTDTRYLGSYSGKVELRVLPDVLQVSAAPPGPRGRQAPTSPPRMTVHEGQELALGCLARTSTQKHTHLAVSFGRSVPEAPVGRSTLQEVVGIRSDLAVEAGAPYAERLAAGELRLGKEGTDRYRMVVGGAQAGDAGTYHCTAAEWIQDPDGSWAQIAEKRAVLAHVDVQTLSSQLAVTVGPGERRIGPGEPLELLCNVSGALPPAGRHAAYSVGWEMAPAGAPGPGRLVAQLDTEGVGSLGPGYEGRHIAMEKVASRTYRLRLEAARPGDAGTYRCLAKAYVRGSGTRLREAASARSRPLPVHVREEGVVLEAVAWLAGGTVYRGETASLLCNISVRGGPPGLRLAASWWVERPEDGELSSVPAQLVGGVGQDGVAELGVRPGGGPVSVELVGPRSHRLRLHSLGPEDEGVYHCAPSAWVQHADYSWYQAGSARSGPVTVYPYMHALDTLFVPLLVGTGVALVTGATVLGTITCCFMKRLRKR

SEQ ID NO: 39991 - protein, 613 aa, Homo sapiens; identical to SEQ ID NO: 39990
  Payload ID: 8149
  Gene Symbol: IGSF8
  Gene Name: immunoglobulin superfamily, member 8
  Uniprot ID: Q969P0
  ENSP ID: ENSP00000357065

SEQ ID NO: 39992 - protein, 301 aa, Homo sapiens
  Payload ID: 8149
  Gene Symbol: IGSF8
  Gene Name: immunoglobulin superfamily, member 8
  ENSP ID: ENSP00000397464
MGALRPTLLPPSLPLLLLLMLGMGCWAREVLVPEGPLYRVAGTAVSISCNVTGYEGPAQQNFEWFLYRPEAPDTALGIVSTKDTQFSYAVFKSRVVAGEVQVQRLQGDAVVLKIARLQAQDAGIYECHTPSTDTRYLGSYSGKVELRVLPDVLQVSAAPPGPRGRQAPTSPPRMTVHEGQELALGCLARTSTQKHTHLAVSFGRSVPEAPVGRSTLQEVVGIRSDLAVEAGAPYAERLAAGELRLGKEGTDRYRMVVGGAQAGDAGTYHCTAAEWIQDPDGSWAQIAEKRAVLAHVDVQTL

SEQ ID NO: 39993 - protein, 613 aa, Homo sapiens; identical to SEQ ID NO: 39990
  Payload ID: 8149
  Gene Symbol: IGSF8
  Gene Name: immunoglobulin superfamily, member 8
  Uniprot ID: Q969P0
  ENSP ID: ENSP00000477565

SEQ ID NO: 39994 - protein, 1163 aa, Homo sapiens
  Payload ID: 8150
  Gene Symbol: IGSF9
  Gene Name: immunoglobulin superfamily, member 9
  Uniprot ID: Q9P2J2
  ENSP ID: ENSP00000355049
MVWCLGLAVLSLVISQGADGRGKPEVVSVVGRAGESVVLGCDLLPPAGRPPLHVIEWLRFGFLLPIFIQFGLYSPRIDPDYVGRVRLQKGASLQIEGLRVEDQGWYECRVFFLDQHIPEDDFANGSWVHLTVNSPPQFQETPPAVLEVQELEPVTLRCVARGSPLPHVTWKLRGKDLGQGQGQVQVQNGTLRIRRVERGSSGVYTCQASSTEGSATHATQLLVLGPPVIVVPPKNSTVNASQDVSLACHAEAYPANLTYSWFQDNINVFHISRLQPRVRILVDGSLRLLATQPDDAGCYTCVPSNGLLHPPSASAYLTVLCMPGVIRCPVRANPPLLFVSWTKDGKALQLDKFPGWSQGTEGSLIIALGNEDALGEYSCTPYNSLGTAGPSPVTRVLLKAPPAFIERPKEEYFQEVGRELLIPCSAQGDPPPVVSWTKVGRGLQGQAQVDSNSSLILRPLTKEAHGHWECSASNAVARVATSTNVYVLGTSPHVVTNVSVVALPKGANVSWEPGFDGGYLQRFSVWYTPLAKRPDRMHHDWVSLAVPVGAAHLLVPGLQPHTQYQFSVLAQNKLGSGPFSEIVLSAPEGLPTTPAAPGLPPTEIPPPLSPPRGLVAVRTPRGVLLHWDPPELVPKRLDGYVLEGRQGSQGWEVLDPAVAGTETELLVPGLIKDVLYEFRLVAFAGSFVSDPSNTANVSTSGLEVYPSRTQLPGLLPQPVLAGVVGGVCFLGVAVLVSILAGCLLNRRRAARRRRKRLRQDPPLIFSPTGKSAAPSALGSGSPDSVAKLKLQGSPVPSLRQSLLWGDPAGTPSPHPDPPSSRGPLPLEPICRGPDGRFVMGPTVAAPQERSGREQAEPRTPAQRLARSFDCSSSSPSGAPQPLCIEDISPVAPPPAAPPSPLPGPGPLLQYLSLPFFREMNVDGDWPPLEEPSPAAPPDYMDTRRCPTSSFLRSPETPPVSPRESLPGAVVGAGATAEPPYTALADWTLRERLLPGLLPAAPRGSLTSQSSGRGSASFLRPPSTAPSAGGSYLSPAPGDTSSWASGPERWPRREHVVTVSKRRNTSVDENYEWDSEFPGDMELLETLHLGLASSRLRPEAEPELGVKTPEEGCLLNTAHVTGPEARCAALREEFLAFRRRRDATRARLPAYRQPVPHPEQATLL

SEQ ID NO: 39995 - protein, 1179 aa, Homo sapiens
  Payload ID: 8150
  Gene Symbol: IGSF9
  Gene Name: immunoglobulin superfamily, member 9
  Uniprot ID: Q9P2J2
  ENSP ID: ENSP00000357073
MVWCLGLAVLSLVISQGADGRGKPEVVSVVGRAGESVVLGCDLLPPAGRPPLHVIEWLRFGFLLPIFIQFGLYSPRIDPDYVGRVRLQKGASLQIEGLRVEDQGWYECRVFFLDQHIPEDDFANGSWVHLTVNSPPQFQETPPAVLEVQELEPVTLRCVARGSPLPHVTWKLRGKDLGQGQGQVQVQNGTLRIRRVERGSSGVYTCQASSTEGSATHATQLLVLGPPVIVVPPKNSTVNASQDVSLACHAEAYPANLTYSWFQDNINVFHISRLQPRVRILVDGSLRLLATQPDDAGCYTCVPSNGLLHPPSASAYLTVLYPAQVTAMPPETPLPIGMPGVIRCPVRANPPLLFVSWTKDGKALQLDKFPGWSQGTEGSLIIALGNEDALGEYSCTPYNSLGTAGPSPVTRVLLKAPPAFIERPKEEYFQEVGRELLIPCSAQGDPPPVVSWTKVGRGLQGQAQVDSNSSLILRPLTKEAHGHWECSASNAVARVATSTNVYVLGTSPHVVTNVSVVALPKGANVSWEPGFDGGYLQRFSVWYTPLAKRPDRMHHDWVSLAVPVGAAHLLVPGLQPHTQYQFSVLAQNKLGSGPFSEIVLSAPEGLPTTPAAPGLPPTEIPPPLSPPRGLVAVRTPRGVLLHWDPPELVPKRLDGYVLEGRQGSQGWEVLDPAVAGTETELLVPGLIKDVLYEFRLVAFAGSFVSDPSNTANVSTSGLEVYPSRTQLPGLLPQPVLAGVVGGVCFLGVAVLVSILAGCLLNRRRAARRRRKRLRQDPPLIFSPTGKSAAPSALGSGSPDSVAKLKLQGSPVPSLRQSLLWGDPAGTPSPHPDPPSSRGPLPLEPICRGPDGRFVMGPTVAAPQERSGREQAEPRTPAQRLARSFDCSSSSPSGAPQPLCIEDISPVAPPPAAPPSPLPGPGPLLQYLSLPFFREMNVDGDWPPLEEPSPAAPPDYMDTRRCPTSSFLRSPETPPVSPRESLPGAVVGAGATAEPPYTALADWTLRERLLPGLLPAAPRGSLTSQSSGRGSASFLRPPSTAPSAGGSYLSPAPGDTSSWASGPERWPRREHVVTVSKRRNTSVDENYEWDSEFPGDMELLETLHLGLASSRLRPEAEPELGVKTPEEGCLLNTAHVTGPEARCAALREEFLAFRRRRDATRARLPAYRQPVPHPEQATLL

SEQ ID NO: 39996 - protein, 717 aa, Homo sapiens
  Payload ID: 8150
  Gene Symbol: IGSF9
  Gene Name: immunoglobulin superfamily, member 9
  ENSP ID: ENSP00000483854
MVWCLGLAVLSLVISQGADGRGKPEVVSVVGRAGESVVLGCDLLPPAGRPPLHVIEWLRFGFLLPIFIQFGLYSPRIDPDYVGRVRLQKGASLQIEGLRVEDQGWYECRVFFLDQHIPEDDFANGSWVHLTVNSPPQFQETPPAVLEVQELEPVTLRCVARGSPLPHVTWKLRGKDLGQGQGQVQVQNGTLRIRRVERGSSGVYTCQASSTEGSATHATQLLVLGPPVIVVPPKNSTVNASQDVSLACHAEAYPANLTYSWFQDNINVFHISRLQPRVRILVDGSLRLLATQPDDAGCYTCVPSNGLLHPPSASAYLTVLYPAQVTAMPPETPLPIGMPGVIRCPVRANPPLLFVSWTKDGKALQLDKFPGWSQGTEGSLIIALGNEDALGEYSCTPYNSLGTAGPSPVTRVLLKAPPAFIERPKEEYFQEVGRELLIPCSAQGDPPPAAPPSPLPGPGPLLQYLSLPFFREMNVDGDWPPLEEPSPAAPPDYMDTRRCPTSSFLRSPETPPVSPRESLPGAVVGAGATAEPPYTALADWTLRERLLPGLLPAAPRGSLTSQSSGRGSASFLRPPSTAPSAGGSYLSPAPGDTSSWASGPERWPRREHVVTVSKRRNTSVDENYEWDSEFPGDMELLETLHLGLASSRLRPEAEPELGVKTPEEGCLLNTAHVTGPEARCAALREEFLAFRRRRDATRARLPAYRQPVPHPEQATLL

SEQ ID NO: 39997 - protein, 1349 aa, Homo sapiens
  Payload ID: 8151
  Gene Symbol: IGSF9B
  Gene Name: immunoglobulin superfamily, member 9B
  Uniprot ID: Q9UPX0
  ENSP ID: ENSP00000317980
MIWYVATFIASVIGTRGLAAEGAHGLREEPEFVTARAGESVVLRCDVIHPVTGQPPPYVVEWFKFGVPIPIFIKFGYYPPHVDPEYAGRASLHDKASLRLEQVRSEDQGWYECKVLMLDQQYDTFHNGSWVHLTINAPPTFTETPPQYIEAKEGGSITMTCTAFGNPKPIVTWLKEGTLLGASGKYQVSDGSLTVTSVSREDRGAYTCRAYSIQGEAVHTTHLLVQGPPFIVSPPENITVNISQDALLTCRAEAYPGNLTYTWYWQDENVYFQNDLKLRVRILIDGTLIIFRVKPEDSGKYTCVPSNSLGRSPSASAYLTVQYPARVLNMPPVIYVPVGIHGYIRCPVDAEPPATVVKWNKDGRPLQVEKNLGWTLMEDGSIRIEEATEEALGTYTCVPYNTLGTMGQSAPARLVLKDPPYFTVLPGWEYRQEAGRELLIPCAAAGDPFPVITWRKVGKPSRSKHSALPSGSLQFRALSKEDHGEWECVATNVVTSITASTHLTVIGTSPHAPGSVRVQVSMTTANVSWEPGYDGGYEQTFSVWMKRAQFGPHDWLSLPVPPGPSWLLVDTLEPETAYQFSVLAQNKLGTSAFSEVVTVNTLAFPITTPEPLVLVTPPRCLIANRTQQGVLLSWLPPANHSFPIDRYIMEFRVAERWELLDDGIPGTEGEFFAKDLSQDTWYEFRVLAVMQDLISEPSNIAGVSSTDIFPQPDLTEDGLARPVLAGIVATICFLAAAILFSTLAACFVNKQRKRKLKRKKDPPLSITHCRKSLESPLSSGKVSPESIRTLRAPSESSDDQGQPAAKRMLSPTREKELSLYKKTKRAISSKKYSVAKAEAEAEATTPIELISRGPDGRFVMDPAEMEPSLKSRRIEGFPFAEETDMYPEFRQSDEENEDPLVPTSVAALKSQLTPLSSSQESYLPPPAYSPRFQPRGLEGPGGLEGRLQATGQARPPAPRPFHHGQYYGYLSSSSPGEVEPPPFYVPEVGSPLSSVMSSPPLPTEGPFGHPTIPEENGENASNSTLPLTQTPTGGRSPEPWGRPEFPFGGLETPAMMFPHQLPPCDVPESLQPKAGLPRGLPPTSLQVPAAYPGILSLEAPKGWAGKSPGRGPVPAPPAAKWQDRPMQPLVSQGQLRHTSQGMGIPVLPYPEPAEPGAHGGPSTFGLDTRWYEPQPRPRPSPRQARRAEPSLHQVVLQPSRLSPLTQSPLSSRTGSPELAARARPRPGLLQQAEMSEITLQPPAAVSFSRKSTPSTGSPSQSSRSGSPSYRPAMGFTTLATGYPSPPPGPAPAGPGDSLDVFGQTPSPRRTGEELLRPETPPPTLPTSGKLQRDRPAPATSPPERALSKL

SEQ ID NO: 39998 - protein, 206 aa, Homo sapiens
  Payload ID: 8151
  Gene Symbol: IGSF9B
  Gene Name: immunoglobulin superfamily, member 9B
  ENSP ID: ENSP00000434026
SFLCPTWPSPSGAHGLREEPEFVTARAGESVVLRCDVIHPVTGQPPPYVVEWFKFGVPIPIFIKFGYYPPHVDPEYAGRASLHDKASLRLEQVRSEDQGWYECKVLMLDQQYDTFHNGSWVHLTINAPPTFTETPPQYIEAKEGGSITMTCTAFGNPKPIVTWLKEGTLLGASGKYQVSDGSLTVTSVSREDRGAYTCRAYSIQGE

SEQ ID NO: 39999 - protein, 162 aa, Homo sapiens
  Payload ID: 8151
  Gene Symbol: IGSF9B
  Gene Name: immunoglobulin superfamily, member 9B
  ENSP ID: ENSP00000435989
MGPPRGLWRKSPSAPELGGVSAGLTVLSEKVPLSLAFCPLWPLASLLVVCAPEMERGPVTCTQAQTVRGAHGLREEPEFVTARAGESVVLRCDVIHPVTGQPPPYVVEWFKFGVPIPIFIKFGYYPPHVDPEYAGRASLHDKASLRLEQVRSEDQGWYECKV

SEQ ID NO: 40000 - protein, 1437 aa, Homo sapiens
  Payload ID: 8151
  Gene Symbol: IGSF9B
  Gene Name: immunoglobulin superfamily, member 9B
  Uniprot ID: Q9UPX0
  ENSP ID: ENSP00000436552
MIWYVATFIASVIGTRGLAAEGAHGLREEPEFVTARAGESVVLRCDVIHPVTGQPPPYVVEWFKFGVPIPIFIKFGYYPPHVDPEYAGRASLHDKASLRLEQVRSEDQGWYECKVLMLDQQYDTFHNGSWVHLTINAPPTFTETPPQYIEAKEGGSITMTCTAFGNPKPIVTWLKEGTLLGASGKYQVSDGSLTVTSVSREDRGAYTCRAYSIQGEAVHTTHLLVQGPPFIVSPPENITVNISQDALLTCRAEAYPGNLTYTWYWQDENVYFQNDLKLRVRILIDGTLIIFRVKPEDSGKYTCVPSNSLGRSPSASAYLTVQYPARVLNMPPVIYVPVGIHGYIRCPVDAEPPATVVKWNKDGRPLQVEKNLGWTLMEDGSIRIEEATEEALGTYTCVPYNTLGTMGQSAPARLVLKDPPYFTVLPGWEYRQEAGRELLIPCAAAGDPFPVITWRKVGKPSRSKHSALPSGSLQFRALSKEDHGEWECVATNVVTSITASTHLTVIGTSPHAPGSVRVQVSMTTANVSWEPGYDGGYEQTFSVWMKRAQFGPHDWLSLPVPPGPSWLLVDTLEPETAYQFSVLAQNKLGTSAFSEVVTVNTLAFPITTPEPLVLVTPPRCLIANRTQQGVLLSWLPPANHSFPIDRYIMEFRVAERWELLDDGIPGTEGEFFAKDLSQDTWYEFRVLAVMQDLISEPSNIAGVSSTDIFPQPDLTEDGLARPVLAGIVATICFLAAAILFSTLAACFVNKQRKRKLKRKKDPPLSITHCRKSLESPLSSGKVSPESIRTLRAPSESSDDQGQPAAKRMLSPTREKELSLYKKTKRAISSKKYSVAKAEAEAEATTPIELISRGPDGRFVMDPAEMEPSLKSRRIEGFPFAEETDMYPEFRQSDEENEDPLVPTSVAALKSQLTPLSSSQESYLPPPAYSPRFQPRGLEGPGGLEGRLQATGQARPPAPRPFHHGQYYGYLSSSSPGEVEPPPFYVPEVGSPLSSVMSSPPLPTEGPFGHPTIPEENGENASNSTLPLTQTPTGGRSPEPWGRPEFPFGGLETPAMMFPHQLPPCDVPESLQPKAGLPRGLPPTSLQVPAAYPGILSLEAPKGWAGKSPGRGPVPAPPAAKWQDRPMQPLVSQGQLRHTSQGMGIPVLPYPEPAEPGAHGGPSTFGLDTRWYEPQPRPRPSPRQARRAEPSLHQVVLQPSRLSPLTQSPLSSRTGSPELAARARPRPGLLQQAEMSEITLQPPAAVSFSRKSTPSTGSPSQSSRSGSPSYRPAMGFTTLATGYPSPPPGPAPAGPGDSLDVFGQTPSPRRTGEELLRPETPPPTLPTSGTLPPAPGNAAAPERLEALKYQRIKKPKKSSKGSSKSKKRSDDSASQTQQLPNSQVLWPDEAVCLRKKKRHSRPDPFARLSDLCHRQLPEDQTAILNSVDHDDPGHATLL

SEQ ID NO: 40001 - protein, 1251 aa, Homo sapiens
  Payload ID: 8152
  Gene Symbol: IGFN1
  Gene Name: immunoglobulin-like and fibronectin type III domain containing 1
  Uniprot ID: Q86VF2
  ENSP ID: ENSP00000295591
MAGKLRKSHIPGVSIWQLVEEIPEGCSTPDFEQKPVTSALPEGKNAVFRAVVCGEPRPEVRWQNSKGDLSDSSKYKISSSPGSKEHVLQINKLTGEDTDLYRCTAVNAYGEAACSVRLTVIEVGFRKNRKRHREPQEDLRKELMDFRKLLKKRAPPAPKKKMDLEQIWQLLMTADRKDYEKICLKYGIVDYRGMLRRLQEMKKEQEDKMAQYINTISSLRHIRVTKDGNAKFDLELDLKDSQSKIYLYKDGEMIPYGFNNQTKHCLRRLGKRYEFQIQDLRPEDSGIYQVKVEDAVVFSTELEASAIPPRVVVPLAETHCEEQGDAVFECTLSSPCPSAAWHFRHRLLHPSDKYEVYVSPDGLTHRLVVRGARFSDMGPYSLGTGLYTSSAWLVVEAGKDKDLQSTSADHKLQSRRSGKDGRLDIYGERRDATRSSTSRYKPGTGSFSKDAQGPMGHFSQGLADMEVQPGEAATLSCTLTSDLGPGTWFKDGVKLTTQDGVIFKQDGLVHSLFITHVQGTQAGRYTFVAGDQQSEATLTVQDSPTIAPDVTEKLREPLVVKAGKPVIVKIPFQSHLPIQAAWRKDGAEVVGSSDREAQVDLGDGYTRLCLPSAGRKDCGQYSVTLRSEGGSVQAELTLQVIDKPDPPQGPMEVQDCHRAGVCLRWRPPRDNGGRTVECYVVERRQAGRSTWLKVGEAPADSTTFTDAHVEPGRKYTFRVRAVTSEGAGEALESEEILVAPEALPKAPSAPAILSASSQGITLTWTAPRGPGSAHILGYLIERRKKGSNTWTAVNDQPVPERRWTVADVRQGCQYEFRVTAVAPSGPGEPGPPSDAVFARDPMRPPGLVRNLQVTDRSNTSITLSWAGPDTQEGDEAQGYVVELCSSDSLQWLPCHVGTVPVTTYTAKGLRPGEGYFVRVTAVNEGGQSQPSALDTLVQAMPVTVCPKFLVDSSTKDLLTVKVGDTVRVPVSFEAMPMPEVTWLKDGLPLPKRSVTVTKDGLTQLLIPVAGLSDSGLYTVVLRTLQGKEVAHSFRIRVAACPQAPGPIHLQENVPGTVTAEWEPSPDEAQDVPLHYAVFTRSSAHGPWHEAADRIHTNRFTLLGILPGHEYHFRVVAKNELGASKPSDTSQPWCIPRQRDRFTVKAPCYREPDLSQKPRFLVGLRSHLLPQGCECCMSCAVQGSPRPHVTWFKNDRSLEGNPAVYSTDLLGVCSLTIPSVSPKDSGEYKAVAENTLGQAVSTATLIVIEPST

SEQ ID NO: 40002 - protein, 3708 aa, Homo sapiens
  Payload ID: 8152
  Gene Symbol: IGFN1
  Gene Name: immunoglobulin-like and fibronectin type III domain containing 1
  Uniprot ID: Q86VF2
  ENSP ID: ENSP00000334714
MAGKLRKSHIPGVSIWQLVEEIPEGCSTPDFEQKPVTSALPEGKNAVFRAVVCGEPRPEVRWQNSKGDLSDSSKYKISSSPGSKEHVLQINKLTGEDTDLYRCTAVNAYGEAACSVRLTVIEVGFRKNRKRHREPQEDLRKELMDFRKLLKKRAPPAPKKKMDLEQIWQLLMTADRKDYEKICLKYGIVDYRGMLRRLQEMKKEQEDKMAQYINTISSLRHIRVTKDGNAKFDLELDLKDSQSKIYLYKDGEMIPYGFNNQTKHCLRRLGKRYEFQIQDLRPEDSGIYQVKVEDAVVFSTELEASAIPPRVVVPLAETHCEEQGDAVFECTLSSPCPSAAWHFRHRLLHPSDKYEVYVSPDGLTHRLVVRGARFSDMGPYSLGTGLYTSSAWLVVEAGKDKDLQSTSADHKLQRQGAQASGAEESGSIESQGEKSREQGPRGGSLEGAGPASGLQHIASPDRDGLGRHGYSLMGDKGTADSAWGPGQEGEGFPVAEGSRATLPRENQSHREGGWARSLAERPHLQGESSESGLGLPEKQQQDRGRDSNSDECWRKAGGWEAGSSRLQAGGLGSSREGKEHRGDSGRQLDRHAPEQLWDARLGPGRGKSDLQGCQSDPVGSWPRGKQIEISQDDSLAEMDRGDAPSRERGRGIVVWGGGTGLGEAGDSNGAGGPGTLELTGGRGSGSKVGMAPESWGSQGGRDADYGEARGYWGSGELLEQIPGGKDFQEPSISGGRKFLLGDGSPEIKAEDSLQEADGICRGESVVTGSAYKTGPGGPGDPRGCEGVLQELRGRDGQETAWASGEVEYDPRSFQSSQGWTAGHRAAGGIGRIESKGTSPWDDTPSSLRKTGAHHGPGVLGPSGGQEGMGGIWVAGLTESGQGVDARSHWLSRAPGLGAQGSGGTLGDKKGLRGPGSIGSEPDFWNGSGSSRVKGPRGETGYKDGLEGPGRMESRYEGGLGYSREISSKSGAGYSYGSGVPGEMGSGHGAGCRVSPRAPAGVESEEGGGYRHGSGAPGGVWSGNEDSGPAGGGSGRVASLKNGSGGPDGAPMNDTRNWASACQAGMDPRGGHHSDGGLGSPGVTGSAGRGGLKAPGVVETVGMGCVEAEPESSGRIRPWGQTGNYGGFRASEALGAFGEGGYEDGSGGPGAMGPGSLRAGSKVGEGDGTRCPGAKASGAGAGYRDDTRHPESLAPHNGAASGSQWAYGAGNVLGYEDGSELPGPQGTGVRTAYGERSRGLGPRSTGPGGEAGFRDGSGGLQGMGSADGPGCRKGIGSSGEMGSVDKEGYKKDLGAPENMGSGSKADYRDGVGGSGAMGSMDEAGYRKDLGAPEGISSGSKADYRGGLQDSREAGSGSKADYSGGLKGSREIGSMDETDNRKDLGVPEGMGAGYRAGLRGPGEMGSLDESGHRNGIGGYGEMGSGYREDLGAPEGMGTGSKAGYRDGLRGSGEMRSMDEAGYRKNLGAPERMDSGSKAGYRGGLRGSGEMGLIEAGYRKDLGVSEGGGSGSKAGYRGGLGSGEMGSVDKAGYRKDLGASEAIGSGSKAGFTDGLGGSEEMGSVNKAGYRKDLGAPKGMGSGSKASFRDGLGGSGEMGSVNEAGYRKDLGVPEGIGSGSKAGFRDGLGGSEEMGSVNKAGYRKDLGAPKGIGSGSKAGFRDGLGSSGEMGSMDEAGYRKNLGAPEGIGSGSKAGFRDGLGSSVEMGSVNEAGYRKDLGAPEGMGSGSKAGFRDGLGGSGEMGSVNEAGYRKDLGAPKGIGSGSKADFRDALGSSGEMGSMDEAGYRKDLWAPEGIGSGSKAGFRDGLGSSVEMGSVNEAGYRKDLGAPEGMGSGSKAGFRDGLGGSGEMGSVNEAGYRKDLGAPKGIGSGSKADFRDALGSSGEMGSMDEAGYRKDLWAPEGIGSGSKAGFRDGLGSSVEMGSVNEAGYRKDLGAPEGMGSGSKEGFRDGLGGSEEMGSVNKAGYRKDLGAPKGMGSGSKEGFRDGLGGSEEMGSMDEAGYRKDLGAPEGIGSGSKAGFRDGLGGSEEMRSMDEAGYRKDLGAPERIGSGSKAGFRDGLGSSVEMGSVNEAGYRKDLGAPKGMGSGSKTGFRDGLGGSEEMESMDEAGYRKDLGAPEGIGSGSKAGFRDGLGSSTEMGSVNEAGYRKDLGAPKGMGSESKAGFRDGLGSSGEMGSMDEAGYRKDLGAPEGMGSGSKAGFRDGLGGSEEMGSVNKAGYRKDLGAPKGMGSGSKAGFRDGLGSSGEMGSMDEADYRKDLGAPEEMGSGSYTDYRNGLGSSGKISSGDEAGYKNVLGGSGRNPLGSEAGSRGSLEDSGYILSWNEAGSRQGFGGTSGMGSGSEVSYRGGSGGSGETGPEGKMGYGDGSGRLGVPGSLAGIGHEAGPRGHKAMGHRSGYWVASEGDTNSKDGPERARETRLVDGAGPGVEPGMAGMPGTAGGMAHRDSLRGTGVLGSQGGRQTLSDERGSTKDLGGYGTSGIPEASEAAGAKGKPDVKEWQDSSGTPGSSRDRGAPRVKDRSPDQAGIMGASGFLDGKGAVEGETWAGMAALGSGYERDIWKAGPGMTDRGRVAGQGGLASQGGGDSLLGGRRVGSGSSVGTGQDLDSGSMPGGRGKSTSGPADRQGTSNAWAPDWENQGFSQGSIDAGKQPAGSRASGSLQEKDAAFGGTHEGPGGFKGGEGAPGQEAAGGCRSPWSLDSKGSSPGRGSSVDAEDSGILGKGNSTEWGNALTPKPGESGPQGAWNGLDGPFGRKASRDRSGGTQDLSSQRGKGQRGGKRSLGEQGSLEAENGEVQGPGALKEDEGQGVEEAGRSGRRPGSLRSRSQAQSGAEVGGGKRRGADEAGSMGWQPMGENWGCLEEMLNEDQSREPPGHLGSRRSGKDGRLDIYGERRDATRSSTSRYKPGTGSFSKDAQGPMGHFSQGLADMEVQPGEAATLSCTLTSDLGPGTWFKDGVKLTTQDGVIFKQDGLVHSLFITHVQGTQAGRYTFVAGDQQSEATLTVQDSPTIAPDVTEKLREPLVVKAGKPVIVKIPFQSHLPIQAAWRKDGAEVVGSSDREAQVDLGDGYTRLCLPSAGRKDCGQYSVTLRSEGGSVQAELTLQVIDKPDPPQGPMEVQDCHRAGVCLRWRPPRDNGGRTVECYVVERRQAGRSTWLKVGEAPADSTTFTDAHVEPGRKYTFRVRAVTSEGAGEALESEEILVAPEALPKAPSAPAILSASSQGITLTWTAPRGPGSAHILGYLIERRKKGSNTWTAVNDQPVPERRWTVADVRQGCQYEFRVTAVAPSGPGEPGPPSDAVFARDPMRPPGLVRNLQVTDRSNTSITLSWAGPDTQEGDEAQGYVVELCSSDSLQWLPCHVGTVPVTTYTAKGLRPGEGYFVRVTAVNEGGQSQPSALDTLVQAMPVTVCPKFLVDSSTKDLLTVKVGDTVRVPVSFEAMPMPEVTWLKDGLPLPKRSVTVTKDGLTQLLIPVAGLSDSGLYTVVLRTLQGKEVAHSFRIRVAACPQAPGPIHLQENVPGTVTAEWEPSPDEAQDVPLHYAVFTRSSAHGPWHEAADRIHTNRFTLLGILPGHEYHFRVVAKNELGASKPSDTSQPWCIPRQRDRFTVKAPCYREPDLSQKPRFLVGLRSHLLPQGCECCMSCAVQGSPRPHVTWFKNDRSLEGNPAVYSTDLLGVCSLTIPSVSPKDSGEYKAVAENTLGQAVSTATLIVIEPST

SEQ ID NO: 40003 - protein, 1126 aa, Homo sapiens
  Payload ID: 8152
  Gene Symbol: IGFN1
  Gene Name: immunoglobulin-like and fibronectin type III domain containing 1
  ENSP ID: ENSP00000387975
  MOD_RES (1)..(1): Any amino acid
XGRRVGSGSSVGTGQDLDSGSMPGGRGKSTSGPADRQGTSNAWAPDWENQGFSQGSIDAGKQPAGSRASGSLQEKDAAFGGTHEGPGGFKGGEGAPGQEAAGGCRSPWSLDSKGSSPGRGSSVDAEDSGILGKGNSTEWGNALTPKPGESGPQGAWNGLDGPFGRKASRDRSGGTQDLSSQRGKGQRGGKRSLGEQGSLEAENGEVQGPGALKEDEGQGVEEAGRSGRRPGSLRSRSQAQSGAEVGGGKRRGADEAGSMGWQPMGENWGCLEEMLNEDQSREPPGHLGSRRSGKDGRLDIYGERRDATRSSTSRYKPGTGSFSKDAQGPMGHFSQGLADMEVQPGEAATLSCTLTSDLGPGTWFKDGVKLTTQDGVIFKQDGLVHSLFITHVQGTQAGRYTFVAGDQQSEATLTVQDSPTIAPDVTEKLREPLVVKAGKPVIVKIPFQSHLPIQAAWRKDGAEVVGSSDREAQVDLGDGYTRLCLPSAGRKDCGQYSVTLRSEGGSVQAELTLQVIDKPDPPQGPMEVQDCHRAGVCLRWRPPRDNGGRTVECYVVERRQAGRSTWLKVGEAPADSTTFTDAHVEPGRKYTFRVRAVTSEGAGEALESEEILVAPEALPKAPSAPAILSASSQGITLTWTAPRGPGSAHILGYLIERRKKGSNTWTAVNDQPVPERRWTVADVRQGCQYEFRVTAVAPSGPGEPGPPSDAVFARDPMRPPGLVRNLQVTDRSNTSITLSWAGPDTQEGDEAQGYVVELCSSDSLQWLPCHVGTVPVTTYTAKGLRPGEGYFVRVTAVNEGGQSQPSALDTLVQAMPVTVCPKFLVDSSTKDLLTVKVGDTVRVPVSFEAMPMPEVTWLKDGLPLPKRSVTVTKDGLTQLLIPVAGLSDSGLYTVVLRTLQGKEVAHSFRIRVAACPQAPGPIHLQENVPGTVTAEWEPSPDEAQDVPLHYAVFTRSSAHGPWHEAADRIHTNRFTLLGILPGHEYHFRVVAKNELGASKPSDTSQPWCIPRQRDRFTVKAPCYREPDLSQKPRFLVGLRSHLLPQGCECCMSCAVQGSPRPHVTWFKNDRSLEGNPAVYSTDLLGVCSLTIPSVSPKDSGEYKAVAENTLGQAVSTATLIVIEPST

SEQ ID NO: 40004 - protein, 570 aa, Homo sapiens
  Payload ID: 8152
  Gene Symbol: IGFN1
  Gene Name: immunoglobulin-like and fibronectin type III domain containing 1
  Uniprot ID: Q86VF2
  ENSP ID: ENSP00000399041
MAGKLRKSHIPGVSIWQLVEEIPEGCSTPDFEQKPVTSALPEGKNAVFRAVVCGEPRPEVRWQNSKGDLSDSSKYKISSSPGSKEHVLQINKLTGEDTDLYRCTAVNAYGEAACSVRLTVIEVGFRKNRKRHREPQEDLRKELMDFRKLLKKRAPPAPKKKMDLEQIWQLLMTADRKDYEKICLKYGIVDYRGMLRRLQEMKKEQEDKMAQYINTISSLRHIRVTKDGNAKFDLELDLKDSQSKIYLYKDGEMIPYGFNNQTKHCLRRLGKRYEFQIQDLRPEDSGIYQVKVEDAVVFSTELEASAIPPRVVVPLAETHCEEQGDAVFECTLSSPCPSAAWHFRHRLLHPSDKYEVYVSPDGLTHRLVVRGARFSDMGPYSLGTGLYTSSAWLVVEAGKDKDLQSTSADHKLQSRRSGKDGRLDIYGERRDATRSSTSRYKPGTGSFSKDAQGPMGHFSQGLADMEVQPGEAATLSCTLTSDLGPGTWFKDGVKLTTQDGVIFKQDGLVHSLFITHVQGTQAGRYTFVAGDQQSEATLTVQDSPTIAPDVTEKLREPLVVKAGKPIQTYH

SEQ ID NO: 40005 - protein, 502 aa, Homo sapiens
  Payload ID: 8153
  Gene Symbol: ILDR1
  Gene Name: immunoglobulin-like domain containing receptor 1
  Uniprot ID: Q86SU0
  ENSP ID: ENSP00000273691
MAWPKLPAPWLLLCTWLPAGCLSLLVTVQHTERYVTLFASIILKCDYTTSAQLQDVVVTWRFKSFCKDPIFDYYSASYQAALSLGQDPSNDCNDNQREVRIVAQRRGQNEPVLGVDYRQRKITIQNRADLVINEVMWWDHGVYYCTIEAPGDTSGDPDKEVKLIVLHWLTVIFIILGALLLLLLIGVCWCQCCPQYCCCYIRCPCCPAHCCCPEEDLSLPSSLPQMPMTQTTNQPPIANGVLEYLEKELRNLNLAQPLPPDLKGRFGHPCSMLSSLGSEVVERRIIHLPPLIRDLSSSRRTSDSLHQQWLTPIPSRPWDLREGRSHHHYPDFHQELQDRGPKSWALERRELDPSWSGRHRSSRLNGSPIHWSDRDSLSDVPSSSEARWRPSHPPFRSRCQERPRRPSPRESTQRHGRRRRHRSYSPPLPSGLSSWSSEEDKERQPQSWRAHRRGSHSPHWPEEKPPSYRSLDITPGKNSRKKGSVERRSEKDSSHSGRSVVI

SEQ ID NO: 40006 - protein, 546 aa, Homo sapiens
  Payload ID: 8153
  Gene Symbol: ILDR1
  Gene Name: immunoglobulin-like domain containing receptor 1
  Uniprot ID: Q86SU0
  ENSP ID: ENSP00000345667
MAWPKLPAPWLLLCTWLPAGCLSLLVTVQHTERYVTLFASIILKCDYTTSAQLQDVVVTWRFKSFCKDPIFDYYSASYQAALSLGQDPSNDCNDNQREVRIVAQRRGQNEPVLGVDYRQRKITIQNRADLVINEVMWWDHGVYYCTIEAPGDTSGDPDKEVKLIVLHWLTVIFIILGALLLLLLIGVCWCQCCPQYCCCYIRCPCCPAHCCCPEEALARHRYMKQAQALGPQMMGKPLYWGADRSSQVSSYPMHPLLQRDLSLPSSLPQMPMTQTTNQPPIANGVLEYLEKELRNLNLAQPLPPDLKGRFGHPCSMLSSLGSEVVERRIIHLPPLIRDLSSSRRTSDSLHQQWLTPIPSRPWDLREGRSHHHYPDFHQELQDRGPKSWALERRELDPSWSGRHRSSRLNGSPIHWSDRDSLSDVPSSSEARWRPSHPPFRSRCQERPRRPSPRESTQRHGRRRRHRSYSPPLPSGLSSWSSEEDKERQPQSWRAHRRGSHSPHWPEEKPPSYRSLDITPGKNSRKKGSVERRSEKDSSHSGRSVVI

SEQ ID NO: 40007 - protein, 457 aa, Homo sapiens
  Payload ID: 8153
  Gene Symbol: ILDR1
  Gene Name: immunoglobulin-like domain containing receptor 1
  Uniprot ID: Q86SU0
  ENSP ID: ENSP00000377251
MAWPKLPAPWLLLCTWLPAGCLSLLVTVQHTERYVTLFASIILKCDYTTSAQLQDVVVTWRFKSFCKDPIFDYYSASYQAALSLGQDPSNDCNDNQREVRIVAQRRGQNEPVLGVDYRQRKITIQNPLARHRYMKQAQALGPQMMGKPLYWGADRSSQVSSYPMHPLLQRDLSLPSSLPQMPMTQTTNQPPIANGVLEYLEKELRNLNLAQPLPPDLKGRFGHPCSMLSSLGSEVVERRIIHLPPLIRDLSSSRRTSDSLHQQWLTPIPSRPWDLREGRSHHHYPDFHQELQDRGPKSWALERRELDPSWSGRHRSSRLNGSPIHWSDRDSLSDVPSSSEARWRPSHPPFRSRCQERPRRPSPRESTQRHGRRRRHRSYSPPLPSGLSSWSSEEDKERQPQSWRAHRRGSHSPHWPEEKPPSYRSLDITPGKNSRKKGSVERRSEKDSSHSGRSVVI

SEQ ID NO: 40008 - protein, 514 aa, Homo sapiens
  Payload ID: 8153
  Gene Symbol: ILDR1
  Gene Name: immunoglobulin-like domain containing receptor 1
  Uniprot ID: Q86SU0
  ENSP ID: ENSP00000419414
MAGNIFCPFALFFLPMSRVGHLQHFLLLLALGCLSLLVTVQHTERYVTLFASIILKCDYTTSAQLQDVVVTWRFKSFCKDPIFDYYSASYQAALSLGQDPSNDCNDNQREVRIVAQRRGQNEPVLGVDYRQRKITIQNRADLVINEVMWWDHGVYYCTIEAPGDTSGDPDKEVKLIVLHWLTVIFIILGALLLLLLIGVCWCQCCPQYCCCYIRCPCCPAHCCCPEEDLSLPSSLPQMPMTQTTNQPPIANGVLEYLEKELRNLNLAQPLPPDLKGRFGHPCSMLSSLGSEVVERRIIHLPPLIRDLSSSRRTSDSLHQQWLTPIPSRPWDLREGRSHHHYPDFHQELQDRGPKSWALERRELDPSWSGRHRSSRLNGSPIHWSDRDSLSDVPSSSEARWRPSHPPFRSRCQERPRRPSPRESTQRHGRRRRHRSYSPPLPSGLSSWSSEEDKERQPQSWRAHRRGSHSPHWPEEKPPSYRSLDITPGKNSRKKGSVERRSEKDSSHSGRSVVI

SEQ ID NO: 40009 - protein, 639 aa, Homo sapiens
  Payload ID: 8154
  Gene Symbol: ILDR2
  Gene Name: immunoglobulin-like domain containing receptor 2
  Uniprot ID: Q71H61
  ENSP ID: ENSP00000271417
MDRVLLRWISLFWLTAMVEGLQVTVPDKKKVAMLFQPTVLRCHFSTSSHQPAVVQWKFKSYCQDRMGESLGMSSTRAQSLSKRNLEWDPYLDCLDSRRTVRVVASKQGSTVTLGDFYRGREITIVHDADLQIGKLMWGDSGLYYCIITTPDDLEGKNEDSVELLVLGRTGLLADLLPSFAVEIMPEWVFVGLVLLGVFLFFVLVGICWCQCCPHSCCCYVRCPCCPDSCCCPQALYEAGKAAKAGYPPSVSGVPGPYSIPSVPLGGAPSSGMLMDKPHPPPLAPSDSTGGSHSVRKGYRIQADKERDSMKVLYYVEKELAQFDPARRMRGRYNNTISELSSLHEEDSNFRQSFHQMRSKQFPVSGDLESNPDYWSGVMGGSSGASRGPSAMEYNKEDRESFRHSQPRSKSEMLSRKNFATGVPAVSMDELAAFADSYGQRPRRADGNSHEARGGSRFERSESRAHSGFYQDDSLEEYYGQRSRSREPLTDADRGWAFSPARRRPAEDAHLPRLVSRTPGTAPKYDHSYLGSARERQARPEGASRGGSLETPSKRSAQLGPRSASYYAWSPPGTYKAGSSQDDQEDASDDALPPYSELELTRGPSYRGRDLPYHSNSEKKRKKEPAKKTNDFPTRMSLVV

SEQ ID NO: 40010 - protein, 167 aa, Homo sapiens
  Payload ID: 8154
  Gene Symbol: ILDR2
  Gene Name: immunoglobulin-like domain containing receptor 2
  ENSP ID: ENSP00000431316
MDRVLLRWISLFWLTAMVEGLQVTVPDKKKVAMLFQPTVLRCHFSTSSHQPAVVQWKFKSYCQDRMGESLGMSSTRAQSLSKRNLEWDPYLDCLDSRRTVRVVASKQGSTVTLGDFYRGREITIVHDADLQIGKLMWGDSGLYYCIITTPDDLEGKNEDSVELLVLE

SEQ ID NO: 40011 - protein, 580 aa, Homo sapiens
  Payload ID: 8154
  Gene Symbol: ILDR2
  Gene Name: immunoglobulin-like domain containing receptor 2
  ENSP ID: ENSP00000432750
MDRVLLRWISLFWLTAMVEGLQVTVPDKKKVAMLFQPTVLRCHFSTSSHQPAVVQWKFKSYCQDRMGESLGMSSTRAQSLSKRNLEWDPYLDCLDSRRTVRVVASKQGSTVTLGDFYRGREITIVHDADLQIGKLMWGDSGLYYCIITTPDDLEGKNEDSVELLVLGRTGLLADLLPSFAVEIMPEWVFVGLVLLGVFLFFVLVGICWCQCCPHSCCCYVRCPCCPDSCCCPQAFRKGYRIQADKERDSMKVLYYVEKELAQFDPARRMRGRYNNTISELSSLHEEDSNFRQSFHQMRSKQFPVSGDLESNPDYWSGVMGGSSGASRGPSAMEYNKEDRESFRHSQPRSKSEMLSRKNFATGVPAVSMDELAAFADSYGQRPRRADGNSHEARGGSRFERSESRAHSGFYQDDSLEEYYGQRSRSREPLTDADRGWAFSPARRRPAEDAHLPRLVSRTPGTAPKYDHSYLGSARERQARPEGASRGGSLETPSKRSAQLGPRSASYYAWSPPGTYKAGSSQDDQEDASDDALPPYSELELTRGPSYRGRDLPYHSNSEKKRKKEPAKKTNDFPTRMSLVV

SEQ ID NO: 40012 - protein, 531 aa, Homo sapiens
  Payload ID: 8154
  Gene Symbol: ILDR2
  Gene Name: immunoglobulin-like domain containing receptor 2
  ENSP ID: ENSP00000434273
MDRVLLRWISLFWLTAMVEGLQVTVPDKKKVAMLFQPTVLRCHFSTSSHQPAVVQWKFKSYCQDRMGESLGMSSTRAQSLSKRNLEWDPYLDCLDSRRTVRVVASKQGSTVTLGDFYRGREITIVHDADLQIGKLMWGDSGLYYCIITTPDDLEGKNEDSVELLVLGRTGLLADLLPSFAVEIMPVRKGYRIQADKERDSMKVLYYVEKELAQFDPARRMRGRYNNTISELSSLHEEDSNFRQSFHQMRSKQFPVSGDLESNPDYWSGVMGGSSGASRGPSAMEYNKEDRESFRHSQPRSKSEMLSRKNFATGVPAVSMDELAAFADSYGQRPRRADGNSHEARGGSRFERSESRAHSGFYQDDSLEEYYGQRSRSREPLTDADRGWAFSPARRRPAEDAHLPRLVSRTPGTAPKYDHSYLGSARERQARPEGASRGGSLETPSKRSAQLGPRSASYYAWSPPGTYKAGSSQDDQEDASDDALPPYSELELTRGPSYRGRDLPYHSNSEKKRKKEPAKKTNDFPTRMSLVV

SEQ ID NO: 40013 - protein, 512 aa, Homo sapiens
  Payload ID: 8154
  Gene Symbol: ILDR2
  Gene Name: immunoglobulin-like domain containing receptor 2
  ENSP ID: ENSP00000436120
MDRVLLRWISLFWLTAMVEGLQVTVPDKKKVAMLFQPTVLRCHFSTSSHQPAVVQWKFKSYCQDRMGESLGMSSTRAQSLSKRNLEWDPYLDCLDSRRTVRVVASKQGSTVTLGDFYRGREITIVHDADLQIGKLMWGDSGLYYCIITTPDDLEGKNEDSVELLVLVRKGYRIQADKERDSMKVLYYVEKELAQFDPARRMRGRYNNTISELSSLHEEDSNFRQSFHQMRSKQFPVSGDLESNPDYWSGVMGGSSGASRGPSAMEYNKEDRESFRHSQPRSKSEMLSRKNFATGVPAVSMDELAAFADSYGQRPRRADGNSHEARGGSRFERSESRAHSGFYQDDSLEEYYGQRSRSREPLTDADRGWAFSPARRRPAEDAHLPRLVSRTPGTAPKYDHSYLGSARERQARPEGASRGGSLETPSKRSAQLGPRSASYYAWSPPGTYKAGSSQDDQEDASDDALPPYSELELTRGPSYRGRDLPYHSNSEKKRKKEPAKKTNDFPTRMSLVV

SEQ ID NO: 40014 - protein, 620 aa, Homo sapiens
  Payload ID: 8154
  Gene Symbol: ILDR2
  Gene Name: immunoglobulin-like domain containing receptor 2
  ENSP ID: ENSP00000436882
MDRVLLRWISLFWLTAMVEGLQVTVPDKKKVAMLFQPTVLRCHFSTSSHQPAVVQWKFKSYCQDRMGESLGMSSTRAQSLSKRNLEWDPYLDCLDSRRTVRVVASKQGSTVTLGDFYRGREITIVHDADLQIGKLMWGDSGLYYCIITTPDDLEGKNEDSVELLVLEWVFVGLVLLGVFLFFVLVGICWCQCCPHSCCCYVRCPCCPDSCCCPQALYEAGKAAKAGYPPSVSGVPGPYSIPSVPLGGAPSSGMLMDKPHPPPLAPSDSTGGSHSVRKGYRIQADKERDSMKVLYYVEKELAQFDPARRMRGRYNNTISELSSLHEEDSNFRQSFHQMRSKQFPVSGDLESNPDYWSGVMGGSSGASRGPSAMEYNKEDRESFRHSQPRSKSEMLSRKNFATGVPAVSMDELAAFADSYGQRPRRADGNSHEARGGSRFERSESRAHSGFYQDDSLEEYYGQRSRSREPLTDADRGWAFSPARRRPAEDAHLPRLVSRTPGTAPKYDHSYLGSARERQARPEGASRGGSLETPSKRSAQLGPRSASYYAWSPPGTYKAGSSQDDQEDASDDALPPYSELELTRGPSYRGRDLPYHSNSEKKRKKEPAKKTNDFPTRMSLVV

SEQ ID NO: 40015 - protein, 437 aa, Homo sapiens
  Payload ID: 8154
  Gene Symbol: ILDR2
  Gene Name: immunoglobulin-like domain containing receptor 2
  ENSP ID: ENSP00000437008
MDRVLLRWISLFWLTAMVEGLQVTVPDKKKVAMLFQPTVLRCHFSTSSHQPAVVQWKFKSYCQDRMGESLGMSSTRAQSLSKRNLEWDPYLDCLDSRRTVRVVASKQGSTVTLGDFYRGREITIVHDADLQIGKLMWGDSGLYYCIITTPDDLEGKNEDSVELLVLGRTGLLADLLPSFAVEIMPEWVFVGLVLLGVFLFFVLVGICWCQCCPHSCCCYVRCPCCPDSCCCPQALYEAGKAAKAGYPPSVSGVPGPYSIPSVPLGGAPSSGMLMDKPHPPPLAPSDSTGGSHSVRKGYRIQADKERDSMKVLYYVEKELAQFDPARRMRGRYNNTISELSSLHEEDSNFRQSFHQMRSKQFPVSGDLESNPDYWSGVMGGSSGASRGPSAMEYNKEDRESFRHRMTFQPGCPLWSDVVNISLDNEKSDMDYGDKTQI

SEQ ID NO: 40016 - protein, 481 aa, Homo sapiens
  Payload ID: 8155
  Gene Symbol: IRG1
  Gene Name: immunoresponsive 1 homolog (mouse)
  Uniprot ID: A6NK06
  ENSP ID: ENSP00000366682
MMLKSITESFATAIHGLKVGHLTDRVIQRSKRMILDTLGAGFLGTTTEVFHIASQYSKIYSSNISSTVWGQPDIRLPPTYAAFVNGVAIHSMDFDDTWHPATHPSGAVLPVLTALAEALPRSPKFSGLDLLLAFNVGIEVQGRLLHFAKEANDMPKRFHPPSVVGTLGSAAAASKFLGLSSTKCREALAIAVSHAGAPMANAATQTKPLHIGNAAKHGIEAAFLAMLGLQGNKQVLDLEAGFGAFYANYSPKVLPSIASYSWLLDQQDVAFKRFPAHLSTHWVADAAASVRKHLVAERALLPTDYIKRIVLRIPNVQYVNRPFPVSEHEARHSFQYVACAMLLDGGITVPSFHECQINRPQVRELLSKVELEYPPDNLPSFNILYCEISVTLKDGATFTDRSDTFYGHWRKPLSQEDLEEKFRANASKMLSWDTVESLIKIVKNLEDLEDCSVLTTLLKGPSPPEVASNSPACNNSITNLS

SEQ ID NO: 40017 - protein, 481 aa, Homo sapiens
  Payload ID: 8155
  Gene Symbol: IRG1
  Gene Name: immunoresponsive 1 homolog (mouse)
  ENSP ID: ENSP00000401584
FPLKSITESFATAIHGLKVGHLTDRVIQRSKRMILDTLGAGFLGTTTEVFHIASQYSKIYSSNISSTVWGQPDIRLPPTYAAFVNGVAIHSMDFDDTWHPATHPSGAVLPVLTALAEALPRSPKFSGLDLLLAFNVGIEVQGRLLHFAKEANDMPKRFHPPSVVGTLGSAAAASKFLGLSSTKCREALAIAVSHAGAPMANAATQTKPLHIGNAAKHGIEAAFLAMLGLQGNKQVLDLEAGFGAFYANYSPKVLPSIASYSWLLDQQDVAFKRFPAHLSTHWVADAAASVRKHLVAERALLPTDYIKRIVLRIPNVQYVNRPFPVSEHEARHSFQYVACAMLLDGGITVPSFHECQINRPQVRELLSKVELEYPPDNLPSFNILYCEISVTLKDGATFTDRSDTFYGHWRKPLSQEDLEEKFRANASKMLSWDTVESLIKIVKNLEDLEDCSVLTTLLKGPSPPEVASNSPACNNSITNLS

SEQ ID NO: 40018 - protein, 563 aa, Homo sapiens
  Payload ID: 8156
  Gene Symbol: IMPDH1
  Gene Name: IMP (inosine 5'-monophosphate) dehydrogenase 1
  Uniprot ID: P20839
  ENSP ID: ENSP00000265385
MEGPLTPPPLQGGGAAAVPEPGARQHPGHETAAQRYSARLLQAGYEPESMADYLISGGTGYVPEDGLTAQQLFASADGLTYNDFLILPGFIDFIADEVDLTSALTRKITLKTPLISSPMDTVTEADMAIAMALMGGIGFIHHNCTPEFQANEVRKVKKFEQGFITDPVVLSPSHTVGDVLEAKMRHGFSGIPITETGTMGSKLVGIVTSRDIDFLAEKDHTTLLSEVMTPRIELVVAPAGVTLKEANEILQRSKKGKLPIVNDCDELVAIIARTDLKKNRDYPLASKDSQKQLLCGAAVGTREDDKYRLDLLTQAGVDVIVLDSSQGNSVYQIAMVHYIKQKYPHLQVIGGNVVTAAQAKNLIDAGVDGLRVGMGCGSICITQEVMACGRPQGTAVYKVAEYARRFGVPIIADGGIQTVGHVVKALALGASTVMMGSLLAATTEAPGEYFFSDGVRLKKYRGMGSLDAMEKSSSSQKRYFSEGDKVKIAQGVSGSIQDKGSIQKFVPYLIAGIQHGCQDIGARSLSVLRSMMYSGELKFEKRTMSAQIEGGVHGLHSYEKRLY

SEQ ID NO: 40019 - protein, 599 aa, Homo sapiens
  Payload ID: 8156
  Gene Symbol: IMPDH1
  Gene Name: IMP (inosine 5'-monophosphate) dehydrogenase 1
  Uniprot ID: P20839
  ENSP ID: ENSP00000345096
MEGPLTPPPLQGGGAAAVPEPGARQHPGHETAAQRYSARLLQAGYEPESPRLDLATHPTTPRSELSSVVLLAGVGVQMDRLRRASMADYLISGGTGYVPEDGLTAQQLFASADGLTYNDFLILPGFIDFIADEVDLTSALTRKITLKTPLISSPMDTVTEADMAIAMALMGGIGFIHHNCTPEFQANEVRKVKKFEQGFITDPVVLSPSHTVGDVLEAKMRHGFSGIPITETGTMGSKLVGIVTSRDIDFLAEKDHTTLLSEVMTPRIELVVAPAGVTLKEANEILQRSKKGKLPIVNDCDELVAIIARTDLKKNRDYPLASKDSQKQLLCGAAVGTREDDKYRLDLLTQAGVDVIVLDSSQGNSVYQIAMVHYIKQKYPHLQVIGGNVVTAAQAKNLIDAGVDGLRVGMGCGSICITQEVMACGRPQGTAVYKVAEYARRFGVPIIADGGIQTVGHVVKALALGASTVMMGSLLAATTEAPGEYFFSDGVRLKKYRGMGSLDAMEKSSSSQKRYFSEGDKVKIAQGVSGSIQDKGSIQKFVPYLIAGIQHGCQDIGARSLSVLRSMMYSGELKFEKRTMSAQIEGGVHGLHSYEKRLY

SEQ ID NO: 40020 - protein, 589 aa, Homo sapiens
  Payload ID: 8156
  Gene Symbol: IMPDH1
  Gene Name: IMP (inosine 5'-monophosphate) dehydrogenase 1
  Uniprot ID: P20839
  ENSP ID: ENSP00000346219
MEGPLTPPPLQGGGAAAVPEPGARQHPGHETAAQRYSARLLQAGYEPESCFLLELSSVVLLAGVGVQMDRLRRASMADYLISGGTGYVPEDGLTAQQLFASADGLTYNDFLILPGFIDFIADEVDLTSALTRKITLKTPLISSPMDTVTEADMAIAMALMGGIGFIHHNCTPEFQANEVRKVKKFEQGFITDPVVLSPSHTVGDVLEAKMRHGFSGIPITETGTMGSKLVGIVTSRDIDFLAEKDHTTLLSEVMTPRIELVVAPAGVTLKEANEILQRSKKGKLPIVNDCDELVAIIARTDLKKNRDYPLASKDSQKQLLCGAAVGTREDDKYRLDLLTQAGVDVIVLDSSQGNSVYQIAMVHYIKQKYPHLQVIGGNVVTAAQAKNLIDAGVDGLRVGMGCGSICITQEVMACGRPQGTAVYKVAEYARRFGVPIIADGGIQTVGHVVKALALGASTVMMGSLLAATTEAPGEYFFSDGVRLKKYRGMGSLDAMEKSSSSQKRYFSEGDKVKIAQGVSGSIQDKGSIQKFVPYLIAGIQHGCQDIGARSLSVLRSMMYSGELKFEKRTMSAQIEGGVHGLHSYEKRLY

SEQ ID NO: 40021 - protein, 566 aa, Homo sapiens
  Payload ID: 8156
  Gene Symbol: IMPDH1
  Gene Name: IMP (inosine 5'-monophosphate) dehydrogenase 1
  Uniprot ID: P20839
  ENSP ID: ENSP00000399400
MEGPLTPPPLQGGGAAAVPEPGARQHPGHETAAQRYSARLLQAGYEPESPRLDLATHPTTPRSELSSVVLLAGVGVQMDRLRRASDFLILPGFIDFIADEVDLTSALTRKITLKTPLISSPMDTVTEADMAIAMALMGGIGFIHHNCTPEFQANEVRKVKKFEQGFITDPVVLSPSHTVGDVLEAKMRHGFSGIPITETGTMGSKLVGIVTSRDIDFLAEKDHTTLLSEVMTPRIELVVAPAGVTLKEANEILQRSKKGKLPIVNDCDELVAIIARTDLKKNRDYPLASKDSQKQLLCGAAVGTREDDKYRLDLLTQAGVDVIVLDSSQGNSVYQIAMVHYIKQKYPHLQVIGGNVVTAAQAKNLIDAGVDGLRVGMGCGSICITQEVMACGRPQGTAVYKVAEYARRFGVPIIADGGIQTVGHVVKALALGASTVMMGSLLAATTEAPGEYFFSDGVRLKKYRGMGSLDAMEKSSSSQKRYFSEGDKVKIAQGVSGSIQDKGSIQKFVPYLIAGIQHGCQDIGARSLSVLRSMMYSGELKFEKRTMSAQIEGGVHGLHSYEKRLY

SEQ ID NO: 40022 - protein, 513 aa, Homo sapiens
  Payload ID: 8156
  Gene Symbol: IMPDH1
  Gene Name: IMP (inosine 5'-monophosphate) dehydrogenase 1
  ENSP ID: ENSP00000417296
MADYLISGGTGYVPEDGLTAQQLFASADGLTYNDFLILPGFIDFIADEVDLTSALTRKITLKTPLISSPMDTVTEADMAIAMALMGGIGFIHHNCTPEFQANEVRKVKFEQGFITDPVVLSPSHTVGDVLEAKMRHGFSGIPITETGTMGSKLVGIVTSRDIDFLAEKDHTTLLSEVMTPRIELVVAPAGVTLKEANEILQRSKKGKLPIVNDCDELVAIIARTDLKKNRDYPLASKDSQKQLLCGAAVGTREDDKYRLDLLTQAGVDVIVLDSSQGNSVYQIAMVHYIKQKYPHLQVIGGNVVTAAQAKNLIDAGVDGLRVGMGCGSICITQEVMACGRPQGTAVYKVAEYARRFGVPIIADGGIQTVGHVVKALALGASTVMMGSLLAATTEAPGEYFFSDGVRLKKYRGMGSLDAMEKSSSSQKRYFSEGDKVKIAQGVSGSIQDKGSIQKFVPYLIAGIQHGCQDIGARSLSVLRSMMYSGELKFEKRTMSAQIEGGVHGLHSYEKRLY

SEQ ID NO: 40023 - protein, 184 aa, Homo sapiens
  Payload ID: 8156
  Gene Symbol: IMPDH1
  Gene Name: IMP (inosine 5'-monophosphate) dehydrogenase 1
  ENSP ID: ENSP00000418592
MEGPLTPPPLQGGGAAAVPEPGARQHPGHETAAQRYSARLLQAGYEPESDFLILPGFIDFIADEVDLTSALTRKITLKTPLISSPMDTVTEADMAIAMAKFEQGFITDPVVLSPSHTVGDVLEAKMRHGFSGIPITETGTMGSKLVGIVTSRDIDFLAEKDHTTLLSEVMTPRIELVVAPAGVT

SEQ ID NO: 40024 - protein, 226 aa, Homo sapiens
  Payload ID: 8156
  Gene Symbol: IMPDH1
  Gene Name: IMP (inosine 5'-monophosphate) dehydrogenase 1
  ENSP ID: ENSP00000418742
SPRLDLATHPTTPRSELSSVVLLAGVGVQMDRLRRASMADYLISGGTGYVPEDGLTAQQLFASADGLTYNDFLILPGFIDFIADEVDLTSALTRKITLKTPLISSPMDTVTEADMAIAMALMGGIGFIHHNCTPEFQANEVRKVKFEQGFITDPVVLSPSHTVGDVLEAKMRHGFSGIPITETGTMGSKLVGIVTSRDIDFLAEKDHTTLLSEANVPGPTGDDAKD

SEQ ID NO: 40025 - protein, 289 aa, Homo sapiens
  Payload ID: 8156
  Gene Symbol: IMPDH1
  Gene Name: IMP (inosine 5'-monophosphate) dehydrogenase 1
  ENSP ID: ENSP00000419609
MEGPLTPPPLQGGGAAAVPEPGARQHPGHETAAQRYSARLLQAGYEPESDFLILPGFIDFIADEVDLTSALTRKITLKTPLISSPMDTVTEADMAIAMALMGGIGFIHHNCTPEFQANEVRKVKKFEQGFITDPVVLSPSHTVGDVLEAKMRHGFSGIPITETGTMGSKLVGIVTSRDIDFLAEKDHTTLLSEVMTPRIELVVAPAGVTLKEANEILQRSKKGKLPIVNDCDELVAIIARTDLKKNRDYPLASKDSQKQLLCGAAVGTREDDKYRLDLLTQAGVDVIVL

SEQ ID NO: 40026 - protein, 509 aa, Homo sapiens
  Payload ID: 8156
  Gene Symbol: IMPDH1
  Gene Name: IMP (inosine 5'-monophosphate) dehydrogenase 1
  Uniprot ID: P20839
  ENSP ID: ENSP00000420185
MADYLISGGTGYVPEDGLTAQQLFASADGLTYNDFLILPGFIDFIADEVDLTSALTRKITLKTPLISSPMDTVTEADMAIAMALMGGIGFIHHNCTPEFQANEKFEQGFITDPVVLSPSHTVGDVLEAKMRHGFSGIPITETGTMGSKLVGIVTSRDIDFLAEKDHTTLLSEVMTPRIELVVAPAGVTLKEANEILQRSKKGKLPIVNDCDELVAIIARTDLKKNRDYPLASKDSQKQLLCGAAVGTREDDKYRLDLLTQAGVDVIVLDSSQGNSVYQIAMVHYIKQKYPHLQVIGGNVVTAAQAKNLIDAGVDGLRVGMGCGSICITQEVMACGRPQGTAVYKVAEYARRFGVPIIADGGIQTVGHVVKALALGASTVMMGSLLAATTEAPGEYFFSDGVRLKKYRGMGSLDAMEKSSSSQKRYFSEGDKVKIAQGVSGSIQDKGSIQKFVPYLIAGIQHGCQDIGARSLSVLRSMMYSGELKFEKRTMSAQIEGGVHGLHSYEKRLY

SEQ ID NO: 40027 - protein, 69 aa, Homo sapiens
  Payload ID: 8156
  Gene Symbol: IMPDH1
  Gene Name: IMP (inosine 5'-monophosphate) dehydrogenase 1
  ENSP ID: ENSP00000420469
MEGPLTPPPLQGGGAAAVPEPGARQHPGHETAAQRYSARLLQAGYEPERTIFSGLTGRCWCPDGSPSQG

SEQ ID NO: 40028 - protein, 190 aa, Homo sapiens
  Payload ID: 8156
  Gene Symbol: IMPDH1
  Gene Name: IMP (inosine 5'-monophosphate) dehydrogenase 1
  ENSP ID: ENSP00000420756
  MOD_RES (1)..(1): Any amino acid
XMADYLISGGTGYVPEDGLTAQQLFASADGLTYNDFLILPGFIDFIADEVDLTSALTRKITLKTPLISSPMDTVTEADMAIAMALMGGIGFIHHNCTPEFQANEVRKVKFEQGFITDPVVLSPSHTVGDVLEAKMRHGFSGIPITETGTMGSKLVGIVTSRDIDFLAEKDHTTLLSEANVPGPTGDDAKD

SEQ ID NO: 40029 - protein, 489 aa, Homo sapiens
  Payload ID: 8156
  Gene Symbol: IMPDH1
  Gene Name: IMP (inosine 5'-monophosphate) dehydrogenase 1
  Uniprot ID: P20839
  ENSP ID: ENSP00000420803
MADYLISGGTGYVPEDGLTAQQLFASADGLTYNDFLILPGFIDFIADEVDLTSALTRKITLKTPLISSPMDTVTEADMAIAMAKFEQGFITDPVVLSPSHTVGDVLEAKMRHGFSGIPITETGTMGSKLVGIVTSRDIDFLAEKDHTTLLSEVMTPRIELVVAPAGVTLKEANEILQRSKKGKLPIVNDCDELVAIIARTDLKKNRDYPLASKDSQKQLLCGAAVGTREDDKYRLDLLTQAGVDVIVLDSSQGNSVYQIAMVHYIKQKYPHLQVIGGNVVTAAQAKNLIDAGVDGLRVGMGCGSICITQEVMACGRPQGTAVYKVAEYARRFGVPIIADGGIQTVGHVVKALALGASTVMMGSLLAATTEAPGEYFFSDGVRLKKYRGMGSLDAMEKSSSSQKRYFSEGDKVKIAQGVSGSIQDKGSIQKFVPYLIAGIQHGCQDIGARSLSVLRSMMYSGELKFEKRTMSAQIEGGVHGLHSYEKRLY

SEQ ID NO: 40030 - protein, 513 aa, Homo sapiens; identical to SEQ ID NO: 40022
  Payload ID: 8156
  Gene Symbol: IMPDH1
  Gene Name: IMP (inosine 5'-monophosphate) dehydrogenase 1
  ENSP ID: ENSP00000486056

SEQ ID NO: 40031 - protein, 514 aa, Homo sapiens
  Payload ID: 8157
  Gene Symbol: IMPDH2
  Gene Name: IMP (inosine 5'-monophosphate) dehydrogenase 2
  Uniprot ID: P12268
  ENSP ID: ENSP00000321584
MADYLISGGTSYVPDDGLTAQQLFNCGDGLTYNDFLILPGYIDFTADQVDLTSALTKKITLKTPLVSSPMDTVTEAGMAIAMALTGGIGFIHHNCTPEFQANEVRKVKKYEQGFITDPVVLSPKDRVRDVFEAKARHGFCGIPITDTGRMGSRLVGIISSRDIDFLKEEEHDCFLEEIMTKREDLVVAPAGITLKEANEILQRSKKGKLPIVNEDDELVAIIARTDLKKNRDYPLASKDAKKQLLCGAAIGTHEDDKYRLDLLAQAGVDVVVLDSSQGNSIFQINMIKYIKDKYPNLQVIGGNVVTAAQAKNLIDAGVDALRVGMGSGSICITQEVLACGRPQATAVYKVSEYARRFGVPVIADGGIQNVGHIAKALALGASTVMMGSLLAATTEAPGEYFFSDGIRLKKYRGMGSLDAMDKHLSSQNRYFSEADKIKVAQGVSGAVQDKGSIHKFVPYLIAGIQHSCQDIGAKSLTQVRAMMYSGELKFEKRTSSAQVEGGVHSLHSYEKRLF

SEQ ID NO: 40032 - protein, 470 aa, Homo sapiens
  Payload ID: 8157
  Gene Symbol: IMPDH2
  Gene Name: IMP (inosine 5'-monophosphate) dehydrogenase 2
  ENSP ID: ENSP00000393525
  MOD_RES (1)..(1): Any amino acid
XMDTVTEAGMAIAMALTGGIGFIHHNCTPEFQANEVRKVKKYEQGFITDPVVLSPKDRVRDVFEAKARHGFCGIPITDTGRMGSRLVGIISSRDIDFLKEEEHDCFLEEIMTKREDLVVAPAGITLKEANEILQRSKKGKLPIVNEDDELVAIIARTDLKKNRDYPLASKDAKKQLLCGAAIGTHEDDKYRLDLLAQAGVDVVVLDSSQGNSIFQINMIKYIKDKYPNLQVIGGNVVTAAQAKNLIDAGVDALRVGMGSGSICITQEVAPKIPPDIKSHSPKCPSTVTGCYMLACGRPQATAVYKVSEYARRFGVPVIADGGIQNVGHIAKALALGASTVMMGSLLAATTEAPGEYFFSDGIRLKKYRGMGSLDAMDKHLSSQNRYFSEADKIKVAQGVSGAVQDKGSIHKFVPYLIAGIQHSCQDIGAKSLTQVRAMMYSGELKFEKRTSSAQVEGGVHSLHSYEKRLF

SEQ ID NO: 40033 - protein, 279 aa, Homo sapiens [sequence omitted]

SEQ ID NO: 40034 - protein, 184 aa, Homo sapiens
  Payload ID: 8158
  Gene Symbol: IMP3
  Gene Name: IMP3, U3 small nucleolar ribonucleoprotein
  Uniprot ID: Q9NV31
  ENSP ID: ENSP00000326981
MVRKLKFHEQKLLKQVDFLNWEVTDHNLHELRVLRRYRLQRREDYTRYNQLSRAVRELARRLRDLPERDQFRVRASAALLDKLYALGLVPTRGSLELCDFVTASSFCRRRLPTVLLKLRMAQHLQAAVAFVEQGHVRVGPDVVTDPAFLVTRSMEDFVTWVDSSKIKRHVLEYNEERDDFDLEA

SEQ ID NO: 40035 - protein, 184 aa, Homo sapiens; identical to SEQ ID NO: 40034
  Payload ID: 8158
  Gene Symbol: IMP3
  Gene Name: IMP3, U3 small nucleolar ribonucleoprotein
  Uniprot ID: Q9NV31
  ENSP ID: ENSP00000385217

SEQ ID NO: 40036 - protein, 291 aa, Homo sapiens
  Payload ID: 8159
  Gene Symbol: IMP4
  Gene Name: IMP4, U3 small nucleolar ribonucleoprotein
  Uniprot ID: Q96G21
  ENSP ID: ENSP00000259239
MLRREARLRREYLYRKAREEAQRSAQERKERLRRALEENRLIPTELRREALALQGSLEFDDAGGEGVTSHVDDEYRWAGVEDPKVMITTSRDPSSRLKMFAKELKLVFPGAQRMNRGRHEVGALVRACKANGVTDLLVVHEHRGTPVGLIVSHLPFGPTAYFTLCNVVMRHDIPDLGTMSEAKPHLITHGFSSRLGKRVSDILRYLFPVPKDDSHRVITFANQDDYISFRHHVYKKTDHRNVELTEVGPRFELKLYMIRLGTLEQEATADVEWRWHPYTNTARKRVFLSTE

SEQ ID NO: 40037 - protein, 248 aa, Homo sapiens
  Payload ID: 8159
  Gene Symbol: IMP4
  Gene Name: IMP4, U3 small nucleolar ribonucleoprotein
  ENSP ID: ENSP00000386411
MLRREARLRREYLYRKAREEAQRSAQERKERLRRALEENRLIPTELRREALALQGSLEFDDAGGEGVTSHVDDEYRWAGVEDPKVMITTSRDPSSRLKMFAKELKLVFPGAQRMNRGRHEVGALVRACKANGVTDLLVVHEHRGTPVGLIVSHLPFGPTAYFTLCNVVMRHDIPDLGTMSEAKPHLITHGFSSRLGKRVSDILRYLFPVPKDDSHRVITFANQDDYISFRHHVYKKTDHRNVELTECT

SEQ ID NO: 40038 - protein, 172 aa, Homo sapiens
  Payload ID: 8159
  Gene Symbol: IMP4
  Gene Name: IMP4, U3 small nucleolar ribonucleoprotein
  ENSP ID: ENSP00000386716
MITTSRDPSSRLKMFAKELKLVFPGAQRMNRGRHEVGALVRACKANGVTDLLVVHEHRGTPVGLIVSHLPFGPTAYFTLCNVVMRHDIPDLGTMSEAKPHLITHGFSSRLGKRVSDILRYLFPVPKDDSHRVITFANQDDYISFRHHVYKKTDHRNVELTEVGPRFELKLYM

SEQ ID NO: 40039 - protein, 236 aa, Homo sapiens
  Payload ID: 8159
  Gene Symbol: IMP4
  Gene Name: IMP4, U3 small nucleolar ribonucleoprotein
  ENSP ID: ENSP00000389701
MMLEVKVTIQGVTSHVDDEYRWAGVEDPKVMITTSRDPSSRLKMFAKELKLVFPGAQRMNRGRHEVGALVRACKANGVTDLLVVHEHRGTPVGLIVSHLPFGPTAYFTLCNVVMRHDIPDLGTMSEAKPHLITHGFSSRLGKRVSDILRYLFPVPKDDSHRVITFANQDDYISFRHHVYKKTDHRNVELTEVGPRFELKLYMIRLGTLEQEATADVEWRWHPYTNTARKRVFLSTE

SEQ ID NO: 40040 - protein, 280 aa, Homo sapiens
  Payload ID: 8159
  Gene Symbol: IMP4
  Gene Name: IMP4, U3 small nucleolar ribonucleoprotein
  ENSP ID: ENSP00000409371
  MOD_RES (1)..(1): Any amino acid
XSKCLPAVFLAHWVLLLVLRVFLPCDENRLIPTELRREALALQGSLEFDDAGGEGVTSHVDDEYRWAGVEDPKVMITTSRDPSSRLKMFAKELKLVFPGAQRMNRGRHEVGALVRACKANGVTDLLVVHEHRGTPVGLIVSHLPFGPTAYFTLCNVVMRHDIPDLGTMSEAKPHLITHGFSSRLGKRVSDILRYLFPVPKDDSHRVITFANQDDYISFRHHVYKKTDHRNVELTEVGPRFELKLYMIRLGTLEQEATADVEWRWHPYTNTARKRVFLSTE

SEQ ID NO: 40041 - protein, 76 aa, Homo sapiens
  Payload ID: 8159
  Gene Symbol: IMP4
  Gene Name: IMP4, U3 small nucleolar ribonucleoprotein
  ENSP ID: ENSP00000416756
MLRREARLRREYLYRKAREEAQRSAQERKERLRRALEENRLIPTELRREALALQGSLEFDDAGGEGNYTRCDQPRG

SEQ ID NO: 40042 - protein, 320 aa, Homo sapiens
  Payload ID: 8160
  Gene Symbol: IMPACT
  Gene Name: impact RWD domain protein
  Uniprot ID: Q9P2X3
  ENSP ID: ENSP00000284202
MAEGDAGSDQRQNEEIEAMAAIYGEEWCVIDDCAKIFCIRISDDIDDPKWTLCLQVMLPNEYPGTAPPIYQLNAPWLKGQERADLSNSLEEIYIQNIGESILYLWVEKIRDVLIQKSQMTEPGPDVKKKTEEEDVECEDDLILACQPESSLKALDFDISETRTEVEVEELPPIDHGIPITDRRSTFQAHLAPVVCPKQVKMVLSKLYENKKIASATHNIYAYRIYCEDKQTFLQDCEDDGETAAGGRLLHLMEILNVKNVMVVVSRWYGGILLGPDRFKHINNCARNILVEKNYTNSPEESSKALGKNKKVRKDKKRNEH

SEQ ID NO: 40043 - protein, 180 aa, Homo sapiens
  Payload ID: 8160
  Gene Symbol: IMPACT
  Gene Name: impact RWD domain protein
  ENSP ID: ENSP00000462769
MAAIYGEEWCVIDDCAKIFCIRISDDIDDPKWTLCLQVMLPNEYPGTAPPIYQLNAPWLKGQERADLSNSLEEIYIQNIGESILYLWVEKIRDVLIQKSQMTEPGPDVKKKTEEEDVECEDDLILACQPESSLKALDFDISETRTEVEVEELPPIDHGIPITDRRSTFQAHLAPVVCPKQ

SEQ ID NO: 40044 - protein, 18 aa, Homo sapiens
  Payload ID: 8160
  Gene Symbol: IMPACT
  Gene Name: impact RWD domain protein
  ENSP ID: ENSP00000463710
  MOD_RES (1)..(1): Any amino acid
XALGKNKKVRKDKKRNEH

SEQ ID NO: 40045 - protein, 106 aa, Homo sapiens
  Payload ID: 8160
  Gene Symbol: IMPACT
  Gene Name: impact RWD domain protein
  ENSP ID: ENSP00000463895
DGETAAGGRLLHLMEILNVKNVMVVVSRWYGGILLGPDRFKHINNCARNILVEKNYTNSPEESSKALGKNKKMGIAEAASKVCFEVYIVKQSLSEENYIKLITTKK

SEQ ID NO: 40046 - protein, 185 aa, Homo sapiens
  Payload ID: 8160
  Gene Symbol: IMPACT
  Gene Name: impact RWD domain protein
  ENSP ID: ENSP00000464363
MAEGDAGSDQRQNEEIEAMAAIYGEEWCVIDDCAKIFCIRISDDIDDPKWTLCLQVMLPNEYPGTAPPIYQLNAPWLKGQERADLSNSLEEIYIQNIGESILYLWVEKIRDVLIQKSQMTEPGPDVKKKTEEEDVECEDDLILACQPESSLKALDFDISETRTEVEELPPIDHGIPITDRRSTFQ

SEQ ID NO: 40047 - protein, 975 aa, Homo sapiens
  Payload ID: 8161
  Gene Symbol: IPO11
  Gene Name: importin 11
  Uniprot ID: Q9UI26
  ENSP ID: ENSP00000316651
MDLNSASTVVLQVLTQATSQDTAVLKPAEEQLKQWETQPGFYSVLLNIFTNHTLDINVRWLAVLYFKHGIDRYWRRVAPHALSEEEKTTLRAGLITNFNEPINQIATQIAVLIAKVARLDCPRQWPELIPTLIESVKVQDDLRQHRALLTFYHVTKTLASKRLAADRKLFYDLASGIYNFACSLWNHHTDTFLQEVSSGNEAAILSSLERTLLSLKVLRKLTVNGFVEPHKNMEVMGFLHGIFERLKQFLECSRSIGTDNVCRDRLEKTIILFTKVLLDFLDQHPFSFTPLIQRSLEFSVSYVFTEVGEGVTFERFIVQCMNLIKMIVKNYAYKPSKNFEDSSPETLEAHKIKMAFFTYPTLTEICRRLVSHYFLLTEEELTMWEEDPEGFTVEETGGDSWKYSLRPCTEVLFIDIFHEYNQTLTPVLLEMMQTLQGPTNVEDMNALLIKDAVYNAVGLAAYELFDSVDFDQWFKNQLLPELQVIHNRYKPLRRRVIWLIGQWISVKFKSDLRPMLYEAICNLLQDQDLVVRIETATTLKLTVDDFEFRTDQFLPYLETMFTLLFQLLQQVTECDTKMHVLHVLSCVIERVNMQIRPYVGCLVQYLPLLWKQSEEHNMLRCAILTTLIHLVQGLGADSKNLYPFLLPVIQLSTDVSQPPHVYLLEDGLELWLVTLENSPCITPELLRIFQNMSPLLELSSENLRTCFKIINGYIFLSSTEFLQTYAVGLCQSFCELLKEITTEGQVQVLKVVENALKVNPILGPQMFQPILPYVFKGIIEGERYPVVMSTYLGVMGRVLLQNTSFFSSLLNEMAHKFNQEMDQLLGNMIEMWVDRMDNITQPERRKLSALALLSLLPSDNSVIQDKFCGIINISVEGLHDVMTEDPETGTYKDCMLMSHLEEPKVTEDEEPPTEQDKRKKMLALKDPVHTVSLQQFIYEKLKAQQEMLGEQGFQSLMETVDTEIVTQLQEFLQGF

SEQ ID NO: 40048 - protein, 1015 aa, Homo sapiens
  Payload ID: 8161
  Gene Symbol: IPO11
  Gene Name: importin 11
  Uniprot ID: Q9UI26
  ENSP ID: ENSP00000386992
MVQPIIHLGYVVYSLLYLGYKPVQHVTALNTVSSCHKMVSMDLNSASTVVLQVLTQATSQDTAVLKPAEEQLKQWETQPGFYSVLLNIFTNHTLDINVRWLAVLYFKHGIDRYWRRVAPHALSEEEKTTLRAGLITNFNEPINQIATQIAVLIAKVARLDCPRQWPELIPTLIESVKVQDDLRQHRALLTFYHVTKTLASKRLAADRKLFYDLASGIYNFACSLWNHHTDTFLQEVSSGNEAAILSSLERTLLSLKVLRKLTVNGFVEPHKNMEVMGFLHGIFERLKQFLECSRSIGTDNVCRDRLEKTIILFTKVLLDFLDQHPFSFTPLIQRSLEFSVSYVFTEVGEGVTFERFIVQCMNLIKMIVKNYAYKPSKNFEDSSPETLEAHKIKMAFFTYPTLTEICRRLVSHYFLLTEEELTMWEEDPEGFTVEETGGDSWKYSLRPCTEVLFIDIFHEYNQTLTPVLLEMMQTLQGPTNVEDMNALLIKDAVYNAVGLAAYELFDSVDFDQWFKNQLLPELQVIHNRYKPLRRRVIWLIGQWISVKFKSDLRPMLYEAICNLLQDQDLVVRIETATTLKLTVDDFEFRTDQFLPYLETMFTLLFQLLQQVTECDTKMHVLHVLSCVIERVNMQIRPYVGCLVQYLPLLWKQSEEHNMLRCAILTTLIHLVQGLGADSKNLYPFLLPVIQLSTDVSQPPHVYLLEDGLELWLVTLENSPCITPELLRIFQNMSPLLELSSENLRTCFKIINGYIFLSSTEFLQTYAVGLCQSFCELLKEITTEGQVQVLKVVENALKVNPILGPQMFQPILPYVFKGIIEGERYPVVMSTYLGVMGRVLLQNTSFFSSLLNEMAHKFNQEMDQLLGNMIEMWVDRMDNITQPERRKLSALALLSLLPSDNSVIQDKFCGIINISVEGLHDVMTEDPETGTYKDCMLMSHLEEPKVTEDEEPPTEQDKRKKMLALKDPVHTVSLQQFIYEKLKAQQEMLGEQGFQSLMETVDTEIVTQLQEFLQGF

SEQ ID NO: 40049 - protein, 94 aa, Homo sapiens
  Payload ID: 8161
  Gene Symbol: IPO11
  Gene Name: importin 11
  ENSP ID: ENSP00000387039
MTEDPETGTYKDCMLMSHLEEPKVTEDEEPPTEQDKRKKMLALKDPVHTVSLQQFIYEKLKAQQEMLGEQGFQSLMETVDTEIVTQLQEFLQGF

SEQ ID NO: 40050 - protein, 863 aa, Homo sapiens
  Payload ID: 8161
  Gene Symbol: IPO11
  Gene Name: importin 11
  ENSP ID: ENSP00000395685
MDLNSASTVVLQVLTQATSQDTAVLKPAEEQLKQWETQPGFYSVLLNIFTNHTLDINVRWLAVLYFKHGIDRYWRRVAPHALSEEEKTTLRAGLITNFNEPINQIATQIAVLIAKVARLDCPRQWPELIPTLIESVKVQDDLRQHRALLTFYHVTKTLASKRLAADRKLFYDLASGIYNFACSLWNHHTDTFLQEVSSGNEAAILSSLERTLLSLKVLRKLTVNGFVEPHKNMEVMGFLHGIFERLKQFLECSRSIGTDNVCRDRLEKTIILFTKVLLDFLDQHPFSFTPLIQRSLEFSVSYVFTEVGEGVTFERFIVQCMNLIKMIVKNYAYKPSKNFEDSSPETLEAHKIKMAFFTYPTLTEICRRLVSHYFLLTEEELTMWEEDPEGFTVEETGGDSWKYSLRPCTEVLFIDIFHEYNQTLTPVLLEMMQTLQGPTNVEDMNALLIKDAVYNAVGLAAYELFDSVDFDQWFKNQLLPELQVIHNRYKPLRRRVIWLIGQWISVKFKSDLRPMLYEAICNLLQDQDLVVRIETATTLKLTVDDFEFRTDQFLPYLETMFTLLFQLLQQVTECDTKMHVLHVLSCVIERVNMQIRPYVGCLVQYLPLLWKQSEEHNMLRCAILTTLIHLVQGLGADSKNLYPFLLPVIQLSTDVSQPPHVYLLEDGLELWLVTLENSPCITPELLRIFQNMSPLLELSSENLRTCFKIINGYIFLSSTEFLQTYAVGLCQSFCELLKEITTEGQVQVLKVVENALKVNPILGPQMFQPILPYVFKGIIEGERYPVVMSTYLGVMGRVLLQNTSFFSSLLNEMAHKFNQEMDQLLGNMIEMWVDRMDNITQPERRKLSALALLSLLPSDNSQF

SEQ ID NO: 40051 - protein, 59 aa, Homo sapiens
  Payload ID: 8161
  Gene Symbol: IPO11
  Gene Name: importin 11
  ENSP ID: ENSP00000398230
MDQLLGNMIEMWVDRMDNITQPERRKLSALALLSLLPSDNSFLYPWQPLFYTLTVKEPM

SEQ ID NO: 40052 - protein, 160 aa, Homo sapiens
  Payload ID: 8161
  Gene Symbol: IPO11
  Gene Name: importin 11
  ENSP ID: ENSP00000421517
  MOD_RES (1)..(1): Any amino acid
XLRCAILTTLIHLVQVVENALKVNPILGPQMFQPILPYVFKGIIEGERYPVVMSTYLGVMGRVLLQNTSFFSSLLNEMAHKFNQEMDQLLGNMIEMWVDRMDNITQPERRKLSALALLSLLPSDNSVIQDKFCGIINISVEGLHDVMTEDPETGTYKDWP

SEQ ID NO: 40053 - protein, 63 aa, Homo sapiens
  Payload ID: 8161
  Gene Symbol: IPO11
  Gene Name: importin 11
  ENSP ID: ENSP00000425573
MDLNSASTVVLQVLTQATSQDTAVLKPAEEQLKQWETQPGFYSVLLNIFTNHTLDINVRWLAV

SEQ ID NO: 40054 - protein, 148 aa, Homo sapiens
  Payload ID: 8161
  Gene Symbol: IPO11
  Gene Name: importin 11
  ENSP ID: ENSP00000427129
MDLNSASTVVLQVLTQATSQDTAVLKPAEEQLKQWETQPGFYSVLLNIFTNHTLDINVRWLAVLYFKHGIDRYWRRVAPHALSEEEKTTLRAGLITNFNEPINQIATQIAVLIAKVARLDCPRQWPELIPTLIESVKVQDDLRQHRAL

SEQ ID NO: 40055 - protein, 162 aa, Homo sapiens
  Payload ID: 8161
  Gene Symbol: IPO11
  Gene Name: importin 11
  ENSP ID: ENSP00000427274
MDLNSASTVVLQVLTQATSQDTAVLKPAEEQLKQWETQPGFYSVLLNIFTNHTLDINVRWLAVLYFKHGIDRYWRRVAPHALSEEEKTTLRAGLITNFNEPINQIATQIAVLIAKVARLDCPRQWPELIPTLIESVKVQDDLRQHRALLTFYHVTKTLASKR

SEQ ID NO: 40056 - protein, 181 aa, Homo sapiens
  Payload ID: 8162
  Gene Symbol: IPO13
  Gene Name: importin 13
  ENSP ID: ENSP00000361414
MVLGAGWGWAYQLHLLQALKRKPDLFLCERLDVKAVFQCAVLALKFPEAPTVKASCGFFTELLPRCGEVESVGKVVQEDGRMLLIAVLEAIGGQASRSLMDCFADILFALNKHCFSLLSMWIKEALQPPGFPSARLSPEQKDTFSQQILRERVNKRRVKEMVKEFTLLCRGLHGTDYTADY

SEQ ID NO: 40057 - protein, 963 aa, Homo sapiens
  Payload ID: 8162
  Gene Symbol: IPO13
  Gene Name: importin 13
  Uniprot ID: O94829
  ENSP ID: ENSP00000361418
MERREEQPGAAGAGAAPALDFTVENVEKALHQLYYDPNIENKNLAQKWLMQAQVSPQAWHFSWQLLQPDKVPEIQYFGASALHIKISRYWSDIPTDQYESLKAQLFTQITRFASGSKIVLTRLCVALASLALSMMPDAWPCAVADMVRLFQAEDSPVDGQGRCLALLELLTVLPEEFQTSRLPQYRKGLVRTSLAVECGAVFPLLEQLLQQPSSPSCVRQKVLKCFSSWVQLEVPLQDCEALIQAAFAALQDSELFDSSVEAIVNAISQPDAQRYVNTLLKLIPLVLGLQEQLRQAVQNGDMETSHGICRIAVALGENHSRALLDQVEHWQSFLALVNMIMFCTGIPGHYPVNETTSSLTLTFWYTLQDDILSFEAEKQAVYQQVYRPVYFQLVDVLLHKAQFPSDEEYGFWSSDEKEQFRIYRVDISDTLMYVYEMLGAELLSNLYDKLGRLLTSSEEPYSWQHTEALLYGFQSIAETIDVNYSDVVPGLIGLIPRISISNVQLADTVMFTIGALSEWLADHPVMINSVLPLVLHALGNPELSVSSVSTLKKICRECKYDLPPYAANIVAVSQDVLMKQIHKTSQCMWLMQALGFLLSALQVEEILKNLHSLISPYIQQLEKLAEEIPNPSNKLAIVHILGLLSNLFTTLDISHHEDDHEGPELRKLPVPQGPNPVVVVLQQVFQLIQKVLSKWLNDAQVVEAVCAIFEKSVKTLLDDFAPMVPQLCEMLGRMYSTIPQASALDLTRQLVHIFAHEPAHFPPIEALFLLVTSVTLTLFQQGPRDHPDIVDSFMQLLAQALKRKPDLFLCERLDVKAVFQCAVLALKFPEAPTVKASCGFFTELLPRCGEVESVGKVVQEDGRMLLIAVLEAIGGQASRSLMDCFADILFALNKHCFSLLSMWIKEALQPPGFPSARLSPEQKDTFSQQILRERVNKRRVKEMVKEFTLLCRGLHGTDYTADY

SEQ ID NO: 40058 - protein, 1081 aa, Homo sapiens
  Payload ID: 8163
  Gene Symbol: IPO4
  Gene Name: importin 4
  Uniprot ID: Q8TEX9
  ENSP ID: ENSP00000346453
MESAGLEQLLRELLLPDTERIRRATEQLQIVLRAPAALPALCDLLASAADPQIRQFAAVLTRRRLNTRWRRLAAEQRESLKSLILTALQRETEHCVSLSLAQLSATIFRKEGLEAWPQLLQLLQHSTHSPHSPEREMGLLLLSVVVTSRPEAFQPHHRELLRLLNETLGEVGSPGLLFYSLRTLTTMAPYLSTEDVPLARMLVPKLIMAMQTLIPIDEAKACEALEALDELLESEVPVITPYLSEVLTFCLEVARNVALGNAIRIRILCCLTFLVKVKSKALLKNRLLPPLLHTLFPIVAAEPPPGQLDPEDQDSEEEELEIELMGETPKHFAVQVVDMLALHLPPEKLCPQLMPMLEEALRSESPYQRKAGLLVLAVLSDGAGDHIRQRLLPPLLQIVCKGLEDPSQVVRNAALFALGQFSENLQPHISSYSREVMPLLLAYLKSVPLGHTHHLAKACYALENFVENLGPKVQPYLPELMECMLQLLRNPSSPRAKELAVSALGAIATAAQASLLPYFPAIMEHLREFLLTGREDLQPVQIQSLETLGVLARAVGEPMRPLAEECCQLGLGLCDQVDDPDLRRCTYSLFAALSGLMGEGLAPHLEQITTLMLLSLRSTEGIVPQYDGSSSFLLFDDESDGEEEEELMDEDVEEEDDSEISGYSVENAFFDEKEDTCAAVGEISVNTSVAFLPYMESVFEEVFKLLECPHLNVRKAAHEALGQFCCALHKACQSCPSEPNTAALQAALARVVPSYMQAVNRERERQVVMAVLEALTGVLRSCGTLTLKPPGRLAELCGVLKAVLQRKTACQDTDEEEEEEDDDQAEYDAMLLEHAGEAIPALAAAAGGDSFAPFFAGFLPLLVCKTKQGCTVAEKSFAVGTLAETIQGLGAASAQFVSRLLPVLLSTAQEADPEVRSNAIFGMGVLAEHGGHPAQEHFPKLLGLLFPLLARERHDRVRDNICGALARLLMASPTRKPEPQVLAALLHALPLKEDLEEWVTIGRLFSFLYQSSPDQVIDVAPELLRICSLILADNKIPPDTKAALLLLLTFLAKQHTDSFQAALGSLPVDKAQELQAVLGLS

SEQ ID NO: 40059 - protein, 48 aa, Homo sapiens
  Payload ID: 8163
  Gene Symbol: IPO4
  Gene Name: importin 4
  ENSP ID: ENSP00000452710
MESAGLEQLLRELLLPDTERIRRLPPRPRNSSRSFFGPPPLCRLSATC

SEQ ID NO: 40060 - protein, 154 aa, Homo sapiens
  Payload ID: 8163
  Gene Symbol: IPO4
  Gene Name: importin 4
  ENSP ID: ENSP00000452798
MESAGLEQLLRELLLPDTERIRRATEQLQIVLRAPAALPALCDLLASAADPQTTEHPLATAGGGATGEPQVPDPDGPAERNRALCEPQPGPALSHHFSKGRLGGLATAFAAASAQYPQPPQPRERDGAFAAKCGGDLPARGLPTPPPGASSASE

SEQ ID NO: 40061 - protein, 101 aa, Homo sapiens
  Payload ID: 8163
  Gene Symbol: IPO4
  Gene Name: importin 4
  ENSP ID: ENSP00000453108
MESAGLEQLLRELLLPDTERIRRATEQLQIVLRAPAALPALCDLLASAADPQIRQFAAVLTRRRLNTRWRRLAAEQRESLKSLILTALQRETESLLFAGTV

SEQ ID NO: 40062 - protein, 98 aa, Homo sapiens
  Payload ID: 8163
  Gene Symbol: IPO4
  Gene Name: importin 4
  ENSP ID: ENSP00000453349
MESAGLEQLLRELLLPDTERIRRATEQLQIVLRAPAALPALCDLLASAADPQIRQFAAVLTRRRLNTRWRRLAAEQRESLKSLILTALQRETEWGFCC

SEQ ID NO: 40063 - protein, 547 aa, Homo sapiens
  Payload ID: 8163
  Gene Symbol: IPO4
  Gene Name: importin 4
  ENSP ID: ENSP00000453708
  MOD_RES (1)..(1): Any amino acid
XQPVQIQSLETLGVLARAVGEPMRPLAEECCQLGLGLCDQVDDPDLRRCTYSLFAALSGLMGEGLAPHLEQITTLMLLSLRSTEGIVPQYDGSSSFLLFDDESDGEEEEELMDEDVEEEDDSEISGYSVENAFFDEKEDTCAAVGEISVNTSVAFLPYMESVFEEVFKLLECPHLNVRKAAHEALGQFCCALHKACQSCPSEPNTAALQAALARVVPSYMQAVNRERERQVVMAVLEALTGVLRSCGTLTLKPPGRLAELCGVLKAVLQRKTACQDTDEEEEEEDDDQAEYDAMLLEHAGEAIPALAAAAGGDSFAPFFAGFLPLLVCKTKQGCTVAEKSFAVGTLAETIQGLGAASAQFVSRLLPVLLSTAQEADPEVRSNAIFGMGVLAEHGGHPAQEHFPKLLGLLFPLLARERHDRVRDNICGALARLLMASPTRKPEPQVLAALLHALPLKEDLEEWVTIGRLFSFLYQSSPDQVIDVAPELLRICSLILADNKIPPGEDTKAALLLLLTFLAKQHTDSFQAALGSLPVDKAQELQAVLGLS

SEQ ID NO: 40064 - protein, 312 aa, Homo sapiens
  Payload ID: 8163
  Gene Symbol: IPO4
  Gene Name: importin 4
  ENSP ID: ENSP00000453818
  MOD_RES (1)..(1): Any amino acid
XPSEPNTAALQAALARVVPSYMQAVNRERERQVVMAVLEALTGVLRSCGTLTLKPPGRLAELCGVLKAVLQRKTACQDTDEEEEEEDDDQAEYDAMLLEHAGEAIPALAAAAGGDSFAPFFAGFLPLLVCKTKQGCTVAEKSFAVGTLAETIQGLGAASAQFVSRLLPVLLSTAQEADPEVRSNAIFGMGVLAEHGGHPAQEHFPKLLGLLFPLLARERHDRVRDNICGALARLLMASPTRKPEPQVIDVAPELLRICSLILADNKIPPDTKAALLLLLTFLAKQHTDSFQAALGSLPVDKAQELQAVLGLS

SEQ ID NO: 40065 - protein, 911 aa, Homo sapiens
  Payload ID: 8163
  Gene Symbol: IPO4
  Gene Name: importin 4
  ENSP ID: ENSP00000453825
MESAGLEQLLRELLLPDTERIRRATEQLQIVLRAPAALPALCDLLASAADPQIRQFAAVLTRRRLNTRWRRLAAEQRESLKSLILTALQRETEHCVSLSLAQLSATIFRKEGLEAWPQLLQLLQHSTHSPHSPEREMGLLLLSVVVTSRPEAFQPHHRELLRLLNETLGEVGSPGLLFYSLRTLTTMAPYLSTEDVPLARMLVPKLIMAMQTLIPIDEAKACEALEALDELLESEVPVITPYLSEVLTFCLEVARNVALGNAIRIRILCCLTFLVKVKSKALLKNRLLPPLLHTLFPIVAAEPPPGQLDPEDQDSEEEELEIELMGETPKHFAVQVVDMLALHLPPEKLCPQLMPMLEEALRSESPYQRKAGLLVLAVLSDGAGDHIRQRLLPPLLQIVCKGLEDPSQVVRNAALFALGQFSENLQPHISSYSREVMPLLLAYLKSVPLGHTHHLAKACYALENFVENLGPKVQPYLPELMECMLQLLRNPSSPRAKELAVSALGAIATAAQASLLPYFPAIMEHLREFLLTGREDLQPVQIQSLETLGVLARAVGEPMRPLAEECCQLGLGLCDQVDDPDLRRCTYSLFAALSGLMGEGLAPHLEQITTLMLLSLRSTEGIVPQYDGSSSFLLFDDESDGEEEEELMDEDVEEEDDSEISGYSVENAFFDEKEDTCAAVGEISVNTSVAFLPYMESVFEEVFKLLECPHLNVRKAAHEALGQFCCALHKACQSCPSEPNTAALQAALARVVPSYMQAVNRERERQVVMAVLEALTGVLRSCGTLTLKPPGRLAELCGVLKAVLQRKTACQDTDEEEEEEDDDQPLTWLHRLNTTPCCWSTLERPSLPWQPRLGETPLPHSLPVSCHYWCARQNRAAQWQRSPLQWGPWQRLFRAWVLPQPSLCLGCSLCC

SEQ ID NO: 40066 - protein, 1115 aa, Homo sapiens
  Payload ID: 8164
  Gene Symbol: IPO5
  Gene Name: importin 5
  Uniprot ID: O00410
  ENSP ID: ENSP00000261574
MPEDQVGKLEATENTISAMAAAAAEQQQFYLLLGNLLSPDNVVRKQAEETYENIPGQSKITFLLQAIRNTTAAEEARQMAAVLLRRLLSSAFDEVYPALPSDVQTAIKSELLMIIQMETQSSMRKKVCDIAAELARNLIDEDGNNQWPEGLKFLFDSVSSQNVGLREAALHIFWNFPGIFGNQQQHYLDVIKRMLVQCMQDQEHPSIRTLSARATAAFILANEHNVALFKHFADLLPGFLQAVNDSCYQNDDSVLKSLVEIADTVPKYLRPHLEATLQLSLKLCGDTSLNNMQRQLALEVIVTLSETAAAMLRKHTNIVAQTIPQMLAMMVDLEEDEDWANADELEDDDFDSNAVAGESALDRMACGLGGKLVLPMIKEHIMQMLQNPDWKYRHAGLMALSAIGEGCHQQMEGILNEIVNFVLLFLQDPHPRVRYAACNAVGQMATDFAPGFQKKFHEKVIAALLQTMEDQGNQRVQAHAAAALINFTEDCPKSLLIPYLDNLVKHLHSIMVLKLQELIQKGTKLVLEQVVTSIASVADTAEEKFVPYYDLFMPSLKHIVENAVQKELRLLRGKTIECISLIGLAVGKEKFMQDASDVMQLLLKTQTDFNDMEDDDPQISYMISAWARMCKILGKEFQQYLPVVMGPLMKTASIKPEVALLDTQDMENMSDDDGWEFVNLGDQQSFGIKTAGLEEKSTACQMLVCYAKELKEGFVEYTEQVVKLMVPLLKFYFHDGVRVAAAESMPLLLECARVRGPEYLTQMWHFMCDALIKAIGTEPDSDVLSEIMHSFAKCIEVMGDGCLNNEHFEELGGILKAKLEEHFKNQELRQVKRQDEDYDEQVEESLQDEDDNDVYILTKVSDILHSIFSSYKEKVLPWFEQLLPLIVNLICPHRPWPDRQWGLCIFDDVIEHCSPASFKYAEYFLRPMLQYVCDNSPEVRQAAAYGLGVMAQYGGDNYRPFCTEALPLLVRVIQSADSKTKENVNATENCISAVGKIMKFKPDCVNVEEVLPHWLSWLPLHEDKEEAVQTFNYLCDLIESNHPIVLGPNNTNLPKIFSIIAEGEMHEAIKHEDPCAKRLANVVRQVQTSGGLWTECIAQLSPEQQAAIQELLNSA

SEQ ID NO: 40067 - protein, 1097 aa, Homo sapiens
  Payload ID: 8164
  Gene Symbol: IPO5
  Gene Name: importin 5
  Uniprot ID: O00410
  ENSP ID: ENSP00000350219
MAAAAAEQQQFYLLLGNLLSPDNVVRKQAEETYENIPGQSKITFLLQAIRNTTAAEEARQMAAVLLRRLLSSAFDEVYPALPSDVQTAIKSELLMIIQMETQSSMRKKVCDIAAELARNLIDEDGNNQWPEGLKFLFDSVSSQNVGLREAALHIFWNFPGIFGNQQQHYLDVIKRMLVQCMQDQEHPSIRTLSARATAAFILANEHNVALFKHFADLLPGFLQAVNDSCYQNDDSVLKSLVEIADTVPKYLRPHLEATLQLSLKLCGDTSLNNMQRQLALEVIVTLSETAAAMLRKHTNIVAQTIPQMLAMMVDLEEDEDWANADELEDDDFDSNAVAGESALDRMACGLGGKLVLPMIKEHIMQMLQNPDWKYRHAGLMALSAIGEGCHQQMEGILNEIVNFVLLFLQDPHPRVRYAACNAVGQMATDFAPGFQKKFHEKVIAALLQTMEDQGNQRVQAHAAAALINFTEDCPKSLLIPYLDNLVKHLHSIMVLKLQELIQKGTKLVLEQVVTSIASVADTAEEKFVPYYDLFMPSLKHIVENAVQKELRLLRGKTIECISLIGLAVGKEKFMQDASDVMQLLLKTQTDFNDMEDDDPQISYMISAWARMCKILGKEFQQYLPVVMGPLMKTASIKPEVALLDTQDMENMSDDDGWEFVNLGDQQSFGIKTAGLEEKSTACQMLVCYAKELKEGFVEYTEQVVKLMVPLLKFYFHDGVRVAAAESMPLLLECARVRGPEYLTQMWHFMCDALIKAIGTEPDSDVLSEIMHSFAKCIEVMGDGCLNNEHFEELGGILKAKLEEHFKNQELRQVKRQDEDYDEQVEESLQDEDDNDVYILTKVSDILHSIFSSYKEKVLPWFEQLLPLIVNLICPHRPWPDRQWGLCIFDDVIEHCSPASFKYAEYFLRPMLQYVCDNSPEVRQAAAYGLGVMAQYGGDNYRPFCTEALPLLVRVIQSADSKTKENVNATENCISAVGKIMKFKPDCVNVEEVLPHWLSWLPLHEDKEEAVQTFNYLCDLIESNHPIVLGPNNTNLPKIFSIIAEGEMHEAIKHEDPCAKRLANVVRQVQTSGGLWTECIAQLSPEQQAAIQELLNSA

SEQ ID NO: 40068 - protein, 182 aa, Homo sapiens
  Payload ID: 8164
  Gene Symbol: IPO5
  Gene Name: importin 5
  ENSP ID: ENSP00000385938
AAAAEQQQFYLLLGNLLSPDNVVRKQAEARQMAAVLLRRLLSSAFDEVYPALPSDVQTAIKSELLMIIQMETQSSMRKKVCDIAAELARNLIDEDGNNQWPEGLKFLFDSVSSQNVGLREAALHIFWNFPGIFGNQQQHYLDVIKRMLVQCMQDQEHPSIRTLSARATAAFILANEHNVALF

SEQ ID NO: 40069 - protein, 106 aa, Homo sapiens
  Payload ID: 8164
  Gene Symbol: IPO5
  Gene Name: importin 5
  ENSP ID: ENSP00000408885
MPEDQVGKLEATENTISAMAAAAAEQQQFYLLLGNLLSPDNVVRKQAEETYENIPGQSKITFLLQAIRNTTAAEEARQMAAVLLRRLLSSAFDEVYPALPSDVQTA

SEQ ID NO: 40070 - protein, 98 aa, Homo sapiens
  Payload ID: 8164
  Gene Symbol: IPO5
  Gene Name: importin 5
  ENSP ID: ENSP00000417162
MPEDQVGKLEATENTISAMAAAAAEQQQFYLLLGNLLSPDNVVRKQAEETYENIPGQSKITFLLQAIRNTTAAEEARQMAAVLLRRLLSSAFDEVYPA

SEQ ID NO: 40071 - protein, 126 aa, Homo sapiens
  Payload ID: 8164
  Gene Symbol: IPO5
  Gene Name: importin 5
  ENSP ID: ENSP00000417647
MAAAAAEQQQFYLLLGNLLSPDNVVRKQAEETYENIPGQSKITFLLQAIRNTTAAEEARQMAAVLLRRLLSSAFDEVYPALPSDVQTAIKSELLMIIQMETQSSMRKKVCDIAAELARNLIASSLG

SEQ ID NO: 40072 - protein, 75 aa, Homo sapiens
  Payload ID: 8164
  Gene Symbol: IPO5
  Gene Name: importin 5
  ENSP ID: ENSP00000417721
MPEDQVGKLEATENTISAMAAAAAEQQQFYLLLGNLLSPDNVVRKQAEETYENIPGQSKITFLLQAIRNTTAAEE

SEQ ID NO: 40073 - protein, 50 aa, Homo sapiens
  Payload ID: 8164
  Gene Symbol: IPO5
  Gene Name: importin 5
  ENSP ID: ENSP00000417993
MPEDQVGKLEATENTISAMAAAAAEQQQFYLLLGNLLSPDNVVRKQAEVT

SEQ ID NO: 40074 - protein, 1097 aa, Homo sapiens; identical to SEQ ID NO: 40067
  Payload ID: 8164
  Gene Symbol: IPO5
  Gene Name: importin 5
  Uniprot ID: O00410
  ENSP ID: ENSP00000418393

SEQ ID NO: 40075 - protein, 77 aa, Homo sapiens
  Payload ID: 8164
  Gene Symbol: IPO5
  Gene Name: importin 5
  ENSP ID: ENSP00000419003
MAAVLLRRLLSSAFDEVYPALPSDVQTAIKSELLMIIQMETQSSMRKKVCDIAAELARNLIDEDGNNQWPEGLKFLF

SEQ ID NO: 40076 - protein, 64 aa, Homo sapiens
  Payload ID: 8164
  Gene Symbol: IPO5
  Gene Name: importin 5
  ENSP ID: ENSP00000419166
MPEDQVGKLEATENTISAMAAAAAEQQQFYLLLGNLLSPDNVVRKQAEETYENIPGQSKITFLL

SEQ ID NO: 40077 - protein, 63 aa, Homo sapiens
  Payload ID: 8164
  Gene Symbol: IPO5
  Gene Name: importin 5
  ENSP ID: ENSP00000419398
MPEDQVGKLEATENTISAMAAAAAEQQQFYLLLGNLLSPDNVVRKQAETDMFEKFETCVALHK

SEQ ID NO: 40078 - protein, 1099 aa, Homo sapiens
  Payload ID: 8164
  Gene Symbol: IPO5
  Gene Name: importin 5
  ENSP ID: ENSP00000419764
  MOD_RES (1)..(1): Any amino acid
XFRPLLPRRLAPVTSPPPLAPTCGRSRRAPVQETYENIPGQSKITFLLQAIRNTTAAEEARQMAAVLLRRLLSSAFDEVYPALPSDVQTAIKSELLMIIQMETQSSMRKKVCDIAAELARNLIDEDGNNQWPEGLKFLFDSVSSQNVGLREAALHIFWNFPGIFGNQQQHYLDVIKRMLVQCMQDQEHPSIRTLSARATAAFILANEHNVALFKHFADLLPGFLQAVNDSCYQNDDSVLKSLVEIADTVPKYLRPHLEATLQLSLKLCGDTSLNNMQRQLALEVIVTLSETAAAMLRKHTNIVAQTIPQMLAMMVDLEEDEDWANADELEDDDFDSNAVAGESALDRMACGLGGKLVLPMIKEHIMQMLQNPDWKYRHAGLMALSAIGEGCHQQMEGILNEIVNFVLLFLQDPHPRVRYAACNAVGQMATDFAPGFQKKFHEKVIAALLQTMEDQGNQRVQAHAAAALINFTEDCPKSLLIPYLDNLVKHLHSIMVLKLQELIQKGTKLVLEQVVTSIASVADTAEEKFVPYYDLFMPSLKHIVENAVQKELRLLRGKTIECISLIGLAVGKEKFMQDASDVMQLLLKTQTDFNDMEDDDPQISYMISAWARMCKILGKEFQQYLPVVMGPLMKTASIKPEVALLDTQDMENMSDDDGWEFVNLGDQQSFGIKTAGLEEKSTACQMLVCYAKELKEGFVEYTEQVVKLMVPLLKFYFHDGVRVAAAESMPLLLECARVRGPEYLTQMWHFMCDALIKAIGTEPDSDVLSEIMHSFAKCIEVMGDGCLNNEHFEELGGILKAKLEEHFKNQELRQVKRQDEDYDEQVEESLQDEDDNDVYILTKVSDILHSIFSSYKEKVLPWFEQLLPLIVNLICPHRPWPDRQWGLCIFDDVIEHCSPASFKYAEYFLRPMLQYVCDNSPEVRQAAAYGLGVMAQYGGDNYRPFCTEALPLLVRVIQSADSKTKENVNATENCISAVGKIMKFKPDCVNVEEVLPHWLSWLPLHEDKEEAVQTFNYLCDLIESNHPIVLGPNNTNLPKIFSIIAEGEMHEAIKHEDPCAKRLANVVRQVQTSGGLWTECIAQLSPEQQAAIQELLNSA

SEQ ID NO: 40079 - protein, 119 aa, Homo sapiens
  Payload ID: 8164
  Gene Symbol: IPO5
  Gene Name: importin 5
  ENSP ID: ENSP00000419766
MPEDQVGKLEATENTISAMAAAAAEQQQFYLLLGNLLSPDNVVRKQAEETYENIPGQSKITFLLQAIRNTTAAEEARQMAAVLLRRLLSSAFDEVYPALPSDVQTAIKSELLMIIQMET

SEQ ID NO: 40080 - protein, 74 aa, Homo sapiens
  Payload ID: 8164
  Gene Symbol: IPO5
  Gene Name: importin 5
  ENSP ID: ENSP00000419797
MAAAAAEQQQFYLLLGNLLSPDNVVRKQAEETYENIPGQSKITFLLQAIRNTTAAEEARQMAAVLLRRLLSSAF

SEQ ID NO: 40081 - protein, 117 aa, Homo sapiens
  Payload ID: 8164
  Gene Symbol: IPO5
  Gene Name: importin 5
  ENSP ID: ENSP00000419860
MPEDQVGKLEATENTISAMAAAAAEQQQFYLLLGNLLSPDNVVRKQAEETYENIPGQSKITFLLQAIRNTTAAEEARQMAAVLLRRLLSSAFDEVYPALPSDVQTAIKSELLMIIQM

SEQ ID NO: 40082 - protein, 128 aa, Homo sapiens
  Payload ID: 8164
  Gene Symbol: IPO5
  Gene Name: importin 5
  ENSP ID: ENSP00000420043
MIWRTFYTKTNRGKKFLREHCSESTAACLQMPEDQVGKLEATENTISAMAAAAAEQQQFYLLLGNLLSPDNVVRKQAEETYENIPGQSKITFLLQAIRNTTAAEEARQMAAVLLRRLLSSAFDEVYPA

SEQ ID NO: 40083 - protein, 170 aa, Homo sapiens
  Payload ID: 8164
  Gene Symbol: IPO5
  Gene Name: importin 5
  ENSP ID: ENSP00000420079
MAAAAAEQQQFYLLLGNLLSPDNVVRKQAEETYENIPGQSKITFLLQAIRNTTAAEEARQMAAVLLRRLLSSAFDEVYPALPSDVQTAIKSELLMIIQMETQSSMRKKVCDIAAELARNLIDEDGNNQWPEGLKFLFDSVSSQNVGLREAALHIFWNFPGIFGNQQQHYL

SEQ ID NO: 40084 - protein, 88 aa, Homo sapiens
  Payload ID: 8164
  Gene Symbol: IPO5
  Gene Name: importin 5
  ENSP ID: ENSP00000420149
MPEDQVGKLEATENTISAMAAAAAEQQQFYLLLGNLLSPDNVVRKQAEETYENIPGQSKITFLLQAIRNTTAAEEARQMAAVLLRRLL

SEQ ID NO: 40085 - protein, 142 aa, Homo sapiens
  Payload ID: 8164
  Gene Symbol: IPO5
  Gene Name: importin 5
  ENSP ID: ENSP00000420284
MPEDQVGKLEATENTISAMAAAAAEQQQFYLLLGNLLSPDNVVRKQAEETYENIPGQSKITFLLQAIRNTTAAEEARQMAAVLLRRLLSSAFDEVYPALPSDVQTAIKSELLMIIQMETQSSMRKKVCDIAAELARNLIGVY

SEQ ID NO: 40086 - protein, 165 aa, Homo sapiens
  Payload ID: 8164
  Gene Symbol: IPO5
  Gene Name: importin 5
  ENSP ID: ENSP00000420491
MCPLFYFSSYKETYENIPGQSKITFLLQAIRNTTAAEEARQMAAVLLRRLLSSAFDEVYPALPSDVQTAIKSELLMIIQMETQSSMRKKVCDIAAELARNLIDEDGNNQWPEGLKFLFDSVSSQNVGLREAALHIFWNFPGIFGNQQQHYLDVIKRMLVQCMQDQ

SEQ ID NO: 40087 - protein, 63 aa, Homo sapiens; identical to SEQ ID NO: 40077
  Payload ID: 8164
  Gene Symbol: IPO5
  Gene Name: importin 5
  ENSP ID: ENSP00000487097

SEQ ID NO: 40088 - protein, 1038 aa, Homo sapiens
  Payload ID: 8165
  Gene Symbol: IPO7
  Gene Name: importin 7
  Uniprot ID: O95373
  ENSP ID: ENSP00000369042
MDPNTIIEALRGTMDPALREAAERQLNEAHKSLNFVSTLLQITMSEQLDLPVRQAGVIYLKNMITQYWPDRETAPGDISPYTIPEEDRHCIRENIVEAIIHSPELIRVQLTTCIHHIIKHDYPSRWTAIVDKIGFYLQSDNSACWLGILLCLYQLVKNYEYKKPEERSPLVAAMQHFLPVLKDRFIQLLSDQSDQSVLIQKQIFKIFYALVQYTLPLELINQQNLTEWIEILKTVVNRDVPNETLQVEEDDRPELPWWKCKKWALHILARLFERYGSPGNVSKEYNEFAEVFLKAFAVGVQQVLLKVLYQYKEKQYMAPRVLQQTLNYINQGVSHALTWKNLKPHIQGIIQDVIFPLMCYTDADEELWQEDPYEYIRMKFDVFEDFISPTTAAQTLLFTACSKRKEVLQKTMGFCYQILTEPNADPRKKDGALHMIGSLAEILLKKKIYKDQMEYMLQNHVFPLFSSELGYMRARACWVLHYFCEVKFKSDQNLQTALELTRRCLIDDREMPVKVEAAIALQVLISNQEKAKEYITPFIRPVMQALLHIIRETENDDLTNVIQKMICEYSEEVTPIAVEMTQHLAMTFNQVIQTGPDEEGSDDKAVTAMGILNTIDTLLSVVEDHKEITQQLEGICLQVIGTVLQQHVLEFYEEIFSLAHSLTCQQVSPQMWQLLPLVFEVFQQDGFDYFTDMMPLLHNYVTVDTDTLLSDTKYLEMIYSMCKKVLTGVAGEDAECHAAKLLEVIILQCKGRGIDQCIPLFVEAALERLTREVKTSELRTMCLQVAIAALYYNPHLLLNTLENLRFPNNVEPVTNHFITQWLNDVDCFLGLHDRKMCVLGLCALIDMEQIPQVLNQVSGQILPAFILLFNGLKRAYACHAEHENDSDDDDEAEDDDETEELGSDEDDIDEDGQEYLEILAKQAGEDGDDEDWEEDDAEETALEGYSTIIDDEDNPVDEYQIFKAIFQTIQNRNPVWYQALTHGLNEEQRKQLQDIATLADQRRAAHESKMIEKHGGYKFSAPVVPSSFNFGGPAPGMN

SEQ ID NO: 40089 - protein, 64 aa, Homo sapiens
  Payload ID: 8165
  Gene Symbol: IPO7
  Gene Name: importin 7
  ENSP ID: ENSP00000433313
MDPNTIIEALRGTMDPALREAAERQLNETEFRSCCPDWSAMAQSRLATTSASRIRAILLPQPLE

SEQ ID NO: 40090 - protein, 130 aa, Homo sapiens
  Payload ID: 8165
  Gene Symbol: IPO7
  Gene Name: importin 7
  ENSP ID: ENSP00000435235
MITQYWPDRETAPGDISPYTIPEEDRHCIRENIVEAIIHSPELIRVQLTTCIHHIIKHDYPSRWTAIVDKIGFYLQSDNSACWLGILLCLYQLVKNYEYKKPEERSPLVAAMQHFLPVLKDRFIQLLSDQ

SEQ ID NO: 40091 - protein, 64 aa, Homo sapiens; identical to SEQ ID NO: 40089
  Payload ID: 8165
  Gene Symbol: IPO7
  Gene Name: importin 7
  ENSP ID: ENSP00000486575

SEQ ID NO: 40092 - protein, 1037 aa, Homo sapiens
  Payload ID: 8166
  Gene Symbol: IPO8
  Gene Name: importin 8
  Uniprot ID: O15397
  ENSP ID: ENSP00000256079
MDLNRIIQALKGTIDPKLRIAAENELNQSYKIINFAPSLLRIIVSDHVEFPVRQAAAIYLKNMVTQYWPDREPPPGEAIFPFNIHENDRQQIRDNIVEGIIRSPDLVRVQLTMCLRAIIKHDFPGHWPGVVDKIDYYLQSQSSASWLGSLLCLYQLVKTYEYKKAEEREPLIIAMQIFLPRIQQQIVQLLPDSSYYSVLLQKQILKIFYALVQYALPLQLVNNQTMTTWMEIFRTIIDRTVPPETLHIDEDDRPELVWWKCKKWALHIVARLFERYGSPGNVTKEYFEFSEFFLKTYAVGIQQVLLKILDQYRQKEYVAPRVLQQAFNYLNQGVVHSITWKQMKPHIQNISEDVIFSVMCYKDEDEELWQEDPYEYIRMKFDIFEDYASPTTAAQTLLYTAAKKRKEVLPKMMAFCYQILTDPNFDPRKKDGALHVIGSLAEILLKKSLFKDQMELFLQNHVFPLLLSNLGYLRARSCWVLHAFSSLKFHNELNLRNAVELAKKSLIEDKEMPVKVEAALALQSLISNQIQAKEYMKPHVRPIMQELLHIVRETENDDVTNVIQKMICEYSQEVASIAVDMTQHLAEIFGKVLQSDEYEEVEDKTVMAMGILHTIDTILTVVEDHKEITQQLENICLRIIDLVLQKHVIEFYEEILSLAYSLTCHSISPQMWQLLGILYEVFQQDCFEYFTDMMPLLHNYVTIDTDTLLSNAKHLEILFTMCRKVLCGDAGEDAECHAAKLLEVIILQCKGRGIDQCIPLFVQLVLERLTRGVKTSELRTMCLQVAIAALYYNPDLLLHTLERIQLPHNPGPITVQFINQWMNDTDCFLGHHDRKMCIIGLSILLELQNRPPAVDAVVGQIVPSILFLFLGLKQVCATRQLVNREDRSKAEKADMEENEEISSDEEETNVTAQAMQSNNGRGEDEEEEDDDWDEEVLEETALEGFSTPLDLDNSVDEYQFFTQALITVQSRDAAWYQLLMAPLSEDQRTALQEVYTLAEHRRTVAEAKKKIEQQGGFTFENKGVLSAFNFGTVPSNN

SEQ ID NO: 40093 - protein, 84 aa, Homo sapiens
  Payload ID: 8166
  Gene Symbol: IPO8
  Gene Name: importin 8
  ENSP ID: ENSP00000439413
MLMLSGNTSAKYFFSFACGQSKVFLLPSSVLTAAIYLKNMVTQYWPDREPPPGEAIFPFNIHENDRQQIRDNIVEGIIRSPDLV

SEQ ID NO: 40094 - protein, 167 aa, Homo sapiens
  Payload ID: 8166
  Gene Symbol: IPO8
  Gene Name: importin 8
  ENSP ID: ENSP00000439556
MSVACSMFCTEWMWRQYPSSATHSTAEYALPLQLVNNQTMTTWMEIFRTIIDRTVPPETLHIDEDDRPELVWWKCKKWALHIVARLFERYGSPGNVTKEYFEFSEFFLKTYAVGIQQVLLKILDQYRQKEYVAPRVLQQAFNYLNQGVVHSITWKQMKPHIQNISED

SEQ ID NO: 40095 - protein, 151 aa, Homo sapiens
  Payload ID: 8166
  Gene Symbol: IPO8
  Gene Name: importin 8
  ENSP ID: ENSP00000440979
MVTQYWPDREPPPGEAIFPFNIHENDRQQIRDNIVEGIIRSPDLVRVQLTMCLRAIIKHDFPGHWPGVVDKIDYYLQSQSSASWLGSLLCLYQLVKTYEYKKAEEREPLIIAMQIFLPRIQQQIVQLLPDSSYYSVLLQKQILKIFYALVQ

SEQ ID NO: 40096 - protein, 35 aa, Homo sapiens
  Payload ID: 8166
  Gene Symbol: IPO8
  Gene Name: importin 8
  ENSP ID: ENSP00000443789
MDLNRIIQALKGTIDPKLRIAAENELNQFTSDYSL

SEQ ID NO: 40097 - protein, 33 aa, Homo sapiens
  Payload ID: 8166
  Gene Symbol: IPO8
  Gene Name: importin 8
  ENSP ID: ENSP00000444050
MVTQYWPDREPPPGEAIFPFNIHENDRQQIRDN

SEQ ID NO: 40098 - protein, 832 aa, Homo sapiens
  Payload ID: 8166
  Gene Symbol: IPO8
  Gene Name: importin 8
  Uniprot ID: O15397
  ENSP ID: ENSP00000444520
MESLTLKGYALPLQLVNNQTMTTWMEIFRTIIDRTVPPETLHIDEDDRPELVWWKCKKWALHIVARLFERYGSPGNVTKEYFEFSEFFLKTYAVGIQQVLLKILDQYRQKEYVAPRVLQQAFNYLNQGVVHSITWKQMKPHIQNISEDVIFSVMCYKDEDEELWQEDPYEYIRMKFDIFEDYASPTTAAQTLLYTAAKKRKEVLPKMMAFCYQILTDPNFDPRKKDGALHVIGSLAEILLKKSLFKDQMELFLQNHVFPLLLSNLGYLRARSCWVLHAFSSLKFHNELNLRNAVELAKKSLIEDKEMPVKVEAALALQSLISNQIQAKEYMKPHVRPIMQELLHIVRETENDDVTNVIQKMICEYSQEVASIAVDMTQHLAEIFGKVLQSDEYEEVEDKTVMAMGILHTIDTILTVVEDHKEITQQLENICLRIIDLVLQKHVIEFYEEILSLAYSLTCHSISPQMWQLLGILYEVFQQDCFEYFTDMMPLLHNYVTIDTDTLLSNAKHLEILFTMCRKVLCGDAGEDAECHAAKLLEVIILQCKGRGIDQCIPLFVQLVLERLTRGVKTSELRTMCLQVAIAALYYNPDLLLHTLERIQLPHNPGPITVQFINQWMNDTDCFLGHHDRKMCIIGLSILLELQNRPPAVDAVVGQIVPSILFLFLGLKQVCATRQLVNREDRSKAEKADMEENEEISSDEEETNVTAQAMQSNNGRGEDEEEEDDDWDEEVLEETALEGFSTPLDLDNSVDEYQFFTQALITVQSRDAAWYQLLMAPLSEDQRTALQEVYTLAEHRRTVAEAKKKIEQQGGFTFENKGVLSAFNFGTVPSNN

SEQ ID NO: 40099 - protein, 167 aa, Homo sapiens
  Payload ID: 8166
  Gene Symbol: IPO8
  Gene Name: importin 8
  ENSP ID: ENSP00000446232
  MOD_RES (1)..(1): Any amino acid
XLLELQNRPPAVDAVVGQIVPSILFLFLGLKQVCATRQLVNREDRSKAEKADMEENEEISSDEEETNVTAQAMQSNNGRGEDEEEEDDDWDEEVLEETALEGFSTPLDLDNSVDEYQFFTQALITVQSRDAAWYQLLMAPLSEDQRTALQEVYTLAEHRRTVAGQPE

SEQ ID NO: 40100 - protein, 46 aa, Homo sapiens
  Payload ID: 8166
  Gene Symbol: IPO8
  Gene Name: importin 8
  ENSP ID: ENSP00000446254
MVILLYLRHIKSYKIINFAPSLLRIIVSDHVEFPVRQAAAIYLKNM

SEQ ID NO: 40101 - protein, 142 aa, Homo sapiens
  Payload ID: 8166
  Gene Symbol: IPO8
  Gene Name: importin 8
  ENSP ID: ENSP00000481026
  MOD_RES (1)..(1): Any amino acid
XVQLTMCLRAIIKHDFPGHWPGVVDKIDYYLQSQSSASWLGSLLCLYQLVKTYEYKKAEEREPLIIAMQIFLPRIQQQIVQLLPDSSYYSVLLQKQILKIFYALVQVGFYCRKQTWSPVFLPDTWKVLNKCHLLLKIILYYP

SEQ ID NO: 40102 - protein, 1041 aa, Homo sapiens
  Payload ID: 8167
  Gene Symbol: IPO9
  Gene Name: importin 9
  Uniprot ID: Q96P70
  ENSP ID: ENSP00000354742
MAAAAAAGAASGLPGPVAQGLKEALVDTLTGILSPVQEVRAAAEEQIKVLEVTEEFGVHLAELTVDPQGALAIRQLASVILKQYVETHWCAQSEKFRPPETTERAKIVIRELLPNGLRESISKVRSSVAYAVSAIAHWDWPEAWPQLFNLLMEMLVSGDLNAVHGAMRVLTEFTREVTDTQMPLVAPVILPEMYKIFTMAEVYGIRTRSRAVEIFTTCAHMICNMEELEKGAAKVLIFPVVQQFTEAFVQALQIPDGPTSDSGFKMEVLKAVTALVKNFPKHMVSSMQQILPIVWNTLTESAAFYVRTEVNYTEEVEDPVDSDGEVLGFENLVFSIFEFVHALLENSKFKSTVKKALPELIYYIILYMQITEEQIKVWTANPQQFVEDEDDDTFSYTVRIAAQDLLLAVATDFQNESAAALAAAATRHLQEAEQTKNSGTEHWWKIHEACMLALGSVKAIITDSVKNGRIHFDMHGFLTNVILADLNLSVSPFLLGRALWAASRFTVAMSPELIQQFLQATVSGLHETQPPSVRISAVRAIWGYCDQLKVSESTHVLQPFLPSILDGLIHLAAQFSSEVLNLVMETLCIVCTVDPEFTASMESKICPFTIAIFLKYSNDPVVASLAQDIFKELSQIEACQGPMQMRLIPTLVSIMQAPADKIPAGLCATAIDILTTVVRNTKPPLSQLLICQAFPAVAQCTLHTDDNATMQNGGECLRAYVSVTLEQVAQWHDEQGHNGLWYVMQVVSQLLDPRTSEFTAAFVGRLVSTLISKAGRELGENLDQILRAILSKMQQAETLSVMQSLIMVFAHLVHTQLEPLLEFLCSLPGPTGKPALEFVMAEWTSRQHLFYGQYEGKVSSVALCKLLQHGINADDKRLQDIRVKGEEIYSMDEGIRTRSKSAKNPERWTNIPLLVKILKLIINELSNVMEANAARQATPAEWSQDDSNDMWEDQEEEEEEEEDGLAGQLLSDILATSKYEEDYYEDDEEDDPDALKDPLYQIDLQAYLTDFLCQFAQQPCYIMFSGHLNDNERRVLQTIGI

SEQ ID NO: 40103 - protein, 155 aa, Homo sapiens
  Payload ID: 8167
  Gene Symbol: IPO9
  Gene Name: importin 9
  ENSP ID: ENSP00000387761
SNVMEANAARQATPAEWSQDDSNDMWEDQEEEEEEEEDGLAGQLLSDILATSKYEEDYYEDDEEDDPDALKDPLYQIDLQATLMTMRGEFYRPSASKKGSLSTFAPSGPAANHFAALTGLEMHFLLNLKWHLDPWPLASAVTLMTIQTRLTGAVT

SEQ ID NO: 40104 - protein, 452 aa, Homo sapiens
  Payload ID: 8168
  Gene Symbol: INADL
  Gene Name: InaD-like (Drosophila)
  ENSP ID: ENSP00000307496
MVQGGFPEKIRQRYADLPGELHIIELEKDKNGLGLSLAGNKDRSRMSIFVVGINPEGPAAADGRMRIGDELLEINNQILYGRSHQNASAIIKTAPSKVKLVFIRNEDAVNQMAVTPFPVPSSSPSSIEDQSGTEPISSEEDGSVEVGIKQLPESESFKLAVSQMKQQKYPTKVSFSSQEIPLAPASSYHSTDADFTGYGGFQAPLSVDPATCPIVPGQEMIIEISKGRSGLGLSIVGGKDTPLFWRLGSPRAWSQHLVRAFMLHHPVTEVEGQNAIVIHEVYEEGAAARDGRLWAGDQILEVNGVDLRNSSHEEAITALRQTPQKVRLVVYRDEAHYRDEENLEIFPVDLQKKAGRGLGLSIVGKRNGSGVFISDIVKGGAADLDGRLIQGDQILSVNGEDMRNASQETVATILKCAQGLVQLEIGRLRAGSWTSARTTSQNSQVVDGFSSD

SEQ ID NO: 40105 - protein, 1181 aa, Homo sapiens
  Payload ID: 8168
  Gene Symbol: INADL
  Gene Name: InaD-like (Drosophila)
  Uniprot ID: Q8NI35
  ENSP ID: ENSP00000326199
MPENPATDKLQVLQVLDRLKMKLQEKGDTSQNEKLSMFYETLKSPLFNQILTLQQSIKQLKGQLNHIPSDCSANFDFSRKGLLVFTDGSITNGNVHRPSNNSTVSGLFPWTPKLGNEDFNSVIQQMAQGRQIEYIDIERPSTGGLGFSVVALRSQNLGKVDIFVKDVQPGSVADRDQRLKENDQILAINHTPLDQNISHQQAIALLQQTTGSLRLIVAREPVHTKSSTSSSLNDTTLPETVCWGHVEEVELINDGSGLGFGIVGGKTSGVVVRTIVPGGLADRDGRLQTGDHILKIGGTNVQGMTSEQVAQVLRNCGNSVRMLVARDPAGDISVTPPAPAALPVALPTVASKGPGSDSSLFETYNVELVRKDGQSLGIRIVGYVGTSHTGEASGIYVKSIIPGSAAYHNGHIQVNDKIVAVDGVNIQGFANHDVVEVLRNAGQVVHLTLVRRKTSSSTSPLEPPSDRGTVVEPLKPPALFLTGAVETETNVDGEDEEIKERIDTLKNDNIQALEKLEKVPDSPENELKSRWENLLGPDYEVMVATLDTQIADDAELQKYSKLLPIHTLRLGVEVDSFDGHHYISSIVSGGPVDTLGLLQPEDELLEVNGMQLYGKSRREAVSFLKEVPPPFTLVCCRRLFDDEASVDEPRRTETSLPETEVDHNMDVNTEEDDDGELALWSPEVKIVELVKDCKGLGFSILDYQDPLDPTRSVIVIRSLVADGVAERSGGLLPGDRLVSVNEYCLDNTSLAEAVEILKAVPPGLVHLGICKPLVEDNEEESCYILHSSSNEDKTEFSGTIHDINSSLILEAPKGFRDEPYFKEELVDEPFLDLGKSFHSQQKEIEQSKEAWEMHEFLTPRLQEMDEEREILVDEEYELYQDPSPSMELYPLSHIQEATPVPSVNELHFGTQWLHDNEPSESQEARTGRTVYSQEAQPYGYCPENVMKENFVMESLPSVPSTEGNSQQGRFDDLENLNSLAKTSLDLGMIPNDVQGPSLLIDLPVVAQRREQEDLPLYQHQATRVISKASAYTGMLSSRYATDTCELPEREEGEGEETPNFSHWGPPRIVEIFREPNVSLGISIVGGQTVIKRLKNGEELKGIFIKQVLEDSPAGKTNALKTGDKILEVSGVDLQNASHSEAVEAIKNAGNPVVFIVQSLSSTPPWTTERDSVSKKKKRKER

SEQ ID NO: 40106 - protein, 1801 aa, Homo sapiens
  Payload ID: 8168
  Gene Symbol: INADL
  Gene Name: InaD-like (Drosophila)
  Uniprot ID: Q8NI35
  ENSP ID: ENSP00000360200
MPENPATDKLQVLQVLDRLKMKLQEKGDTSQNEKLSMFYETLKSPLFNQILTLQQSIKQLKGQLNHIPSDCSANFDFSRKGLLVFTDGSITNGNVHRPSNNSTVSGLFPWTPKLGNEDFNSVIQQMAQGRQIEYIDIERPSTGGLGFSVVALRSQNLGKVDIFVKDVQPGSVADRDQRLKENDQILAINHTPLDQNISHQQAIALLQQTTGSLRLIVAREPVHTKSSTSSSLNDTTLPETVCWGHVEEVELINDGSGLGFGIVGGKTSGVVVRTIVPGGLADRDGRLQTGDHILKIGGTNVQGMTSEQVAQVLRNCGNSVRMLVARDPAGDISVTPPAPAALPVALPTVASKGPGSDSSLFETYNVELVRKDGQSLGIRIVGYVGTSHTGEASGIYVKSIIPGSAAYHNGHIQVNDKIVAVDGVNIQGFANHDVVEVLRNAGQVVHLTLVRRKTSSSTSPLEPPSDRGTVVEPLKPPALFLTGAVETETNVDGEDEEIKERIDTLKNDNIQALEKLEKVPDSPENELKSRWENLLGPDYEVMVATLDTQIADDAELQKYSKLLPIHTLRLGVEVDSFDGHHYISSIVSGGPVDTLGLLQPEDELLEVNGMQLYGKSRREAVSFLKEVPPPFTLVCCRRLFDDEASVDEPRRTETSLPETEVDHNMDVNTEEDDDGELALWSPEVKIVELVKDCKGLGFSILDYQDPLDPTRSVIVIRSLVADGVAERSGGLLPGDRLVSVNEYCLDNTSLAEAVEILKAVPPGLVHLGICKPLVEDNEEESCYILHSSSNEDKTEFSGTIHDINSSLILEAPKGFRDEPYFKEELVDEPFLDLGKSFHSQQKEIEQSKEAWEMHEFLTPRLQEMDEEREILVDEEYELYQDPSPSMELYPLSHIQEATPVPSVNELHFGTQWLHDNEPSESQEARTGRTVYSQEAQPYGYCPENVMKENFVMESLPSVPSTEGNSQQGRFDDLENLNSLAKTSLDLGMIPNDVQGPSLLIDLPVVAQRREQEDLPLYQHQATRVISKASAYTGMLSSRYATDTCELPEREEGEGEETPNFSHWGPPRIVEIFREPNVSLGISIVGGQTVIKRLKNGEELKGIFIKQVLEDSPAGKTNALKTGDKILEVSGVDLQNASHSEAVEAIKNAGNPVVFIVQSLSSTPRVIPNVHNKANKITGNQNQDTQEKKEKRQGTAPPPMKLPPPYKALTDDSDENEEEDAFTDQKIRQRYADLPGELHIIELEKDKNGLGLSLAGNKDRSRMSIFVVGINPEGPAAADGRMRIGDELLEINNQILYGRSHQNASAIIKTAPSKVKLVFIRNEDAVNQMAVTPFPVPSSSPSSIEDQSGTEPISSEEDGSVEVGIKQLPESESFKLAVSQMKQQKYPTKVSFSSQEIPLAPASSYHSTDADFTGYGGFQAPLSVDPATCPIVPGQEMIIEISKGRSGLGLSIVGGKDTPLNAIVIHEVYEEGAAARDGRLWAGDQILEVNGVDLRNSSHEEAITALRQTPQKVRLVVYRDEAHYRDEENLEIFPVDLQKKAGRGLGLSIVGKRNGSGVFISDIVKGGAADLDGRLIQGDQILSVNGEDMRNASQETVATILKCAQGLVQLEIGRLRAGSWTSARTTSQNSQGSQQSAHSSCHPSFAPVITGLQNLVGTKRVSDPSQKNSGTDMEPRTVEINRELSDALGISIAGGRGSPLGDIPVFIAMIQASGVAARTQKLKVGDRIVSINGQPLDGLSHADVVNLLKNAYGRIILQVVADTNISAIAAQLENMSTGYHLGSPTAEHHPEDTEEQLQMTAD

SEQ ID NO: 40107 - protein, 1134 aa, Homo sapiens
  Payload ID: 8168
  Gene Symbol: INADL
  Gene Name: InaD-like (Drosophila)
  Uniprot ID: Q8NI35
  ENSP ID: ENSP00000433669
MVATLDTQIADDAELQKYSKLLPIHTLRLGVEVDSFDGHHYISSIVSGGPVDTLGLLQPEDELLEVNGMQLYGKSRREAVSFLKEVPPPFTLVCCRRLFDDEASVDEPRRTETSLPETEVDHNMDVNTEEDDDGELALWSPEVKIVELVKDCKGLGFSILDYQDPLDPTRSVIVIRSLVADGVAERSGGLLPGDRLVSVNEYCLDNTSLAEAVEILKAVPPGLVHLGICKPLVEDNEEESCYILHSSSNEDKTEFSGTIHDINSSLILEAPKGFRDEPYFKEELVDEPFLDLGKSFHSQQKEIEQSKEAWEMHEFLTPRLQEMDEEREILVDEEYELYQDPSPSMELYPLSHIQEATPVPSVNELHFGTQWLHDNEPSESQEARTGRTVYSQEAQPYGYCPENVMKENFVMESLPSVPSTEGNSQQGRFDDLENLNSLAKTSLDLGMIPNDVQGPSLLIDLPVVAQRREQEDLPLYQHQATRVISKASAYTGMLSSRYATDTCELPEREEGEGEETPNFSHWGPPRIVEIFREPNVSLGISIVGGQTVIKRLKNGEELKGIFIKQVLEDSPAGKTNALKTGDKILEVSGVDLQNASHSEAVEAIKNAGNPVVFIVQSLSSTPRVIPNVHNKANKITGNQNQDTQEKKEKRQGTAPPPMKLPPPYKALTDDSDENEEEDAFTDQKIRQRYADLPGELHIIELEKDKNGLGLSLAGNKDRSRMSIFVVGINPEGPAAADGRMRIGDELLEINNQILYGRSHQNASAIIKTAPSKVKLVFIRNEDAVNQMAVTPFPVPSSSPSSIEDQSGTEPISSEEDGSVEVGIKQLPESESFKLAVSQMKQQKYPTKVSFSSQEIPLAPASSYHSTDADFTGYGGFQAPLSVDPATCPIVPGQEMIIEISKGRSGLGLSIVGGKDTPLNAIVIHEVYEEGAAARDGRLWAGDQILEVNGVDLRNSSHEEAITALRQTPQKVRLVVYRDEAHYRDEENLEIFPVDLQKKAGRGLGLSIVGKRNGSGVFISDIVKGGAADLDGRLIQGDQILSVNGEDMRNASQETVATILKCAQGLVQLEIGRLRAGSWTSARTTSQNSQSAECTQQLSSLLRSCHHWPAKPGWHKKSFRSFPEKFRHRYGTKDC

SEQ ID NO: 40108 - protein, 1182 aa, Homo sapiens
  Payload ID: 8168
  Gene Symbol: INADL
  Gene Name: InaD-like (Drosophila)
  ENSP ID: ENSP00000479041
MPENPATDKLQVLQVLDRLKMKLQEKGDTSQNEKLSMFYETLKSPLFNQILTLQQSIKQLKGQLNHIPSDCSANFDFSRKGLLVFTDGSITNGNVHRPSNNSTVSGLFPWTPKLGNEDFNSVIQQMAQGRQIEYIDIERPSTGGLGFSVVALRSQNLGKVDIFVKDVQPGSVADRDQRLKENDQILAINHTPLDQNISHQQAIALLQQTTGSLRLIVAREPVHTKSSTSSSLNDTTLPETVCWGHVEEVELINDGSGLGFGIVGGKTSGVVVRTIVPGGLADRDGRLQTGDHILKIGGTNVQGMTSEQVAQVLRNCGNSVRMLVARDPAGDISVTPPAPAALPVALPTVASKGPGSDSSLFETYNVELVRKDGQSLGIRIVGYVGTSHTGEASGIYVKSIIPGSAAYHNGHIQVNDKIVAVDGVNIQGFANHDVVEVLRNAGQVVHLTLVRRKTSSSTSPLEPPSDRGTVVEPLKPPALFLTGAVETETNVDGEDEEIKERIDTLKNDNIQALEKLEKVPDSPENELKSRWENLLGPDYEVMVATLDTQIADDAELQKYSKLLPIHTLRLGVEVDSFDGHHYISSIVSGGPVDTLGLLQPEDELLEVNGMQLYGKSRREAVSFLKEVPPPFTLVCCRRLFDDEASVDEPRRTETSLPETEVDHNMDVNTEEDDDGELALWSPEVKIVELVKDCKGLGFSILDYQDPLDPTRSVIVIRSLVADGVAERSGGLLPGDRLVSVNEYCLDNTSLAEAVEILKAVPPGLVHLGICKPLVEDNEEESCYILHSSSNEDKTEFSGTIHDINSSLILEAPKGFRDEPYFKEELVDEPFLDLGKSFHSQQKEIEQSKEAWEMHEFLTPRLQEMDEEREILVDEEYELYQDPSPSMELYPLSHIQEATPVPSVNELHFGTQWLHDNEPSESQEARTGRTVYSQEAQPYGYCPENVMKENFVMESLPSVPSTEGNSQQGRFDDLENLNSLAKTSLDLGMIPNDVQGPSLLIDLPVVAQRREQEDLPLYQHQATRVISKASAYTGMLSSRYATDTCELPEREEGEGEETPNFSHWGPPRIVEIFREPNVSLGISIVGGQTVIKRLKNGEELKGIFIKQVLEDSPAGKTNALKTGDKILEASGVDKELCNQFVSPAEGRKIATWEVCSEPSSCHSTPAWVTEQDSVSKKKKNHEG

SEQ ID NO: 40109 - protein, 139 aa, Homo sapiens
  Payload ID: 8168
  Gene Symbol: INADL
  Gene Name: InaD-like (Drosophila)
  ENSP ID: ENSP00000489130
  MOD_RES (1)..(1): Any amino acid
XAITALRQTPQKVRLVVYRDEAHYRDEENLEIFPVDLQKKAGRGLGLSIVGKRNGSGVFISDIVKGGAADLDGRLIQGDQILSVNGEDMRNASQETVATILKCAQGLVQLEIGRLRAGSWTSARTTSQNSQVVDGFSSD

SEQ ID NO: 40110 - protein, 593 aa, Homo sapiens
  Payload ID: 8168
  Gene Symbol: INADL
  Gene Name: InaD-like (Drosophila)
  ENSP ID: ENSP00000489159
MVQGGFPEKIRQRYADLPGELHIIELEKDKNGLGLSLAGNKDRSRMSIFVVGINPEGPAAADGRMRIGDELLEINNQILYGRSHQNASAIIKTAPSKVKLVFIRNEDAVNQMAVTPFPVPSSSPSSIEDQSGTEPISSEEDGSVEVGIKQLPESESFKLAVSQMKQQKYPTKVSFSSQEIPLAPASSYHSTDADFTGYGGFQAPLSVDPATCPIVPGQEMIIEISKGRSGLGLSIVGGKDTPLNAIVIHEVYEEGAAARDGRLWAGDQILEVNGVDLRNSSHEEAITALRQTPQKVRLVVYRDEAHYRDEENLEIFPVDLQKKAGRGLGLSIVGKRNGSGVFISDIVKGGAADLDGRLIQGDQILSVNGEDMRNASQETVATILKCAQGLVQLEIGRLRAGSWTSARTTSQNSQGSQQSAHSSCHPSFAPVITGLQNLVGTKRVSDPSQKNSGTDMEPRTVEINRELSDALGISIAGGRGSPLGDIPVFIAMIQASGVAARTQKLKVGDRIVSINGQPLDGLSHADVVNLLKNAYGRIILQVVADTNISAIAAQLENMSTGYHLGSPTAEHHPEDTERCCNCPMDSPCPLLLG

SEQ ID NO: 40111 - protein, 146 aa, Homo sapiens
  Payload ID: 8168
  Gene Symbol: INADL
  Gene Name: InaD-like (Drosophila)
  ENSP ID: ENSP00000489200
  MOD_RES (1)..(1): Any amino acid
XVQSLSSTPRVIPNVHNKANKITGNQNQDTQEKKEKRQGTAPPPMKLPPPYKALTDDSDENEEEDAFTDQKIRQRYADLPGELHIIELEKDKNGLGLSLAGNKDRSRMSIFVVGINPEGPAAADGRMRIGDELLETLTQNRIYSHP

SEQ ID NO: 40112 - protein, 683 aa, Homo sapiens
  Payload ID: 8168
  Gene Symbol: INADL
  Gene Name: InaD-like (Drosophila)
  ENSP ID: ENSP00000489335
MPENPATDKLQVLQVLDRLKMKLQEKGDTSQNEKLSMFYETLKSPLFNQILTLQQSIKQLKGQLNHIPSDCSANFDFSRKGLLVFTDGSITNGNVHRPSNNSTVSGLFPWTPKLGNEDFNSVIQQMAQGRQIEYIDIERPSTGGLGFSVVALRSQNLGKVDIFVKDVQPGSVADRDQRLKENDQILAINHTPLDQNISHQQAIALLQQTTGSLRLIVAREPVHTKSSTSSSLNDTTLPETVCWGHVEEVELINDGSGLGFGIVGGKTSGVVVRTIVPGGLADRDGRLQTGDHILKIGGTNVQGMTSEQVAQVLRNCGNSVRMLVARDPAGDISVTPPAPAALPVALPTVASKGPGSDSSLFETYNVELVRKDGQSLGIRIVGYVGTSHTGEASGIYVKSIIPGSAAYHNGHIQVNDKIVAVDGVNIQGFANHDVVEVLRNAGQVVHLTLVRRKTSSSTSPLEPPSDRGTVVEPLKPPALFLTGAVETETNVDGEDEEIKERIDTLKNDNIQALEKLEKVPDSPENELKSRWENLLGPDYEVMVATLDTQIADDAELQKYSKLLPIHTLRLGVEVDSFDGHHYISSIVSGGPVDTLGLLQPEDELLEVNGMQLYGKSRREAVSFLKEVPPPFTLVCCRRLFDDEASVDEPRRTETSLPETENSLKYKRLTTIWMSILKKMMMGN

SEQ ID NO: 40113 - protein, 111 aa, Homo sapiens
  Payload ID: 8168
  Gene Symbol: INADL
  Gene Name: InaD-like (Drosophila)
  ENSP ID: ENSP00000489475
QEKKEKRQGTAPPPMKLPPPYKALTDDSDENEEEDAFTDQKIRQRYADLPGELHIIELEKDKNGLGLSLAGNKDRSRMSIFVVGINPEGPAAADGRMRIGDELLEVRSMCF

SEQ ID NO: 40114 - protein, 142 aa, Homo sapiens
  Payload ID: 8169
  Gene Symbol: INAFM1
  Gene Name: InaF-motif containing 1
  Uniprot ID: C9JVW0
  ENSP ID: ENSP00000447679
MRGTSCVGGGAESPGGAGLSEGPRGRWLRLAPVCAYFLCVSLAAVLLAVYYGLIWVPTRSPAAPAGPQPSAPSPPCAARPGVPPVPAPAAASLSCLLGVPGGPRPQLQLPLSRRRRYSDPDRRPSRQTPRETPEAAEGRRPG

SEQ ID NO: 40115 - protein, 360 aa, Homo sapiens
  Payload ID: 8170
  Gene Symbol: IST1
  Gene Name: increased sodium tolerance 1 homolog (yeast)
  Uniprot ID: P53990
  ENSP ID: ENSP00000330408
MLGSGFKAERLRVNLRLVINRLKLLEKKKTELAQKARKEIADYLAAGKDERARIRVEHIIREDYLVEAMEILELYCDLLLARFGLIQSMKELDSGLAESVSTLIWAAPRLQSEVAELKIVADQLCAKYSKEYGKLCRTNQIGTVNDRLMHKLSVEAPPKILVERYLIEIAKNYNVPYEPDSVVMAEAPPGVETDLIDVGFTDDVKKGGPGRGGSGGFTAPVGGPDGTVPMPMPMPMPMPSANTPFSYPLPKGPSDFNGLPMGTYQAFPNIHPPQIPATPPSYESMTLMLIRISLLHRLLVLDPSQKPLQSFLPDLQITMTTLSYQSCHLCQTHYQLHLLVPAPQHLKTLTLMIFPGGLKS

SEQ ID NO: 40116 - protein, 335 aa, Homo sapiens
  Payload ID: 8170
  Gene Symbol: IST1
  Gene Name: increased sodium tolerance 1 homolog (yeast)
  Uniprot ID: P53990
  ENSP ID: ENSP00000368075
MLGSGFKAERLRVNLRLVINRLKLLEKKKTELAQKARKEIADYLAAGKDERARIRVEHIIREDYLVEAMEILELYCDLLLARFGLIQSMKELDSGLAESVSTLIWAAPRLQSEVAELKIVADQLCAKYSKEYGKLCRTNQIGTVNDRLMHKLSVEAPPKILVERYLIEIAKNYNVPYEPDSVVMAEAPPGVETDLIDVGFTDDVKKGGPGRGGSGGFTAPVGGPDGTVPMPMPMPMPMPSANTPFSYPLPKGPVDDINADKNISSAQIVGPGPKPEASAKLPSRPADNYDNFVLPELPSVPDTLPTASAGASTSASEDIDFDDLSRRFEELKKKT

SEQ ID NO: 40117 - protein, 366 aa, Homo sapiens
  Payload ID: 8170
  Gene Symbol: IST1
  Gene Name: increased sodium tolerance 1 homolog (yeast)
  Uniprot ID: P53990
  ENSP ID: ENSP00000368076
MLGSGFKAERLRVNLRLVINRLKLLEKKKTELAQKARKEIADYLAAGKDERARIRVEHIIREDYLVEAMEILELYCDLLLARFGLIQSMKELDSGLAESVSTLIWAAPRLQSEVAELKIVADQLCAKYSKEYGKLCRTNQIGTVNDRLMHKLSVEAPPKILVERYLIEIAKNYNVPYEPDSVVMAEAPPGVETDLIDVGFTDDVKKGGPGRGGSGGFTAPVGGPDGTVPMPMPMPMPMPSANTPFSYPLPKGPSDFNGLPMGTYQAFPNIHPPQIPATPPSYESVDDINADKNISSAQIVGPGPKPEASAKLPSRPADNYDNFVLPELPSVPDTLPTASAGASTSASEDIDFDDLSRRFEELKKKT

SEQ ID NO: 40118 - protein, 141 aa, Homo sapiens
  Payload ID: 8170
  Gene Symbol: IST1
  Gene Name: increased sodium tolerance 1 homolog (yeast)
  ENSP ID: ENSP00000398505
MLGSGFKAERLRVNLRLVINRLKLLEKKKTELAQKARKEIADYLAAGKDERARIRVEHIIREDYLVEAMEILELYCDLLLARFGLIQSMKELDSGLAESVSTLIWAAPRLQSEVAELKILCAKYSKEYGKLCRTNQIGTVN

SEQ ID NO: 40119 - protein, 41 aa, Homo sapiens
  Payload ID: 8170
  Gene Symbol: IST1
  Gene Name: increased sodium tolerance 1 homolog (yeast)
  ENSP ID: ENSP00000410081
MLGSGFKAERLRVNLRLVINRLKLLEKKKSRSSSWGRDRSY

SEQ ID NO: 40120 - protein, 289 aa, Homo sapiens
  Payload ID: 8170
  Gene Symbol: IST1
  Gene Name: increased sodium tolerance 1 homolog (yeast)
  ENSP ID: ENSP00000414942
DYLVEAMEILELYCDLLLARFGLIQSMKELDSGLAESVSTLIWAAPRLQSEVAELKIVADQLCAKYSKEYGKLCRTNQIGTVNDRLMHKLSVEAPPKILVERYLIEIAKNYNVPYEPDSVVMAEAPPGVETDLIDVGFTDDVKKGGPGRGGSGGFTAPVGGPDGTVPMPMPMPMPMPSANTPFSYPLPKGPSDFNGLPMGTYQAFPNIHPPQIPATPPSYESVSPGPKPEASAKLPSRPADNYDNFVLPELPSVPDTLPTASAGASTSASEDIDFDDLSRRFEELKKKT

SEQ ID NO: 40121 - protein, 379 aa, Homo sapiens
  Payload ID: 8170
  Gene Symbol: IST1
  Gene Name: increased sodium tolerance 1 homolog (yeast)
  Uniprot ID: P53990
  ENSP ID: ENSP00000438399
MVFKLKTKEEQHSMLGSGFKAERLRVNLRLVINRLKLLEKKKTELAQKARKEIADYLAAGKDERARIRVEHIIREDYLVEAMEILELYCDLLLARFGLIQSMKELDSGLAESVSTLIWAAPRLQSEVAELKIVADQLCAKYSKEYGKLCRTNQIGTVNDRLMHKLSVEAPPKILVERYLIEIAKNYNVPYEPDSVVMAEAPPGVETDLIDVGFTDDVKKGGPGRGGSGGFTAPVGGPDGTVPMPMPMPMPMPSANTPFSYPLPKGPSDFNGLPMGTYQAFPNIHPPQIPATPPSYESVDDINADKNISSAQIVGPGPKPEASAKLPSRPADNYDNFVLPELPSVPDTLPTASAGASTSASEDIDFDDLSRRFEELKKKT

SEQ ID NO: 40122 - protein, 206 aa, Homo sapiens
  Payload ID: 8170
  Gene Symbol: IST1
  Gene Name: increased sodium tolerance 1 homolog (yeast)
  ENSP ID: ENSP00000454541
MLGSGFKAERLRVNLRLVINRLKLLEKKKTELAQKARKEIADYLAAGKDERARIRVEHIIREDYLVEAMEILELYCDLLLARFGLIQSMKELDSGLAESVSTLIWAAPRLQSEVAELKIVADQLCAKYSKEYGKLCRTNQIGTVNDRLMHKLSVEAPPKILVERYLIEIAKNYNVPYEPDSVVMAEAPPGVETDLIDVGFTDDVKK

SEQ ID NO: 40123 - protein, 59 aa, Homo sapiens
  Payload ID: 8170
  Gene Symbol: IST1
  Gene Name: increased sodium tolerance 1 homolog (yeast)
  ENSP ID: ENSP00000455409
MLGSGFKAERLRVNLRLVINRLKLLEKKKTELAQKARKEIADYLAAGKDERARIRVEHI

SEQ ID NO: 40124 - protein, 40 aa, Homo sapiens
  Payload ID: 8170
  Gene Symbol: IST1
  Gene Name: increased sodium tolerance 1 homolog (yeast)
  ENSP ID: ENSP00000455590
MLGSGFKAERLRVNLRLVINRLKLLEKKKTELAQKARKEI

SEQ ID NO: 40125 - protein, 166 aa, Homo sapiens
  Payload ID: 8170
  Gene Symbol: IST1
  Gene Name: increased sodium tolerance 1 homolog (yeast)
  ENSP ID: ENSP00000455757
MLGSGFKAERLRVNLRLVINRLKLLEKKKTELAQKARKEIADYLAAGKDERARIRVEHIIREDYLVEAMEILELYCDLLLARFGLIQSMKELDSGLAESVSTLIWAAPRLQSEVAELKIVADQLCAKYSKEYGKLCRTNQIGTVNDRLMHKLSVEAPPKILVERYL

SEQ ID NO: 40126 - protein, 253 aa, Homo sapiens
  Payload ID: 8170
  Gene Symbol: IST1
  Gene Name: increased sodium tolerance 1 homolog (yeast)
  ENSP ID: ENSP00000455805
MLGSGFKAERLRVNLRLVINRLKLLEKKKTELAQKARKEIADYLAAGKDERARIRVEHIIREDYLVEAMEILELYCDLLLARFGLIQSMKELDSGLAESVSTLIWAAPRLQSEVAELKIVADQLCAKYSKEYGKLCRTNQIGTVNDRLMHKLSVEAPPKILVERYLIEIAKNYNVPYEPDSVVMAEAPPGVETDLIDVGFTDDVKKGGPGRGGSGGFTAPVGGPDGTVPMPMPMPMPMPSANTPFSYPLPKGP

SEQ ID NO: 40127 - protein, 366 aa, Homo sapiens; identical to SEQ ID NO: 40117
  Payload ID: 8170
  Gene Symbol: IST1
  Gene Name: increased sodium tolerance 1 homolog (yeast)
  Uniprot ID: P53990
  ENSP ID: ENSP00000455860

SEQ ID NO: 40128 - protein, 105 aa, Homo sapiens
  Payload ID: 8170
  Gene Symbol: IST1
  Gene Name: increased sodium tolerance 1 homolog (yeast)
  ENSP ID: ENSP00000456200
MLGSGFKAERLRVNLRLVINRLKLLEKKKTELAQKARKEIADYLAAGKDERARIRVEHIIREDYLVEAMEILELYCDLLLARFGLIQSMKELDSGLAESVSTLIW

SEQ ID NO: 40129 - protein, 253 aa, Homo sapiens; identical to SEQ ID NO: 40126
  Payload ID: 8170
  Gene Symbol: IST1
  Gene Name: increased sodium tolerance 1 homolog (yeast)
  ENSP ID: ENSP00000457646

SEQ ID NO: 40130 - protein, 366 aa, Homo sapiens; identical to SEQ ID NO: 40117
  Payload ID: 8170
  Gene Symbol: IST1
  Gene Name: increased sodium tolerance 1 homolog (yeast)
  Uniprot ID: P53990
  ENSP ID: ENSP00000457844

SEQ ID NO: 40131 - protein, 218 aa, Homo sapiens
  Payload ID: 8170
  Gene Symbol: IST1
  Gene Name: increased sodium tolerance 1 homolog (yeast)
  Uniprot ID: P53990
  ENSP ID: ENSP00000463711
MHKLSVEAPPKILVERYLIEIAKNYNVPYEPDSVVMAEAPPGVETDLIDVGFTDDVKKGGPGRGGSGGFTAPVGGPDGTVPMPMPMPMPMPSANTPFSYPLPKGPSDFNGLPMGTYQAFPNIHPPQIPATPPSYESVDDINADKNISSAQIVGPGPKPEASAKLPSRPADNYDNFVLPELPSVPDTLPTASAGASTSASEDIDFDDLSRRFEELKKKT

SEQ ID NO: 40132 - protein, 85 aa, Homo sapiens
  Payload ID: 8170
  Gene Symbol: IST1
  Gene Name: increased sodium tolerance 1 homolog (yeast)
  ENSP ID: ENSP00000463833
MPMPSANTPFSYPLPKGPSDFNGLPMGTYQAFPNIHPPQIPATPPSYESLMCSTLGLSFSYALVLHASHNPQPLVGMRSKIFISI

SEQ ID NO: 40133 - protein, 218 aa, Homo sapiens; identical to SEQ ID NO: 40131
  Payload ID: 8170
  Gene Symbol: IST1
  Gene Name: increased sodium tolerance 1 homolog (yeast)
  Uniprot ID: P53990
  ENSP ID: ENSP00000475853

SEQ ID NO: 40134 - protein, 41 aa, Homo sapiens; identical to SEQ ID NO: 40119
  Payload ID: 8170
  Gene Symbol: IST1
  Gene Name: increased sodium tolerance 1 homolog (yeast)
  ENSP ID: ENSP00000486751

SEQ ID NO: 40135 - protein, 411 aa, Homo sapiens
  Payload ID: 8171
  Gene Symbol: IHH
  Gene Name: indian hedgehog
  Uniprot ID: Q14623
  ENSP ID: ENSP00000295731
MSPARLRPRLHFCLVLLLLLVVPAAWGCGPGRVVGSRRRPPRKLVPLAYKQFSPNVPEKTLGASGRYEGKIARSSERFKELTPNYNPDIIFKDEENTGADRLMTQRCKDRLNSLAISVMNQWPGVKLRVTEGWDEDGHHSEESLHYEGRAVDITTSDRDRNKYGLLARLAVEAGFDWVYYESKAHVHCSVKSEHSAAAKTGGCFPAGAQVRLESGARVALSAVRPGDRVLAMGEDGSPTFSDVLIFLDREPHRLRAFQVIETQDPPRRLALTPAHLLFTADNHTEPAARFRATFASHVQPGQYVLVAGVPGLQPARVAAVSTHVALGAYAPLTKHGTLVVEDVVASCFAAVADHHLAQLAFWPLRLFHSLAWGSWTPGEGVHWYPQLLYRLGRLLLEEGSFHPLGMSGAGS

SEQ ID NO: 40136 - protein, 170 aa, Homo sapiens
  Payload ID: 8172
  Gene Symbol: IDO1
  Gene Name: indoleamine 2,3-dioxygenase 1
  ENSP ID: ENSP00000253513
MAHAMENSWTISKEYHIDEEVGFALPNPQENLPDFYNDWMFIAKHLPDLIESGQLRERVEKLNMLSIDHLTDHKSQRLARLVLGCITMAYVWGKGHGDVRKVLPRNIAVPYCQLSKKLELPPILVYADCVLANWKKKDPNKYVNRTWTFCSHFVMETAVKDSSWSLYWWK

SEQ ID NO: 40137 - protein, 180 aa, Homo sapiens
  Payload ID: 8172
  Gene Symbol: IDO1
  Gene Name: indoleamine 2,3-dioxygenase 1
  ENSP ID: ENSP00000428716
MAHAMENSWTISKEYHIDEEVGFALPNPQENLPDFYNDWMFIAKHLPDLIESGQLRERVEKLNMLSIDHLTDHKSQRLARLVLGCITMAYVWGKGHGDVRKVLPRNIAVPYCQLSKKLELPPILVYADCVLANWKKKDPNKPLTYENMDVLFSFRDGDCSKGFFLVSLLVEIAAASAIKV

SEQ ID NO: 40138 - protein, 78 aa, Homo sapiens
  Payload ID: 8172
  Gene Symbol: IDO1
  Gene Name: indoleamine 2,3-dioxygenase 1
  ENSP ID: ENSP00000429297
MAHAMENSWTISKEYHIDEEVGFALPNPQENLPDFYNDWMFIAKHLPDLIESGQLRERVEKLNMLSIDHLTDHKSQRL

SEQ ID NO: 40139 - protein, 47 aa, Homo sapiens
  Payload ID: 8172
  Gene Symbol: IDO1
  Gene Name: indoleamine 2,3-dioxygenase 1
  ENSP ID: ENSP00000429933
MAHAMENSWTISKEYHIDEEVGFALPNPQENLPDFYNDWMFIAKHLP

SEQ ID NO: 40140 - protein, 403 aa, Homo sapiens [sequence omitted]

SEQ ID NO: 40141 - protein, 403 aa, Homo sapiens [sequence omitted]

SEQ ID NO: 40142 - protein, 407 aa, Homo sapiens
  Payload ID: 8173
  Gene Symbol: IDO2
  Gene Name: indoleamine 2,3-dioxygenase 2
  Uniprot ID: Q6ZQW0
  ENSP ID: ENSP00000426447
MEPHRPNVKTAVPLSLESYHISEEYGFLLPDSLKELPDHYRPWMEIANKLPQLIDAHQLQAHVDKMPLLSCQFLKGHREQRLAHLVLSFLTMGYVWQEGEAQPAEVLPRNLALPFVEVSRNLGLPPILVHSDLVLTNWTKKDPDGFLEIGNLETIISFPGGESLHGFILVTALVEKEAVPGIKALVQATNAILQPNQEALLQALQRLRLSIQDITKTLGQMHDYVDPDIFYAGIRIFLSGWKDNPAMPAGLMYEGVSQEPLKYSGGSAAQSTVLHAFDEFLGIRHSKESGDFLYRMRDYMPPSHKAFIEDIHSAPSLRDYILSSGQDHLLTAYNQCVQALAELRSYHITMVTKYLITAAAKAKHGKPNHLPGPPQALKDRGTGGTAVMSFLKSVRDKTLESILHPRG

SEQ ID NO: 40143 - protein, 420 aa, Homo sapiens
  Payload ID: 8173
  Gene Symbol: IDO2
  Gene Name: indoleamine 2,3-dioxygenase 2
  ENSP ID: ENSP00000443432
MLHFHYYDTSNKIMEPHRPNVKTAVPLSLESYHISEEYGFLLPDSLKELPDHYRPWMEIANKLPQLIDAHQLQAHVDKMPLLSCQFLKGHREQRLAHLVLSFLTMGYVWQEGEAQPAEVLPRNLALPFVEVSRNLGLPPILVHSDLVLTNWTKKDPDGFLEIGNLETIISFPGGESLHGFILVTALVEKEAVPGIKALVQATNAILQPNQEALLQALQRLRLSIQDITKTLGQMHDYVDPDIFYAGIRIFLSGWKDNPAMPAGLMYEGVSQEPLKYSGGSAAQSTVLHAFDEFLGIRHSKESGDFLYRMRDYMPPSHKAFIEDIHSAPSLRDYILSSGQDHLLTAYNQCVQALAELRSYHITMVTKYLITAAAKAKHGKPNHLPGPPQALKDRGTGGTAVMSFLKSVRDKTLESILHPRG

SEQ ID NO: 40144 - protein, 263 aa, Homo sapiens
  Payload ID: 8174
  Gene Symbol: INMT
  Gene Name: indolethylamine N-methyltransferase
  Uniprot ID: O95050
  ENSP ID: ENSP00000013222
MKGGFTGGDEYQKHFLPRDYLATYYSFDGSPSPEAEMLKFNLECLHKTFGPGGLQGDTLIDIGSGPTIYQVLAACDSFQDITLSDFTDRNREELEKWLKKEPGAYDWTPAVKFACELEGNSGRWEEKEEKLRAAVKRVLKCDVHLGNPLAPAVLPLADCVLTLLAMECACCSLDAYRAALCNLASLLKPGGHLVTTVTLRLPSYMVGKREFSCVALEKEEVEQAVLDAGFDIEQLLHSPQSYSVTNAANNGVCFIVARKKPGP

SEQ ID NO: 40145 - protein, 262 aa, Homo sapiens
  Payload ID: 8174
  Gene Symbol: INMT
  Gene Name: indolethylamine N-methyltransferase
  Uniprot ID: O95050
  ENSP ID: ENSP00000386961
MKGGFTGGDEYQKHFLPRDYLATYYSFDGSPSPEAEMLKFNLECLHKTFGPGLQGDTLIDIGSGPTIYQVLAACDSFQDITLSDFTDRNREELEKWLKKEPGAYDWTPAVKFACELEGNSGRWEEKEEKLRAAVKRVLKCDVHLGNPLAPAVLPLADCVLTLLAMECACCSLDAYRAALCNLASLLKPGGHLVTTVTLRLPSYMVGKREFSCVALEKEEVEQAVLDAGFDIEQLLHSPQSYSVTNAANNGVCFIVARKKPGP

SEQ ID NO: 40146 - protein, 199 aa, Homo sapiens
  Payload ID: 8175
  Gene Symbol: ICOS
  Gene Name: inducible T-cell co-stimulator
  Uniprot ID: Q9Y6W8
  ENSP ID: ENSP00000319476
MKSGLWYFFLFCLRIKVLTGEINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 40147 - protein, 168 aa, Homo sapiens
  Payload ID: 8175
  Gene Symbol: ICOS
  Gene Name: inducible T-cell co-stimulator
  Uniprot ID: Q9Y6W8
  ENSP ID: ENSP00000415951
MKSGLWYFFLFCLRIKVLTGEINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKM

SEQ ID NO: 40148 - protein, 309 aa, Homo sapiens; identical to SEQ ID NO: 14416
  Payload ID: 8176
  Gene Symbol: ICOSLG
  Gene Name: inducible T-cell co-stimulator ligand
  Uniprot ID: O75144
  ENSP ID: ENSP00000339477

SEQ ID NO: 40149 - protein, 185 aa, Homo sapiens; identical to SEQ ID NO: 14420
  Payload ID: 8176
  Gene Symbol: ICOSLG
  Gene Name: inducible T-cell co-stimulator ligand
  Uniprot ID: O75144
  ENSP ID: ENSP00000383228

SEQ ID NO: 40150 - protein, 473 aa, Homo sapiens
  Payload ID: 8176
  Gene Symbol: ICOSLG
  Gene Name: inducible T-cell co-stimulator ligand
  ENSP ID: ENSP00000383230
MRLGSPGLLFLLFSSLRADTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGEFAVGSSRFWGAQGRLGCQLSFRVSKNFQKAKVPCLEQLLFLETQRSPRWCAWHFLQPPLGMGWHPGVHFVTLRWDFPNMHRSRETSARPPRSPVPSPDQGVQGGSRHRRPAPMGCPEWVQAPAPSPRGVSRAGPGTGAQPLWGVRSGSGHRQLLSVAATPAALVCPSVPGAT

SEQ ID NO: 40151 - protein, 302 aa, Homo sapiens; identical to SEQ ID NO: 14418
  Payload ID: 8176
  Gene Symbol: ICOSLG
  Gene Name: inducible T-cell co-stimulator ligand
  Uniprot ID: O75144
  ENSP ID: ENSP00000384432

SEQ ID NO: 40152 - protein, 135 aa, Homo sapiens
  Payload ID: 8177
  Gene Symbol: IVNS1ABP
  Gene Name: influenza virus NS1A binding protein
  ENSP ID: ENSP00000356467
MIPNGYLMFEDENFIESSVAKLNALRKSGQFCDVRLQVCGHEMLAHRAVLACCSPYLFEIFNSDSDPHGISHVKFDDLNPEAVEVLLNYAYTAQLKADKELVKDVYSAAKKLKMDRVKQHLLYFCLHSTSTSSLL

SEQ ID NO: 40153 - protein, 642 aa, Homo sapiens
  Payload ID: 8177
  Gene Symbol: IVNS1ABP
  Gene Name: influenza virus NS1A binding protein
  Uniprot ID: Q9Y6Y0
  ENSP ID: ENSP00000356468
MIPNGYLMFEDENFIESSVAKLNALRKSGQFCDVRLQVCGHEMLAHRAVLACCSPYLFEIFNSDSDPHGISHVKFDDLNPEAVEVLLNYAYTAQLKADKELVKDVYSAAKKLKMDRVKQVCGDYLLSRMDVTSCISYRNFASCMGDSRLLNKVDAYIQEHLLQISEEEEFLKLPRLKLEVMLEDNVCLPSNGKLYTKVINWVQRSIWENGDSLEELMEEVQTLYYSADHKLLDGNLLDGQAEVFGSDDDHIQFVQKKPPRENGHKQISSSSTGCLSSPNATVQSPKHEWKIVASEKTSNNTYLCLAVLDGIFCVIFLHGRNSPQSSPTSTPKLSKSLSFEMQQDELIEKPMSPMQYARSGLGTAEMNGKLIAAGGYNREECLRTVECYNPHTDHWSFLAPMRTPRARFQMAVLMGQLYVVGGSNGHSDDLSCGEMYDSNIDDWIPVPELRTNRCNAGVCALNGKLYIVGGSDPYGQKGLKNCDVFDPVTKLWTSCAPLNIRRHQSAVCELGGYLYIIGGAESWNCLNTVERYNPENNTWTLIAPMNVARRGAGVAVLNGKLFVCGGFDGSHAISCVEMYDPTRNEWKMMGNMTSPRSNAGIATVGNTIYAVGGFDGNEFLNTVEVYNLESNEWSPYTKIFQF

SEQ ID NO: 40154 - protein, 117 aa, Homo sapiens
  Payload ID: 8177
  Gene Symbol: IVNS1ABP
  Gene Name: influenza virus NS1A binding protein
  ENSP ID: ENSP00000401826
VCGDYLLSRMDVTSCISYRNFASCMGDSRLLNKVDAYIQEHLLQISEEEEFLKLPRLKLEVMLEDNVCLPSNGKLYTKVINWVQRSIWENGDSLEELMEEVSFKVNGIQPFLKIILL

SEQ ID NO: 40155 - protein, 366 aa, Homo sapiens
  Payload ID: 8178
  Gene Symbol: INHA
  Gene Name: inhibin, alpha
  Uniprot ID: P05111
  ENSP ID: ENSP00000243786
MVLHLLLFLLLTPQGGHSCQGLELARELVLAKVRALFLDALGPPAVTREGGDPGVRRLPRRHALGGFTHRGSEPEEEEDVSQAILFPATDASCEDKSAARGLAQEAEEGLFRYMFRPSQHTRSRQVTSAQLWFHTGLDRQGTAASNSSEPLLGLLALSPGGPVAVPMSLGHAPPHWAVLHLATSALSLLTHPVLVLLLRCPLCTCSARPEATPFLVAHTRTRPPSGGERARRSTPLMSWPWSPSALRLLQRPPEEPAAHANCHRVALNISFQELGWERWIVYPPSFIFHYCHGGCGLHIPPNLSLPVPGAPPTPAQPYSLLPGAQPCCAALPGTMRPLHVRTTSDGGYSFKYETVPNLLTQHCACI

SEQ ID NO: 40156 - protein, 426 aa, Homo sapiens
  Payload ID: 8179
  Gene Symbol: INHBA
  Gene Name: inhibin, beta A
  Uniprot ID: P08476
  ENSP ID: ENSP00000242208
MPLLWLRGFLLASCWIIVRSSPTPGSEGHSAAPDCPSCALAALPKDVPNSQPEMVEAVKKHILNMLHLKKRPDVTQPVPKAALLNAIRKLHVGKVGENGYVEIEDDIGRRAEMNELMEQTSEIITFAESGTARKTLHFEISKEGSDLSVVERAEVWLFLKVPKANRTRTKVTIRLFQQQKHPQGSLDTGEEAEEVGLKGERSELLLSEKVVDARKSTWHVFPVSSSIQRLLDQGKSSLDVRIACEQCQESGASLVLLGKKKKKEEEGEGKKKGGGEGGAGADEEKEQSHRPFLMLQARQSEDHPHRRRRRGLECDGKVNICCKKQFFVSFKDIGWNDWIIAPSGYHANYCEGECPSHIAGTSGSSLSFHSTVINHYRMRGHSPFANLKSCCVPTKLRPMSMLYYDDGQNIIKKDIQNMIVEECGCS

SEQ ID NO: 40157 - protein, 426 aa, Homo sapiens; identical to SEQ ID NO: 40156
  Payload ID: 8179
  Gene Symbol: INHBA
  Gene Name: inhibin, beta A
  Uniprot ID: P08476
  ENSP ID: ENSP00000397197

SEQ ID NO: 40158 - protein, 407 aa, Homo sapiens
  Payload ID: 8180
  Gene Symbol: INHBB
  Gene Name: inhibin, beta B
  Uniprot ID: P09529
  ENSP ID: ENSP00000295228
MDGLPGRALGAACLLLLAAGWLGPEAWGSPTPPPTPAAPPPPPPPGSPGGSQDTCTSCGGFRRPEELGRVDGDFLEAVKRHILSRLQMRGRPNITHAVPKAAMVTALRKLHAGKVREDGRVEIPHLDGHASPGADGQERVSEIISFAETDGLASSRVRLYFFISNEGNQNLFVVQASLWLYLKLLPYVLEKGSRRKVRVKVYFQEQGHGDRWNMVEKRVDLKRSGWHTFPLTEAIQALFERGERRLNLDVQCDSCQELAVVPVFVDPGEESHRPFVVVQARLGDSRHRIRKRGLECDGRTNLCCRQQFFIDFRLIGWNDWIIAPTGYYGNYCEGSCPAYLAGVPGSASSFHTAVVNQYRMRGLNPGTVNSCCIPTKLSTMSMLYFDDEYNIVKRDVPNMIVEECGCA

SEQ ID NO: 40159 - protein, 352 aa, Homo sapiens
  Payload ID: 8181
  Gene Symbol: INHBC
  Gene Name: inhibin, beta C
  Uniprot ID: P55103
  ENSP ID: ENSP00000308716
MTSSLLLAFLLLAPTTVATPRAGGQCPACGGPTLELESQRELLLDLAKRSILDKLHLTQRPTLNRPVSRAALRTALQHLHGVPQGALLEDNREQECEIISFAETGLSTINQTRLDFHFSSDRTAGDREVQQASLMFFVQLPSNTTWTLKVRVLVLGPHNTNLTLATQYLLEVDASGWHQLPLGPEAQAACSQGHLTLELVLEGQVAQSSVILGGAAHRPFVAARVRVGGKHQIHRRGIDCQGGSRMCCRQEFFVDFREIGWHDWIIQPEGYAMNFCIGQCPLHIAGMPGIAASFHTAVLNLLKANTAAGTTGGGSCCVPTARRPLSLLYYDRDSNIVKTDIPDMVVEACGCS

SEQ ID NO: 40160 - protein, 350 aa, Homo sapiens
  Payload ID: 8182
  Gene Symbol: INHBE
  Gene Name: inhibin, beta E
  Uniprot ID: P58166
  ENSP ID: ENSP00000266646
MRLPDVQLWLVLLWALVRAQGTGSVCPSCGGSKLAPQAERALVLELAKQQILDGLHLTSRPRITHPPPQAALTRALRRLQPGSVAPGNGEEVISFATVTDSTSAYSSLLTFHLSTPRSHHLYHARLWLHVLPTLPGTLCLRIFRWGPRRRRQGSRTLLAEHHITNLGWHTLTLPSSGLRGEKSGVLKLQLDCRPLEGNSTVTGQPRRLLDTAGHQQPFLELKIRANEPGAGRARRRTPTCEPATPLCCRRDHYVDFQELGWRDWILQPEGYQLNYCSGQCPPHLAGSPGIAASFHSAVFSLLKANNPWPASTSCCVPTARRPLSLLYLDHNGNVVKTDVPDMVVEACGCS

SEQ ID NO: 40161 - protein, 274 aa, Homo sapiens
  Payload ID: 8182
  Gene Symbol: INHBE
  Gene Name: inhibin, beta E
  ENSP ID: ENSP00000450212
METAAAVVKLERLEAALTRALRRLQPGSVAPGNGEEVISFATVTDSTSAYSSLLTFHLSTPRSHHLYHARLWLHVLPTLPGTLCLRIFRWGPRRRRQGSRTLLAEHHITNLGWHTLTLPSSGLRGEKSGVLKLQLDCRPLEGNSTVTGQPRRLLDTAGHQQPFLELKIRANEPGAGRARRRTPTCEPATPLCCRRDHYVDFQELGWRDWILQPEGYQLNYCSGQCPPHLAGSPGIAASFHSAVFSLLKANNPWPASTSCCVPTARRPLSLLYLD

SEQ ID NO: 40162 - protein, 1353 aa, Homo sapiens
  Payload ID: 8183
  Gene Symbol: IBTK
  Gene Name: inhibitor of Bruton agammaglobulinemia tyrosine kinase
  Uniprot ID: Q9P2D0
  ENSP ID: ENSP00000305721
MSSPMPDCTSKCRSLKHALDVLSVVTKGSENQIKAFLSSHCYNAATIKDVFGRNALHLVSSCGKKGVLDWLIQKGVDLLVKDKESGWTALHRSIFYGHIDCVWSLLKHGVSLYIQDKEGLSALDLVMKDRPTHVVFKNTDPTDVYTWGDNTNFTLGHGSQNSKHHPELVDLFSRSGIYIKQVVLCKFHSVFLSQKGQVYTCGHGPGGRLGHGDEQTCLVPRLVEGLNGHNCSQVAAAKDHTVVLTEDGCVYTFGLNIFHQLGIIPPPSSCNVPRQIQAKYLKGRTIIGVAAGRFHTVLWTREAVYTMGLNGGQLGCLLDPNGEKCVTAPRQVSALHHKDIALSLVAASDGATVCVTTRGDIYLLADYQCKKMASKQLNLKKVLVSGGHMEYKVDPEHLKENGGQKICILAMDGAGRVFCWRSVNSSLKQCRWAYPRQVFISDIALNRNEILFVTQDGEGFRGRWFEEKRKSSEKKEILSNLHNSSSDVSYVSDINSVYERIRLEKLTFAHRAVSVSTDPSGCNFAILQSDPKTSLYEIPAVSSSSFFEEFGKLLREADEMDSIHDVTFQVGNRLFPAHKYILAVHSDFFQKLFLSDGNTSEFTDIYQKDEDSAGCHLFVVEKVHPDMFEYLLQFIYTDTCDFLTHGFKPRIHLNKNPEEYQGTLNSHLNKVNFHEDDNQKSAFEVYKSNQAQTVSERQKSKPKSCKKGKNIREDDPVRMLQTVAKKFDFSNLSSRLDGVRFENEKINVIAKNTGNKLKLSQKKCSFLCDVTMKSVDGKEFPCHKCVLCARLEYFHSMLSSSWIEASSCAALEMPIHSDILKVILDYLYTDEAVVIKESQNVDFICSVLVVADQLLITRLKEICEVALTEKLTLKNAAMLLEFAAMYSAKQLKLSCLQFIGLNMAALLEARSLDVLSDGVLKDLSEFYRKMIPAMDRRVITPYQDGPDISYLEVEDGDIFLKEEINMEQNHSETMFKKAKTKAKKKPRKRSDSSGGYNLSDIIQSPSSTGLLKSGKTNSVESLPELLTSDSEGSYAGVGSPRDLQSPDFTTGFHSDKIEAKVKPYVNGTSPVYSREDLKPWEKSPILKISAPQPIPSNRIDTTSSASWVAGSFSPVSPPVVDLRTIMEIEESRQKCGATPKSHLGKTVSHGVKLSQKQRKMIALTTKENNSGMNSMETVLFTPSKAPKPVNAWASSLHSVSSKSFRDFLLEEKKSVTSHSSGDHVKKVSFKGIENSQAPKIVRCSTHGTPGPEGNHISDLPLLDSPNPWLSSSVTAPSMVAPVTFASIVEEELQQEAALIRSREKPLALIQIEEHAIQDLLVFYEAFGNPEEFVIVERTPQGPLAVPMWNKHGC

SEQ ID NO: 40163 - protein, 238 aa, Homo sapiens
  Payload ID: 8183
  Gene Symbol: IBTK
  Gene Name: inhibitor of Bruton agammaglobulinemia tyrosine kinase
  ENSP ID: ENSP00000422136
MSSPMPDCTSKCRSLKHALDVLSVVTKGSENQIKAFLSSHCYNAATIKDVFGRNALHLVSSCGKKGVLDWLIQKGVDLLVKDKESGWTALHRSIFYGHIDCVWSLLKHGVSLYIQDKEGLSALDLVMKDRPTHVVFKNTDPTDVYTWGDNTNFTLGHGSQNSKHHPELVDLFSRSGIYIKQVVLCKFHSVFLSQKGQVYTCGHGPGGRLGHGDEQTCLVIEMSLHYLGPSACGRTEWS

SEQ ID NO: 40164 - protein, 1152 aa, Homo sapiens
  Payload ID: 8183
  Gene Symbol: IBTK
  Gene Name: inhibitor of Bruton agammaglobulinemia tyrosine kinase
  ENSP ID: ENSP00000422762
MSSPMPDCTSKCRSLKHALDVLSVVTKGSENQIKAFLSSHCYNAATIKDVFGRNALHLVSSCGKKGVLDWLIQKGVDLLVKDKESGWTALHRSIFYGHIDCVWSLLKHGVSLYIQDKEGLSALDLVMKDRPTHVVFKNTDPTDVYTWGDNTNFTLGHGSQNSKHHPELVDLFSRSGIYIKQVVLCKFHSVFLSQKGQVYTCGHGPGGRLGHGDEQTCLVPRLVEGLNGHNCSQVAAAKDHTVVLTEDGCVYTFGLNIFHQLGIIPPPSSCNVPRQIQAKYLKGRTIIGVAAGRFHTVLWTREAVYTMGLNGGQLGCLLDPNGEKCVTAPRQVSALHHKDIALSLVAASDGATVCVTTRGDIYLLADYQCKKMASKQLNLKKVLVSGGHMEYKVDPEHLKENGGQKICILAMDGAGRVFCWRSVNSSLKQCRWAYPRQVFISDIALNRNEILFVTQDGEGFRGRWFEEKRKSSEKKEILSNLHNSSSDVSYVSDINSVYERIRLEKLTFAHRAVSVSTDPSGCNFAILQSDPKTRLDGVRFENEKINVIAKNTGNKLKLSQKKCSFLCDVTMKSVDGKEFPCHKCVLCARLEYFHSMLSSSWIEASSCAALEMPIHSDILKVILDYLYTDEAVVIKESQNVDFICSVLVVADQLLITRLKEICEVALTEKLTLKNAAMLLEFAAMYSAKQLKLSCLQFIGLNMAALLEARSLDVLSDGVLKDLSEFYRKMIPAMDRRVITPYQDGPDISYLEVEDGDIFLKEEINMEQNHSETMFKKAKTKAKKKPRKRSDSSGGYNLSDIIQSPSSTGLLKSGKTNSVESLPELLTSDSEGSYAGVGSPRDLQSPDFTTGFHSDKIEAKVKPYVNGTSPVYSREDLKPWEKSPILKISAPQPIPSNRIDTTSSASWVAGSFSPVSPPVVDLRTIMEIEESRQKCGATPKSHLGKTVSHGVKLSQKQRKMIALTTKENNSGMNSMETVLFTPSKAPKPVNAWASSLHSVSSKSFRDFLLEEKKSVTSHSSGDHVKKVSFKGIENSQAPKIVRCSTHGTPGPEGNHISDLPLLDSPNPWLSSSVTAPSMVAPVTFASIVEEELQQEAALIRSREKPLALIQIEEHAIQDLLVFYEAFGNPEEFVIVERTPQGPLAVPMWNKHGC

SEQ ID NO: 40165 - protein, 128 aa, Homo sapiens
  Payload ID: 8183
  Gene Symbol: IBTK
  Gene Name: inhibitor of Bruton agammaglobulinemia tyrosine kinase
  ENSP ID: ENSP00000424634
LRTIMEIEESRQKCGATPKSHLGKTVSHGVKLSQKQRKMIALTTKENNSGMNSMETVLFTPSKAPKPVNAWASSLHSVSSKSFRDFLLEEKKSVTSHSSGDHVKKVSFKGIENSQAPKIVSFVGGERR

SEQ ID NO: 40166 - protein, 1338 aa, Homo sapiens
  Payload ID: 8183
  Gene Symbol: IBTK
  Gene Name: inhibitor of Bruton agammaglobulinemia tyrosine kinase
  ENSP ID: ENSP00000426405
MSSPMPDCTSKCRSLKHALDVLSVVTKGSENQIKAFLSSHCYNAATIKDVFGRNALHLVSSCGKKGVLDWLIQKGVDLLVKDKESGWTALHRSIFYGHIDCVWSLLKHGVSLYIQDKEGLSALDLVMKDRPTHVVFKNTDPTDVYTWGDNTNFTLGHGSQNSKHHPELVDLFSRSGIYIKQVVLCKFHSVFLSQKGQVYTCGHGPGGRLGHGDEQTCLVPRLVEGLNGHNCSQVAAAKDHTVVLTEDGCVYTFGLNIFHQLGIIPPPSSCNVPRQIQAKYLKGRTIIGVAAGRFHTVLWTREAVYTMGLNGGQLGCLLDPNGEKCVTAPRQVSALHHKDIALSLVAASDGATVCVTTRGDIYLLADYQCKKMASKQLNLKKVLVSGGHMEYKVDPEHLKENGGQKICILAMDGAGRVFCWRSVNSSLKQCRWAYPRQVFISDIALNRNEILFVTQDGEGFRGRWFEEKRKSSEKKEILSNLHNSSSDVSYVSDINSVYERIRLEKLTFAHRAVSVSTDPSGCNFAILQSDPKTSLYEIPAVSSSSFFEEFGKLLREADEMDSIHDVTFQVGNRLFPAHKYILAVHSDFFQKLFLSDGNTSEFTDIYQKDEDSAGCHLFVVEKVHPDMFEYLLQFIYTDTCDFLTHGFKPRIHLNKNPEEYQGTLNSHLNKVNFHEDDNQKSAFEVYKSNQAQTVSERQKSKPKSCKKGKNIREDDPVRMLQTVAKKFDFSNLSSRLDGVRFENEKINVIAKNTGNKLKLSQKKCSFLCDVTMKSVDGKEFPCHKCVLCARLEYFHSMLSSSWIEASSCAALEMPIHSDILKVILDYLYTDEAVVIKESQNVDFICSVLVVADQLLITRLKEICEVALTEKLTLKNAAMLLEFAAMYSAKQLKLSCLQFIGLNMAALLEARSLDVLSDGVLKDLSEFYRKMIPAMDRRVITPYQDGPDISYLEVEDGDIFLKEEINMEQNHSETMFKKAKTKAKKKPRKRSDSSGGYNLSDIIQSPSSTELLTSDSEGSYAGVGSPRDLQSPDFTTGFHSDKIEAKVKPYVNGTSPVYSREDLKPWEKSPILKISAPQPIPSNRIDTTSSASWVAGSFSPVSPPVVDLRTIMEIEESRQKCGATPKSHLGKTVSHGVKLSQKQRKMIALTTKENNSGMNSMETVLFTPSKAPKPVNAWASSLHSVSSKSFRDFLLEEKKSVTSHSSGDHVKKVSFKGIENSQAPKIVRCSTHGTPGPEGNHISDLPLLDSPNPWLSSSVTAPSMVAPVTFASIVEEELQQEAALIRSREKPLALIQIEEHAIQDLLVFYEAFGNPEEFVIVERTPQGPLAVPMWNKHGC

SEQ ID NO: 40167 - protein, 1152 aa, Homo sapiens; identical to SEQ ID NO: 40164
  Payload ID: 8183
  Gene Symbol: IBTK
  Gene Name: inhibitor of Bruton agammaglobulinemia tyrosine kinase
  ENSP ID: ENSP00000478891

SEQ ID NO: 40168 - protein, 128 aa, Homo sapiens; identical to SEQ ID NO: 40165
  Payload ID: 8183
  Gene Symbol: IBTK
  Gene Name: inhibitor of Bruton agammaglobulinemia tyrosine kinase
  ENSP ID: ENSP00000488952

SEQ ID NO: 40169 - protein, 1152 aa, Homo sapiens; identical to SEQ ID NO: 40164
  Payload ID: 8183
  Gene Symbol: IBTK
  Gene Name: inhibitor of Bruton agammaglobulinemia tyrosine kinase
  ENSP ID: ENSP00000488965

SEQ ID NO: 40170 - protein, 238 aa, Homo sapiens; identical to SEQ ID NO: 40163
  Payload ID: 8183
  Gene Symbol: IBTK
  Gene Name: inhibitor of Bruton agammaglobulinemia tyrosine kinase
  ENSP ID: ENSP00000489043

SEQ ID NO: 40171 - protein, 1353 aa, Homo sapiens; identical to SEQ ID NO: 40162
  Payload ID: 8183
  Gene Symbol: IBTK
  Gene Name: inhibitor of Bruton agammaglobulinemia tyrosine kinase
  ENSP ID: ENSP00000489389

SEQ ID NO: 40172 - protein, 1338 aa, Homo sapiens; identical to SEQ ID NO: 40166
  Payload ID: 8183
  Gene Symbol: IBTK
  Gene Name: inhibitor of Bruton agammaglobulinemia tyrosine kinase
  ENSP ID: ENSP00000489548

SEQ ID NO: 40173 - protein, 1152 aa, Homo sapiens; identical to SEQ ID NO: 40164
  Payload ID: 8183
  Gene Symbol: IBTK
  Gene Name: inhibitor of Bruton agammaglobulinemia tyrosine kinase
  ENSP ID: ENSP00000489552

SEQ ID NO: 40174 - protein, 221 aa, Homo sapiens
  Payload ID: 8184
  Gene Symbol: INCA1
  Gene Name: inhibitor of CDK, cyclin A1 interacting protein 1
  Uniprot ID: Q0VD86
  ENSP ID: ENSP00000347129
MQVQDDGVNLIPFAKCSRVVSRSPPPRLPSQSLRPMPQRYGDVFWKNLNQRPTPTWLEEQHIPPMLLPPPEMLWRRKKRRPCLEGMQQQGLGGVPARVRAVTYHLEDLRRRQSIINELKKAQWGSSGAASEPVVLGEEGCGFPSTNEYPDLEEERATYPQEEDRFLTPGRAQLLWSPWSPLDQEEACASRQLHSLASFSTVTARRNPLHNPWGMELAASEE

SEQ ID NO: 40175 - protein, 236 aa, Homo sapiens
  Payload ID: 8184
  Gene Symbol: INCA1
  Gene Name: inhibitor of CDK, cyclin A1 interacting protein 1
  Uniprot ID: Q0VD86
  ENSP ID: ENSP00000458316
MQVQDDGVNLIPFAKCSRVVSRSPPPRLPSQSLRPMPQRYGDVFWKNLNQRPTPTWLEEQHIPPMLRATGCSQLGLYPPEQLPPPEMLWRRKKRRPCLEGMQQQGLGGVPARVRAVTYHLEDLRRRQSIINELKKAQWGSSGAASEPVVLGEEGCGFPSTNEYPDLEEERATYPQEEDRFLTPGRAQLLWSPWSPLDQEEACASRQLHSLASFSTVTARRNPLHNPWGMELAASEE

SEQ ID NO: 40176 - protein, 236 aa, Homo sapiens; identical to SEQ ID NO: 40175
  Payload ID: 8184
  Gene Symbol: INCA1
  Gene Name: inhibitor of CDK, cyclin A1 interacting protein 1
  Uniprot ID: Q0VD86
  ENSP ID: ENSP00000460673

SEQ ID NO: 40177 - protein, 221 aa, Homo sapiens; identical to SEQ ID NO: 40174
  Payload ID: 8184
  Gene Symbol: INCA1
  Gene Name: inhibitor of CDK, cyclin A1 interacting protein 1
  Uniprot ID: Q0VD86
  ENSP ID: ENSP00000461844

SEQ ID NO: 40178 - protein, 149 aa, Homo sapiens
  Payload ID: 8185
  Gene Symbol: ID1
  Gene Name: inhibitor of DNA binding 1, dominant negative helix-loop-helix protein
  Uniprot ID: P41134
  ENSP ID: ENSP00000365273
MKVASGSTATAAAGPSCALKAGKTASGAGEVVRCLSEQSVAISRCAGGAGARLPALLDEQQVNVLLYDMNGCYSRLKELVPTLPQNRKVSKVEILQHVIDYIRDLQLELNSESEVGTPGGRGLPVRAPLSTLNGEISALTAEVRSRSDH

SEQ ID NO: 40179 - protein, 155 aa, Homo sapiens
  Payload ID: 8185
  Gene Symbol: ID1
  Gene Name: inhibitor of DNA binding 1, dominant negative helix-loop-helix protein
  Uniprot ID: P41134
  ENSP ID: ENSP00000365280
MKVASGSTATAAAGPSCALKAGKTASGAGEVVRCLSEQSVAISRCAGGAGARLPALLDEQQVNVLLYDMNGCYSRLKELVPTLPQNRKVSKVEILQHVIDYIRDLQLELNSESEVGTPGGRGLPVRAPLSTLNGEISALTAEAACVPADDRILCR

SEQ ID NO: 40180 - protein, 134 aa, Homo sapiens
  Payload ID: 8186
  Gene Symbol: ID2
  Gene Name: inhibitor of DNA binding 2, dominant negative helix-loop-helix protein
  Uniprot ID: Q02363
  ENSP ID: ENSP00000234091
MKAFSPVRSVRKNSLSDHSLGISRSKTPVDDPMSLLYNMNDCYSKLKELVPSIPQNKKVSKMEILQHVIDYILDLQIALDSHPTIVSLHHQRPGQNQASRTPLTTLNTDISILSLQASEFPSELMSNDSKALCG

SEQ ID NO: 40181 - protein, 134 aa, Homo sapiens; identical to SEQ ID NO: 40180
  Payload ID: 8186
  Gene Symbol: ID2
  Gene Name: inhibitor of DNA binding 2, dominant negative helix-loop-helix protein
  Uniprot ID: Q02363
  ENSP ID: ENSP00000379585

SEQ ID NO: 40182 - protein, 134 aa, Homo sapiens; identical to SEQ ID NO: 40180
  Payload ID: 8186
  Gene Symbol: ID2
  Gene Name: inhibitor of DNA binding 2, dominant negative helix-loop-helix protein
  Uniprot ID: Q02363
  ENSP ID: ENSP00000385465

SEQ ID NO: 40183 - protein, 119 aa, Homo sapiens
  Payload ID: 8187
  Gene Symbol: ID3
  Gene Name: inhibitor of DNA binding 3, dominant negative helix-loop-helix protein
  Uniprot ID: Q02535
  ENSP ID: ENSP00000363689
MKALSPVRGCYEAVCCLSERSLAIARGRGKGPAAEEPLSLLDDMNHCYSRLRELVPGVPRGTQLSQVEILQRVIDYILDLQVVLAEPAPGPPDGPHLPIQTAELTPELVISNDKRSFCH

SEQ ID NO: 40184 - protein, 119 aa, Homo sapiens; identical to SEQ ID NO: 40183
  Payload ID: 8187
  Gene Symbol: ID3
  Gene Name: Inhibitor of DNA binding 3, dominant negative helix-loop-helix protein
  ENSP ID: ENSP00000489102

SEQ ID NO: 40185 - protein, 161 aa, Homo sapiens
  Payload ID: 8188
  Gene Symbol: ID4
  Gene Name: inhibitor of DNA binding 4, dominant negative helix-loop-helix protein
  Uniprot ID: P47928
  ENSP ID: ENSP00000367972
MKAVSPVRPSGRKAPSGCGGGELALRCLAEHGHSLGGSAAAAAAAAAARCKAAEAAADEPALCLQCDMNDCYSRLRRLVPTIPPNKKVSKVEILQHVIDYILDLQLALETHPALLRQPPPPAPPHHPAGTCPAAPPRTPLTALNTDPAGAVNKQGDSILCR

SEQ ID NO: 40186 - protein, 159 aa, Homo sapiens
  Payload ID: 8188
  Gene Symbol: ID4
  Gene Name: inhibitor of DNA binding 4, dominant negative helix-loop-helix protein
  ENSP ID: ENSP00000480976
MKAVSPVRPRAARPSGCGGGELALRCLAEHGHSLGGSQAAAAAAAARCKAAEAAADEPALCLQCDMNDCYSRLRRLVPTIPPNKKVSKVEILQHVIDYILDLQLALETHPALLRQPPPPAPPHHPAGTCPAAPPRTPLTALNTDPAGAVNKQGDSILCR

SEQ ID NO: 40187 - protein, 279 aa, Homo sapiens
  Payload ID: 8189
  Gene Symbol: ING1
  Gene Name: inhibitor of growth family, member 1
  Uniprot ID: Q9UK53
  ENSP ID: ENSP00000328436
MLSPANGEQLHLVNYVEDYLDSIESLPFDLQRNVSLMREIDAKYQEILKELDECYERFSRETDGAQKRRMLHCVQRALIRSQELGDEKIQIVSQMVELVENRTRQVDSHVELFEAQQELGDTAGNSGKAGADRPKGEAAAQADKPNSKRSRRQRNNENRENASSNHDHDDGASGTPKEKKAKTSKKKKRSKAKAEREASPADLPIDPNEPTYCLCNQVSYGEMIGCDNDECPIEWFHFSCVGLNHKPKGKWYCPKCRGENEKTMDKALEKSKKERAYNR

SEQ ID NO: 40188 - protein, 235 aa, Homo sapiens
  Payload ID: 8189
  Gene Symbol: ING1
  Gene Name: inhibitor of growth family, member 1
  Uniprot ID: Q9UK53
  ENSP ID: ENSP00000345202
MEILKELDECYERFSRETDGAQKRRMLHCVQRALIRSQELGDEKIQIVSQMVELVENRTRQVDSHVELFEAQQELGDTAGNSGKAGADRPKGEAAAQADKPNSKRSRRQRNNENRENASSNHDHDDGASGTPKEKKAKTSKKKKRSKAKAEREASPADLPIDPNEPTYCLCNQVSYGEMIGCDNDECPIEWFHFSCVGLNHKPKGKWYCPKCRGENEKTMDKALEKSKKERAYNR

SEQ ID NO: 40189 - protein, 422 aa, Homo sapiens
  Payload ID: 8189
  Gene Symbol: ING1
  Gene Name: inhibitor of growth family, member 1
  ENSP ID: ENSP00000364929
MSFVECPYHSPAERLVAEADEGGPSAITGMGLCFRCLLFSFSGRSGVEGGRVDLNVFGSLGLQPWIGSSRCWGGPCSSALRCGWFSSWPPPSKSAIPIGGGSRGAGRVSRWPPPHWLEAWRVSPRPLSPLSPATFGRGFIAVAVIPGLWARGRGCSSDRLPRPAGPARRQFQAASLLTRGWGRAWPWKQILKELDECYERFSRETDGAQKRRMLHCVQRALIRSQELGDEKIQIVSQMVELVENRTRQVDSHVELFEAQQELGDTAGNSGKAGADRPKGEAAAQADKPNSKRSRRQRNNENRENASSNHDHDDGASGTPKEKKAKTSKKKKRSKAKAEREASPADLPIDPNEPTYCLCNQVSYGEMIGCDNDECPIEWFHFSCVGLNHKPKGKWYCPKCRGENEKTMDKALEKSKKERAYNR

SEQ ID NO: 40190 - protein, 210 aa, Homo sapiens
  Payload ID: 8189
  Gene Symbol: ING1
  Gene Name: inhibitor of growth family, member 1
  Uniprot ID: Q9UK53
  ENSP ID: ENSP00000364930
MLHCVQRALIRSQELGDEKIQIVSQMVELVENRTRQVDSHVELFEAQQELGDTAGNSGKAGADRPKGEAAAQADKPNSKRSRRQRNNENRENASSNHDHDDGASGTPKEKKAKTSKKKKRSKAKAEREASPADLPIDPNEPTYCLCNQVSYGEMIGCDNDECPIEWFHFSCVGLNHKPKGKWYCPKCRGENEKTMDKALEKSKKERAYNR

SEQ ID NO: 40191 - protein, 111 aa, Homo sapiens
  Payload ID: 8189
  Gene Symbol: ING1
  Gene Name: inhibitor of growth family, member 1
  ENSP ID: ENSP00000480985
MSFVECPYHSPAERLVAEADEGGPSAITEILKELDECYERFSRETDGAQKRRMLHCVQRALIRSQELGDEKIQIVSQMVELVENRTRQVDSHVELFEAQQELGDTAGNSGK

SEQ ID NO: 40192 - protein, 280 aa, Homo sapiens
  Payload ID: 8190
  Gene Symbol: ING2
  Gene Name: inhibitor of growth family, member 2
  Uniprot ID: Q9H160
  ENSP ID: ENSP00000307183
MLGQQQQQLYSSAALLTGERSRLLTCYVQDYLECVESLPHDMQRNVSVLRELDNKYQETLKEIDDVYEKYKKEDDLNQKKRLQQLLQRALINSQELGDEKIQIVTQMLELVENRARQMELHSQCFQDPAESERASDKAKMDSSQPERSSRRPRRQRTSESRDLCHMANGIEDCDDQPPKEKKSKSAKKKKRSKAKQEREASPVEFAIDPNEPTYCLCNQVSYGEMIGCDNEQCPIEWFHFSCVSLTYKPKGKWYCPKCRGDNEKTMDKSTEKTKKDRRSR

SEQ ID NO: 40193 - protein, 138 aa, Homo sapiens
  Payload ID: 8190
  Gene Symbol: ING2
  Gene Name: inhibitor of growth family, member 2
  ENSP ID: ENSP00000410291
MDQDGDQQLGPSRILAPQTLKEIDDVYEKYKKEDDLNQKKRLQQLLQRALINSQELGDEKIQIVTQMLELVENRARQMELHSQCFQDPAESERASDKAKMDSSQPERSSRRPRRQRTSESRDLCHMANGIEDCDDQPP

SEQ ID NO: 40194 - protein, 418 aa, Homo sapiens
  Payload ID: 8191
  Gene Symbol: ING3
  Gene Name: inhibitor of growth family, member 3
  Uniprot ID: Q9NXR8
  ENSP ID: ENSP00000320566
MLYLEDYLEMIEQLPMDLRDRFTEMREMDLQVQNAMDQLEQRVSEFFMNAKKNKPEWREEQMASIKKDYYKALEDADEKVQLANQIYDLVDRHLRKLDQELAKFKMELEADNAGITEILERRSLELDTPSQPVNNHHAHSHTPVEKRKYNPTSHHTTTDHIPEKKFKSEALLSTLTSDASKENTLGCRNNNSTASSNNAYNVNSSQPLGSYNIGSLSSGTGAGAITMAAAQAVQATAQMKEGRRTSSLKASYEAFKNNDFQLGKEFSMARETVGYSSSSALMTTLTQNASSSAADSRSGRKSKNNNKSSSQQSSSSSSSSSLSSCSSSSTVVQEISQQTTVVPESDSNSQVDWTYDPNEPRYCICNQVSYGEMVGCDNQDCPIEWFHYGCVGLTEAPKGKWYCPQCTAAMKRRGSRHK

SEQ ID NO: 40195 - protein, 92 aa, Homo sapiens
  Payload ID: 8191
  Gene Symbol: ING3
  Gene Name: inhibitor of growth family, member 3
  Uniprot ID: Q9NXR8
  ENSP ID: ENSP00000341697
MLYLEDYLEMIEQLPMDLRDRFTEMREMDLQVQNAMDQLEQRVSEFFMNAKKNKPEWREEQMASIKKDYYKALEDADEKVQLANQIYDLQHF

SEQ ID NO: 40196 - protein, 403 aa, Homo sapiens
  Payload ID: 8191
  Gene Symbol: ING3
  Gene Name: inhibitor of growth family, member 3
  ENSP ID: ENSP00000388506
MDLRDRFTEMREMDLQVQNAMDQLEQRVSEFFMNAKKNKPEWREEQMASIKKDYYKALEDADEKVQLANQIYDLVDRHLRKLDQELAKFKMELEADNAGITEILERRSLELDTPSQPVNNHHAHSHTPVEKRKYNPTSHHTTTDHIPEKKFKSEALLSTLTSDASKENTLGCRNNNSTASSNNAYNVNSSQPLGSYNIGSLSSGTGAGAITMAAAQAVQATAQMKEGRRTSSLKASYEAFKNNDFQLGKEFSMARETVGYSSSSALMTTLTQNASSSAADSRSGRKSKNNNKSSSQQSSSSSSSSSLSSCSSSSTVVQEISQQTTVVPESDSNSQVDWTYDPNEPRYCICNQVSYGEMVGCDNQDCPIEWFHYGCVGLTEAPKGKWYCPQCTAAMKRRGSRHK

SEQ ID NO: 40197 - protein, 99 aa, Homo sapiens
  Payload ID: 8191
  Gene Symbol: ING3
  Gene Name: inhibitor of growth family, member 3
  ENSP ID: ENSP00000395719
MLYLEDYLEMIEQLPMDLRDRFTEMREMDLQVQNAMDQLEQRVSEFFMNAKKNKPEWREEQMASIKKDYYKALEDADEKVQLANQIYDLVSKSNVHTVP

SEQ ID NO: 40198 - protein, 93 aa, Homo sapiens
  Payload ID: 8191
  Gene Symbol: ING3
  Gene Name: inhibitor of growth family, member 3
  Uniprot ID: Q9NXR8
  ENSP ID: ENSP00000410406
MLYLEDYLEMIEQLPMDLRDRFTEMREMDLQVQNAMDQLEQRVSEFFMNAKKNKPEWREEQMASIKKDYYKALEDADEKVQLANQIYDLDLWN

SEQ ID NO: 40199 - protein, 248 aa, Homo sapiens
  Payload ID: 8192
  Gene Symbol: ING4
  Gene Name: inhibitor of growth family, member 4
  Uniprot ID: Q9UNL4
  ENSP ID: ENSP00000343396
MAAGMYLEHYLDSIENLPFELQRNFQLMRDLDQRTEDLKAEIDKLATEYMSSARSLSSEEKLALLKQIQEAYGKCKEFGDDKVQLAMQTYEMVDKHIRRLDTDLARFEADLKEKQIESSDYDSSSSKGKKSRTQKEKKAARARSKGKNSDEEAPKTAQKKLKLVRTSPEYGMPSVTFGSVHPSDVLDMPVDPNEPTYCLCHQVSYGEMIGCDNPDCSIEWFHFACVGLTTKPRGKWFCPRCSQERKKK

SEQ ID NO: 40200 - protein, 249 aa, Homo sapiens
  Payload ID: 8192
  Gene Symbol: ING4
  Gene Name: inhibitor of growth family, member 4
  Uniprot ID: Q9UNL4
  ENSP ID: ENSP00000380024
MAAGMYLEHYLDSIENLPFELQRNFQLMRDLDQRTEDLKAEIDKLATEYMSSARSLSSEEKLALLKQIQEAYGKCKEFGDDKVQLAMQTYEMVDKHIRRLDTDLARFEADLKEKQIESSDYDSSSSKGKKKGRTQKEKKAARARSKGKNSDEEAPKTAQKKLKLVRTSPEYGMPSVTFGSVHPSDVLDMPVDPNEPTYCLCHQVSYGEMIGCDNPDCSIEWFHFACVGLTTKPRGKWFCPRCSQERKKK

SEQ ID NO: 40201 - protein, 225 aa, Homo sapiens
  Payload ID: 8192
  Gene Symbol: ING4
  Gene Name: inhibitor of growth family, member 4
  Uniprot ID: Q9UNL4
  ENSP ID: ENSP00000397343
MAAGMYLEHYLDNLKAEIDKLATEYMSSARSLSSEEKLALLKQIQEAYGKCKEFGDDKVQLAMQTYEMVDKHIRRLDTDLARFEADLKEKQIESSDYDSSSSKGKKKGRTQKEKKAARARSKGKNSDEEAPKTAQKKLKLVRTSPEYGMPSVTFGSVHPSDVLDMPVDPNEPTYCLCHQVSYGEMIGCDNPDCSIEWFHFACVGLTTKPRGKWFCPRCSQERKKK

SEQ ID NO: 40202 - protein, 246 aa, Homo sapiens
  Payload ID: 8192
  Gene Symbol: ING4
  Gene Name: inhibitor of growth family, member 4
  Uniprot ID: Q9UNL4
  ENSP ID: ENSP00000412705
MAAGMYLEHYLDSIENLPFELQRNFQLMRDLDQRTEDLKAEIDKLATEYMSSARSLSSEEKLALLKQIQEAYGKCKEFGDDKVQLAMQTYEMVDKHIRRLDTDLARFEADLKEKQIESSDYDSSSSKEGRTQKEKKAARARSKGKNSDEEAPKTAQKKLKLVRTSPEYGMPSVTFGSVHPSDVLDMPVDPNEPTYCLCHQVSYGEMIGCDNPDCSIEWFHFACVGLTTKPRGKWFCPRCSQERKKK

SEQ ID NO: 40203 - protein, 179 aa, Homo sapiens
  Payload ID: 8192
  Gene Symbol: ING4
  Gene Name: inhibitor of growth family, member 4
  Uniprot ID: Q9UNL4
  ENSP ID: ENSP00000414008
MAAGMYLEHYLDSIENLPFELQRNFQLMRDLDQRTEDLKAEIDKLATEYMSSARSLSSEEKLALLKQIQEAYGKCKEFGDDKVQLAMQTYEMVDKHIRRLDTDLARFEADLKEKQIESSDYDSSSSKGKKKGRTQKEKKAARARSKGKNSDEEAPKTAQKKLKLVRTVPLSGSILPVWG

SEQ ID NO: 40204 - protein, 245 aa, Homo sapiens
  Payload ID: 8192
  Gene Symbol: ING4
  Gene Name: inhibitor of growth family, member 4
  Uniprot ID: Q9UNL4
  ENSP ID: ENSP00000415903
MAAGMYLEHYLDSIENLPFELQRNFQLMRDLDQRTEDLKAEIDKLATEYMSSARSLSSEEKLALLKQIQEAYGKCKEFGDDKVQLAMQTYEMVDKHIRRLDTDLARFEADLKEKQIESSDYDSSSSKGRTQKEKKAARARSKGKNSDEEAPKTAQKKLKLVRTSPEYGMPSVTFGSVHPSDVLDMPVDPNEPTYCLCHQVSYGEMIGCDNPDCSIEWFHFACVGLTTKPRGKWFCPRCSQERKKK

SEQ ID NO: 40205 - protein, 47 aa, Homo sapiens
  Payload ID: 8192
  Gene Symbol: ING4
  Gene Name: inhibitor of growth family, member 4
  ENSP ID: ENSP00000431892
MAAGMYLEHYLDSIENLPFELQRNFQLMRDLDQRTEEALDTISSLEH

SEQ ID NO: 40206 - protein, 51 aa, Homo sapiens
  Payload ID: 8192
  Gene Symbol: ING4
  Gene Name: inhibitor of growth family, member 4
  ENSP ID: ENSP00000433081
MAAGMYLEHYLDSIENLPFELQRNFQLMRDLDQRTEGGQTHSAAGHRPGPF

SEQ ID NO: 40207 - protein, 36 aa, Homo sapiens
  Payload ID: 8192
  Gene Symbol: ING4
  Gene Name: inhibitor of growth family, member 4
  ENSP ID: ENSP00000435867
NLPFELQRNFQLMRDLDQRTEGGQTHSAAGHRPGPF

SEQ ID NO: 40208 - protein, 47 aa, Homo sapiens; identical to SEQ ID NO: 40205
  Payload ID: 8192
  Gene Symbol: ING4
  Gene Name: inhibitor of growth family, member 4
  ENSP ID: ENSP00000436406

SEQ ID NO: 40209 - protein, 21 aa, Homo sapiens
  Payload ID: 8192
  Gene Symbol: ING4
  Gene Name: inhibitor of growth family, member 4
  ENSP ID: ENSP00000437198
MPSVTFGSVHPSDVLDMPVDP

SEQ ID NO: 40210 - protein, 51 aa, Homo sapiens
  Payload ID: 8192
  Gene Symbol: ING4
  Gene Name: inhibitor of growth family, member 4
  ENSP ID: ENSP00000473635
MPSVTFGSVHPSDVLDMPVDPNEPTYCLCHQVSYGEMIGCDNPDCSIEWFH

SEQ ID NO: 40211 - protein, 51 aa, Homo sapiens; identical to SEQ ID NO: 40206
  Payload ID: 8192
  Gene Symbol: ING4
  Gene Name: inhibitor of growth family, member 4
  ENSP ID: ENSP00000480978

SEQ ID NO: 40212 - protein, 240 aa, Homo sapiens
  Payload ID: 8193
  Gene Symbol: ING5
  Gene Name: inhibitor of growth family, member 5
  Uniprot ID: Q8WYH8
  ENSP ID: ENSP00000322142
MATAMYLEHYLDSIENLPCELQRNFQLMRELDQRTEDKKAEIDILAAEYISTVKTLSPDQRVERLQKIQNAYSKCKEYSDDKVQLAMQTYEMVDKHIRRLDADLARFEADLKDKMEGSDFESSGGRGLKKGRGQKEKRGSRGRGRRTSEEDTPKKKKHKGGSEFTDTILSVHPSDVLDMPVDPNEPTYCLCHQVSYGEMIGCDNPDCPIEWFHFACVDLTTKPKGKWFCPRCVQEKRKKK

SEQ ID NO: 40213 - protein, 226 aa, Homo sapiens
  Payload ID: 8193
  Gene Symbol: ING5
  Gene Name: inhibitor of growth family, member 5
  Uniprot ID: Q8WYH8
  ENSP ID: ENSP00000385937
MATAMYLEHYLDSIENLPCELQRNFQLMRELDQRTEDKKAEIDILAAEYISTVKTLSPDQRVERLQKIQNAYSKCKEYSDDKVQLAMQTYEMVDKHIRRLDADLARFEADLKDKMEGSDFESSGGRGLKKGRGQKEKRGSRGRGRRTSEEDTPKKKKHKGGSEFTDTILSVHPSDVLDMPVDPNEPTYCLCHQVSYGEMIGCDNPDCPIEWFHFACVDLTTKPKGK

SEQ ID NO: 40214 - protein, 142 aa, Homo sapiens
  Payload ID: 8193
  Gene Symbol: ING5
  Gene Name: inhibitor of growth family, member 5
  ENSP ID: ENSP00000416878
MATAMYLEHYLDSIENLPCELQRNFQLMRELDQRTEDKKAEIDILAAEYISTVKTLSPDQRVERLQKIQNAYSKCKEYSDDKVQLAMQTYEMVDKHIRRLDADLARFEADLKDKMEGSDFESSGGRGLKSKSVNFFSLFYYC

SEQ ID NO: 40215 - protein, 164 aa, Homo sapiens
  Payload ID: 8194
  Gene Symbol: IKBKB
  Gene Name: inhibitor of kappa light polypeptide gene enhancer in B-cells, kinase beta
  ENSP ID: ENSP00000339151
MSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIGKSQSRNSGRVLQGECGAPPLRLDTFMKTESSIGI

SEQ ID NO: 40216 - protein, 697 aa, Homo sapiens
  Payload ID: 8194
  Gene Symbol: IKBKB
  Gene Name: inhibitor of kappa light polypeptide gene enhancer in B-cells, kinase beta
  Uniprot ID: O14920
  ENSP ID: ENSP00000404920
MSSDGTIRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGSLCTSFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 40217 - protein, 76 aa, Homo sapiens
  Payload ID: 8194
  Gene Symbol: IKBKB
  Gene Name: inhibitor of kappa light polypeptide gene enhancer in B-cells, kinase beta
  ENSP ID: ENSP00000427978
MSWSPSLTTQTCGAWEMKERLGTGGFGNVIRWHNQVGPLCSLGRGGEPGPLLTASTFSDPAGPRAHLWLWSSWDSE

SEQ ID NO: 40218 - protein, 562 aa, Homo sapiens
  Payload ID: 8194
  Gene Symbol: IKBKB
  Gene Name: inhibitor of kappa light polypeptide gene enhancer in B-cells, kinase beta
  ENSP ID: ENSP00000428186
MSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGSLCTSFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGIRERSETPGRTDDGSADRHCGLTEEPHGPEAGGNAGRPRGASKGAVQETKGKTSRPAN

SEQ ID NO: 40219 - protein, 48 aa, Homo sapiens
  Payload ID: 8194
  Gene Symbol: IKBKB
  Gene Name: inhibitor of kappa light polypeptide gene enhancer in B-cells, kinase beta
  ENSP ID: ENSP00000428799
MSWSPSLTTQTCGAWEMKERLGTGGFGNVIRWHNQADPPQCGGCPRCP

SEQ ID NO: 40220 - protein, 109 aa, Homo sapiens
  Payload ID: 8194
  Gene Symbol: IKBKB
  Gene Name: inhibitor of kappa light polypeptide gene enhancer in B-cells, kinase beta
  ENSP ID: ENSP00000428892
MSWSPSLTTQTCGAWEMKERLGTGGFGNVIRWHNQDAALRGHCRRLVCTLEVLHYRGPAHIAGPTNVQGYSHGSSFLCREKSAWSTVCHTRDWTVSNSNLSGQSPSSAW

SEQ ID NO: 40221 - protein, 562 aa, Homo sapiens; identical to SEQ ID NO: 40218
  Payload ID: 8194
  Gene Symbol: IKBKB
  Gene Name: inhibitor of kappa light polypeptide gene enhancer in B-cells, kinase beta
  ENSP ID: ENSP00000428922

SEQ ID NO: 40222 - protein, 48 aa, Homo sapiens; identical to SEQ ID NO: 40219
  Payload ID: 8194
  Gene Symbol: IKBKB
  Gene Name: inhibitor of kappa light polypeptide gene enhancer in B-cells, kinase beta
  ENSP ID: ENSP00000429239

SEQ ID NO: 40223 - protein, 51 aa, Homo sapiens
  Payload ID: 8194
  Gene Symbol: IKBKB
  Gene Name: inhibitor of kappa light polypeptide gene enhancer in B-cells, kinase beta
  ENSP ID: ENSP00000429319
MSWSPSLTTQTCGAWEMKERLGTGGFGNVIRWHNQPLRLDTFMKTESSIGI

SEQ ID NO: 40224 - protein, 48 aa, Homo sapiens; identical to SEQ ID NO: 40219
  Payload ID: 8194
  Gene Symbol: IKBKB
  Gene Name: inhibitor of kappa light polypeptide gene enhancer in B-cells, kinase beta
  ENSP ID: ENSP00000429357

SEQ ID NO: 40225 - protein, 48 aa, Homo sapiens; identical to SEQ ID NO: 40219
  Payload ID: 8194
  Gene Symbol: IKBKB
  Gene Name: inhibitor of kappa light polypeptide gene enhancer in B-cells, kinase beta
  ENSP ID: ENSP00000429699

SEQ ID NO: 40226 - protein, 48 aa, Homo sapiens; identical to SEQ ID NO: 40219
  Payload ID: 8194
  Gene Symbol: IKBKB
  Gene Name: inhibitor of kappa light polypeptide gene enhancer in B-cells, kinase beta
  ENSP ID: ENSP00000429924

SEQ ID NO: 40227 - protein, 375 aa, Homo sapiens
  Payload ID: 8194
  Gene Symbol: IKBKB
  Gene Name: inhibitor of kappa light polypeptide gene enhancer in B-cells, kinase beta
  ENSP ID: ENSP00000430114
MSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGSLCTSFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGK

SEQ ID NO: 40228 - protein, 256 aa, Homo sapiens
  Payload ID: 8194
  Gene Symbol: IKBKB
  Gene Name: inhibitor of kappa light polypeptide gene enhancer in B-cells, kinase beta
  Uniprot ID: O14920
  ENSP ID: ENSP00000430483
MSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGSLCTSFVGTLQYLAPELLEQQKYTVTVDYWSFGTLAFECITGFRPFLPNWQPVQCVRMWPGTVAHSCNPSTLGGRGRWIS

SEQ ID NO: 40229 - protein, 43 aa, Homo sapiens
  Payload ID: 8194
  Gene Symbol: IKBKB
  Gene Name: inhibitor of kappa light polypeptide gene enhancer in B-cells, kinase beta
  ENSP ID: ENSP00000430557
MSWSPSLTTQTCGAWEMKERLGTGGFGNVIRWHNQAFKSAAEE

SEQ ID NO: 40230 - protein, 756 aa, Homo sapiens
  Payload ID: 8194
  Gene Symbol: IKBKB
  Gene Name: inhibitor of kappa light polypeptide gene enhancer in B-cells, kinase beta
  Uniprot ID: O14920
  ENSP ID: ENSP00000430684
MSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGSLCTSFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 40231 - protein, 754 aa, Homo sapiens
  Payload ID: 8194
  Gene Symbol: IKBKB
  Gene Name: inhibitor of kappa light polypeptide gene enhancer in B-cells, kinase beta
  Uniprot ID: O14920
  ENSP ID: ENSP00000430868
MFSGGCHSPGFGRPSPAFPAPGSPPPAPRPCRQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGSLCTSFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 40232 - protein, 562 aa, Homo sapiens; identical to SEQ ID NO: 40218
  Payload ID: 8194
  Gene Symbol: IKBKB
  Gene Name: inhibitor of kappa light polypeptide gene enhancer in B-cells, kinase beta
  ENSP ID: ENSP00000486961

SEQ ID NO: 40233 - protein, 1332 aa, Homo sapiens
  Payload ID: 8195
  Gene Symbol: IKBKAP
  Gene Name: inhibitor of kappa light polypeptide gene enhancer in B-cells, kinase complex-associated protein
  Uniprot ID: O95163
  ENSP ID: ENSP00000363779
MRNLKLFRTLEFRDIQGPGNPQCFSLRTEQGTVLIGSEHGLIEVDPVSREVKNEVSLVAEGFLPEDGSGRIVGVQDLLDQESVCVATASGDVILCSLSTQQLECVGSVASGISVMSWSPDQELVLLATGQQTLIMMTKDFEPILEQQIHQDDFGESKFITVGWGRKETQFHGSEGRQAAFQMQMHESALPWDDHRPQVTWRGDGQFFAVSVVCPETGARKVRVWNREFALQSTSEPVAGLGPALAWKPSGSLIASTQDKPNQQDIVFFEKNGLLHGHFTLPFLKDEVKVNDLLWNADSSVLAVWLEDLQREESSIPKTCVQLWTVGNYHWYLKQSLSFSTCGKSKIVSLMWDPVTPYRLHVLCQGWHYLAYDWHWTTDRSVGDNSSDLSNVAVIDGNRVLVTVFRQTVVPPPMCTYQLLFPHPVNQVTFLAHPQKSNDLAVLDASNQISVYKCGDCPSADPTVKLGAVGGSGFKVCLRTPHLEKRYKIQFENNEDQDVNPLKLGLLTWIEEDVFLAVSHSEFSPRSVIHHLTAASSEMDEEHGQLNVSSSAAVDGVIISLCCNSKTKSVVLQLADGQIFKYLWESPSLAIKPWKNSGGFPVRFPYPCTQTELAMIGEEECVLGLTDRCRFFINDIEVASNITSFAVYDEFLLLTTHSHTCQCFCLRDASFKTLQAGLSSNHVSHGEVLRKVERGSRIVTVVPQDTKLVLQMPRGNLEVVHHRALVLAQIRKWLDKLMFKEAFECMRKLRINLNLIYDHNPKVFLGNVETFIKQIDSVNHINLFFTELKEEDVTKTMYPAPVTSSVYLSRDPDGNKIDLVCDAMRAVMESINPHKYCLSILTSHVKKTTPELEIVLQKVHELQGNAPSDPDAVSAEEALKYLLHLVDVNELYDHSLGTYDFDLVLMVAEKSQKDPKEYLPFLNTLKKMETNYQRFTIDKYLKRYEKAIGHLSKCGPEYFPECLNLIKDKNLYNEALKLYSPSSQQYQDISIAYGEHLMQEHMYEPAGLMFARCGAHEKALSAFLTCGNWKQALCVAAQLNFTKDQLVGLGRTLAGKLVEQRKHIDAAMVLEECAQDYEEAVLLLLEGAAWEEALRLVYKYNRLDIIETNVKPSILEAQKNYMAFLDSQTATFSRHKKRLLVVRELKEQAQQAGLDDEVPHGQESDLFSETSSVVSGSEMSGKYSHSNSRISARSSKNRRKAERKKHSLKEGSPLEDLALLEALSEVVQNTENLKDEVYHILKVLFLFEFDEQGRELQKAFEDTLQLMERSLPEIWTLTYQQNSATPVLGPNSTANSIMASYQQQKTSVPVLDAELFIPPKINRRTQWKLSLLD

SEQ ID NO: 40234 - protein, 346 aa, Homo sapiens
  Payload ID: 8195
  Gene Symbol: IKBKAP
  Gene Name: inhibitor of kappa light polypeptide gene enhancer in B-cells, kinase complex-associated protein
  ENSP ID: ENSP00000433514
  MOD_RES (1)..(1): Any amino acid
XPEYFPECLNLIKDKNLYNEALKLYSPSSQQYQDISIAYGEHLMQEHMYEPAGLMFARCGAHEKALSAFLTCGNWKQALCVAAQLNFTKDQLVGLGRTLAGKLVEQRKHIDAAMVLEECAQDYEEAVLLLLEGAAWEEALRLVYKYNRLDIIETNVKPSILEAQKNYMAFLDSQTATFSRHKKRLLVVRELKEQAQQAGLDDEVPHGQESDLFSETSSVVSGSEMSGKYSHSNSRISARSSKNRRKAERKKHSLKEGSPLEDLALLEALSEVVQNTENLKDEVYHILKVLFLFEFDEQGRELQKAFEDTLQLMERSLPEIWTLTYQQNSATPTWGEGVLLCCPSWS

SEQ ID NO: 40235 - protein, 983 aa, Homo sapiens
  Payload ID: 8195
  Gene Symbol: IKBKAP
  Gene Name: inhibitor of kappa light polypeptide gene enhancer in B-cells, kinase complex-associated protein
  ENSP ID: ENSP00000439367
MWDPVTPYRLHVLCQGWHYLAYDWHWTTDRSVGDNSSDLSNVAVIDGNRVLVTVFRQTVVPPPMCTYQLLFPHPVNQVTFLAHPQKSNDLAVLDASNQISVYKCGDCPSADPTVKLGAVGGSGFKVCLRTPHLEKRYKIQFENNEDQDVNPLKLGLLTWIEEDVFLAVSHSEFSPRSVIHHLTAASSEMDEEHGQLNVSSSAAVDGVIISLCCNSKTKSVVLQLADGQIFKYLWESPSLAIKPWKNSGGFPVRFPYPCTQTELAMIGEEECVLGLTDRCRFFINDIEVASNITSFAVYDEFLLLTTHSHTCQCFCLRDASFKTLQAGLSSNHVSHGEVLRKVERGSRIVTVVPQDTKLVLQMPRGNLEVVHHRALVLAQIRKWLDKLMFKEAFECMRKLRINLNLIYDHNPKVFLGNVETFIKQIDSVNHINLFFTELKEEDVTKTMYPAPVTSSVYLSRDPDGNKIDLVCDAMRAVMESINPHKYCLSILTSHVKKTTPELEIVLQKVHELQGNAPSDPDAVSAEEALKYLLHLVDVNELYDHSLGTYDFDLVLMVAEKSQKDPKEYLPFLNTLKKMETNYQRFTIDKYLKRYEKAIGHLSKCGPEYFPECLNLIKDKNLYNEALKLYSPSSQQYQDISIAYGEHLMQEHMYEPAGLMFARCGAHEKALSAFLTCGNWKQALCVAAQLNFTKDQLVGLGRTLAGKLVEQRKHIDAAMVLEECAQDYEEAVLLLLEGAAWEEALRLVYKYNRLDIIETNVKPSILEAQKNYMAFLDSQTATFSRHKKRLLVVRELKEQAQQAGLDDEVPHGQESDLFSETSSVVSGSEMSGKYSHSNSRISARSSKNRRKAERKKHSLKEGSPLEDLALLEALSEVVQNTENLKDEVYHILKVLFLFEFDEQGRELQKAFEDTLQLMERSLPEIWTLTYQQNSATPVLGPNSTANSIMASYQQQKTSVPVLDAELFIPPKINRRTQWKLSLLD

SEQ ID NO: 40236 - protein, 631 aa, Homo sapiens
  Payload ID: 8196
  Gene Symbol: IKBKE
  Gene Name: inhibitor of kappa light polypeptide gene enhancer in B-cells, kinase epsilon
  Uniprot ID: Q14164
  ENSP ID: ENSP00000462396
MEYCSSGSLLSVLESPENAFGLPEDEFLVVLRCVVAGMNHLRENGIVHRDIKPGNIMRLVGEEGQSIYKLTDFGAARELDDDEKFVSVYGTEEYLHPDMYERAVLRKPQQKAFGVTVDLWSIGVTLYHAATGSLPFIPFGGPRRNKEIMYRITTEKPAGAIAGAQRRENGPLEWSYTLPITCQLSLGLQSQLVPILANILEVEQAKCWGFDQFFAETSDILQRVVVHVFSLSQAVLHHIYIHAHNTIAIFQEAVHKQTSVAPRHQEYLFEGHLCVLEPSVSAQHIAHTTASSPLTLFSTAIPKGLAFRDPALDVPKFVPKVDLQADYNTAKGVLGAGYQALRLARALLDGQELMFRGLHWVMEVLQATCRRTLEVARTSLLYLSSSLGTERFSSVAGTPEIQELKAAAELRSRLRTLAEVLSRCSQNITETQESLSSLNRELVKSRDQVHEDRSIQQIQCCLDKMNFIYKQFKKSRMRPGLGYNEEQIHKLDKVNFSHLAKRLLQVFQEECVQKYQASLVTHGKRMRVVHETRNHLRLVGCSVAACNTEAQGVQESLSKLLEELSHQLLQDRAKGAQASPPPIAPYPSPTRKDLLLHMQELCEGMKLLASDLLDNNRIIERLNRVPAPPDV

SEQ ID NO: 40237 - protein, 716 aa, Homo sapiens
  Payload ID: 8196
  Gene Symbol: IKBKE
  Gene Name: inhibitor of kappa light polypeptide gene enhancer in B-cells, kinase epsilon
  Uniprot ID: Q14164
  ENSP ID: ENSP00000464030
MQSTANYLWHTDDLLGQGATASVYKARNKKSGELVAVKVFNTTSYLRPREVQVREFEVLRKLNHQNIVKLFAVEETGGSRQKVLVMEYCSSGSLLSVLESPENAFGLPEDEFLVVLRCVVAGMNHLRENGIVHRDIKPGNIMRLVGEEGQSIYKLTDFGAARELDDDEKFVSVYGTEEYLHPDMYERAVLRKPQQKAFGVTVDLWSIGVTLYHAATGSLPFIPFGGPRRNKEIMYRITTEKPAGAIAGAQRRENGPLEWSYTLPITCQLSLGLQSQLVPILANILEVEQAKCWGFDQFFAETSDILQRVVVHVFSLSQAVLHHIYIHAHNTIAIFQEAVHKQTSVAPRHQEYLFEGHLCVLEPSVSAQHIAHTTASSPLTLFSTAIPKGLAFRDPALDVPKFVPKVDLQADYNTAKGVLGAGYQALRLARALLDGQELMFRGLHWVMEVLQATCRRTLEVARTSLLYLSSSLGTERFSSVAGTPEIQELKAAAELRSRLRTLAEVLSRCSQNITETQESLSSLNRELVKSRDQVHEDRSIQQIQCCLDKMNFIYKQFKKSRMRPGLGYNEEQIHKLDKVNFSHLAKRLLQVFQEECVQKYQASLVTHGKRMRVVHETRNHLRLVGCSVAACNTEAQGVQESLSKLLEELSHQLLQDRAKGAQASPPPIAPYPSPTRKDLLLHMQELCEGMKLLASDLLDNNRIIERLNRVPAPPDV

SEQ ID NO: 40238 - protein, 657 aa, Homo sapiens
  Payload ID: 8196
  Gene Symbol: IKBKE
  Gene Name: inhibitor of kappa light polypeptide gene enhancer in B-cells, kinase epsilon
  ENSP ID: ENSP00000473833
MQSTANYLWHTDDLLGQGATASVYKARNKKSGELVAVKVFNTTSYLRPREVQVREFEVLRKLNHQNIVKLFAVEETGGSRQKVLVMEYCSSGSLLSVLESPENAFGLPEDEFLVVLRCVVAGMNHLRENGIVHRDIKPGNIMRLVGEEGQSIYKLTDFGAARELDDDEKFVSVYGTEEYLHPDMYERAVLRKPQQKAFGVTVDLWSIGVTLYHAATGSLPFIPFGGPRRNKEIMYRITTEKPAGAIAGAQRRENGPLEWSYTLPITCQLSLGLQSQLVPILANILEVEQAKCWGFDQFFAETSDILQRVVVHVFSLSQAVLHHIYIHAHNTIAIFQEAVHKQTSVAPRHQEYLFEGHLCVLEPSVSAQHIAHTTASSPLTLFSTAIPKGLAFRDPALDVPKFVPKVDLQADYNTAKGVLGAGYQALRLARALLDGQELMFRGLHWVMEVLQATCRRTLEVARTSLLYLSSSLGTERFSSVAGTPEIQELKAAAELRSRLRTLAEVLSRCSQNITETQESLSSLNRELVKSRDQVHEDRSIQQIQCCLDKMNFIYKQFKKSRMRPGLGYNEEQIHKLDKVNFSHLAKRLLQVFQEECVQKYQASLVTHGKRMRVVHETRNHLRLVGCSVAACNTEAQGVQESLSKHARALRGDEAAGI

SEQ ID NO: 40239 - protein, 146 aa, Homo sapiens
  Payload ID: 8196
  Gene Symbol: IKBKE
  Gene Name: inhibitor of kappa light polypeptide gene enhancer in B-cells, kinase epsilon
  ENSP ID: ENSP00000474229
MQSTANYLWHTDDLLGQGATASVYKARNKKSGELVAVKVFNTTSYLRPREVQVREFEVLRKLNHQNIVKLFAVEETGGSRQKVLVMEYCSSGSLLSVLESPENAFGLPEDEFLVVLRCVVAGMNHLRENGIVHRDIKPGNIMRLVG

SEQ ID NO: 40240 - protein, 153 aa, Homo sapiens
  Payload ID: 8196
  Gene Symbol: IKBKE
  Gene Name: inhibitor of kappa light polypeptide gene enhancer in B-cells, kinase epsilon
  ENSP ID: ENSP00000474422
MQSTANYLWHTDDLLGQGATASVYKARNKKSGELVAVKVFNTTSYLRPREVQVREFEVLRKLNHQNIVKLFAVEETGGSRQKVLVMEYCSSGSLLSVLESPENAFGLPEDEFLVVLRCVGEPLPVPASTLRPAAGLGQMLTGLRCLTPANHSI

SEQ ID NO: 40241 - protein, 172 aa, Homo sapiens
  Payload ID: 8197
  Gene Symbol: IKBKG
  Gene Name: inhibitor of kappa light polypeptide gene enhancer in B-cells, kinase gamma
  ENSP ID: ENSP00000390368
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEG

SEQ ID NO: 40242 - protein, 250 aa, Homo sapiens
  Payload ID: 8197
  Gene Symbol: IKBKG
  Gene Name: inhibitor of kappa light polypeptide gene enhancer in B-cells, kinase gamma
  ENSP ID: ENSP00000394934
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVV

SEQ ID NO: 40243 - protein, 138 aa, Homo sapiens
  Payload ID: 8197
  Gene Symbol: IKBKG
  Gene Name: inhibitor of kappa light polypeptide gene enhancer in B-cells, kinase gamma
  ENSP ID: ENSP00000395205
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAED

SEQ ID NO: 40244 - protein, 195 aa, Homo sapiens
  Payload ID: 8197
  Gene Symbol: IKBKG
  Gene Name: inhibitor of kappa light polypeptide gene enhancer in B-cells, kinase gamma
  ENSP ID: ENSP00000398579
MVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQ

SEQ ID NO: 40245 - protein, 419 aa, Homo sapiens
  Payload ID: 8197
  Gene Symbol: IKBKG
  Gene Name: inhibitor of kappa light polypeptide gene enhancer in B-cells, kinase gamma
  Uniprot ID: Q9Y6K9
  ENSP ID: ENSP00000471166
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAKQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 40246 - protein, 320 aa, Homo sapiens
  Payload ID: 8197
  Gene Symbol: IKBKG
  Gene Name: inhibitor of kappa light polypeptide gene enhancer in B-cells, kinase gamma
  Uniprot ID: Q9Y6K9
  ENSP ID: ENSP00000478616
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRRKLAQLQVAYHQLFQEYDNHIKSSVVGSERKRADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 40247 - protein, 412 aa, Homo sapiens
  Payload ID: 8197
  Gene Symbol: IKBKG
  Gene Name: inhibitor of kappa light polypeptide gene enhancer in B-cells, kinase gamma
  ENSP ID: ENSP00000478979
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVGMQLEDLKQQLQQAEEALVAKQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 40248 - protein, 115 aa, Homo sapiens
  Payload ID: 8197
  Gene Symbol: IKBKG
  Gene Name: inhibitor of kappa light polypeptide gene enhancer in B-cells, kinase gamma
  ENSP ID: ENSP00000479144
MAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSV

SEQ ID NO: 40249 - protein, 419 aa, Homo sapiens; identical to SEQ ID NO: 40245
  Payload ID: 8197
  Gene Symbol: IKBKG
  Gene Name: inhibitor of kappa light polypeptide gene enhancer in B-cells, kinase gamma
  Uniprot ID: Q9Y6K9
  ENSP ID: ENSP00000479662

SEQ ID NO: 40250 - protein, 48 aa, Homo sapiens
  Payload ID: 8197
  Gene Symbol: IKBKG
  Gene Name: inhibitor of kappa light polypeptide gene enhancer in B-cells, kinase gamma
  ENSP ID: ENSP00000480431
MALVIQVGKLRPREVRTPQTINPSLFPSLPVKLSSIIEVPSALALLDE

SEQ ID NO: 40251 - protein, 411 aa, Homo sapiens
  Payload ID: 8197
  Gene Symbol: IKBKG
  Gene Name: inhibitor of kappa light polypeptide gene enhancer in B-cells, kinase gamma
  ENSP ID: ENSP00000483381
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVGMQLEDLKQQLQQAEEALVAKQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 40252 - protein, 487 aa, Homo sapiens
  Payload ID: 8197
  Gene Symbol: IKBKG
  Gene Name: inhibitor of kappa light polypeptide gene enhancer in B-cells, kinase gamma
  Uniprot ID: Q9Y6K9
  ENSP ID: ENSP00000483825
MALVIQVGKLRPREVRTPQTINPSLFPSLPVKLSSIIEVPSGGERCCSRRTLVYKARAFWKGAPLPCWMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAKQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 40253 - protein, 418 aa, Homo sapiens
  Payload ID: 8197
  Gene Symbol: IKBKG
  Gene Name: inhibitor of kappa light polypeptide gene enhancer in B-cells, kinase gamma
  ENSP ID: ENSP00000484023
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAKQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 40254 - protein, 181 aa, Homo sapiens
  Payload ID: 8197
  Gene Symbol: IKBKG
  Gene Name: inhibitor of kappa light polypeptide gene enhancer in B-cells, kinase gamma
  ENSP ID: ENSP00000484275
ENQELRDAIRQSNQILRERCEELLHFQASQREEKEFLMCKFQEARKLVERLGLEKLDLKRQKEQALREVEHLKRCQQERTQVTVSEGSGRTGRAPGETRRELQRLLAQGSCADGTCFFRQQCGTASTESQPGSSPQPWRPGFSRGVGRVGTERLRGQPWSLGCSHQRSSCVAQGSPHKSCH

SEQ ID NO: 40255 - protein, 141 aa, Homo sapiens
  Payload ID: 8198
  Gene Symbol: INMT-FAM188B
  Gene Name: INMT-FAM188B readthrough (NMD candidate)
  ENSP ID: ENSP00000456039
MKGGFTGGDEYQKHFLPRDYLATYYSFDGSPSPEAEMLKFNLECLHKTFGPGLQGDTLIDIGSGPTIYQVLAACDSFQDITLSDFTDRNREELEKWLKKEPGAYDWTPAVKFACELEGNRDMELINNTTLVNSRHPAITGP

SEQ ID NO: 40256 - protein, 122 aa, Homo sapiens
  Payload ID: 8198
  Gene Symbol: INMT-FAM188B
  Gene Name: INMT-FAM188B readthrough (NMD candidate)
  ENSP ID: ENSP00000456833
  MOD_RES (1)..(1): Any amino acid
XKGGFTGGDEYQKHFLPRDYLATYYSFDGSPSPEAEMLKFNLECLHKTFGPGGLQGDTLIDIGSGPTIYQVLAACDSFQDITLSDFTDRNREELEKWLKKEPGAYDWTPAVKFACELEGNRA

SEQ ID NO: 40257 - protein, 914 aa, Homo sapiens
  Payload ID: 8199
  Gene Symbol: INCENP
  Gene Name: inner centromere protein antigens 135/155kDa
  Uniprot ID: Q9NQS7
  ENSP ID: ENSP00000278849
MGTTAPGPIHLLELCDQKLMEFLCNMDNKDLVWLEEIQEEAERMFTREFSKEPELMPKTPSQKNRRKKRRISYVQDENRDPIRRRLSRRKSRSSQLSSRRLRSKDSVEKLATVVGENGSVLRRVTRAAAAAAAATMALAAPSSPTPESPTMLTKKPEDNHTQCQLVPVVEIGISERQNAEQHVTQLMSTEPLPRTLSPTPASATAPTSQGIPTSDEESTPKKSKARILESITVSSLMATPQDPKGQGVGTGRSASKLRIAQVSPGPRDSPAFPDSPWRERVLAPILPDNFSTPTGSRTDSQSVRHSPIAPSSPSPQVLAQKYSLVAKQESVVRRASRRLAKKTAEEPAASGRIICHSYLERLLNVEVPQKVGSEQKEPPEEAEPVAAAEPEVPENNGNNSWPHNDTEIANSTPNPKPAASSPETPSAGQQEAKTDQADGPREPPQSARRKRSYKQAVSELDEEQHLEDEELQPPRSKTPSSPCPASKVVRPLRTFLHTVQRNQMLMTPTSAPRSVMKSFIKRNTPLRMDPKEKERQRLENLRRKEEAEQLRRQKVEEDKRRRLEEVKLKREERLRKVLQARERVEQMKEEKKKQIEQKFAQIDEKTEKAKEERLAEEKAKKKAAAKKMEEVEARRKQEEEARRLRWLQQEEEERRHQELLQKKKEEEQERLRKAAEAKRLAEQREQERREQERREQERREQERREQERREQERQLAEQERRREQERLQAERELQEREKALRLQKEQLQRELEEKKKKEEQQRLAERQLQEEQEKKAKEAAGASKALNVTVDVQSPACTSYQMTPQGHRAPPKINPDNYGMDLNSDDSTDDEAHPRKPIPTWARGTPLSQAIIHQYYHPPNLLELFGTILPLDLEDIFKKSKPRYHKRTSSAVWNSPPLQGARVPSSLAYSLKKH

SEQ ID NO: 40258 - protein, 918 aa, Homo sapiens
  Payload ID: 8199
  Gene Symbol: INCENP
  Gene Name: inner centromere protein antigens 135/155kDa
  Uniprot ID: Q9NQS7
  ENSP ID: ENSP00000378295
MGTTAPGPIHLLELCDQKLMEFLCNMDNKDLVWLEEIQEEAERMFTREFSKEPELMPKTPSQKNRRKKRRISYVQDENRDPIRRRLSRRKSRSSQLSSRRLRSKDSVEKLATVVGENGSVLRRVTRAAAAAAAATMALAAPSSPTPESPTMLTKKPEDNHTQCQLVPVVEIGISERQNAEQHVTQLMSTEPLPRTLSPTPASATAPTSQGIPTSDEESTPKKSKARILESITVSSLMATPQDPKGQGVGTGRSASKLRIAQVSPGPRDSPAFPDSPWRERVLAPILPDNFSTPTGSRTDSQSVRHSPIAPSSPSPQVLAQKYSLVAKQESVVRRASRRLAKKTAEEPAASGRIICHSYLERLLNVEVPQKVGSEQKEPPEEAEPVAAAEPEVPENNGNNSWPHNDTEIANSTPNPKPAASSPETPSAGQQEAKTDQADGPREPPQSARRKRSYKQAVSELDEEQHLEDEELQPPRSKTPSSPCPASKVVRPLRTFLHTVQRNQMLMTPTSAPRSVMKSFIKRNTPLRMDPKCSFVEKERQRLENLRRKEEAEQLRRQKVEEDKRRRLEEVKLKREERLRKVLQARERVEQMKEEKKKQIEQKFAQIDEKTEKAKEERLAEEKAKKKAAAKKMEEVEARRKQEEEARRLRWLQQEEEERRHQELLQKKKEEEQERLRKAAEAKRLAEQREQERREQERREQERREQERREQERREQERQLAEQERRREQERLQAERELQEREKALRLQKEQLQRELEEKKKKEEQQRLAERQLQEEQEKKAKEAAGASKALNVTVDVQSPACTSYQMTPQGHRAPPKINPDNYGMDLNSDDSTDDEAHPRKPIPTWARGTPLSQAIIHQYYHPPNLLELFGTILPLDLEDIFKKSKPRYHKRTSSAVWNSPPLQGARVPSSLAYSLKKH

SEQ ID NO: 40259 - protein, 167 aa, Homo sapiens
  Payload ID: 8199
  Gene Symbol: INCENP
  Gene Name: inner centromere protein antigens 135/155kDa
  ENSP ID: ENSP00000433100
MGTTAPGPIHLLELCDQKLMEFLCNMDNKDLVWLEEIQEEAERMFTREFSKEPELMPKTPSQKNRRKKRRISYVQDENRDPIRRRLSRRKSRSSQLSSRRLRSKDSVEKLATVVGENGSVLRRVTRAAAAAAAATMALAAPSSPTPESPTMLTKKPEDNHTQCQLVP

SEQ ID NO: 40260 - protein, 659 aa, Homo sapiens
  Payload ID: 8200
  Gene Symbol: IMMT
  Gene Name: inner membrane protein, mitochondrial
  ENSP ID: ENSP00000254636
MVLGPAAYNVPLPKKSIQSGPLKISSVSEVMKESKQPASQLQKQKGDTPASATAGDTLSVPAPAVQPEESLKTDHPEIGEGKPTPALSEASSSSIRERPPEEVAARLAQQEKQEQVKIESLAKSLEDALRQTASVTLQAIAAQNAAVQAVNAHSNILKAAMDNSEIAGEKKSAQWRTVEGALKERRKAVDEAADALLKAKEELEKMKSVIENAKKKEVAGAKPHITAAEGKLHNMIVDLDNVVKKVQAAQSEAKVVSQYHELVVQARDDFKRELDSITPEVLPGWKGMSVSDLADKLSTDDLNSLIAHAHRRIDQLNRELAEQKATEKQHITLALEKQKLEEKRAFDSAVAKALEHHRSEIQAEQDRKIEEVRDAMENEMRTQLRRQAAAHTDHLRDVLRVQEQELKSEFEQNLSEKLSEQELQFRRLSQEQVDNFTLDINTAYARLRGIEQAVQSHAVAEEEARKAHQLWLSVEALKYSMKTSSAETPTIPLGSAVEAIKANCSDNEFTQALTAAIPPESLTRGVYSEETLRARFYAVQKLARRVAMIDETRNSLYQYFLSYLQSLLLFPPQQLKPPPELCPEDINTFKLLSYASYCIEHGDLELAAKFVNQLKGESRRVAQDWLKEARMTLETKQIVEILTAYASAVGIGTTQVQPE

SEQ ID NO: 40261 - protein, 711 aa, Homo sapiens
  Payload ID: 8200
  Gene Symbol: IMMT
  Gene Name: inner membrane protein, mitochondrial
  ENSP ID: ENSP00000387227
MLRACQLSGVTAAAQSCLCGKFVLRPLRPCRRYSTSGSSGLTTGKIAGAGLLFVGGGIGGTILYAKWDSHFRESVEKTIPYSDKLFEMVLGPAAYNVPLPKKSIQSGPLKISSVSEVMKESKQPASQLQKQKGDTPASATEASSSSIRERPPEEVAARLAQQEKQEQVKIESLAKSLEDALRQTASVTLQAIAAQNAAVQAVNAHSNILKAAMDNSEIAGEKKSAQWRTVEGALKERRKAVDEAADALLKAKEELEKMKSVIENAKKKEVAGAKPHITAAEGKLHNMIVDLDNVVKKVQAAQSEAKVVSQYHELVVQARDDFKRELDSITPEVLPGWKGMSVSDLADKLSTDDLNSLIAHAHRRIDQLNRELAEQKATEKQHITLALEKQKLEEKRAFDSAVAKALEHHRSEIQAEQDRKIEEVRDAMENEMRTQLRRQAAAHTDHLRDVLRVQEQELKSEFEQNLSEKLSEQELQFRRLSQEQVDNFTLDINTAYARLRGIEQAVQSHAVAEEEARKAHQLWLSVEALKYSMKTSSAETPTIPLGSAVEAIKANCSDNEFTQALTAAIPPESLTRGVYSEETLRARFYAVQKLARRVAMIDETRNSLYQYFLSYLQSLLLFPPQQLKPPPELCPEDINTFKLLSYASYCIEHGDLELAAKFVNQLKGESRRVAQDWLKEARMTLETKQIVEILTAYASAVGIGTTQVQPE

SEQ ID NO: 40262 - protein, 147 aa, Homo sapiens
  Payload ID: 8200
  Gene Symbol: IMMT
  Gene Name: inner membrane protein, mitochondrial
  ENSP ID: ENSP00000387237
MLRACQLSGVTAAAQSCLCGKFVLRPLRPCRRYSTSGSSGLTTGKIAGAGLLFVGGGIGGTILYAKWDSHFRESVEKTIPYSDKLFEMVLGPAAYNVPLPKKSIQSGPLKISSVSEVMKESKQPASQLQKQKGDTPASATGKYKYHE

SEQ ID NO: 40263 - protein, 758 aa, Homo sapiens
  Payload ID: 8200
  Gene Symbol: IMMT
  Gene Name: inner membrane protein, mitochondrial
  Uniprot ID: Q16891
  ENSP ID: ENSP00000387262
MLRACQLSGVTAAAQSCLCGKFVLRPLRPCRRYSTSGSSGLTTGKIAGAGLLFVGGGIGGTILYAKWDSHFRESVEKTIPYSDKLFEMVLGPAAYNVPLPKKSIQSGPLKISSVSEVMKESKQPASQLQKQKGDTPASATAPTEAAQIISAAGDTLSVPAPAVQPEESLKTDHPEIGEGKPTPALSEEASSSSIRERPPEEVAARLAQQEKQEQVKIESLAKSLEDALRQTASVTLQAIAAQNAAVQAVNAHSNILKAAMDNSEIAGEKKSAQWRTVEGALKERRKAVDEAADALLKAKEELEKMKSVIENAKKKEVAGAKPHITAAEGKLHNMIVDLDNVVKKVQAAQSEAKVVSQYHELVVQARDDFKRELDSITPEVLPGWKGMSVSDLADKLSTDDLNSLIAHAHRRIDQLNRELAEQKATEKQHITLALEKQKLEEKRAFDSAVAKALEHHRSEIQAEQDRKIEEVRDAMENEMRTQLRRQAAAHTDHLRDVLRVQEQELKSEFEQNLSEKLSEQELQFRRLSQEQVDNFTLDINTAYARLRGIEQAVQSHAVAEEEARKAHQLWLSVEALKYSMKTSSAETPTIPLGSAVEAIKANCSDNEFTQALTAAIPPESLTRGVYSEETLRARFYAVQKLARRVAMIDETRNSLYQYFLSYLQSLLLFPPQQLKPPPELCPEDINTFKLLSYASYCIEHGDLELAAKFVNQLKGESRRVAQDWLKEARMTLETKQIVEILTAYASAVGIGTTQVQPE

SEQ ID NO: 40264 - protein, 747 aa, Homo sapiens
  Payload ID: 8200
  Gene Symbol: IMMT
  Gene Name: inner membrane protein, mitochondrial
  Uniprot ID: Q16891
  ENSP ID: ENSP00000396899
MLRACQLSGVTAAAQSCLCGKFVLRPLRPCRRYSTSGSSGLTTGKIAGAGLLFVGGGIGGTILYAKWDSHFRESVEKTIPYSDKLFEMVLGPAAYNVPLPKKSIQSGPLKISSVSEVMKESKQPASQLQKQKGDTPASATAGDTLSVPAPAVQPEESLKTDHPEIGEGKPTPALSEEASSSSIRERPPEEVAARLAQQEKQEQVKIESLAKSLEDALRQTASVTLQAIAAQNAAVQAVNAHSNILKAAMDNSEIAGEKKSAQWRTVEGALKERRKAVDEAADALLKAKEELEKMKSVIENAKKKEVAGAKPHITAAEGKLHNMIVDLDNVVKKVQAAQSEAKVVSQYHELVVQARDDFKRELDSITPEVLPGWKGMSVSDLADKLSTDDLNSLIAHAHRRIDQLNRELAEQKATEKQHITLALEKQKLEEKRAFDSAVAKALEHHRSEIQAEQDRKIEEVRDAMENEMRTQLRRQAAAHTDHLRDVLRVQEQELKSEFEQNLSEKLSEQELQFRRLSQEQVDNFTLDINTAYARLRGIEQAVQSHAVAEEEARKAHQLWLSVEALKYSMKTSSAETPTIPLGSAVEAIKANCSDNEFTQALTAAIPPESLTRGVYSEETLRARFYAVQKLARRVAMIDETRNSLYQYFLSYLQSLLLFPPQQLKPPPELCPEDINTFKLLSYASYCIEHGDLELAAKFVNQLKGESRRVAQDWLKEARMTLETKQIVEILTAYASAVGIGTTQVQPE

SEQ ID NO: 40265 - protein, 757 aa, Homo sapiens
  Payload ID: 8200
  Gene Symbol: IMMT
  Gene Name: inner membrane protein, mitochondrial
  Uniprot ID: Q16891
  ENSP ID: ENSP00000407788
MLRACQLSGVTAAAQSCLCGKFVLRPLRPCRRYSTSGSSGLTTGKIAGAGLLFVGGGIGGTILYAKWDSHFRESVEKTIPYSDKLFEMVLGPAAYNVPLPKKSIQSGPLKISSVSEVMKESKQPASQLQKQKGDTPASATAPTEAAQIISAAGDTLSVPAPAVQPEESLKTDHPEIGEGKPTPALSEASSSSIRERPPEEVAARLAQQEKQEQVKIESLAKSLEDALRQTASVTLQAIAAQNAAVQAVNAHSNILKAAMDNSEIAGEKKSAQWRTVEGALKERRKAVDEAADALLKAKEELEKMKSVIENAKKKEVAGAKPHITAAEGKLHNMIVDLDNVVKKVQAAQSEAKVVSQYHELVVQARDDFKRELDSITPEVLPGWKGMSVSDLADKLSTDDLNSLIAHAHRRIDQLNRELAEQKATEKQHITLALEKQKLEEKRAFDSAVAKALEHHRSEIQAEQDRKIEEVRDAMENEMRTQLRRQAAAHTDHLRDVLRVQEQELKSEFEQNLSEKLSEQELQFRRLSQEQVDNFTLDINTAYARLRGIEQAVQSHAVAEEEARKAHQLWLSVEALKYSMKTSSAETPTIPLGSAVEAIKANCSDNEFTQALTAAIPPESLTRGVYSEETLRARFYAVQKLARRVAMIDETRNSLYQYFLSYLQSLLLFPPQQLKPPPELCPEDINTFKLLSYASYCIEHGDLELAAKFVNQLKGESRRVAQDWLKEARMTLETKQIVEILTAYASAVGIGTTQVQPE

SEQ ID NO: 40266 - protein, 613 aa, Homo sapiens
  Payload ID: 8200
  Gene Symbol: IMMT
  Gene Name: inner membrane protein, mitochondrial
  ENSP ID: ENSP00000415762
  MOD_RES (1)..(1): Any amino acid
XIQSGPLKISSVSEVMKESKQPASQLQKQKGDTPASATAGDTLSVPAPAVQPEESLKTDHPEIGEGKPTPALSALAKSLEDALRQTASVTLQAIAAQNAAVQAVNAHSNILKAAMDNSEIAGEKKSAQWRTVEGALKERRKAVDEAADALLKAKEELEKMKSVIENAKKKEVAGAKPHITAAEGKLHNMIVDLDNVVKKVQAAQSEAKVVSQYHELVVQARDDFKRELDSITPEVLPGWKGMSVSDLADKLSTDDLNSLIAHAHRRIDQLNRELAEQKATEKQHITLALEKQKLEEKRAFDSAVAKALEHHRSEIQAEQDRKIEEVRDAMENEMRTQLRRQAAAHTDHLRDVLRVQEQELKSEFEQNLSEKLSEQELQFRRLSQEQVDNFTLDINTAYARLRGIEQAVQSHAVAEEEARKAHQLWLSVEALKYSMKTSSAETPTIPLGSAVEAIKANCSDNEFTQALTAAIPPESLTRGVYSEETLRARFYAVQKLARRVAMIDETRNSLYQYFLSYLQSLLLFPPQQLKPPPELCPEDINTFKLLSYASYCIEHGDLELAAKFVNQLKGESRRVAQDWLKEARMTLETKQIVEILTAYASAVGIGTTQVQPE

SEQ ID NO: 40267 - protein, 372 aa, Homo sapiens
  Payload ID: 8200
  Gene Symbol: IMMT
  Gene Name: inner membrane protein, mitochondrial
  ENSP ID: ENSP00000482042
MLRACQLSGVTAAAQSCLCGKFVLRPLRPCRRYSTSGSSGLTTGKIAGAGLLFVGGGIGGTILYAKWDSHFRESVEKTIPYSDKLFEMVLGPAAYNVPLPKKSIQSGPLKISSVSEVMKESKQPASQLQKQKGDTPASATAGDTLSVPAPAVQPEESLKTDHPEIGEGKPTPALSEASSSSIRERPPEEVAARLAQQEKQEQVKIESLAKSLEDALRQTASVTLQAIAAIPPESLTRGVYSEETLRARFYAVQKLARRVAMIDETRNSLYQYFLSYLQSLLLFPPQQLKPPPELCPEDINTFKLLSYASYCIEHGDLELAAKFVNQLKGESRRVAQDWLKEARMTLETKQIVEILTAYASAVGIGTTQVQPE

SEQ ID NO: 40268 - protein, 166 aa, Homo sapiens
  Payload ID: 8201
  Gene Symbol: IMMP1L
  Gene Name: inner mitochondrial membrane peptidase subunit 1
  Uniprot ID: Q96LU5
  ENSP ID: ENSP00000278200
MLRGVLGKTFRLVGYTIQYGCIAHCAFEYVGGVVMCSGPSMEPTIQNSDIVFAENLSRHFYGIQRGDIVIAKSPSDPKSNICKRVIGLEGDKILTTSPSDFFKSHSYVPMGHVWLEGDNLQNSTDSRCYGPIPYGLIRGRIFFKIWPLSDFGFLRASPNGHRFSDD

SEQ ID NO: 40269 - protein, 107 aa, Homo sapiens
  Payload ID: 8201
  Gene Symbol: IMMP1L
  Gene Name: inner mitochondrial membrane peptidase subunit 1
  ENSP ID: ENSP00000432001
MLRGVLGKTFRLVGYTIQYGCIAHCAFEYVGGVVMCSGPSMEPTIQNSDIVFAENLSRHFYGIQRGDIVIAKSPSDPKSNICKRVIGLEGDKILTTSPSDFFKSHSY

SEQ ID NO: 40270 - protein, 57 aa, Homo sapiens
  Payload ID: 8201
  Gene Symbol: IMMP1L
  Gene Name: inner mitochondrial membrane peptidase subunit 1
  ENSP ID: ENSP00000432471
MGHVWLEGDNLQNSTDSRCYGPIPYGLIRGRIFFKIWPLSDFGFLRASPNGHRFSDD

SEQ ID NO: 40271 - protein, 30 aa, Homo sapiens
  Payload ID: 8201
  Gene Symbol: IMMP1L
  Gene Name: inner mitochondrial membrane peptidase subunit 1
  ENSP ID: ENSP00000432670
  MOD_RES (1)..(1): Any amino acid
XCKRVIGLEGDKILTTSPSDFFKSHSYHFR

SEQ ID NO: 40272 - protein, 57 aa, Homo sapiens; identical to SEQ ID NO: 40270
  Payload ID: 8201
  Gene Symbol: IMMP1L
  Gene Name: inner mitochondrial membrane peptidase subunit 1
  ENSP ID: ENSP00000432673

SEQ ID NO: 40273 - protein, 96 aa, Homo sapiens
  Payload ID: 8201
  Gene Symbol: IMMP1L
  Gene Name: inner mitochondrial membrane peptidase subunit 1
  ENSP ID: ENSP00000432792
MLRGVLGKTFRLVGYTIQYGCIAHCAFEYVGGVVMCSGPSMEPTIQNSDIVFAENLSRHFYGIQRGDIVIAKSPSDPKSNICKRVIGLEGDKILTT

SEQ ID NO: 40274 - protein, 94 aa, Homo sapiens
  Payload ID: 8201
  Gene Symbol: IMMP1L
  Gene Name: inner mitochondrial membrane peptidase subunit 1
  ENSP ID: ENSP00000434280
MLRGVLGKTFRLVGYTIQYGCIAHCAFEYVGGVVMVPMGHVWLEGDNLQNSTDSRCYGPIPYGLIRGRIFFKIWPLSDFGFLRASPNGHRFSDD

SEQ ID NO: 40275 - protein, 166 aa, Homo sapiens; identical to SEQ ID NO: 40268
  Payload ID: 8201
  Gene Symbol: IMMP1L
  Gene Name: inner mitochondrial membrane peptidase subunit 1
  Uniprot ID: Q96LU5
  ENSP ID: ENSP00000435576

SEQ ID NO: 40276 - protein, 175 aa, Homo sapiens
  Payload ID: 8202
  Gene Symbol: IMMP2L
  Gene Name: inner mitochondrial membrane peptidase subunit 2
  Uniprot ID: Q96T52
  ENSP ID: ENSP00000329553
MAQSQGWVKRYIKAFCKGFFVAVPVAVTFLDRVACVARVEGASMQPSLNPGGSQSSDVVLLNHWKVRNFEVHRGDIVSLVSPKNPEQKIIKRVIALEGDIVRTIGHKNRYVKVPRGHIWVEGDHHGHSFDSNSFGPVSLGLLHAHATHILWPPERWQKLESVLPPERLPVQREEE

SEQ ID NO: 40277 - protein, 175 aa, Homo sapiens; identical to SEQ ID NO: 40276
  Payload ID: 8202
  Gene Symbol: IMMP2L
  Gene Name: inner mitochondrial membrane peptidase subunit 2
  Uniprot ID: Q96T52
  ENSP ID: ENSP00000384966

SEQ ID NO: 40278 - protein, 110 aa, Homo sapiens
  Payload ID: 8202
  Gene Symbol: IMMP2L
  Gene Name: inner mitochondrial membrane peptidase subunit 2
  Uniprot ID: Q96T52
  ENSP ID: ENSP00000388327
MAQSQGWVKRYIKAFCKGFFVAVPVAVTFLDRVACVARVEGASMQPSLNPGGSQSSDVVLLNHWKVRNFEVHRGDIVSLVSPKNPEQKIIKRVIALEGDIVRDGRKLKRI

SEQ ID NO: 40279 - protein, 80 aa, Homo sapiens
  Payload ID: 8202
  Gene Symbol: IMMP2L
  Gene Name: inner mitochondrial membrane peptidase subunit 2
  ENSP ID: ENSP00000394387
MAQSQGWVKRYIKAFCKGFFVAVPVAVTFLDRVACVARVEGASMQPSLNPGGSQSSDVVLLNHWKVRNFEVHRGDIVSLV

SEQ ID NO: 40280 - protein, 175 aa, Homo sapiens; identical to SEQ ID NO: 40276
  Payload ID: 8202
  Gene Symbol: IMMP2L
  Gene Name: inner mitochondrial membrane peptidase subunit 2
  Uniprot ID: Q96T52
  ENSP ID: ENSP00000399353

SEQ ID NO: 40281 - protein, 157 aa, Homo sapiens
  Payload ID: 8202
  Gene Symbol: IMMP2L
  Gene Name: inner mitochondrial membrane peptidase subunit 2
  ENSP ID: ENSP00000402824
MVGEDIEARRHFLNLCCQPRRVSLRLKKCISEVKDKAGSAQCHPLEQRAGIPSGEWRQLKERSPKNPEQKIIKRVIALEGDIVRTIGHKNRYVKVPRGHIWVEGDHHGHSFDSNSFGPVSLGLLHAHATHILWPPERWQKLESVLPPERLPVQREEE

SEQ ID NO: 40282 - protein, 79 aa, Homo sapiens
  Payload ID: 8202
  Gene Symbol: IMMP2L
  Gene Name: inner mitochondrial membrane peptidase subunit 2
  ENSP ID: ENSP00000407402
MAQSQGWVKRYIKAFCKGFFVAVPVAVTFLDRVACVARVEGASMQPSLNPGGSQSSDVVLLNHWKVRNFEVHRGDIVSL

SEQ ID NO: 40283 - protein, 1556 aa, Homo sapiens
  Payload ID: 8203
  Gene Symbol: INO80
  Gene Name: INO80 complex subunit
  Uniprot ID: Q9ULG1
  ENSP ID: ENSP00000355205
MASELGARDDGGCTELAKPLYLQYLERALRLDHFLRQTSAIFNRNISSDDSEDGLDDSNPLLPQSGDPLIQVKEEPPNSLLGETSGAGSSGMLNTYSLNGVLQSESKCDKGNLYNFSKLKKSRKWLKSILLSDESSEADSQSEDDDEEELNLSREELHNMLRLHKYKKLHQNKYSKDKELQQYQYYSAGLLSTYDPFYEQQRHLLGPKKKKFKEEKKLKAKLKKVKKKRRRDEELSSEESPRRHHHQTKVFAKFSHDAPPPGTKKKHLSIEQLNARRRKVWLSIVKKELPKANKQKASARNLFLTNSRKLAHQCMKEVRRAALQAQKNCKETLPRARRLTKEMLLYWKKYEKVEKEHRKRAEKEALEQRKLDEEMREAKRQQRKLNFLITQTELYAHFMSRKRDMGHDGIQEEILRKLEDSSTQRQIDIGGGVVVNITQEDYDSNHFKAQALKNAENAYHIHQARTRSFDEDAKESRAAALRAANKSGTGFGESYSLANPSIRAGEDIPQPTIFNGKLKGYQLKGMNWLANLYEQGINGILADEMGLGKTVQSIALLAHLAERENIWGPFLIISPASTLNNWHQEFTRFVPKFKVLPYWGNPHDRKVIRRFWSQKTLYTQDAPFHVVITSYQLVVQDVKYFQRVKWQYMVLDEAQALKSSSSVRWKILLQFQCRNRLLLTGTPIQNTMAELWALLHFIMPTLFDSHEEFNEWFSKDIESHAENKSAIDENQLSRLHMILKPFMLRRIKKDVENELSDKIEILMYCQLTSRQKLLYQALKNKISIEDLLQSSMGSTQQAQNTTSSLMNLVMQFRKVCNHPELFERQETWSPFHISLKPYHISKFIYRHGQIRVFNHSRDRWLRVLSPFAPDYIQRSLFHRKGINEESCFSFLRFIDISPAEMANLMLQGLLARWLALFLSLKASYRLHQLRSWGAPEGESHQRYLRNKDFLLGVNFPLSFPNLCSCPLLKSLVFSSHCKAVSGYSDQVVHQRRSATSSLRRCLLTELPSFLCVASPRVTAVPLDSYCNDRSAEYERRVLKEGGSLAAKQCLLNGAPELAADWLNRRSQFFPEPAGGLWSIRPQNGWSFIRIPGKESLITDSGKLYALDVLLTRLKSQGHRVLIYSQMTRMIDLLEEYMVYRKHTYMRLDGSSKISERRDMVADFQNRNDIFVFLLSTRAGGLGINLTAADTVIFYDSDWNPTVDQQAMDRAHRLGQTKQVTVYRLICKGTIEERILQRAKEKSEIQRMVISGGNFKPDTLKPKEVVSLLLDDEELEKKLRLRQEEKRQQEETNRVKERKRKREKYAEKKKKEDELDGKRRKEGVNLVIPFVPSADNSNLSADGDDSFISVDSAMPSPFSEISISSELHTGSIPLDESSSDMLVIVDDPASSAPQSRATNSPASITGSVSDTVNGISIQEMPAAGRGHSARSRGRPKGSGSTAKGAGKGRSRKSTAGSAAAMAGAKAGAAAASAAAYAAYGYNVSKGISASSPLQTSLVRPAGLADFGPSSASSPLSSPLSKGNNVPGNPKNLHMTSSLAPDSLVRKQGKGTNPSGGR

SEQ ID NO: 40284 - protein, 1556 aa, Homo sapiens; identical to SEQ ID NO: 40283
  Payload ID: 8203
  Gene Symbol: INO80
  Gene Name: INO80 complex subunit
  Uniprot ID: Q9ULG1
  ENSP ID: ENSP00000384686

SEQ ID NO: 40285 - protein, 27 aa, Homo sapiens
  Payload ID: 8203
  Gene Symbol: INO80
  Gene Name: INO80 complex subunit
  ENSP ID: ENSP00000452806
  MOD_RES (1)..(1): Any amino acid
XRVCDTHPTWEMFALTHDLLGYCHVKS

SEQ ID NO: 40286 - protein, 1104 aa, Homo sapiens
  Payload ID: 8203
  Gene Symbol: INO80
  Gene Name: INO80 complex subunit
  ENSP ID: ENSP00000453677
MASELGARDDGGCTELAKPLYLQYLERALRLDHFLRQTSAIFNRNISSDDSEDGLDDSNPLLPQSGDPLIQVKEEPPNSLLGETSGAGSSGMLNTYSLNGVLQSESKCDKGNLYNFSKLKKSRKWLKSILLSDESSEADSQSEDDDEEELNLSREELHNMLRLHKYKKLHQNKYSKDKELQQYQYYSAGLLSTYDPFYEQQRHLLGPKKKKFKEEKKLKAKLKKVKKKRRRDEELSSEESPRRHHHQTKVFAKFSHDAPPPGTKKKHLSIEQLNARRRKVWLSIVKKELPKANKQKASARNLFLTNSRKLAHQCMKEVRRAALQAQKNCKETLPRARRLTKEMLLYWKKYEKVEKEHRKRAEKEALEQRKLDEEMREAKRQQRKLNFLITQTELYAHFMSRKRDMGHDGIQEEILRKLEDSSTQRQIDIGGGVVVNITQEDYDSNHFKAQALKNAENAYHIHQARTRSFDEDAKESRAAALRAANKSGTGFGESYSLANPSIRAGEDIPQPTIFNGKLKGYQLKGMNWLANLYEQGINGILADEMGLGKTVQSIALLAHLAERENIWGPFLIISPASTLNNWHQEFTRFVPKFKVLPYWGNPHDRKVIRRFWSQKTLYTQDAPFHVVITSYQLVVQDVKYFQRVKWQYMVLDEAQALKSSSSVRWKILLQFQCRNRLLLTGTPIQNTMAELWALLHFIMPTLFDSHEEFNEWFSKDIESHAENKSAIDENQLSRLHMILKPFMLRRIKKDVENELSDKIEILMYCQLTSRQKLLYQALKNKISIEDLLQSSMGSTQQAQNTTSSLMNLVMQFRKVCNHPELFERQETWSPFHISLKPYHISKFIYRHGQIRVFNHSRDRWLRVLSPFAPDYIQRSLFHRKGINEESCFSFLRFIDISPAEMANLMLQGLLARWLALFLSLKASYRLHQLRSWGAPEGESHQRYLRNKDFLLGVNFPLSFPNLCSCPLLKSLVFSSHCKAVSGYSDQVVHQRRSATSSLRRCLLTELPSFLCVASPRVTAVPLDSYCNDRSAEYERRVLKEGGSLAAKQCLLNGAPELAADWLNRRSQFFPEPAGGLWSIRPQNGWSFIRIPGIHGLQEAYLHEA

SEQ ID NO: 40287 - protein, 79 aa, Homo sapiens
  Payload ID: 8203
  Gene Symbol: INO80
  Gene Name: INO80 complex subunit
  ENSP ID: ENSP00000454057
  MOD_RES (1)..(1): Any amino acid
XTLNNWHQEFTRFVPKFKVLPYWGNPHDRKVIRRFWSQCSLEDPLTVPVSESAFANRDPNSEHHGRALGSAAFHYANII

SEQ ID NO: 40288 - protein, 192 aa, Homo sapiens
  Payload ID: 8203
  Gene Symbol: INO80
  Gene Name: INO80 complex subunit
  ENSP ID: ENSP00000483661
MDRAHRLGQTKQVTVYRLICKGTIEERILQRAKEKSEIQRMVISGGNFKPDTLKPKEVVSLLLDDEELEKKLRLRQEEKRQQEETNRVKERKRKREKYAEKKKKEDELDGKRRKEGVNLVIPFVPSADNSNLSADGDDSFISVDSAMPSPFSEISISSELHTGSIPLDESSSLAPDSLVRKQGKGTNPSGGR

SEQ ID NO: 40289 - protein, 356 aa, Homo sapiens
  Payload ID: 8204
  Gene Symbol: INO80B
  Gene Name: INO80 complex subunit B
  Uniprot ID: Q9C086
  ENSP ID: ENSP00000233331
MSKLWRRGSTSGAMEAPEPGEALELSLAGAHGHGVHKKKHKKHKKKHKKKHHQEEDAGPTQPSPAKPQLKLKIKLGGQVLGTKSVPTFTVIPEGPRSPSPLMVVDNEEEPMEGVPLEQYRAWLDEDSNLSPSPLRDLSGGLGGQEEEEEQRWLDALEKGELDDNGDLKKEINERLLTARQRALLQKARSQPSPMLPLPVAEGCPPPALTEEMLLKREERARKRRLQAARRAEEHKNQTIERLTKTAATSGRGGRGGARGERRGGRAAAPAPMVRYCSGAQGSTLSFPPGVPAPTAVSQRPSPSGPPPRCSVPGCPHPRRYACSRTGQALCSLQCYRINLQMRLGGPEGPGSPLLAT

SEQ ID NO: 40290 - protein, 207 aa, Homo sapiens
  Payload ID: 8204
  Gene Symbol: INO80B
  Gene Name: INO80 complex subunit B
  ENSP ID: ENSP00000386937
MSKLWRRGSTSGAMEAPEPGFPSTGEALELSLAGAHGHGVHKKKHKKHKKKHKKKHHQEEDAGPTQPSPAKPQLKLKIKLGGQVLGTKSVPTFTVIPEGPRSPSPLMVVDNEEEPMEGVPLEQYRAWLDEDSNLSPSPLRDLSGGLGGQEEEEEQRWLDALEKGELDDNGDLKKEINERLLTARQRALLQKARSQPSPMLPLPVAEG

SEQ ID NO: 40291 - protein, 184 aa, Homo sapiens
  Payload ID: 8204
  Gene Symbol: INO80B
  Gene Name: INO80 complex subunit B
  ENSP ID: ENSP00000387267
MSKLWRRGSTSGAMEAPEPGEALELSLAGAHGHGVHKKKHKKHKKKHKKKHHQEEDAGPTQPSPAKPQLKLKIKLGGQVLGTKSVPTFTVIPEGPRSPSPLMVVDNEEEPMEGVPLEQYRAWLDEDSNLSPSPLRDLSGGLGGQEEEEEQRWLDALEKGELDDNGDLKKEINERLLTARQRRCC

SEQ ID NO: 40292 - protein, 176 aa, Homo sapiens
  Payload ID: 8204
  Gene Symbol: INO80B
  Gene Name: INO80 complex subunit B
  ENSP ID: ENSP00000389887
MSKLWRRGSTSGAMEAPEPGEALELSLAGAHGHGVHKKKHKKHKKKHKKKHHQEEDAGPTQPSPAKPQLKLKIKLGGQVLGTKSVPTFTVIPEGPRSPSPLMVVDNEEEPMEGVPLEQYRAWLGGLGGQEEEEEQRWLDALEKGELDDNGDLKKEINERLLTARQRALLQKARSQP

SEQ ID NO: 40293 - protein, 97 aa, Homo sapiens
  Payload ID: 8204
  Gene Symbol: INO80B
  Gene Name: INO80 complex subunit B
  ENSP ID: ENSP00000398740
KKHHQEEDAGPTQPSPAKPQLKLKIKLGGQVLGTKSVPTFTVIPEGPRSPSPLMVVDNEEEPMEGVPLEQYRAWLGEDLEMKTVISLPLHFGTYQEG

SEQ ID NO: 40294 - protein, 192 aa, Homo sapiens
  Payload ID: 8205
  Gene Symbol: INO80C
  Gene Name: INO80 complex subunit C
  Uniprot ID: Q6PI98
  ENSP ID: ENSP00000334473
MAAQIPIVATTSTPGIVRNSKKRPASPSHNGSSGGGYGASKKKKASASSFAQGISMEAMSENKMVPSEFSTGPVEKAAKPLPFKDPNFVHSGHGGAVAGKKNRTWKNLKQILASERALPWQLNDPNYFSIDAPPSFKPAKKYSDVSGLLANYTDPQSKLRFSTIEEFSYIRRLPSDVVTGYLALRKATSIVP

SEQ ID NO: 40295 - protein, 228 aa, Homo sapiens
  Payload ID: 8205
  Gene Symbol: INO80C
  Gene Name: INO80 complex subunit C
  Uniprot ID: Q6PI98
  ENSP ID: ENSP00000391457
MAAQIPIVATTSTPGIVRNSKKRPASPSHNGSSGGGYGASKKKKASASSFAQTCLSPSTMIVRPPQPRGTTCLLPSAMIVRPPQPRGNGISMEAMSENKMVPSEFSTGPVEKAAKPLPFKDPNFVHSGHGGAVAGKKNRTWKNLKQILASERALPWQLNDPNYFSIDAPPSFKPAKKYSDVSGLLANYTDPQSKLRFSTIEEFSYIRRLPSDVVTGYLALRKATSIVP

SEQ ID NO: 40296 - protein, 137 aa, Homo sapiens
  Payload ID: 8205
  Gene Symbol: INO80C
  Gene Name: INO80 complex subunit C
  ENSP ID: ENSP00000464948
MEAMSENKMVPSEFSTGPVEKAAKPLPFKDPNFVHSGHGGAVAGKKNRTWKNLKQILASERALPWQLNDPNYFSIDAPPSFKPAKKYSDVSGLLANYTDPQSKLRFSTIEEFSYIRRLPSDVVTGYLALRKATSIVP

SEQ ID NO: 40297 - protein, 197 aa, Homo sapiens
  Payload ID: 8205
  Gene Symbol: INO80C
  Gene Name: INO80 complex subunit C
  Uniprot ID: Q6PI98
  ENSP ID: ENSP00000465273
MAAQIPIVATTSTPGIVRNSKKRPASPSHNGSSGGGYGASKKKKASASSFAQGISMEAMSENKMVPSEFSTGPVEKAAKPLPFKDPNFVHSGHGGAVAGKKNRTWKNLKQILASERALPWQLNDPNYFSIDAPPSFKPAKKYSDVSGLLEPPNCFPQRLHQLTFPLAMDEGSNFSRCSPTLVNFGFVFIMAILVGVK

SEQ ID NO: 40298 - protein, 29 aa, Homo sapiens
  Payload ID: 8205
  Gene Symbol: INO80C
  Gene Name: INO80 complex subunit C
  ENSP ID: ENSP00000465637
MEAMSENKMVPSEFSTGPVEKAAKPLPFK

SEQ ID NO: 40299 - protein, 89 aa, Homo sapiens
  Payload ID: 8205
  Gene Symbol: INO80C
  Gene Name: INO80 complex subunit C
  ENSP ID: ENSP00000466269
MAAQIPIVATTSTPGIVRNSKKRPASPSHNGSSGGGYGASKKKKASASSFAQTCLSPSTMIVRPPQPRGTAHWWKGLALSRMRLWTVDF

SEQ ID NO: 40300 - protein, 98 aa, Homo sapiens
  Payload ID: 8205
  Gene Symbol: INO80C
  Gene Name: INO80 complex subunit C
  ENSP ID: ENSP00000467013
MAAQIPIVATTSTPGIVRNSKKRPASPSHNGSSGGGYGASKKKKASASSFAQTSVLMLLHPLSQLRSILMFQVCLPTTQTPRANCGSAPLKSFPTFGG

SEQ ID NO: 40301 - protein, 95 aa, Homo sapiens
  Payload ID: 8205
  Gene Symbol: INO80C
  Gene Name: INO80 complex subunit C
  ENSP ID: ENSP00000467708
MAAQIPIVATTSTPGIVRNSKKRPASPSHNGSSGGGYGASKKKKASASSFAQANYTDPQSKLRFSTIEEFSYIRRLPSDVVTGYLALRKATSIVP

SEQ ID NO: 40302 - protein, 136 aa, Homo sapiens
  Payload ID: 8205
  Gene Symbol: INO80C
  Gene Name: INO80 complex subunit C
  ENSP ID: ENSP00000473165
  MOD_RES (1)..(1): Any amino acid
XHSLSCLLPRKTCLLPSAMIVRPPQPRGNGISMEAMSENKMVPSEFSTGPVEKAAKPLPFKDPNFVHSGHGGAVAGKKNRTWKNLKQILASERALPWQLNDPNYFSIDAPPSFKPAKKYSDVSGLLANYTDPQSKL

SEQ ID NO: 40303 - protein, 1027 aa, Homo sapiens
  Payload ID: 8206
  Gene Symbol: INO80D
  Gene Name: INO80 complex subunit D
  Uniprot ID: Q53TQ3
  ENSP ID: ENSP00000384198
MYEGKHIHFSEVDNKPLCSYSPKLCKQRRLNGYAFCIRHVLEDKTAPFKQCEYVAKYNSQRCTNPIPKSEDRRYCNSHLQVLGFIPKKERKKKNDPIDEVKVRHQMDTMAFSLTVPTLALKMPNGLDGMSLSPPGARVPLHYLETELEDPFAFNEEDDDLKKGATVRKKLQSKLAQNRQRQRETEILKVRQEHFSPPPAPSQQQPPQQHSHLSPLSTSLKPPAPPQGSVCKSPQPQNTSLPMQGVAPTTHTIAQARQLSHKRPLPLLPSSRAPTVDPPRTDRILMKATAFSPHFSCISRLQRLVKLCTQKHQLDTDLFPHLGLDWSEESGEEPEDSEQASPYQVAWSIRETLRYQRHASDDDDAESRSSRVTQLCTYFQQKYKHLCRLERAESRQKKCRHTFRKALLQAASKEPECTGQLIQELRRAACSRTSISRTKLREVEPAACSGTVKGEQCANKALPFTRHCFQHILLNHSQQLFSSCTAKFADGQQCSVPVFDITHQTPLCEEHAKKMDNFLRGDNSRKVQHQQQRKPRKKTKPPALTKKHKKKRRRGPRRPQKPIPPAVPQGNLSMPASVSLPVEASHIRSPSTPELSADELPDDIANEITDIPHDLELNQEDFSDVLPRLPDDLQDFDFFEGKNGDLLPTTEEAEELERALQAVTSLECLSTIGVLAQSDGVPVQELSDRGIGVFSTGTGASGIQSLSREVNTDLGELLNGRIVHDNFSSLELDENLLRSATLSNPPTPLAGQIQGQFSAPANVGLTSATLISQSALGERAFPGQFHGLHDGSHASQRPHPAQLLSKADDLITSRQQYSSDHSHSSPHGSHYDSEHVPSPYSDHITSPHTTSYSGDNMAATFSAEMPIMAQHLLPTQLEVPLGGVVNPRTHWGNLPVNLGDPSPFSNLLGADGHLLSTSLSTPPTTSNSETTQPAFATVTPSSSSVLPGLPQTSFSGMGPSAELMASTSPKQQLPQFSAAFGHQLSSHSGIPKDLQPSHSSIAPPTGFTVTGATATSTNNASSPFPSPN

SEQ ID NO: 40304 - protein, 439 aa, Homo sapiens
  Payload ID: 8206
  Gene Symbol: INO80D
  Gene Name: INO80 complex subunit D
  ENSP ID: ENSP00000402369
MDTMAFSLTVPTLALKMPNGLDGMSLSPPGARVPLHYLETELEDPFAFNEEDDDLKKGATVRKKLQSKLAQNRQRQRETEILKVRQEHFSPPPAPSQQQPPQQHSHLSPLSTSLKPPAPPQGSVCKSPQPQNTSLPMQGVAPTTHTIAQARQLSHKRPLPLLPSSRAPTVDPPRTDRILMKATAFSPHFSCISRLQRLVKLCTQKHQLDTDLFPHLGLDWSEESGEEPEDSEQASPYQVAWSIRETLRYQRHASDDDDAESRSSRVTQLCTYFQQKYKHLCRLERAESRQKKCRHTFRKALLQAASKEPECTGQLIQELRRAACSRTSISRTKLREVEPAACSGTVKGEQCANKALPFTRHCFQHILLNHSQQLFSSCTAKFADGQQCSVPVFDITHQTPLCEEHAKKMDNFLRGDNSRKVQHQQQRKPRKKTKPPALT

SEQ ID NO: 40305 - protein, 37 aa, Homo sapiens
  Payload ID: 8206
  Gene Symbol: INO80D
  Gene Name: INO80 complex subunit D
  ENSP ID: ENSP00000409031
MYEGKHIHFSEVDNKPLCSYSPKLCKQRRLNGYAFCI

SEQ ID NO: 40306 - protein, 205 aa, Homo sapiens
  Payload ID: 8207
  Gene Symbol: INO80E
  Gene Name: INO80 complex subunit E
  ENSP ID: ENSP00000303977
MNGPADGEVDYKKKYRNLKRKLKFLIYEHECFQEELRKAQRKLLKVSRDKSFLLDRLLQYENVDEDSSDSDATASSDNSETEGTPKLSDTPAPKRKRSPPLGGAPSPSSLSLPPSTGFPLQASGVPSPYLSSMAVGPPDCPVGGPLTFPGRGSGAGVGTTLTPLPPPKMPPPTILSTVPRQMFSDAGSGDDALDGDDDLVIDIPE

SEQ ID NO: 40307 - protein, 137 aa, Homo sapiens
  Payload ID: 8207
  Gene Symbol: INO80E
  Gene Name: INO80 complex subunit E
  Uniprot ID: Q8NBZ0
  ENSP ID: ENSP00000454665
MNGPADGEVDYKKKYRNLKRKLKFLIYEHECFQEELRKAQRKLLKVSRDKSFLLDRLLQYENVDEDSSDSDATASSDNSETEGTPKLSDTPAPKRKRSPPLGGAPSPSSLSLPPSTGFPLQASGVPSPYLSSERGQA

SEQ ID NO: 40308 - protein, 227 aa, Homo sapiens
  Payload ID: 8207
  Gene Symbol: INO80E
  Gene Name: INO80 complex subunit E
  ENSP ID: ENSP00000454924
MNGPADGEVDYKKKYRNLKRKLKFLIYEHECFQEELRKAQRKLLKVSRDKSFLLDRLLQYENVDEDSSDSDATASSDNSETEGTPKLSDTPAPKRKRSPPLGGAPSPSSLSLPPSTGFPLQASGVPSPYLSSLPEPSPLRPKREKRPRLPRKLKMAVGPPDCPVGGPLTFPGRGSGAGVGTTLTPLPPPKMPPPTILSTVPRQMFSDAGSGDDALDGDDDLVIDIPE

SEQ ID NO: 40309 - protein, 137 aa, Homo sapiens; identical to SEQ ID NO: 40307
  Payload ID: 8207
  Gene Symbol: INO80E
  Gene Name: INO80 complex subunit E
  Uniprot ID: Q8NBZ0
  ENSP ID: ENSP00000456073

SEQ ID NO: 40310 - protein, 244 aa, Homo sapiens
  Payload ID: 8207
  Gene Symbol: INO80E
  Gene Name: INO80 complex subunit E
  Uniprot ID: Q8NBZ0
  ENSP ID: ENSP00000457016
MNGPADGEVDYKKKYRNLKRKLKFLIYEHECFQEELRKAQRKLLKVSRDKSFLLDRLLQYENVDEDSSDSDATASSDNSETEGTPKLSDTPAPKRKRSPPLGGAPSPSSLSLPPSTGFPLQASGVPSPYLSSLASSRYPPFPSDYLALQLPEPSPLRPKREKRPRLPRKLKMAVGPPDCPVGGPLTFPGRGSGAGVGTTLTPLPPPKMPPPTILSTVPRQMFSDAGSGDDALDGDDDLVIDIPE

SEQ ID NO: 40311 - protein, 85 aa, Homo sapiens
  Payload ID: 8207
  Gene Symbol: INO80E
  Gene Name: INO80 complex subunit E
  ENSP ID: ENSP00000458392
  MOD_RES (1)..(1): Any amino acid
XLSLPPSTGFPLQASGVPSPYLSSLASSRYPPFPSDYLALQLPEPSPLRPKREKRPRLPRKLKMFSDAGSGDDALDGDDDLVIDI

SEQ ID NO: 40312 - protein, 188 aa, Homo sapiens
  Payload ID: 8207
  Gene Symbol: INO80E
  Gene Name: INO80 complex subunit E
  ENSP ID: ENSP00000459432
MNGPADGEVDYKKKYRNLKRKLKFLIYEHECFQEELRKAQRKLLKVSRDKSFLLDRLLQYENVDEDSSDSDATASSDNSETEGTPKLSDTPAPKRKRSPPLGGAPSPSSLSLPPSTGFPLQASGVPSPYLSSLASSRYPPFPSDYLALQLPEPSPLRPKREKRPRLPRKLKTLVVREQTERWSELGRE

SEQ ID NO: 40313 - protein, 173 aa, Homo sapiens
  Payload ID: 8207
  Gene Symbol: INO80E
  Gene Name: INO80 complex subunit E
  ENSP ID: ENSP00000461808
MNGPADGEVDYKKKYRNLKRKLKFLIYEHECFQEELRKAQRKLLKVSRDKSFLLDRLLQYENVDEDSSDSDATASSDNSETEGTPKLSDTPAPKRKRSPPLGGAPSPSSLSLPPSTGFPLQASGVPSPYLSSLASSRYPPFPSDYLALQLPEPSPLRPKREKRPRLPRKLKVP

SEQ ID NO: 40314 - protein, 137 aa, Homo sapiens; identical to SEQ ID NO: 40307
  Payload ID: 8207
  Gene Symbol: INO80E
  Gene Name: INO80 complex subunit E
  Uniprot ID: Q8NBZ0
  ENSP ID: ENSP00000484187

SEQ ID NO: 40315 - protein, 363 aa, Homo sapiens
  Payload ID: 8208
  Gene Symbol: INO80B-WBP1
  Gene Name: INO80B-WBP1 readthrough (NMD candidate)
  ENSP ID: ENSP00000388677
MSKLWRRGSTSGAMEAPEPGEALELSLAGAHGHGVHKKKHKKHKKKHKKKHHQEEDAGPTQPSPAKPQLKLKIKLGGQVLGTKSVPTFTVIPEGPRSPSPLMVVDNEEEPMEGVPLEQYRAWLDEDSNLSPSPLRDLSGGLGGQEEEEEQRWLDALEKGELDDNGDLKKEINERLLTARQRALLQKARSQPSPMLPLPVAEGCPPPALTEEMLLKREERARKRRLQAARRAEEHKNQTIERLTKTAATSGRGGRGGARGERRGGRAAAPAPMVRYCSGAQGSTLSFPPGVPAPTAVSQRPSPSGPPPRCSVPGCPHPRRYACSRTGQALCSLQCYRINLQMRLGGPEGPGSPLLATFESCAQE

SEQ ID NO: 40316 - protein, 263 aa, Homo sapiens
  Payload ID: 8208
  Gene Symbol: INO80B-WBP1
  Gene Name: INO80B-WBP1 readthrough (NMD candidate)
  ENSP ID: ENSP00000392498
MSKLWRRGSTSGAMEAPEPGEALELSLAGAHGHGVHKKKHKKHKKKHKKKHHQEEDAGPTQPSPAKPQLKLKIKLGGQVLGTKSVPTFTVIPEGPRSPSPLMVVDNEEEPMEGVPLEQYRAWLDEDSNLSPSPLRDLSGGLGGQEEEEEQRWLDALEKGELDDNGDLKKEINERLLTARQRALLQKARSQPSPMLPLPVAEGCPPPALTEEMLLKREERARKRRLQAARRAEEHKNQTIERLTKTAATTSRAVPRSEQPALPL

SEQ ID NO: 40317 - protein, 194 aa, Homo sapiens
  Payload ID: 8209
  Gene Symbol: ITPA
  Gene Name: inosine triphosphatase (nucleoside triphosphate pyrophosphatase)
  Uniprot ID: Q9BY32
  ENSP ID: ENSP00000369456
MAASLVGKKIVFVTGNAKKLEEVVQILGDKFPCTLVAQKIDLPEYQGEPDEISIQKCQEAVRQVQGPVLVEDTCLCFNALGGLPGPYIKWFLEKLKPEGLHQLLAGFEDKSAYALCTFALSTGDPSQPVRLFRGRTSGRIVAPRGCQDFGWDPCFQPDGYEQTYAEMPKAEKNAVSHRFRALLELQEYFGSLAA

SEQ ID NO: 40318 - protein, 153 aa, Homo sapiens
  Payload ID: 8209
  Gene Symbol: ITPA
  Gene Name: inosine triphosphatase (nucleoside triphosphate pyrophosphatase)
  Uniprot ID: Q9BY32
  ENSP ID: ENSP00000382732
MAASLVGKKIVFVTGNAKKLEEVQGPVLVEDTCLCFNALGGLPGPYIKWFLEKLKPEGLHQLLAGFEDKSAYALCTFALSTGDPSQPVRLFRGRTSGRIVAPRGCQDFGWDPCFQPDGYEQTYAEMPKAEKNAVSHRFRALLELQEYFGSLAA

SEQ ID NO: 40319 - protein, 177 aa, Homo sapiens
  Payload ID: 8209
  Gene Symbol: ITPA
  Gene Name: inosine triphosphatase (nucleoside triphosphate pyrophosphatase)
  Uniprot ID: Q9BY32
  ENSP ID: ENSP00000413282
MAASLVVQILGDKFPCTLVAQKIDLPEYQGEPDEISIQKCQEAVRQVQGPVLVEDTCLCFNALGGLPGPYIKWFLEKLKPEGLHQLLAGFEDKSAYALCTFALSTGDPSQPVRLFRGRTSGRIVAPRGCQDFGWDPCFQPDGYEQTYAEMPKAEKNAVSHRFRALLELQEYFGSLAA

SEQ ID NO: 40320 - protein, 491 aa, Homo sapiens
  Payload ID: 8210
  Gene Symbol: IPPK
  Gene Name: inositol 1,3,4,5,6-pentakisphosphate 2-kinase
  Uniprot ID: Q9H8X2
  ENSP ID: ENSP00000287996
MEEGKMDENEWGYHGEGNKSLVVAHAQRCVVLRFLKFPPNRKKTSEEIFQHLQNIVDFGKNVMKEFLGENYVHYGEVVQLPLEFVKQLCLKIQSERPESRCDKDLDTLSGYAMCLPNLTRLQTYRFAEHRPILCVEIKPKCGFIPFSSDVTHEMKHKVCRYCMHQHLKVATGKWKQISKYCPLDLYSGNKQRMHFALKSLLQEAQNNLKIFKNGELIYGCKDARSPVADWSELAHHLKPFFFPSNGLASGPHCTRAVIRELVHVITRVLLSGSDKGRAGTLSPGLGPQGPRVCEASPFSRSLRCQGKNTPERSGLPKGCLLYKTLQVQMLDLLDIEGLYPLYNRVERYLEEFPEERKTLQIDGPYDEAFYQKLLDLSTEDDGTVAFALTKVQQYRVAMTAKDCSIMIALSPCLQDASSDQRPVVPSSRSRFAFSVSVLDLDLKPYESIPHQYKLDGKIVNYYSKTVRAKDNAVMSTRFKESEDCTLVLHKV

SEQ ID NO: 40321 - protein, 163 aa, Homo sapiens
  Payload ID: 8210
  Gene Symbol: IPPK
  Gene Name: inositol 1,3,4,5,6-pentakisphosphate 2-kinase
  ENSP ID: ENSP00000364672
MLDLLDIEGLYPLYNRVERYLEEFPEERKTLQIDGPYDEAFYQKLLDLSTEDDGTVAFALTKVQQYRVAMTAKDCSIMIALSPCLQDASSDQRPVVPSSRSRFAFSVSVLDLDLKPYESIPHQYKLDGKIVNYYSKTVRAKDNAVMSTRFKESEDCTLVLHKV

SEQ ID NO: 40322 - protein, 547 aa, Homo sapiens
  Payload ID: 8211
  Gene Symbol: ITPRIP
  Gene Name: inositol 1,4,5-trisphosphate receptor interacting protein
  Uniprot ID: Q8IWB1
  ENSP ID: ENSP00000278071
MAMGLFRVCLVVVTAIINHPLLFPRENATVPENEEEIIRKMQAHQEKLQLEQLRLEEEVARLAAEKEALEQVAEEGRQQNETRVAWDLWSTLCMILFLMIEVWRQDHQEGPSPECLGGEEDELPGLGGAPLQGLTLPNKATLGHFYERCIRGATADAARTREFLEGFVDDLLEALRSLCNRDTDMEVEDFIGVDSMYENWQVDRPLLCHLFVPFTPPEPYRFHPELWCSGRSVPLDRQGYGQIKVVRADGDTLSCICGKTKLGEDMLCLLHGRNSMAPPCGDMENLLCATDSLYLDTMQVMKWFQTALTRAWKGIAHKYEFDLAFGQLDSPGSLKIKFRSGKFMPFNLIPVIQCDDSDLYFVSHLPREPSEGTPASSTDWLLSFAVYERHFLRTTLKALPEGACHLSCLQIASFLLSKQSRLTGPSGLSSYHLKTALLHLLLLRQAADWKAGQLDARLHELLCFLEKSLLQKKLHHFFIGNRKVPEAMGLPEAVLRAEPLNLFRPFVLQRSLYRKTLDSFYEMLKNAPALISEYSLHVPSDQPTPKS

SEQ ID NO: 40323 - protein, 547 aa, Homo sapiens; identical to SEQ ID NO: 40322
  Payload ID: 8211
  Gene Symbol: ITPRIP
  Gene Name: inositol 1,4,5-trisphosphate receptor interacting protein
  Uniprot ID: Q8IWB1
  ENSP ID: ENSP00000337178

SEQ ID NO: 40324 - protein, 547 aa, Homo sapiens; identical to SEQ ID NO: 40322
  Payload ID: 8211
  Gene Symbol: ITPRIP
  Gene Name: inositol 1,4,5-trisphosphate receptor interacting protein
  Uniprot ID: Q8IWB1
  ENSP ID: ENSP00000350915

SEQ ID NO: 40325 - protein, 114 aa, Homo sapiens
  Payload ID: 8211
  Gene Symbol: ITPRIP
  Gene Name: inositol 1,4,5-trisphosphate receptor interacting protein
  ENSP ID: ENSP00000414141
MAMGLFRVCLVVVTAIINHPLLFPRENATVPENEEEIIRKMQAHQEKLQLEQLRLEEEVARLAAEKEALEQVAEEGRQQNETRVAWDLWSTLCMILFLMIEVWRQDHQEGPSPE

SEQ ID NO: 40326 - protein, 563 aa, Homo sapiens
  Payload ID: 8212
  Gene Symbol: ITPRIPL1
  Gene Name: inositol 1,4,5-trisphosphate receptor interacting protein-like 1
  Uniprot ID: Q6GPH6
  ENSP ID: ENSP00000355121
MTTDSYSPTSPDAEASMAVISLLFLAVMYVVHHPLMVSDRMDLDTLARSRQLEKRMSEEMRLLEMEFEERKRAAEQRQKAENFWTGDTSSDQLVLGKKDMGWPFQADGQEGPLGWMLGNLWNTGLFCLFLVFELLRQNMQHEPAFDSSSEEEEEEVRVVPVTSYNWLTDFPSQEALDSFYKHYVQNAIRDLPCTCEFVESFVDDLIEACRVLSRQEAHPQLEDCLGIGAAFEKWGTLHETQKFDILVPIVPPQGTMFVLEMRDPALGRRCGCVLVESECVCKREKLLGDVLCLVHHHRDPSAVLGKCSSSIKAALCTGFHLDVCKTVQWFRNMMGNAWALVAHKYDFKLSLPPSTTSCKLRLDYRSGRFLSIHLVLGVQREDTLVYLVSQAPDQEQLTSVDWPESFVACEHLFLKLVGRFAPENTCHLKCLQIILSLRQHQSLPHGASRPILTSYHFKTALMHLLLRLPLTDWAHNMLSQRLQDILWFLGRGLQQRSLHHFLIGNNFLPLTIPIPKTFRNAEPVNLFQHLVLNPKAHSQAVEEFQNLLTQVKTLPHAPLAAAP

SEQ ID NO: 40327 - protein, 555 aa, Homo sapiens
  Payload ID: 8212
  Gene Symbol: ITPRIPL1
  Gene Name: inositol 1,4,5-trisphosphate receptor interacting protein-like 1
  Uniprot ID: Q6GPH6
  ENSP ID: ENSP00000389308
MNVDAEASMAVISLLFLAVMYVVHHPLMVSDRMDLDTLARSRQLEKRMSEEMRLLEMEFEERKRAAEQRQKAENFWTGDTSSDQLVLGKKDMGWPFQADGQEGPLGWMLGNLWNTGLFCLFLVFELLRQNMQHEPAFDSSSEEEEEEVRVVPVTSYNWLTDFPSQEALDSFYKHYVQNAIRDLPCTCEFVESFVDDLIEACRVLSRQEAHPQLEDCLGIGAAFEKWGTLHETQKFDILVPIVPPQGTMFVLEMRDPALGRRCGCVLVESECVCKREKLLGDVLCLVHHHRDPSAVLGKCSSSIKAALCTGFHLDVCKTVQWFRNMMGNAWALVAHKYDFKLSLPPSTTSCKLRLDYRSGRFLSIHLVLGVQREDTLVYLVSQAPDQEQLTSVDWPESFVACEHLFLKLVGRFAPENTCHLKCLQIILSLRQHQSLPHGASRPILTSYHFKTALMHLLLRLPLTDWAHNMLSQRLQDILWFLGRGLQQRSLHHFLIGNNFLPLTIPIPKTFRNAEPVNLFQHLVLNPKAHSQAVEEFQNLLTQVKTLPHAPLAAAP

SEQ ID NO: 40328 - protein, 587 aa, Homo sapiens
  Payload ID: 8212
  Gene Symbol: ITPRIPL1
  Gene Name: inositol 1,4,5-trisphosphate receptor interacting protein-like 1
  ENSP ID: ENSP00000396552
  MOD_RES (1)..(1): Any amino acid
XRKGVTQAGSGLSGYKREPLGSAGHIWCPWLTEESDAEASMAVISLLFLAVMYVVHHPLMVSDRMDLDTLARSRQLEKRMSEEMRLLEMEFEERKRAAEQRQKAENFWTGDTSSDQLVLGKKDMGWPFQADGQEGPLGWMLGNLWNTGLFCLFLVFELLRQNMQHEPAFDSSSEEEEEEVRVVPVTSYNWLTDFPSQEALDSFYKHYVQNAIRDLPCTCEFVESFVDDLIEACRVLSRQEAHPQLEDCLGIGAAFEKWGTLHETQKFDILVPIVPPQGTMFVLEMRDPALGRRCGCVLVESECVCKREKLLGDVLCLVHHHRDPSAVLGKCSSSIKAALCTGFHLDVCKTVQWFRNMMGNAWALVAHKYDFKLSLPPSTTSCKLRLDYRSGRFLSIHLVLGVQREDTLVYLVSQAPDQEQLTSVDWPESFVACEHLFLKLVGRFAPENTCHLKCLQIILSLRQHQSLPHGASRPILTSYHFKTALMHLLLRLPLTDWAHNMLSQRLQDILWFLGRGLQQRSLHHFLIGNNFLPLTIPIPKTFRNAEPVNLFQHLVLNPKAHSQAVEEFQNLLTQVKTLPHAPLAAAP

SEQ ID NO: 40329 - protein, 180 aa, Homo sapiens
  Payload ID: 8212
  Gene Symbol: ITPRIPL1
  Gene Name: inositol 1,4,5-trisphosphate receptor interacting protein-like 1
  ENSP ID: ENSP00000408336
MAVISLLFLAVMYVVHHPLMVSDRMDLDTLARSRQLEKRMSEEMRLLEMEFEERKRAAEQRQKAENFWTGDTSSDQLVLGKKDMGWPFQADGQEGPLGWMLGNLWNTGLFCLFLVFELLRQNMQHEPAFDSSSEEEEEEVRVVPVTSYNWLTDFPSQEALDSFYKHYVQNAIRDLPCTCE

SEQ ID NO: 40330 - protein, 547 aa, Homo sapiens
  Payload ID: 8212
  Gene Symbol: ITPRIPL1
  Gene Name: inositol 1,4,5-trisphosphate receptor interacting protein-like 1
  Uniprot ID: Q6GPH6
  ENSP ID: ENSP00000439566
MAVISLLFLAVMYVVHHPLMVSDRMDLDTLARSRQLEKRMSEEMRLLEMEFEERKRAAEQRQKAENFWTGDTSSDQLVLGKKDMGWPFQADGQEGPLGWMLGNLWNTGLFCLFLVFELLRQNMQHEPAFDSSSEEEEEEVRVVPVTSYNWLTDFPSQEALDSFYKHYVQNAIRDLPCTCEFVESFVDDLIEACRVLSRQEAHPQLEDCLGIGAAFEKWGTLHETQKFDILVPIVPPQGTMFVLEMRDPALGRRCGCVLVESECVCKREKLLGDVLCLVHHHRDPSAVLGKCSSSIKAALCTGFHLDVCKTVQWFRNMMGNAWALVAHKYDFKLSLPPSTTSCKLRLDYRSGRFLSIHLVLGVQREDTLVYLVSQAPDQEQLTSVDWPESFVACEHLFLKLVGRFAPENTCHLKCLQIILSLRQHQSLPHGASRPILTSYHFKTALMHLLLRLPLTDWAHNMLSQRLQDILWFLGRGLQQRSLHHFLIGNNFLPLTIPIPKTFRNAEPVNLFQHLVLNPKAHSQAVEEFQNLLTQVKTLPHAPLAAAP

SEQ ID NO: 40331 - protein, 535 aa, Homo sapiens
  Payload ID: 8213
  Gene Symbol: ITPRIPL2
  Gene Name: inositol 1,4,5-trisphosphate receptor interacting protein-like 2
  Uniprot ID: Q3MIP1
  ENSP ID: ENSP00000370849
MSVHYTLNLRVFWPLVTGLCTALVCLYHVLRGSGGARAEPADGVDGGFPLLKVAVLLLLSYVLLRCRHAVRQRFLPGSPRLEGHAAFSSRHFREPGLSILLESYYEHEVRLSPHVLGHSKAHVSRIVGELVRAGRARGSPGLIPGGALALAFRGDFIQVGSAYEQHKIRRPDSFDVLVPLRLPPLVALEPRSLGEEPALAPAFRGCFLCALKAPPSPSGASGGHWLRDCKPFADAFCVDVRGRRHLSATLVLRWFQSHLQRSLATVRYSLEGRCRVTLTPGGLEQPPTLHILPCRTDYGCCRLSMAVRLIPAVHLGDGVFLVAPPPPPLPSAPLLELPEGLRAEALWGVNTARQEQKLLSWLQERAAPGACYLKCLQLLKALRDLGARGLDSAAATQWGRILSSYVLKTVLLAVLLRKGAPGQGWDEEHLGRCLEELVQFLRDCLLRRHTLFHCVLGPGGAAAEVGPLPKALREAAPVDLLAAFDGHARELAAARLLSTWQRLPQLLRAYGGPRYLARCPPPRSQRTQGFLEGEP

SEQ ID NO: 40332 - protein, 127 aa, Homo sapiens
  Payload ID: 8213
  Gene Symbol: ITPRIPL2
  Gene Name: inositol 1,4,5-trisphosphate receptor interacting protein-like 2
  ENSP ID: ENSP00000455257
VALRRRPGRGPTRLASSTLGSRLRHFLPASWRGLASPSEEETPGVRVTGSGAERSGGRARRAAQAMSSCAVATLSGSASCPGLPVWRVTPPSPRDTSESRASASCWRVTTSMRCACLRTCWATARRT

SEQ ID NO: 40333 - protein, 2743 aa, Homo sapiens
  Payload ID: 8214
  Gene Symbol: ITPR1
  Gene Name: inositol 1,4,5-trisphosphate receptor, type 1
  Uniprot ID: Q14643
  ENSP ID: ENSP00000306253
MSDKMSSFLHIGDICSLYAEGSTNGFISTLGLVDDRCVVQPETGDLNNPPKKFRDCLFKLCPMNRYSAQKQFWKAAKPGANSTTDAVLLNKLHHAADLEKKQNETENRKLLGTVIQYGNVIQLLHLKSNKYLTVNKRLPALLEKNAMRVTLDEAGNEGSWFYIQPFYKLRSIGDSVVIGDKVVLNPVNAGQPLHASSHQLVDNPGCNEVNSVNCNTSWKIVLFMKWSDNKDDILKGGDVVRLFHAEQEKFLTCDEHRKKQHVFLRTTGRQSATSATSSKALWEVEVVQHDPCRGGAGYWNSLFRFKHLATGHYLAAEVDPDQDASRSRLRNAQEKMVYSLVSVPEGNDISSIFELDPTTLRGGDSLVPRNSYVRLRHLCTNTWVHSTNIPIDKEEEKPVMLKIGTSPVKEDKEAFAIVPVSPAEVRDLDFANDASKVLGSIAGKLEKGTITQNERRSVTKLLEDLVYFVTGGTNSGQDVLEVVFSKPNRERQKLMREQNILKQIFKLLQAPFTDCGDGPMLRLEELGDQRHAPFRHICRLCYRVLRHSQQDYRKNQEYIAKQFGFMQKQIGYDVLAEDTITALLHNNRKLLEKHITAAEIDTFVSLVRKNREPRFLDYLSDLCVSMNKSIPVTQELICKAVLNPTNADILIETKLVLSRFEFEGVSSTGENALEAGEDEEEVWLFWRDSNKEIRSKSVRELAQDAKEGQKEDRDVLSYYRYQLNLFARMCLDRQYLAINEISGQLDVDLILRCMSDENLPYDLRASFCRLMLHMHVDRDPQEQVTPVKYARLWSEIPSEIAIDDYDSSGASKDEIKERFAQTMEFVEEYLRDVVCQRFPFSDKEKNKLTFEVVNLARNLIYFGFYNFSDLLRLTKILLAILDCVHVTTIFPISKMAKGEENKGNNDVEKLKSSNVMRSIHGVGELMTQVVLRGGGFLPMTPMAAAPEGNVKQAEPEKEDIMVMDTKLKIIEILQFILNVRLDYRISCLLCIFKREFDESNSQTSETSSGNSSQEGPSNVPGALDFEHIEEQAEGIFGGSEENTPLDLDDHGGRTFLRVLLHLTMHDYPPLVSGALQLLFRHFSQRQEVLQAFKQVQLLVTSQDVDNYKQIKQDLDQLRSIVEKSELWVYKGQGPDETMDGASGENEHKKTEEGNNKPQKHESTSSYNYRVVKEILIRLSKLCVQESASVRKSRKQQQRLLRNMGAHAVVLELLQIPYEKAEDTKMQEIMRLAHEFLQNFCAGNQQNQALLHKHINLFLNPGILEAVTMQHIFMNNFQLCSEINERVVQHFVHCIETHGRNVQYIKFLQTIVKAEGKFIKKCQDMVMAELVNSGEDVLVFYNDRASFQTLIQMMRSERDRMDENSPLMYHIHLVELLAVCTEGKNVYTEIKCNSLLPLDDIVRVVTHEDCIPEVKIAYINFLNHCYVDTEVEMKEIYTSNHMWKLFENFLVDICRACNNTSDRKHADSILEKYVTEIVMSIVTTFFSSPFSDQSTTLQTRQPVFVQLLQGVFRVYHCNWLMPSQKASVESCIRVLSDVAKSRAIAIPVDLDSQVNNLFLKSHSIVQKTAMNWRLSARNAARRDSVLAASRDYRNIIERLQDIVSALEDRLRPLVQAELSVLVDVLHRPELLFPENTDARRKCESGGFICKLIKHTKQLLEENEEKLCIKVLQTLREMMTKDRGYGEKLISIDELDNAELPPAPDSENATEELEPSPPLRQLEDHKRGEALRQVLVNRYYGNVRPSGRRESLTSFGNGPLSAGGPGKPGGGGGGSGSSSMSRGEMSLAEVQCHLDKEGASNLVIDLIMNASSDRVFHESILLAIALLEGGNTTIQHSFFCRLTEDKKSEKFFKVFYDRMKVAQQEIKATVTVNTSDLGNKKKDDEVDRDAPSRKKAKEPTTQITEEVRDQLLEASAATRKAFTTFRREADPDDHYQPGEGTQATADKAKDDLEMSAVITIMQPILRFLQLLCENHNRDLQNFLRCQNNKTNYNLVCETLQFLDCICGSTTGGLGLLGLYINEKNVALINQTLESLTEYCQGPCHENQNCIATHESNGIDIITALILNDINPLGKKRMDLVLELKNNASKLLLAIMESRHDSENAERILYNMRPKELVEVIKKAYMQGEVEFEDGENGEDGAASPRNVGHNIYILAHQLARHNKELQSMLKPGGQVDGDEALEFYAKHTAQIEIVRLDRTMEQIVFPVPSICEFLTKESKLRIYYTTERDEQGSKINDFFLRSEDLFNEMNWQKKLRAQPVLYWCARNMSFWSSISFNLAVLMNLLVAFFYPFKGVRGGTLEPHWSGLLWTAMLISLAIVIALPKPHGIRALIASTILRLIFSVGLQPTLFLLGAFNVCNKIIFLMSFVGNCGTFTRGYRAMVLDVEFLYHLLYLVICAMGLFVHEFFYSLLLFDLVYREETLLNVIKSVTRNGRSIILTAVLALILVYLFSIVGYLFFKDDFILEVDRLPNETAVPETGESLASEFLFSDVCRVESGENCSSPAPREELVPAEETEQDKEHTCETLLMCIVTVLSHGLRSGGGVGDVLRKPSKEEPLFAARVIYDLLFFFMVIIIVLNLIFGVIIDTFADLRSEKQKKEEILKTTCFICGLERDKFDNKTVTFEEHIKEEHNMWHYLCFIVLVKVKDSTEYTGPESYVAEMIKERNLDWFPRMRAMSLVSSDSEGEQNELRNLQEKLESTMKLVTNLSGQLSELKDQMTEQRKQKQRIGLLGHPPHMNVNPQQPA

SEQ ID NO: 40334 - protein, 2758 aa, Homo sapiens
  Payload ID: 8214
  Gene Symbol: ITPR1
  Gene Name: inositol 1,4,5-trisphosphate receptor, type 1
  Uniprot ID: Q14643
  ENSP ID: ENSP00000346595
MSDKMSSFLHIGDICSLYAEGSTNGFISTLGLVDDRCVVQPETGDLNNPPKKFRDCLFKLCPMNRYSAQKQFWKAAKPGANSTTDAVLLNKLHHAADLEKKQNETENRKLLGTVIQYGNVIQLLHLKSNKYLTVNKRLPALLEKNAMRVTLDEAGNEGSWFYIQPFYKLRSIGDSVVIGDKVVLNPVNAGQPLHASSHQLVDNPGCNEVNSVNCNTSWKIVLFMKWSDNKDDILKGGDVVRLFHAEQEKFLTCDEHRKKQHVFLRTTGRQSATSATSSKALWEVEVVQHDPCRGGAGYWNSLFRFKHLATGHYLAAEVDPDFEEECLEFQPSVDPDQDASRSRLRNAQEKMVYSLVSVPEGNDISSIFELDPTTLRGGDSLVPRNSYVRLRHLCTNTWVHSTNIPIDKEEEKPVMLKIGTSPVKEDKEAFAIVPVSPAEVRDLDFANDASKVLGSIAGKLEKGTITQNERRSVTKLLEDLVYFVTGGTNSGQDVLEVVFSKPNRERQKLMREQNILKQIFKLLQAPFTDCGDGPMLRLEELGDQRHAPFRHICRLCYRVLRHSQQDYRKNQEYIAKQFGFMQKQIGYDVLAEDTITALLHNNRKLLEKHITAAEIDTFVSLVRKNREPRFLDYLSDLCVSMNKSIPVTQELICKAVLNPTNADILIETKLVLSRFEFEGVSSTGENALEAGEDEEEVWLFWRDSNKEIRSKSVRELAQDAKEGQKEDRDVLSYYRYQLNLFARMCLDRQYLAINEISGQLDVDLILRCMSDENLPYDLRASFCRLMLHMHVDRDPQEQVTPVKYARLWSEIPSEIAIDDYDSSGASKDEIKERFAQTMEFVEEYLRDVVCQRFPFSDKEKNKLTFEVVNLARNLIYFGFYNFSDLLRLTKILLAILDCVHVTTIFPISKMAKGEENKGNNDVEKLKSSNVMRSIHGVGELMTQVVLRGGGFLPMTPMAAAPEGNVKQAEPEKEDIMVMDTKLKIIEILQFILNVRLDYRISCLLCIFKREFDESNSQTSETSSGNSSQEGPSNVPGALDFEHIEEQAEGIFGGSEENTPLDLDDHGGRTFLRVLLHLTMHDYPPLVSGALQLLFRHFSQRQEVLQAFKQVQLLVTSQDVDNYKQIKQDLDQLRSIVEKSELWVYKGQGPDETMDGASGENEHKKTEEGNNKPQKHESTSSYNYRVVKEILIRLSKLCVQESASVRKSRKQQQRLLRNMGAHAVVLELLQIPYEKAEDTKMQEIMRLAHEFLQNFCAGNQQNQALLHKHINLFLNPGILEAVTMQHIFMNNFQLCSEINERVVQHFVHCIETHGRNVQYIKFLQTIVKAEGKFIKKCQDMVMAELVNSGEDVLVFYNDRASFQTLIQMMRSERDRMDENSPLMYHIHLVELLAVCTEGKNVYTEIKCNSLLPLDDIVRVVTHEDCIPEVKIAYINFLNHCYVDTEVEMKEIYTSNHMWKLFENFLVDICRACNNTSDRKHADSILEKYVTEIVMSIVTTFFSSPFSDQSTTLQTRQPVFVQLLQGVFRVYHCNWLMPSQKASVESCIRVLSDVAKSRAIAIPVDLDSQVNNLFLKSHSIVQKTAMNWRLSARNAARRDSVLAASRDYRNIIERLQDIVSALEDRLRPLVQAELSVLVDVLHRPELLFPENTDARRKCESGGFICKLIKHTKQLLEENEEKLCIKVLQTLREMMTKDRGYGEKLISIDELDNAELPPAPDSENATEELEPSPPLRQLEDHKRGEALRQVLVNRYYGNVRPSGRRESLTSFGNGPLSAGGPGKPGGGGGGSGSSSMSRGEMSLAEVQCHLDKEGASNLVIDLIMNASSDRVFHESILLAIALLEGGNTTIQHSFFCRLTEDKKSEKFFKVFYDRMKVAQQEIKATVTVNTSDLGNKKKDDEVDRDAPSRKKAKEPTTQITEEVRDQLLEASAATRKAFTTFRREADPDDHYQPGEGTQATADKAKDDLEMSAVITIMQPILRFLQLLCENHNRDLQNFLRCQNNKTNYNLVCETLQFLDCICGSTTGGLGLLGLYINEKNVALINQTLESLTEYCQGPCHENQNCIATHESNGIDIITALILNDINPLGKKRMDLVLELKNNASKLLLAIMESRHDSENAERILYNMRPKELVEVIKKAYMQGEVEFEDGENGEDGAASPRNVGHNIYILAHQLARHNKELQSMLKPGGQVDGDEALEFYAKHTAQIEIVRLDRTMEQIVFPVPSICEFLTKESKLRIYYTTERDEQGSKINDFFLRSEDLFNEMNWQKKLRAQPVLYWCARNMSFWSSISFNLAVLMNLLVAFFYPFKGVRGGTLEPHWSGLLWTAMLISLAIVIALPKPHGIRALIASTILRLIFSVGLQPTLFLLGAFNVCNKIIFLMSFVGNCGTFTRGYRAMVLDVEFLYHLLYLVICAMGLFVHEFFYSLLLFDLVYREETLLNVIKSVTRNGRSIILTAVLALILVYLFSIVGYLFFKDDFILEVDRLPNETAVPETGESLASEFLFSDVCRVESGENCSSPAPREELVPAEETEQDKEHTCETLLMCIVTVLSHGLRSGGGVGDVLRKPSKEEPLFAARVIYDLLFFFMVIIIVLNLIFGVIIDTFADLRSEKQKKEEILKTTCFICGLERDKFDNKTVTFEEHIKEEHNMWHYLCFIVLVKVKDSTEYTGPESYVAEMIKERNLDWFPRMRAMSLVSSDSEGEQNELRNLQEKLESTMKLVTNLSGQLSELKDQMTEQRKQKQRIGLLGHPPHMNVNPQQPA

SEQ ID NO: 40335 - protein, 2710 aa, Homo sapiens
  Payload ID: 8214
  Gene Symbol: ITPR1
  Gene Name: inositol 1,4,5-trisphosphate receptor, type 1
  Uniprot ID: Q14643
  ENSP ID: ENSP00000349597
MSDKMSSFLHIGDICSLYAEGSTNGFISTLGLVDDRCVVQPETGDLNNPPKKFRDCLFKLCPMNRYSAQKQFWKAAKPGANSTTDAVLLNKLHHAADLEKKQNETENRKLLGTVIQYGNVIQLLHLKSNKYLTVNKRLPALLEKNAMRVTLDEAGNEGSWFYIQPFYKLRSIGDSVVIGDKVVLNPVNAGQPLHASSHQLVDNPGCNEVNSVNCNTSWKIVLFMKWSDNKDDILKGGDVVRLFHAEQEKFLTCDEHRKKQHVFLRTTGRQSATSATSSKALWEVEVVQHDPCRGGAGYWNSLFRFKHLATGHYLAAEVDPDFEEECLEFQPSVDPDQDASRSRLRNAQEKMVYSLVSVPEGNDISSIFELDPTTLRGGDSLVPRNSYVRLRHLCTNTWVHSTNIPIDKEEEKPVMLKIGTSPVKEDKEAFAIVPVSPAEVRDLDFANDASKVLGSIAGKLEKGTITQNERRSVTKLLEDLVYFVTGGTNSGQDVLEVVFSKPNRERQKLMREQNILKQIFKLLQAPFTDCGDGPMLRLEELGDQRHAPFRHICRLCYRVLRHSQQDYRKNQEYIAKQFGFMQKQIGYDVLAEDTITALLHNNRKLLEKHITAAEIDTFVSLVRKNREPRFLDYLSDLCVSMNKSIPVTQELICKAVLNPTNADILIETKLVLSRFEFEGVSSTGENALEAGEDEEEVWLFWRDSNKEIRSKSVRELAQDAKEGQKEDRDVLSYYRYQLNLFARMCLDRQYLAINEISGQLDVDLILRCMSDENLPYDLRASFCRLMLHMHVDRDPQEQVTPVKYARLWSEIPSEIAIDDYDSSGASKDEIKERFAQTMEFVEEYLRDVVCQRFPFSDKEKNKLTFEVVNLARNLIYFGFYNFSDLLRLTKILLAILDCVHVTTIFPISKMAKGEENKGSNVMRSIHGVGELMTQVVLRGGGFLPMTPMAAAPEGNVKQAEPEKEDIMVMDTKLKIIEILQFILNVRLDYRISCLLCIFKREFDESNSQTSETSSGNSSQEGPSNVPGALDFEHIEEQAEGIFGGSEENTPLDLDDHGGRTFLRVLLHLTMHDYPPLVSGALQLLFRHFSQRQEVLQAFKQVQLLVTSQDVDNYKQIKQDLDQLRSIVEKSELWVYKGQGPDETMDGASGENEHKKTEEGNNKPQKHESTSSYNYRVVKEILIRLSKLCVQESASVRKSRKQQQRLLRNMGAHAVVLELLQIPYEKAEDTKMQEIMRLAHEFLQNFCAGNQQNQALLHKHINLFLNPGILEAVTMQHIFMNNFQLCSEINERVVQHFVHCIETHGRNVQYIKFLQTIVKAEGKFIKKCQDMVMAELVNSGEDVLVFYNDRASFQTLIQMMRSERDRMDENSPLMYHIHLVELLAVCTEGKNVYTEIKCNSLLPLDDIVRVVTHEDCIPEVKIAYINFLNHCYVDTEVEMKEIYTSNHMWKLFENFLVDICRACNNTSDRKHADSILEKYVTEIVMSIVTTFFSSPFSDQSTTLQTRQPVFVQLLQGVFRVYHCNWLMPSQKASVESCIRVLSDVAKSRAIAIPVDLDSQVNNLFLKSHSIVQKTAMNWRLSARNAARRDSVLAASRDYRNIIERLQDIVSALEDRLRPLVQAELSVLVDVLHRPELLFPENTDARRKCESGGFICKLIKHTKQLLEENEEKLCIKVLQTLREMMTKDRGYGEKGEALRQVLVNRYYGNVRPSGRRESLTSFGNGPLSAGGPGKPGGGGGGSGSSSMSRGEMSLAEVQCHLDKEGASNLVIDLIMNASSDRVFHESILLAIALLEGGNTTIQHSFFCRLTEDKKSEKFFKVFYDRMKVAQQEIKATVTVNTSDLGNKKKDDEVDRDAPSRKKAKEPTTQITEEVRDQLLEASAATRKAFTTFRREADPDDHYQPGEGTQATADKAKDDLEMSAVITIMQPILRFLQLLCENHNRDLQNFLRCQNNKTNYNLVCETLQFLDCICGSTTGGLGLLGLYINEKNVALINQTLESLTEYCQGPCHENQNCIATHESNGIDIITALILNDINPLGKKRMDLVLELKNNASKLLLAIMESRHDSENAERILYNMRPKELVEVIKKAYMQGEVEFEDGENGEDGAASPRNVGHNIYILAHQLARHNKELQSMLKPGGQVDGDEALEFYAKHTAQIEIVRLDRTMEQIVFPVPSICEFLTKESKLRIYYTTERDEQGSKINDFFLRSEDLFNEMNWQKKLRAQPVLYWCARNMSFWSSISFNLAVLMNLLVAFFYPFKGVRGGTLEPHWSGLLWTAMLISLAIVIALPKPHGIRALIASTILRLIFSVGLQPTLFLLGAFNVCNKIIFLMSFVGNCGTFTRGYRAMVLDVEFLYHLLYLVICAMGLFVHEFFYSLLLFDLVYREETLLNVIKSVTRNGRSIILTAVLALILVYLFSIVGYLFFKDDFILEVDRLPNETAVPETGESLASEFLFSDVCRVESGENCSSPAPREELVPAEETEQDKEHTCETLLMCIVTVLSHGLRSGGGVGDVLRKPSKEEPLFAARVIYDLLFFFMVIIIVLNLIFGVIIDTFADLRSEKQKKEEILKTTCFICGLERDKFDNKTVTFEEHIKEEHNMWHYLCFIVLVKVKDSTEYTGPESYVAEMIKERNLDWFPRMRAMSLVSSDSEGEQNELRNLQEKLESTMKLVTNLSGQLSELKDQMTEQRKQKQRIGLLGHPPHMNVNPQQPA

SEQ ID NO: 40336 - protein, 2695 aa, Homo sapiens
  Payload ID: 8214
  Gene Symbol: ITPR1
  Gene Name: inositol 1,4,5-trisphosphate receptor, type 1
  Uniprot ID: Q14643
  ENSP ID: ENSP00000397885
MSDKMSSFLHIGDICSLYAEGSTNGFISTLGLVDDRCVVQPETGDLNNPPKKFRDCLFKLCPMNRYSAQKQFWKAAKPGANSTTDAVLLNKLHHAADLEKKQNETENRKLLGTVIQYGNVIQLLHLKSNKYLTVNKRLPALLEKNAMRVTLDEAGNEGSWFYIQPFYKLRSIGDSVVIGDKVVLNPVNAGQPLHASSHQLVDNPGCNEVNSVNCNTSWKIVLFMKWSDNKDDILKGGDVVRLFHAEQEKFLTCDEHRKKQHVFLRTTGRQSATSATSSKALWEVEVVQHDPCRGGAGYWNSLFRFKHLATGHYLAAEVDPDQDASRSRLRNAQEKMVYSLVSVPEGNDISSIFELDPTTLRGGDSLVPRNSYVRLRHLCTNTWVHSTNIPIDKEEEKPVMLKIGTSPVKEDKEAFAIVPVSPAEVRDLDFANDASKVLGSIAGKLEKGTITQNERRSVTKLLEDLVYFVTGGTNSGQDVLEVVFSKPNRERQKLMREQNILKQIFKLLQAPFTDCGDGPMLRLEELGDQRHAPFRHICRLCYRVLRHSQQDYRKNQEYIAKQFGFMQKQIGYDVLAEDTITALLHNNRKLLEKHITAAEIDTFVSLVRKNREPRFLDYLSDLCVSMNKSIPVTQELICKAVLNPTNADILIETKLVLSRFEFEGVSSTGENALEAGEDEEEVWLFWRDSNKEIRSKSVRELAQDAKEGQKEDRDVLSYYRYQLNLFARMCLDRQYLAINEISGQLDVDLILRCMSDENLPYDLRASFCRLMLHMHVDRDPQEQVTPVKYARLWSEIPSEIAIDDYDSSGASKDEIKERFAQTMEFVEEYLRDVVCQRFPFSDKEKNKLTFEVVNLARNLIYFGFYNFSDLLRLTKILLAILDCVHVTTIFPISKMAKGEENKGSNVMRSIHGVGELMTQVVLRGGGFLPMTPMAAAPEGNVKQAEPEKEDIMVMDTKLKIIEILQFILNVRLDYRISCLLCIFKREFDESNSQTSETSSGNSSQEGPSNVPGALDFEHIEEQAEGIFGGSEENTPLDLDDHGGRTFLRVLLHLTMHDYPPLVSGALQLLFRHFSQRQEVLQAFKQVQLLVTSQDVDNYKQIKQDLDQLRSIVEKSELWVYKGQGPDETMDGASGENEHKKTEEGNNKPQKHESTSSYNYRVVKEILIRLSKLCVQESASVRKSRKQQQRLLRNMGAHAVVLELLQIPYEKAEDTKMQEIMRLAHEFLQNFCAGNQQNQALLHKHINLFLNPGILEAVTMQHIFMNNFQLCSEINERVVQHFVHCIETHGRNVQYIKFLQTIVKAEGKFIKKCQDMVMAELVNSGEDVLVFYNDRASFQTLIQMMRSERDRMDENSPLMYHIHLVELLAVCTEGKNVYTEIKCNSLLPLDDIVRVVTHEDCIPEVKIAYINFLNHCYVDTEVEMKEIYTSNHMWKLFENFLVDICRACNNTSDRKHADSILEKYVTEIVMSIVTTFFSSPFSDQSTTLQTRQPVFVQLLQGVFRVYHCNWLMPSQKASVESCIRVLSDVAKSRAIAIPVDLDSQVNNLFLKSHSIVQKTAMNWRLSARNAARRDSVLAASRDYRNIIERLQDIVSALEDRLRPLVQAELSVLVDVLHRPELLFPENTDARRKCESGGFICKLIKHTKQLLEENEEKLCIKVLQTLREMMTKDRGYGEKGEALRQVLVNRYYGNVRPSGRRESLTSFGNGPLSAGGPGKPGGGGGGSGSSSMSRGEMSLAEVQCHLDKEGASNLVIDLIMNASSDRVFHESILLAIALLEGGNTTIQHSFFCRLTEDKKSEKFFKVFYDRMKVAQQEIKATVTVNTSDLGNKKKDDEVDRDAPSRKKAKEPTTQITEEVRDQLLEASAATRKAFTTFRREADPDDHYQPGEGTQATADKAKDDLEMSAVITIMQPILRFLQLLCENHNRDLQNFLRCQNNKTNYNLVCETLQFLDCICGSTTGGLGLLGLYINEKNVALINQTLESLTEYCQGPCHENQNCIATHESNGIDIITALILNDINPLGKKRMDLVLELKNNASKLLLAIMESRHDSENAERILYNMRPKELVEVIKKAYMQGEVEFEDGENGEDGAASPRNVGHNIYILAHQLARHNKELQSMLKPGGQVDGDEALEFYAKHTAQIEIVRLDRTMEQIVFPVPSICEFLTKESKLRIYYTTERDEQGSKINDFFLRSEDLFNEMNWQKKLRAQPVLYWCARNMSFWSSISFNLAVLMNLLVAFFYPFKGVRGGTLEPHWSGLLWTAMLISLAIVIALPKPHGIRALIASTILRLIFSVGLQPTLFLLGAFNVCNKIIFLMSFVGNCGTFTRGYRAMVLDVEFLYHLLYLVICAMGLFVHEFFYSLLLFDLVYREETLLNVIKSVTRNGRSIILTAVLALILVYLFSIVGYLFFKDDFILEVDRLPNETAVPETGESLASEFLFSDVCRVESGENCSSPAPREELVPAEETEQDKEHTCETLLMCIVTVLSHGLRSGGGVGDVLRKPSKEEPLFAARVIYDLLFFFMVIIIVLNLIFGVIIDTFADLRSEKQKKEEILKTTCFICGLERDKFDNKTVTFEEHIKEEHNMWHYLCFIVLVKVKDSTEYTGPESYVAEMIKERNLDWFPRMRAMSLVSSDSEGEQNELRNLQEKLESTMKLVTNLSGQLSELKDQMTEQRKQKQRIGLLGHPPHMNVNPQQPA

SEQ ID NO: 40337 - protein, 2743 aa, Homo sapiens; identical to SEQ ID NO: 40333
  Payload ID: 8214
  Gene Symbol: ITPR1
  Gene Name: inositol 1,4,5-trisphosphate receptor, type 1
  Uniprot ID: Q14643
  ENSP ID: ENSP00000401671

SEQ ID NO: 40338 - protein, 721 aa, Homo sapiens
  Payload ID: 8214
  Gene Symbol: ITPR1
  Gene Name: inositol 1,4,5-trisphosphate receptor, type 1
  ENSP ID: ENSP00000440564
MSDKMSSFLHIGDICSLYAEGSTNGFISTLGLVDDRCVVQPETGDLNNPPKKFRDCLFKLCPMNRYSAQKQFWKAAKPGANSTTDAVLLNKLHHAADLEKKQNETENRKLLGTVIQYGNVIQLLHLKSNKYLTVNKRLPALLEKNAMRVTLDEAGNEGSWFYIQPFYKLRSIGDSVVIGDKVVLNPVNAGQPLHASSHQLVDNPGCNEVNSVNCNTSWKIVLFMKWSDNKDDILKGGDVVRLFHAEQEKFLTCDEHRKKQHVFLRTTGRQSATSATSSKALWEVEVVQHDPCRGGAGYWNSLFRFKHLATGHYLAAEVDPDFEEECLEFQPSVCNKIIFLMSFVGNCGTFTRGYRAMVLDVEFLYHLLYLVICAMGLFVHEFFYSLLLFDLVYREETLLNVIKSVTRNGRSIILTAVLALILVYLFSIVGYLFFKDDFILEVDRLPNETAVPETGESLASEFLFSDVCRVESGENCSSPAPREELVPAEETEQDKEHTCETLLMCIVTVLSHGLRSGGGVGDVLRKPSKEEPLFAARVIYDLLFFFMVIIIVLNLIFGVIIDTFADLRSEKQKKEEILKTTCFICGLERDKFDNKTVTFEEHIKEEHNMWHYLCFIVLVKVKDSTEYTGPESYVAEMIKERNLDWFPRMRAMSLVSSDSEGEQNELRNLQEKLESTMKLVTNLSGQLSELKDQMTEQRKQKQRIGLLGHPPHMNVNPQQPA

SEQ ID NO: 40339 - protein, 181 aa, Homo sapiens
  Payload ID: 8215
  Gene Symbol: ITPR2
  Gene Name: inositol 1,4,5-trisphosphate receptor, type 2
  Uniprot ID: Q14571
  ENSP ID: ENSP00000242737
MTEKMSSFLYIGDIVSLYAEGSVNGFISTLGLVDDRCVVHPEAGDLANPPKKFRDCLFKVCPMNRYSAQKQYWKAKQAKQGNHTEAALLKKLQHAAELEQKQNESENKKLLGEIVKYSNVIQLLHIKSNKYLTVNKRLPALLEKNAMRVSLDAAGNEGSWFYIHPFWKLRSEGDNDASFWI

SEQ ID NO: 40340 - protein, 2701 aa, Homo sapiens
  Payload ID: 8215
  Gene Symbol: ITPR2
  Gene Name: inositol 1,4,5-trisphosphate receptor, type 2
  Uniprot ID: Q14571
  ENSP ID: ENSP00000370744
MTEKMSSFLYIGDIVSLYAEGSVNGFISTLGLVDDRCVVHPEAGDLANPPKKFRDCLFKVCPMNRYSAQKQYWKAKQAKQGNHTEAALLKKLQHAAELEQKQNESENKKLLGEIVKYSNVIQLLHIKSNKYLTVNKRLPALLEKNAMRVSLDAAGNEGSWFYIHPFWKLRSEGDNIVVGDKVVLMPVNAGQPLHASNIELLDNPGCKEVNAVNCNTSWKITLFMKYSSYREDVLKGGDVVRLFHAEQEKFLTCDEYEKKQHIFLRTTLRQSATSATSSKALWEIEVVHHDPCRGGAGQWNSLFRFKHLATGNYLAAELNPDYRDAQNEGKNVRDGVPPTSKKKRQAGEKIMYTLVSVPHGNDIASLFELDATTLQRADCLVPRNSYVRLRHLCTNTWVTSTSIPIDTDEERPVMLKIGTCQTKEDKEAFAIVSVPLSEVRDLDFANDANKVLATTVKKLENGTITQNERRFVTKLLEDLIFFVADVPNNGQEVLDVVITKPNRERQKLMREQNILAQVFGILKAPFKEKAGEGSMLRLEDLGDQRYAPYKYMLRLCYRVLRHSQQDYRKNQEYIAKNFCVMQSQIGYDILAEDTITALLHNNRKLLEKHITAKEIETFVSLLRRNREPRFLDYLSDLCVSNTTAIPVTQELICKFMLSPGNADILIQTKVVSMQADNPMESSILSDDIDDEEVWLYWIDSNKEPHGKAIRHLAQEAKEGTKADLEVLTYYRYQLNLFARMCLDRQYLAINQISTQLSVDLILRCVSDESLPFDLRASFCRLMLHMHVDRDPQESVVPVRYARLWTEIPTKITIHEYDSITDSSRNDMKRKFALTMEFVEEYLKEVVNQPFPFGDKEKNKLTFEVVHLARNLIYFGFYSFSELLRLTRTLLAILDIVQAPMSSYFERLSKFQDGGNNVMRTIHGVGEMMTQMVLSRGSIFPMSVPDVPPSIHPSKQGSPTEHEDVTVMDTKLKIIEILQFILSVRLDYRISYMLSIYKKEFGEDNDNAETSASGSPDTLLPSAIVPDIDEIAAQAETMFAGRKEKNPVQLDDEGGRTFLRVLIHLIMHDYPPLLSGALQLLFKHFSQRAEVLQAFKQVQLLVSNQDVDNYKQIKADLDQLRLTVEKSELWVEKSSNYENGEIGESQVKGGEEPIEESNILSPVQDGTKKPQIDSNKSNNYRIVKEILIRLSKLCVQNKKCRNQHQRLLKNMGAHSVVLDLLQIPYEKNDEKMNEVMNLAHTFLQNFCRGNPQNQVLLHKHLNLFLTPGLLEAETMRHIFMNNYHLCNEISERVVQHFVHCIETHGRHVEYLRFLQTIVKADGKYVKKCQDMVMTELINGGEDVLIFYNDRASFPILLHMMCSERDRGDESGPLAYHITLVELLAACTEGKNVYTEIKCNSLLPLDDIVRVVTHDDCIPEVKIAYVNFVNHCYVDTEVEMKEIYTSNHIWKLFENFLVDMARVCNTTTDRKHADIFLEKCVTESIMNIVSGFFNSPFSDNSTSLQTHQPVFIQLLQSAFRIYNCTWPNPAQKASVESCIRTLAEVAKNRGIAIPVDLDSQVNTLFMKSHSNMVQRAAMGWRLSARSGPRFKEALGGPAWDYRNIIEKLQDVVASLEHQFSPMMQAEFSVLVDVLYSPELLFPEGSDARIRCGAFMSKLINHTKKLMEKEEKLCIKILQTLREMLEKKDSFVEEGNTLRKILLNRYFKGDYSIGVNGHLSGAYSKTAQVGGSFSGQDSDKMGISMSDIQCLLDKEGASELVIDVIVNTKNDRIFSEGIFLGIALLEGGNTQTQYSFYQQLHEQKKSEKFFKVLYDRMKAAQKEIRSTVTVNTIDLGNKKRDDDNELMTSGPRMRVRDSTLHLKEGMKGQLTEASSATSKAYCVYRREMDPEIDIMCTGPEAGNTEEKSAEEVTMSPAIAIMQPILRFLQLLCENHNRELQNFLRNQNNKTNYNLVCETLQFLDCICGSTTGGLGLLGLYINEKNVALVNQNLESLTEYCQGPCHENQTCIATHESNGIDIIIALILNDINPLGKYRMDLVLQLKNNASKLLLAIMESRHDSENAERILFNMRPRELVDVMKNAYNQGLECDHGDDEGGDDGVSPKDVGHNIYILAHQLARHNKLLQQMLKPGSDPDEGDEALKYYANHTAQIEIVRHDRTMEQIVFPVPNICEYLTRESKCRVFNTTERDEQGSKVNDFFQQTEDLYNEMKWQKKIRNNPALFWFSRHISLWGSISFNLAVFINLAVALFYPFGDDGDEGTLSPLFSVLLWIAVAICTSMLFFFSKPVGIRPFLVSIMLRSIYTIGLGPTLILLGAANLCNKIVFLVSFVGNRGTFTRGYRAVILDMAFLYHVAYVLVCMLGLFVHEFFYSFLLFDLVYREETLLNVIKSVTRNGRSIILTAVLALILVYLFSIIGFLFLKDDFTMEVDRLKNRTPVTGSHQVPTMTLTTMMEACAKENCSPTIPASNTADEEYEDGIERTCDTLLMCIVTVLNQGLRNGGGVGDVLRRPSKDEPLFAARVVYDLLFYFIVIIIVLNLIFGVIIDTFADLRSEKQKKEEILKTTCFICGLERDKFDNKTVSFEEHIKSEHNMWHYLYFIVLVKVKDPTEYTGPESYVAQMIVEKNLDWFPRMRAMSLVSNEGDSEQNEIRSLQEKLESTMSLVKQLSGQLAELKEQMTEQRKNKQRLGFLGSNTPHVNHHMPPH

SEQ ID NO: 40341 - protein, 102 aa, Homo sapiens
  Payload ID: 8215
  Gene Symbol: ITPR2
  Gene Name: inositol 1,4,5-trisphosphate receptor, type 2
  ENSP ID: ENSP00000408287
NTKNDRIFSEGIFLGIALLEGGNTQTQYSFYQQLHEQKKSEKFFKVLYDRMKAAQKEIRSTVTVNTIDLGNKKRDDDNELMTSGPRMREFWSWGDPKTALQD

SEQ ID NO: 40342 - protein, 79 aa, Homo sapiens
  Payload ID: 8215
  Gene Symbol: ITPR2
  Gene Name: inositol 1,4,5-trisphosphate receptor, type 2
  ENSP ID: ENSP00000440548
MTEKMSSFLYIGDIVSLYAEGSVNGFISTLGLPFQGVPYEQIFCPEAILESKASQTREPHRGSLAEETTARCRTGTKTK

SEQ ID NO: 40343 - protein, 2671 aa, Homo sapiens
  Payload ID: 8216
  Gene Symbol: ITPR3
  Gene Name: inositol 1,4,5-trisphosphate receptor, type 3
  Uniprot ID: Q14573
  ENSP ID: ENSP00000363435
MSEMSSFLHIGDIVSLYAEGSVNGFISTLGLVDDRCVVEPAAGDLDNPPKKFRDCLFKVCPMNRYSAQKQYWKAKQTKQDKEKIADVVLLQKLQHAAQMEQKQNDTENKKVHGDVVKYGSVIQLLHMKSNKYLTVNKRLPALLEKNAMRVTLDATGNEGSWLFIQPFWKLRSNGDNVVVGDKVILNPVNAGQPLHASNYELSDNAGCKEVNSVNCNTSWKINLFMQFRDHLEEVLKGGDVVRLFHAEQEKFLTCDEYKGKLQVFLRTTLRQSATSATSSNALWEVEVVHHDPCRGGAGHWNGLYRFKHLATGNYLAAEENPSYKGDASDPKAAGMGAQGRTGRRNAGEKIKYCLVAVPHGNDIASLFELDPTTLQKTDSFVPRNSYVRLRHLCTNTWIQSTNVPIDIEEERPIRLMLGTCPTKEDKEAFAIVSVPVSEIRDLDFANDASSMLASAVEKLNEGFISQNDRRFVIQLLEDLVFFVSDVPNNGQNVLDIMVTKPNRERQKLMREQNILKQVFGILKAPFREKGGEGPLVRLEELSDQKNAPYQHMFRLCYRVLRHSQEDYRKNQEHIAKQFGMMQSQIGYDILAEDTITALLHNNRKLLEKHITKTEVETFVSLVRKNREPRFLDYLSDLCVSNHIAIPVTQELICKCVLDPKNSDILIRTELRPVKEMAQSHEYLSIEYSEEEVWLTWTDKNNEHHEKSVRQLAQEARAGNAHDENVLSYYRYQLKLFARMCLDRQYLAIDEISQQLGVDLIFLCMADEMLPFDLRASFCHLMLHVHVDRDPQELVTPVKFARLWTEIPTAITIKDYDSNLNASRDDKKNKFANTMEFVEDYLNNVVSEAVPFANEEKNKLTFEVVSLAHNLIYFGFYSFSELLRLTRTLLGIIDCVQGPPAMLQAYEDPGGKNVRRSIQGVGHMMSTMVLSRKQSVFSAPSLSAGASAAEPLDRSKFEENEDIVVMETKLKILEILQFILNVRLDYRISYLLSVFKKEFVEVFPMQDSGADGTAPAFDSTTANMNLDRIGEQAEAMFGVGKTSSMLEVDDEGGRMFLRVLIHLTMHDYAPLVSGALQLLFKHFSQRQEAMHTFKQVQLLISAQDVENYKVIKSELDRLRTMVEKSELWVDKKGSGKGEEVEAGAAKDKKERPTDEEGFLHPPGEKSSENYQIVKGILERLNKMCGVGEQMRKKQQRLLKNMDAHKVMLDLLQIPYDKGDAKMMEILRYTHQFLQKFCAGNPGNQALLHKHLHLFLTPGLLEAETMQHIFLNNYQLCSEISEPVLQHFVHLLATHGRHVQYLDFLHTVIKAEGKYVKKCQDMIMTELTNAGDDVVVFYNDKASLAHLLDMMKAARDGVEDHSPLMYHISLVDLLAACAEGKNVYTEIKCTSLLPLEDVVSVVTHEDCITEVKMAYVNFVNHCYVDTEVEMKEIYTSNHIWTLFENFTLDMARVCSKREKRVADPTLEKYVLSVVLDTINAFFSSPFSENSTSLQTHQTIVVQLLQSTTRLLECPWLQQQHKGSVEACIRTLAMVAKGRAILLPMDLDAHISSMLSSGASCAAAAQRNASSYKATTRAFPRVTPTANQWDYKNIIEKLQDIITALEERLKPLVQAELSVLVDVLHWPELLFLEGSEAYQRCESGGFLSKLIQHTKDLMESEEKLCIKVLRTLQQMLLKKTKYGDRGNQLRKMLLQNYLQNRKSTSRGDLPDPIGTGLDPDWSAIAATQCRLDKEGATKLVCDLITSTKNEKIFQESIGLAIHLLDGGNTEIQKSFHNLMMSDKKSERFFKVLHDRMKRAQQETKSTVAVNMNDLGSQPHEDREPVDPTTKGRVASFSIPGSSSRYSLGPSLRRGHEVSERVQSSEMGTSVLIMQPILRFLQLLCENHNRDLQNFLRCQNNKTNYNLVCETLQFLDIMCGSTTGGLGLLGLYINEDNVGLVIQTLETLTEYCQGPCHENQTCIVTHESNGIDIITALILNDISPLCKYRMDLVLQLKDNASKLLLALMESRHDSENAERILISLRPQELVDVIKKAYLQEEERENSEVSPREVGHNIYILALQLSRHNKQLQHLLKPVKRIQEEEAEGISSMLSLNNKQLSQMLKSSAPAQEEEEDPLAYYENHTSQIEIVRQDRSMEQIVFPVPGICQFLTEETKHRLFTTTEQDEQGSKVSDFFDQSSFLHNEMEWQRKLRSMPLIYWFSRRMTLWGSISFNLAVFINIIIAFFYPYMEGASTGVLDSPLISLLFWILICFSIAALFTKRYSIRPLIVALILRSIYYLGIGPTLNILGALNLTNKIVFVVSFVGNRGTFIRGYKAMVMDMEFLYHVGYILTSVLGLFAHELFYSILLFDLIYREETLFNVIKSVTRNGRSILLTALLALILVYLFSIVGFLFLKDDFILEVDRLPNNHSTASPLGMPHGAAAFVDTCSGDKMDCVSGLSVPEVLEEDRELDSTERACDTLLMCIVTVMNHGLRNGGGVGDILRKPSKDESLFPARVVYDLLFFFIVIIIVLNLIFGVIIDTFADLRSEKQKKEEILKTTCFICGLERDKFDNKTVSFEEHIKLEHNMWNYLYFIVLVRVKNKTDYTGPESYVAQMIKNKNLDWFPRMRAMSLVSNEGEGEQNEIRILQDKLNSTMKLVSHLTAQLNELKEQMTEQRKRRQRLGFVDVQNCISR

SEQ ID NO: 40344 - protein, 2671 aa, Homo sapiens; identical to SEQ ID NO: 40343
  Payload ID: 8216
  Gene Symbol: ITPR3
  Gene Name: inositol 1,4,5-trisphosphate receptor, type 3
  Uniprot ID: Q14573
  ENSP ID: ENSP00000475177

SEQ ID NO: 40345 - protein, 441 aa, Homo sapiens
  Payload ID: 8217
  Gene Symbol: IP6K1
  Gene Name: inositol hexakisphosphate kinase 1
  Uniprot ID: Q92551
  ENSP ID: ENSP00000323780
MCVCQTMEVGQYGKNASRAGDRGVLLEPFIHQVGGHSSMMRYDDHTVCKPLISREQRFYESLPPEMKEFTPEYKGVVSVCFEGDSDGYINLVAYPYVESETVEQDDTTEREQPRRKHSRRSLHRSGSGSDHKEEKASLSLETSESSQEAKSPKVELHSHSEVPFQMLDGNSGLSSEKISHNPWSLRCHKQQLSRMRSESKDRKLYKFLLLENVVHHFKYPCVLDLKMGTRQHGDDASAEKAARQMRKCEQSTSATLGVRVCGMQVYQLDTGHYLCRNKYYGRGLSIEGFRNALYQYLHNGLDLRRDLFEPILSKLRGLKAVLERQASYRFYSSSLLVIYDGKECRAESCLDRRSEMRLKHLDMVLPEVASSCGPSTSPSNTSPEAGPSSQPKVDVRMIDFAHSTFKGFRDDPTVHDGPDRGYVFGLENLISIMEQMRDENQ

SEQ ID NO: 40346 - protein, 276 aa, Homo sapiens
  Payload ID: 8217
  Gene Symbol: IP6K1
  Gene Name: inositol hexakisphosphate kinase 1
  Uniprot ID: Q92551
  ENSP ID: ENSP00000378659
MLDGNSGLSSEKISHNPWSLRCHKQQLSRMRSESKDRKLYKFLLLENVVHHFKYPCVLDLKMGTRQHGDDASAEKAARQMRKCEQSTSATLGVRVCGMQVYQLDTGHYLCRNKYYGRGLSIEGFRNALYQYLHNGLDLRRDLFEPILSKLRGLKAVLERQASYRFYSSSLLVIYDGKECRAESCLDRRSEMRLKHLDMVLPEVASSCGPSTSPSNTSPEAGPSSQPKVDVRMIDFAHSTFKGFRDDPTVHDGPDRGYVFGLENLISIMEQMRDENQ

SEQ ID NO: 40347 - protein, 274 aa, Homo sapiens
  Payload ID: 8217
  Gene Symbol: IP6K1
  Gene Name: inositol hexakisphosphate kinase 1
  ENSP ID: ENSP00000420467
MCVCQTMEVGQYGKNASRAGDRGVLLEPFIHQVGGHSSMMRYDDHTVCKPLISREQRFYESLPPEMKEFTPEYKGVVSVCFEGDSDGYINLVAYPYVESETVEQDDTTEREQPRRKHSRRSLHRSGSGSDHKEEKASLSLETSESSQEAKSPKVELHSHSEVPFQMLDGNSGLSSEKISHNPWSLRCHKQQLSRMRSESKDRKLYKFLLLENVVHHFKYPCVLDLKMGTRQHGDDASAEKAARQMRKCEQSTSATLGVRVCGMQEQVLWPWALH

SEQ ID NO: 40348 - protein, 276 aa, Homo sapiens; identical to SEQ ID NO: 40346
  Payload ID: 8217
  Gene Symbol: IP6K1
  Gene Name: inositol hexakisphosphate kinase 1
  Uniprot ID: Q92551
  ENSP ID: ENSP00000420762

SEQ ID NO: 40349 - protein, 441 aa, Homo sapiens; identical to SEQ ID NO: 40345
  Payload ID: 8217
  Gene Symbol: IP6K1
  Gene Name: inositol hexakisphosphate kinase 1
  Uniprot ID: Q92551
  ENSP ID: ENSP00000482032

SEQ ID NO: 40350 - protein, 426 aa, Homo sapiens
  Payload ID: 8218
  Gene Symbol: IP6K2
  Gene Name: inositol hexakisphosphate kinase 2
  Uniprot ID: Q9UHH9
  ENSP ID: ENSP00000331103
MSPAFRAMDVEPRAKGVLLEPFVHQVGGHSCVLRFNETTLCKPLVPREHQFYETLPAEMRKFTPQYKGVVSVRFEEDEDRNLCLIAYPLKGDHGIVDIVDNSDCEPKSKLLRWTTNKKHHVLETEKTPKDWVRQHRKEEKMKSHKLEEEFEWLKKSEVLYYTVEKKGNISSQLKHYNPWSMKCHQQQLQRMKENAKHRNQYKFILLENLTSRYEVPCVLDLKMGTRQHGDDASEEKAANQIRKCQQSTSAVIGVRVCGMQVYQAGSGQLMFMNKYHGRKLSVQGFKEALFQFFHNGRYLRRELLGPVLKKLTELKAVLERQESYRFYSSSLLVIYDGKERPEVVLDSDAEDLEDLSEESADESAGAYAYKPIGASSVDVRMIDFAHTTCRLYGEDTVVHEGQDAGYIFGLQSLIDIVTEISEESGE

SEQ ID NO: 40351 - protein, 97 aa, Homo sapiens
  Payload ID: 8218
  Gene Symbol: IP6K2
  Gene Name: inositol hexakisphosphate kinase 2
  Uniprot ID: Q9UHH9
  ENSP ID: ENSP00000341925
MSPAFRAMDVEPRAKGVLLEPFVHQVGGHSCVLRFNETTLCKPLVPREHQFYETLPAEMRKFTPQYKGQSQRPLVSWPSLPHFFPWSFPLWPQGSVA

SEQ ID NO: 40352 - protein, 130 aa, Homo sapiens
  Payload ID: 8218
  Gene Symbol: IP6K2
  Gene Name: inositol hexakisphosphate kinase 2
  ENSP ID: ENSP00000387394
MSPAFRAMDVEPRAKGVLLEPFVHQVGGHSCVLRFNETTLCKPLVPREHQFYETLPAEMRKFTPQYKGKSQLLEGLPHWRGDVRDRGHGRPWQPSLEPSLPPTLCFPSLSSFSSSWPSAQHLTPSVFNPW

SEQ ID NO: 40353 - protein, 70 aa, Homo sapiens
  Payload ID: 8218
  Gene Symbol: IP6K2
  Gene Name: inositol hexakisphosphate kinase 2
  Uniprot ID: Q9UHH9
  ENSP ID: ENSP00000387759
MSPAFRAMDVEPRAKGVLLEPFVHQVGGHSCVLRFNETTLCKPLVPREHQFYETLPAEMRKFTPQYKGVS

SEQ ID NO: 40354 - protein, 130 aa, Homo sapiens; identical to SEQ ID NO: 40352
  Payload ID: 8218
  Gene Symbol: IP6K2
  Gene Name: inositol hexakisphosphate kinase 2
  ENSP ID: ENSP00000388116

SEQ ID NO: 40355 - protein, 54 aa, Homo sapiens
  Payload ID: 8218
  Gene Symbol: IP6K2
  Gene Name: inositol hexakisphosphate kinase 2
  ENSP ID: ENSP00000388420
MSPAFRAMDVEPRAKGVLLEPFVHQVGGHSCVLRFNETTLCKPLVPREHQFYET

SEQ ID NO: 40356 - protein, 128 aa, Homo sapiens
  Payload ID: 8218
  Gene Symbol: IP6K2
  Gene Name: inositol hexakisphosphate kinase 2
  ENSP ID: ENSP00000389755
MNLCQSPFQEGCQSLLASWPEQAKEPRREGHTDKQQTEDVLAAGLRCLPHLPAICARRMSPAFRAMDVEPRAKGVLLEPFVHQVGGHSCVLRFNETTLCKPLVPREHQFYETLPAEMRKFTPQYKGVS

SEQ ID NO: 40357 - protein, 100 aa, Homo sapiens
  Payload ID: 8218
  Gene Symbol: IP6K2
  Gene Name: inositol hexakisphosphate kinase 2
  ENSP ID: ENSP00000389761
MSPAFRAMDVEPRAKGVLLEPFVHQVGGHSCVLRFNETTLCKPLVPREHQFYETLPAEMRKFTPQYKGVVSVRFEEDEDRNLCLIAYPLKGDHGIVDIVD

SEQ ID NO: 40358 - protein, 130 aa, Homo sapiens; identical to SEQ ID NO: 40352
  Payload ID: 8218
  Gene Symbol: IP6K2
  Gene Name: inositol hexakisphosphate kinase 2
  ENSP ID: ENSP00000393077

SEQ ID NO: 40359 - protein, 54 aa, Homo sapiens; identical to SEQ ID NO: 40355
  Payload ID: 8218
  Gene Symbol: IP6K2
  Gene Name: inositol hexakisphosphate kinase 2
  ENSP ID: ENSP00000393797

SEQ ID NO: 40360 - protein, 151 aa, Homo sapiens
  Payload ID: 8218
  Gene Symbol: IP6K2
  Gene Name: inositol hexakisphosphate kinase 2
  ENSP ID: ENSP00000394488
MSLNLPEASLLRASWPEQAKEPRREGHTDKQQTEDVLAAGLRCLPHLPAICARRMSPAFRAMDVEPRAKGVLLEPFVHQVGGHSCVLRFNETTLCKPLVPREHQFYETLPAEMRKFTPQYKGQSQRPLVSWPSLPHFFPWSFPLWPQGSVA

SEQ ID NO: 40361 - protein, 87 aa, Homo sapiens
  Payload ID: 8218
  Gene Symbol: IP6K2
  Gene Name: inositol hexakisphosphate kinase 2
  ENSP ID: ENSP00000395819
MSPAFRAMDVEPRAKGVLLEPFVHQVGGHSCVLRFNETTLCKPLVPREHQFYETLPAEMRKFTPQYKGVVSVRFEEDEDRNLCLIAY

SEQ ID NO: 40362 - protein, 97 aa, Homo sapiens; identical to SEQ ID NO: 40351
  Payload ID: 8218
  Gene Symbol: IP6K2
  Gene Name: inositol hexakisphosphate kinase 2
  Uniprot ID: Q9UHH9
  ENSP ID: ENSP00000396203

SEQ ID NO: 40363 - protein, 130 aa, Homo sapiens; identical to SEQ ID NO: 40352
  Payload ID: 8218
  Gene Symbol: IP6K2
  Gene Name: inositol hexakisphosphate kinase 2
  ENSP ID: ENSP00000396904

SEQ ID NO: 40364 - protein, 188 aa, Homo sapiens
  Payload ID: 8218
  Gene Symbol: IP6K2
  Gene Name: inositol hexakisphosphate kinase 2
  Uniprot ID: Q9UHH9
  ENSP ID: ENSP00000399052
MNLCQSPFQEGCQSLLASWPEQAKEPRREGHTDKQQTEDVLAAGLRCLPHLPAICARRMSPAFRAMDVEPRAKGVLLEPFVHQVGGHSCVLRFNETTLCKPLVPREHQFYETLPAEMRKFTPQYKGKSQLLEGLPHWRGDVRDRGHGRPWQPSLEPSLPPTLCFPSLSSFSSSWPSAQHLTPSVFNPW

SEQ ID NO: 40365 - protein, 87 aa, Homo sapiens
  Payload ID: 8218
  Gene Symbol: IP6K2
  Gene Name: inositol hexakisphosphate kinase 2
  Uniprot ID: Q9UHH9
  ENSP ID: ENSP00000400812
MSPAFRAMDVEPRAKGVLLEPFVHQVGGHSCVLRFNETTLCKPLVPREHQFYETLPAEMRKFTPQYKGDISSHQHGGVFVGEWGSLL

SEQ ID NO: 40366 - protein, 91 aa, Homo sapiens
  Payload ID: 8218
  Gene Symbol: IP6K2
  Gene Name: inositol hexakisphosphate kinase 2
  ENSP ID: ENSP00000403968
MSPAFRAMDVEPRAKGVLLEPFVHQVGGHSCVLRFNETTLCKPLVPREHQFYETLPAEMRKFTPQYKGVVSVRFEEDEDRNLCLIAYPLKG

SEQ ID NO: 40367 - protein, 95 aa, Homo sapiens
  Payload ID: 8218
  Gene Symbol: IP6K2
  Gene Name: inositol hexakisphosphate kinase 2
  ENSP ID: ENSP00000406357
MSLNLPEASLLRASWPEQAKEPRREGHTDKQQTEDVLAAGLRCLPHLPAICARRMSPAFRAMDVEPRAKGVLLEPFVHQVGGHSCVLRFNETTLC

SEQ ID NO: 40368 - protein, 148 aa, Homo sapiens
  Payload ID: 8218
  Gene Symbol: IP6K2
  Gene Name: inositol hexakisphosphate kinase 2
  ENSP ID: ENSP00000410454
MNLCQSPFQEGCQSLLASWPEQAKEPRREGHTDKQQTEDVLAAGLRCLPHLPAICARRMSPAFRAMDVEPRAKGVLLEPFVHQVGGHSCVLRFNETTLCKPLVPREHQFYETLPAEMRKFTPQYKGQSQRPLVSWPSLPHFFPWSFPL

SEQ ID NO: 40369 - protein, 189 aa, Homo sapiens
  Payload ID: 8218
  Gene Symbol: IP6K2
  Gene Name: inositol hexakisphosphate kinase 2
  ENSP ID: ENSP00000410950
MNLCQSPFQEGCQSLLRASWPEQAKEPRREGHTDKQQTEDVLAAGLRCLPHLPAICARRMSPAFRAMDVEPRAKGVLLEPFVHQVGGHSCVLRFNETTLCKPLVPREHQFYETLPAEMRKFTPQYKGKSQLLEGLPHWRGDVRDRGHGRPWQPSLEPSLPPTLCFPSLSSFSSSWPSAQHLTPSVFNPW

SEQ ID NO: 40370 - protein, 130 aa, Homo sapiens
  Payload ID: 8218
  Gene Symbol: IP6K2
  Gene Name: inositol hexakisphosphate kinase 2
  ENSP ID: ENSP00000411776
MSPAFRAMDVEPRAKGVLLEPFVHQVGGHSCVLRFNETTLCKPLVPREHQFYETLPAEMRKFTPQYKAVLIFVKFADEFGASGNIETKELGVVSVRFEEDEDRNLCLIAYPLKGDHGIVDIVDNSDCEPK

SEQ ID NO: 40371 - protein, 140 aa, Homo sapiens
  Payload ID: 8218
  Gene Symbol: IP6K2
  Gene Name: inositol hexakisphosphate kinase 2
  ENSP ID: ENSP00000412121
MSLNLPEASLLRASWPEQAKEPRREGHTDKQQTEDVLAAGLRCLPHLPAICARRMSPAFRAMDVEPRAKGVLLEPFVHQVGGHSCVLRFNETTLCKPLVPREHQFYETLPAEMRKFTPQYKGVVSVRFEEDEDRNLCLIA

SEQ ID NO: 40372 - protein, 185 aa, Homo sapiens
  Payload ID: 8218
  Gene Symbol: IP6K2
  Gene Name: inositol hexakisphosphate kinase 2
  Uniprot ID: Q9UHH9
  ENSP ID: ENSP00000414139
MSLNLPEASLLSRASWPEQAKEPRREGHTDKQQTEDVLAAGLRCLPHLPAICARRMSPAFRAMDVEPRAKGVLLEPFVHQVGGHSCVLRFNETTLCKPLVPREHQFYETLPAEMRKFTPQYKGKSQLLEGLPHWRGDVRDRGHGRPWQPSLEPSLPPTLCFPSLSSFSSSWPSAQHLTPSVFNPW

SEQ ID NO: 40373 - protein, 104 aa, Homo sapiens
  Payload ID: 8218
  Gene Symbol: IP6K2
  Gene Name: inositol hexakisphosphate kinase 2
  ENSP ID: ENSP00000414428
MSPAFRAMDVEPRAKGVLLEPFVHQVGGHSCVLRFNETTLCKPLVPREHQFYETLPAEMRKFTPQYKGVVSVRFEEDEDRNLCLIAYPLKGDHGIVDIVDNSDC

SEQ ID NO: 40374 - protein, 410 aa, Homo sapiens
  Payload ID: 8219
  Gene Symbol: IP6K3
  Gene Name: inositol hexakisphosphate kinase 3
  Uniprot ID: Q96PC2
  ENSP ID: ENSP00000293756
MVVQNSADAGDMRAGVQLEPFLHQVGGHMSVMKYDEHTVCKPLVSREQRFYESLPLAMKRFTPQYKGTVTVHLWKDSTGHLSLVANPVKESQEPFKVSTESAAVAIWQTLQQTTGSNGSDCTLAQWPHAQLARSPKESPAKALLRSEPHLNTPAFSLVEDTNGNQVERKSFNPWGLQCHQAHLTRLCSEYPENKRHRFLLLENVVSQYTHPCVLDLKMGTRQHGDDASEEKKARHMRKCAQSTSACLGVRICGMQVYQTDKKYFLCKDKYYGRKLSVEGFRQALYQFLHNGSHLRRELLEPILHQLRALLSVIRSQSSYRFYSSSLLVIYDGQEPPERAPGSPHPHEAPQAAHGSSPGGLTKVDIRMIDFAHTTYKGYWNEHTTYDGPDPGYIFGLENLIRILQDIQEGE

SEQ ID NO: 40375 - protein, 410 aa, Homo sapiens; identical to SEQ ID NO: 40374
  Payload ID: 8219
  Gene Symbol: IP6K3
  Gene Name: inositol hexakisphosphate kinase 3
  Uniprot ID: Q96PC2
  ENSP ID: ENSP00000398861

SEQ ID NO: 40376 - protein, 76 aa, Homo sapiens
  Payload ID: 8219
  Gene Symbol: IP6K3
  Gene Name: inositol hexakisphosphate kinase 3
  ENSP ID: ENSP00000489479
MVVQNSADAGDMRAGVQLEPFLHQVGGHMSVMKYDEHTVCKPLVSREQRFYESLPLAMKRFTPQYKGTVTVHLWKD

SEQ ID NO: 40377 - protein, 359 aa, Homo sapiens
  Payload ID: 8220
  Gene Symbol: IMPAD1
  Gene Name: inositol monophosphatase domain containing 1
  Uniprot ID: Q9NX62
  ENSP ID: ENSP00000262644
MAPMGIRLSPLGVAVFCLLGLGVLYHLYSGFLAGRFSLFGLGGEPGGGAAGPAAAADGGTVDLREMLAVSVLAAVRGGDEVRRVRESNVLHEKSKGKTREGAEDKMTSGDVLSNRKMFYLLKTAFPSVQINTEEHVDAADQEVILWDHKIPEDILKEVTTPKEVPAESVTVWIDPLDATQEYTEDLRKYVTTMVCVAVNGKPMLGVIHKPFSEYTAWAMVDGGSNVKARSSYNEKTPRIVVSRSHSGMVKQVALQTFGNQTTIIPAGGAGYKVLALLDVPDKSQEKADLYIHVTYIKKWDICAGNAILKALGGHMTTLSGEEISYTGSDGIEGGLLASIRMNHQALVRKLPDLEKTGHK

SEQ ID NO: 40378 - protein, 82 aa, Homo sapiens
  Payload ID: 8220
  Gene Symbol: IMPAD1
  Gene Name: inositol monophosphatase domain containing 1
  ENSP ID: ENSP00000428617
  MOD_RES (1)..(1): Any amino acid
XTTPKEVPAESVTVWIDPLDATQEYTEDLRKYVTTMVCVAVNGKPMLGVIHKPFSEYTARNKLVMQLVSLLAMVDYILPCSE

SEQ ID NO: 40379 - protein, 82 aa, Homo sapiens
  Payload ID: 8220
  Gene Symbol: IMPAD1
  Gene Name: inositol monophosphatase domain containing 1
  ENSP ID: ENSP00000430185
RGGDEVRRVRESNVLHEKSKGKTREGAEDKMTSGDVLSNRKMFYLLKTAFPSVQINTEEHVDAADQEAGAGESLEPERWRLQ

SEQ ID NO: 40380 - protein, 416 aa, Homo sapiens
  Payload ID: 8221
  Gene Symbol: IPMK
  Gene Name: inositol polyphosphate multikinase
  Uniprot ID: Q8NFU5
  ENSP ID: ENSP00000363046
MATEPPSPLRVEAPGPPEMRTSPAIESTPEGTPQPAGGRLRFLNGCVPLSHQVAGHMYGKDKVGILQHPDGTVLKQLQPPPRGPRELEFYNMVYAADCFDGVLLELRKYLPKYYGIWSPPTAPNDLYLKLEDVTHKFNKPCIMDVKIGQKSYDPFASSEKIQQQVSKYPLMEEIGFLVLGMRVYHVHSDSYETENQHYGRSLTKETIKDGVSRFFHNGYCLRKDAVAASIQKIEKILQWFENQKQLNFYASSLLFVYEGSSQPTTTKLNDRTLAEKFLSKGQLSDTEVLEYNNNFHVLSSTANGKIESSVGKSLSKMYARHRKIYTKKHHSQTSLKVENLEQDNGWKSMSQEHLNGNVLSQLEKVFYHLPTGCQEIAEVEVRMIDFAHVFPSNTIDEGYVYGLKHLISVLRSILDN

SEQ ID NO: 40381 - protein, 1258 aa, Homo sapiens
  Payload ID: 8222
  Gene Symbol: INPPL1
  Gene Name: inositol polyphosphate phosphatase-like 1
  Uniprot ID: O15357
  ENSP ID: ENSP00000298229
MASACGAPGPGGALGSQAPSWYHRDLSRAAAEELLARAGRDGSFLVRDSESVAGAFALCVLYQKHVHTYRILPDGEDFLAVQTSQGVPVRRFQTLGELIGLYAQPNQGLVCALLLPVEGEREPDPPDDRDASDGEDEKPPLPPRSGSTSISAPTGPSSPLPAPETPTAPAAESAPNGLSTVSHDYLKGSYGLDLEAVRGGASHLPHLTRTLATSCRRLHSEVDKVLSGLEILSKVFDQQSSPMVTRLLQQQNLPQTGEQELESLVLKLSVLKDFLSGIQKKALKALQDMSSTAPPAPQPSTRKAKTIPVQAFEVKLDVTLGDLTKIGKSQKFTLSVDVEGGRLVLLRRQRDSQEDWTTFTHDRIRQLIKSQRVQNKLGVVFEKEKDRTQRKDFIFVSARKREAFCQLLQLMKNKHSKQDEPDMISVFIGTWNMGSVPPPKNVTSWFTSKGLGKTLDEVTVTIPHDIYVFGTQENSVGDREWLDLLRGGLKELTDLDYRPIAMQSLWNIKVAVLVKPEHENRISHVSTSSVKTGIANTLGNKGAVGVSFMFNGTSFGFVNCHLTSGNEKTARRNQNYLDILRLLSLGDRQLNAFDISLRFTHLFWFGDLNYRLDMDIQEILNYISRKEFEPLLRVDQLNLEREKHKVFLRFSEEEISFPPTYRYERGSRDTYAWHKQKPTGVRTNVPSWCDRILWKSYPETHIICNSYGCTDDIVTSDHSPVFGTFEVGVTSQFISKKGLSKTSDQAYIEFESIEAIVKTASRTKFFIEFYSTCLEEYKKSFENDAQSSDNINFLKVQWSSRQLPTLKPILADIEYLQDQHLLLTVKSMDGYESYGECVVALKSMIGSTAQQFLTFLSHRGEETGNIRGSMKVRVPTERLGTRERLYEWISIDKDEAGAKSKAPSVSRGSQEPRSGSRKPAFTEASCPLSRLFEEPEKPPPTGRPPAPPRAAPREEPLTPRLKPEGAPEPEGVAAPPPKNSFNNPAYYVLEGVPHQLLPPEPPSPARAPVPSATKNKVAITVPAPQLGHHRHPRVGEGSSSDEESGGTLPPPDFPPPPLPDSAIFLPPSLDPLPGPVVRGRGGAEARGPPPPKAHPRPPLPPGPSPASTFLGEVASGDDRSCSVLQMAKTLSEVDYAPAGPARSALLPGPLELQPPRGLPSDYGRPLSFPPPRIRESIQEDLAEEAPCLQGGRASGLGEAGMSAWLRAIGLERYEEGLVHNGWDDLEFLSDITEEDLEEAGVQDPAHKRLLLDTLQLSK

SEQ ID NO: 40382 - protein, 149 aa, Homo sapiens
  Payload ID: 8222
  Gene Symbol: INPPL1
  Gene Name: inositol polyphosphate phosphatase-like 1
  ENSP ID: ENSP00000321775
  MOD_RES (1)..(1): Any amino acid
XPARSALLPGPLELQPPRGLPSDYGRPLSFPPPRIRESIQEDLAEEAPCLQGGRASGLGEAGMSAWLRAIGLERYEEGLVHNGWDDLEFLRWGRGWPRGRSWGPQDPLAHLTSQPVLLHSDITEEDLEEAGVQDPAHKRLLLDTLQLSK

SEQ ID NO: 40383 - protein, 41 aa, Homo sapiens
  Payload ID: 8222
  Gene Symbol: INPPL1
  Gene Name: inositol polyphosphate phosphatase-like 1
  ENSP ID: ENSP00000437852
  MOD_RES (1)..(1): Any amino acid
XTIPPCLGHLRLELPPSSSPRKGSQRLQTRPTLSLRASRPL

SEQ ID NO: 40384 - protein, 127 aa, Homo sapiens
  Payload ID: 8222
  Gene Symbol: INPPL1
  Gene Name: inositol polyphosphate phosphatase-like 1
  ENSP ID: ENSP00000440018
MVTRLLQQQALKALQDMSSTAPPAPQPSTRKAKTIPVQAFEVKLDVTLGDLTKIGKSQKFTLSVDVEGGRLVLLRRQRDSQEDWTTFTHDRIRQLIKSQRVQNKLGVVFEKEKDRTQRKDFIFVSAR

SEQ ID NO: 40385 - protein, 17 aa, Homo sapiens
  Payload ID: 8222
  Gene Symbol: INPPL1
  Gene Name: inositol polyphosphate phosphatase-like 1
  ENSP ID: ENSP00000440512
MASACGAPGPGGALGSQ

SEQ ID NO: 40386 - protein, 22 aa, Homo sapiens
  Payload ID: 8222
  Gene Symbol: INPPL1
  Gene Name: inositol polyphosphate phosphatase-like 1
  ENSP ID: ENSP00000440904
MASACGAPGPGGALGSQAPSWY

SEQ ID NO: 40387 - protein, 197 aa, Homo sapiens
  Payload ID: 8222
  Gene Symbol: INPPL1
  Gene Name: inositol polyphosphate phosphatase-like 1
  ENSP ID: ENSP00000441094
VLEGVPHQLLPPEPPSPARAPVPSATKNKVAITVPAPQLGHHRHPRVGEGSSSDEESGGTLPPPDFPPPPLPDSAIFLPPSLDPLPGPVVRGRGGAEARGPPPPKAHPRPPLPPGPSPASTFLGEVASGDDRSCSVLQMAKTLSEVDYAPAGPARSALLPGPLELQPPRGLPSDYGRPLSFPPPRIRESIQEDLAEE

SEQ ID NO: 40388 - protein, 1016 aa, Homo sapiens
  Payload ID: 8222
  Gene Symbol: INPPL1
  Gene Name: inositol polyphosphate phosphatase-like 1
  Uniprot ID: O15357
  ENSP ID: ENSP00000444619
MVTRLLQQQNLPQTGEQELESLVLKLSVLKDFLSGIQKKALKALQDMSSTAPPAPQPSTRKAKTIPVQAFEVKLDVTLGDLTKIGKSQKFTLSVDVEGGRLVLLRRQRDSQEDWTTFTHDRIRQLIKSQRVQNKLGVVFEKEKDRTQRKDFIFVSARKREAFCQLLQLMKNKHSKQDEPDMISVFIGTWNMGSVPPPKNVTSWFTSKGLGKTLDEVTVTIPHDIYVFGTQENSVGDREWLDLLRGGLKELTDLDYRPIAMQSLWNIKVAVLVKPEHENRISHVSTSSVKTGIANTLGNKGAVGVSFMFNGTSFGFVNCHLTSGNEKTARRNQNYLDILRLLSLGDRQLNAFDISLRFTHLFWFGDLNYRLDMDIQEILNYISRKEFEPLLRVDQLNLEREKHKVFLRFSEEEISFPPTYRYERGSRDTYAWHKQKPTGVRTNVPSWCDRILWKSYPETHIICNSYGCTDDIVTSDHSPVFGTFEVGVTSQFISKKGLSKTSDQAYIEFESIEAIVKTASRTKFFIEFYSTCLEEYKKSFENDAQSSDNINFLKVQWSSRQLPTLKPILADIEYLQDQHLLLTVKSMDGYESYGECVVALKSMIGSTAQQFLTFLSHRGEETGNIRGSMKVRVPTERLGTRERLYEWISIDKDEAGAKSKAPSVSRGSQEPRSGSRKPAFTEASCPLSRLFEEPEKPPPTGRPPAPPRAAPREEPLTPRLKPEGAPEPEGVAAPPPKNSFNNPAYYVLEGVPHQLLPPEPPSPARAPVPSATKNKVAITVPAPQLGHHRHPRVGEGSSSDEESGGTLPPPDFPPPPLPDSAIFLPPSLDPLPGPVVRGRGGAEARGPPPPKAHPRPPLPPGPSPASTFLGEVASGDDRSCSVLQMAKTLSEVDYAPAGPARSALLPGPLELQPPRGLPSDYGRPLSFPPPRIRESIQEDLAEEAPCLQGGRASGLGEAGMSAWLRAIGLERYEEGLVHNGWDDLEFLSDITEEDLEEAGVQDPAHKRLLLDTLQLSK

SEQ ID NO: 40389 - protein, 33 aa, Homo sapiens
  Payload ID: 8222
  Gene Symbol: INPPL1
  Gene Name: inositol polyphosphate phosphatase-like 1
  ENSP ID: ENSP00000444630
MVTRLLQQQNLPQTGEQELESLVLKLSVLKDFL

SEQ ID NO: 40390 - protein, 1146 aa, Homo sapiens
  Payload ID: 8222
  Gene Symbol: INPPL1
  Gene Name: inositol polyphosphate phosphatase-like 1
  ENSP ID: ENSP00000446360
MCTRIAFCLMEKISWLCRPRRVCLCAASRPWVSSSACTPSPTRALCAPCFFLRVSESRTHRMTGMPQMGRMRSPRCPRALAPPAFLPTGPSSPLPAPETPTAPAAESAPNGLSTVSHDYLKGSYGLDLEAVRGGASHLPHLTRTLATSCRRLHSEVDKVLSGLEILSKVFDQQSSPMVTRLLQQQNLPQTGEQELESLVLKLSVLKDFLSGIQKKALKALQDMSSTAPPAPQPSTRKAKTIPVQAFEVKLDVTLGDLTKIGKSQKFTLSVDVEGGRLVLLRRQRDSQEDWTTFTHDRIRQLIKSQRVQNKLGVVFEKEKDRTQRKDFIFVSARKREAFCQLLQLMKNKHSKQDEPDMISVFIGTWNMGSVPPPKNVTSWFTSKGLGKTLDEVTVTIPHDIYVFGTQENSVGDREWLDLLRGGLKELTDLDYRPIAMQSLWNIKVAVLVKPEHENRISHVSTSSVKTGIANTLGNKGAVGVSFMFNGTSFGFVNCHLTSGNEKTARRNQNYLDILRLLSLGDRQLNAFDISLRFTHLFWFGDLNYRLDMDIQEILNYISRKEFEPLLRVDQLNLEREKHKVFLRFSEEEISFPPTYRYERGSRDTYAWHKQKPTGVRTNVPSWCDRILWKSYPETHIICNSYGCTDDIVTSDHSPVFGTFEVGVTSQFISKKGLSKTSDQAYIEFESIEAIVKTASRTKFFIEFYSTCLEEYKKSFENDAQSSDNINFLKVQWSSRQLPTLKPILADIEYLQDQHLLLTVKSMDGYESYGECVVALKSMIGSTAQQFLTFLSHRGEETGNIRGSMKVRVPTERLGTRERLYEWISIDKDEAGAKSKAPSVSRGSQEPRSGSRKPAFTEASCPLSRLFEEPEKPPPTGRPPAPPRAAPREEPLTPRLKPEGAPEPEGVAAPPPKNSFNNPAYYVLEGVPHQLLPPEPPSPARAPVPSATKNKVAITVPAPQLGHHRHPRVGEGSSSDEESGGTLPPPDFPPPPLPDSAIFLPPSLDPLPGPVVRGRGGAEARGPPPPKAHPRPPLPPGPSPASTFLGEVASGDDRSCSVLQMAKTLSEVDYAPAGPARSALLPGPLELQPPGTALGLWPAPQLPSTPHPGEHPGRPGRGGSVPAGRAGQRAGRGRHECLAAGHRLGAL

SEQ ID NO: 40391 - protein, 399 aa, Homo sapiens
  Payload ID: 8223
  Gene Symbol: INPP1
  Gene Name: inositol polyphosphate-1-phosphatase
  Uniprot ID: P49441
  ENSP ID: ENSP00000325423
MSDILRELLCVSEKAANIARACRQQEALFQLLIEEKKEGEKNKKFAVDFKTLADVLVQEVIKQNMENKFPGLEKNIFGEESNEFTNDWGEKITLRLCSTEEETAELLSKVLNGNKVASEALARVVHQDVAFTDPTLDSTEINVPQDILGIWVDPIDSTYQYIKGSADIKSNQGIFPCGLQCVTILIGVYDIQTGVPLMGVINQPFVSRDPNTLRWKGQCYWGLSYMGTNMHSLQLTISRRNGSETHTGNTGSEAAFSPSFSAVISTSEKETIKAALSRVCGDRIFGAAGAGYKSLCVVQGLVDIYIFSEDTTFKWDSCAAHAILRAMGGGIVDLKECLERNPETGLDLPQLVYHVENEGAAGVDRWANKGGLIAYRSRKRLETFLSLLVQNLAPAETHT

SEQ ID NO: 40392 - protein, 399 aa, Homo sapiens; identical to SEQ ID NO: 40391
  Payload ID: 8223
  Gene Symbol: INPP1
  Gene Name: inositol polyphosphate-1-phosphatase
  Uniprot ID: P49441
  ENSP ID: ENSP00000376142

SEQ ID NO: 40393 - protein, 155 aa, Homo sapiens
  Payload ID: 8223
  Gene Symbol: INPP1
  Gene Name: inositol polyphosphate-1-phosphatase
  ENSP ID: ENSP00000387079
MSDILRELLCVSEKAANIARACRQQEALFQLLIEEKKEGEKNKKFAVDFKTLADVLVQEVIKQNMENKFPGLEKNIFGEESNEFTNDWGEKITLRLCSTEEETAELLSKVLNGNKVASEALARVVHQDVAFTDPTLDSTEINVPQDILGIWVDPI

SEQ ID NO: 40394 - protein, 88 aa, Homo sapiens
  Payload ID: 8223
  Gene Symbol: INPP1
  Gene Name: inositol polyphosphate-1-phosphatase
  ENSP ID: ENSP00000391415
MSDILRELLCVSEKAANIARACRQQEALFQLLIEEKKEGEKNKKFAVDFKTLADVLVQEVIKQNMENKFPGLEKNIFGEESNEFTNDW

SEQ ID NO: 40395 - protein, 143 aa, Homo sapiens
  Payload ID: 8223
  Gene Symbol: INPP1
  Gene Name: inositol polyphosphate-1-phosphatase
  ENSP ID: ENSP00000392814
MSDILRELLCVSEKAANIARACRQQEALFQLLIEEKKEGEKNKKFAVDFKTLADVLVQEVIKQNMENKFPGLEKNIFGEESNEFTNDWGEKITLRLCSTEEETAELLSKVLNGNKVASEALARVVHQDVAFTDPTLDSTEINV

SEQ ID NO: 40396 - protein, 212 aa, Homo sapiens
  Payload ID: 8223
  Gene Symbol: INPP1
  Gene Name: inositol polyphosphate-1-phosphatase
  ENSP ID: ENSP00000395424
MSDILRELLCVSEKAANIARACRQQEALFQLLIEEKKEGEKNKKFAVDFKTLADVLVQEVIKQNMENKFPGLEKNIFGEESNEFTNDWGEKITLRLCSTEEETAELLSKVLNGNKVASEALARVVHQDVAFTDPTLDSTEINVPQDILGIWVDPIDSTYQYIKGSADIKSNQGIFPCGLQCVTILIGVYDIQTGVPLMGVINQPFVSRDPNT

SEQ ID NO: 40397 - protein, 190 aa, Homo sapiens
  Payload ID: 8223
  Gene Symbol: INPP1
  Gene Name: inositol polyphosphate-1-phosphatase
  ENSP ID: ENSP00000404732
MSDILRELLCVSEKAANIARACRQQEALFQLLIEEKKEGEKNKKFAVDFKTLADVLVQEVIKQNMENKFPGLEKNIFGEESNEFTNDWGEKITLRLCSTEEETAELLSKVLNGNKVASEALARVVHQDVAFTDPTLDSTEINVPQDILGIWVDPIDSTYQYIKGSADIKSNQGIFPCGLQCVTILIGVYD

SEQ ID NO: 40398 - protein, 213 aa, Homo sapiens
  Payload ID: 8223
  Gene Symbol: INPP1
  Gene Name: inositol polyphosphate-1-phosphatase
  ENSP ID: ENSP00000409786
MSDILRELLCVSEKAANIARACRQQEALFQLLIEEKKEGEKNKKFAVDFKTLADVLVQEVIKQNMENKFPGLEKNIFGEESNEFTNDWGEKITLRLCSTEEETAELLSKVLNGNKVASEALARVVHQDVAFTDPTLDSTEINVPQDILGIWVDPIDSTYQYIKGSADIKSNQGIFPCGLQCVTILIGVYDIQTGVPLMGVINQPFVSRDPNTL

SEQ ID NO: 40399 - protein, 30 aa, Homo sapiens
  Payload ID: 8223
  Gene Symbol: INPP1
  Gene Name: inositol polyphosphate-1-phosphatase
  ENSP ID: ENSP00000410662
MSDILRELLCVSEKAANIARACRQQEALFQ

SEQ ID NO: 40400 - protein, 68 aa, Homo sapiens
  Payload ID: 8223
  Gene Symbol: INPP1
  Gene Name: inositol polyphosphate-1-phosphatase
  ENSP ID: ENSP00000412119
MSDILRELLCVSEKAANIARACRQQEALFQLLIEEKKEGEKNKKFAVDFKTLADVLVQEVIKQNMENK

SEQ ID NO: 40401 - protein, 9 aa, Homo sapiens
  Payload ID: 8223
  Gene Symbol: INPP1
  Gene Name: inositol polyphosphate-1-phosphatase
  ENSP ID: ENSP00000415014
MSDILRELL

SEQ ID NO: 40402 - protein, 977 aa, Homo sapiens
  Payload ID: 8224
  Gene Symbol: INPP4A
  Gene Name: inositol polyphosphate-4-phosphatase type I A
  Uniprot ID: Q96PE3
  ENSP ID: ENSP00000074304
MTAREHSPRHGARARAMQRASTIDVAADMLGLSLAGNIQDPDEPILEFSLACSELHTPSLDRKPNSFVAVSVTTPPQAFWTKHAQTEIIEGTNNPIFLSSIAFFQDSLINQMTQVKLSVYDVKDRSQGTMYLLGSGTFIVKDLLQDRHHRLHLTLRSAESDRVGNITVIGWQMEEKSDQRPPVTRSVDTVNGRMVLPVDESLTEALGIRSKYASLRKDTLLKSVFGGAICRMYRFPTTDGNHLRILEQMAESVLSLHVPRQFVKLLLEEDAARVCELEELGELSPCWESLRRQIVTQYQTIILTYQENLTDLHQYRGPSFKASSLKADKKLEFVPTNLHIQRMRVQDDGGSDQNYDIVTIGAPAAHCQGFKSGGLRKKLHKFEETKKHFEECCTSSGCQSIIYIPQDVVRAKEIIAQINTLKTQVSYYAERLSRAAKDRSATGLERTLAILADKTRQLVTVCDCKLLANSIHGLNAARPDYIASKASPTSTEEEQVMLRNDQDTLMARWTGRNSRSSLQVDWHEEEWEKVWLNVDKSLECIIQRVDKLLQKERLHGEGCEDVFPCAGSCTSKKGNPDSHAYWIRPEDPFCDVPSSPCPSTMPSTACHPHLTTHCSPPPEESSPGEWSEALYPLLTTLTDCVAMMSDKAKKAMVFLLMQDSAPTIATYLSLQYRRDVVFCQTLTALICGFIIKLRNCLHDDGFLRQLYTIGLLAQFESLLSTYGEELAMLEDMSLGIMDLRNVTFKVTQATSSASADMLPVITGNRDGFNVRVPLPGPLFDALPREIQSGMLLRVQPVLFNVGINEQQTLAERFGDTSLQEVINVESLVRLNSYFEQFKEVLPEDCLPRSRSQTCLPELLRFLGQNVHARKNKNVDILWQAAEICRRLNGVRFTSCKSAKDRTAMSVTLEQCLILQHEHGMAPQVFTQALECMRSEGCRRENTMKNVGSRKYAFNSLQLKAFPKHYRPPEGTYGKVET

SEQ ID NO: 40403 - protein, 306 aa, Homo sapiens
  Payload ID: 8224
  Gene Symbol: INPP4A
  Gene Name: inositol polyphosphate-4-phosphatase type I A
  ENSP ID: ENSP00000386329
MTAREHSPRHGARARAMQRASTIDVAADMLGLSLAGNIQDPDEPILEFSLACSELHTPSLDRKPNSFVAVSVTTPPQATSSASADMLPVITGNRDGFNVRVPLPGPLFDALPREIQSGMLLRVQPVLFNVGINEQQTLAERFGDTSLQEVINVESLVRLNSYFEQFKEVLPEDCLPRSRSQTCLPELLRFLGQNVHARKNKNVDILWQAAEICRRLNGVRFTSCKSAKDRTAMSVTLEQCLILQHEHGMAPQVFTQALECMRSEGCRRENTMKNVGSRKYAFNSLQLKAFPKHYRPPEGTYGKVET

SEQ ID NO: 40404 - protein, 938 aa, Homo sapiens
  Payload ID: 8224
  Gene Symbol: INPP4A
  Gene Name: inositol polyphosphate-4-phosphatase type I A
  Uniprot ID: Q96PE3
  ENSP ID: ENSP00000386704
MTAREHSPRHGARARAMQRASTIDVAADMLGLSLAGNIQDPDEPILEFSLACSELHTPSLDRKPNSFVAVSVTTPPQAFWTKHAQTEIIEGTNNPIFLSSIAFFQDSLINQMTQVKLSVYDVKDRSQGTMYLLGSGTFIVKDLLQDRHHRLHLTLRSAESDRVGNITVIGWQMEEKSDQRPPVTRSVDTVNGRMVLPVDESLTEALGIRSKYASLRKDTLLKSVFGGAICRMYRFPTTDGNHLRILEQMAESVLSLHVPRQFVKLLLEEDAARVCELEELGELSPCWESLRRQIVTQYQTIILTYQENLTDLHQYRGPSFKASSLKADKKLEFVPTNLHIQRMRVQDDGGSDQNYDIVTIGAPAAHCQGFKSGGLRKKLHKFEETKKHFEECCTSSGCQSIIYIPQDVVRAKEIIAQINTLKTQVSYYAERLSRAAKDRSATGLERTLAILADKTRQLVTVCDCKLLANSIHGLNAARPDYIASKASPTSTEEEQVMLRNDQDTLMARWTGRNSRSSLQVDWHEEEWEKVWLNVDKSLECIIQRVDKLLQKERLHGEGCEDVFPCAGSCTSKKDCSPPPEESSPGEWSEALYPLLTTLTDCVAMMSDKAKKAMVFLLMQDSAPTIATYLSLQYRRDVVFCQTLTALICGFIIKLRNCLHDDGFLRQLYTIGLLAQFESLLSTYGEELAMLEDMSLGIMDLRNVTFKVTQATSSASADMLPVITGNRDGFNVRVPLPGPLFDALPREIQSGMLLRVQPVLFNVGINEQQTLAERFGDTSLQEVINVESLVRLNSYFEQFKEVLPEDCLPRSRSQTCLPELLRFLGQNVHARKNKNVDILWQAAEICRRLNGVRFTSCKSAKDRTAMSVTLEQCLILQHEHGMAPQVFTQALECMRSEGCRRENTMKNVGSRKYAFNSLQLKAFPKHYRPPEGTYGKVET

SEQ ID NO: 40405 - protein, 972 aa, Homo sapiens
  Payload ID: 8224
  Gene Symbol: INPP4A
  Gene Name: inositol polyphosphate-4-phosphatase type I A
  Uniprot ID: Q96PE3
  ENSP ID: ENSP00000386777
MTAREHSPRHGARARAMQRASTIDVAADMLGLSLAGNIQDPDEPILEFSLACSELHTPSLDRKPNSFVAVSVTTPPQAFWTKHAQTEIIEGTNNPIFLSSIAFFQDSLINQMTQVKLSVYDVKDRSQGTMYLLGSGTFIVKDLLQDRHHRLHLTLRSAESDRVGNITVIGWQMEEKSDQRPPVTRSVDTVNGRMVLPVDESLTEALGIRSKYASLRKDTLLKSVFGGAICRMYRFPTTDGNHLRILEQMAESVLSLHVPRQFVKLLLEEDAARVCELEELGELSPCWESLRRQIVTQYQTIILTYQENLTDLHQYRGPSFKASSLKADKKLEFVPTNLHIQRMRVQDDGGSDQNYDIVTIGAPAAHCQGFKSGGLRKKLHKFEETKKHTSSGCQSIIYIPQDVVRAKEIIAQINTLKTQVSYYAERLSRAAKDRSATGLERTLAILADKTRQLVTVCDCKLLANSIHGLNAARPDYIASKASPTSTEEEQVMLRNDQDTLMARWTGRNSRSSLQVDWHEEEWEKVWLNVDKSLECIIQRVDKLLQKERLHGEGCEDVFPCAGSCTSKKGNPDSHAYWIRPEDPFCDVPSSPCPSTMPSTACHPHLTTHCSPPPEESSPGEWSEALYPLLTTLTDCVAMMSDKAKKAMVFLLMQDSAPTIATYLSLQYRRDVVFCQTLTALICGFIIKLRNCLHDDGFLRQLYTIGLLAQFESLLSTYGEELAMLEDMSLGIMDLRNVTFKVTQATSSASADMLPVITGNRDGFNVRVPLPGPLFDALPREIQSGMLLRVQPVLFNVGINEQQTLAERFGDTSLQEVINVESLVRLNSYFEQFKEVLPEDCLPRSRSQTCLPELLRFLGQNVHARKNKNVDILWQAAEICRRLNGVRFTSCKSAKDRTAMSVTLEQCLILQHEHGMAPQVFTQALECMRSEGCRRENTMKNVGSRKYAFNSLQLKAFPKHYRPPEGTYGKVET

SEQ ID NO: 40406 - protein, 954 aa, Homo sapiens
  Payload ID: 8224
  Gene Symbol: INPP4A
  Gene Name: inositol polyphosphate-4-phosphatase type I A
  Uniprot ID: Q96PE3
  ENSP ID: ENSP00000387294
MTAREHSPRHGARARAMQRASTIDVAADMLGLSLAGNIQDPDEPILEFSLACSELHTPSLDRKPNSFVAVSVTTPPQAFWTKHAQTEIIEGTNNPIFLSSIAFFQDSLINQMTQVKLSVYDVKDRSQGTMYLLGSGTFIVKDLLQDRHHRLHLTLRSAESDRVGNITVIGWQMEEKSDQRPPVTRSVDTVNGRMVLPVDESLTEALGIRSKYASLRKDTLLKSVFGGAICRMYRFPTTDGNHLRILEQMAESVLSLHVPRQFVKLLLEEDAARVCELEELGELSPCWESLRRQIVTQYQTIILTYQENLTDLHQYRGPSFKASSLKADKKLEFVPTNLHIQRMRVQDDGGSDQNYDIVTIGAPAAHCQGFKSGGLRKKLHKFEETKKHFEECCTSSGCQSIIYIPQDVVRAKEIIAQINTLKTQVSYYAERLSRAAKDRSATGLERTLAILADKTRQLVTVCDCKLLANSIHGLNAARPDYIASKASPTSTEEEQVMLRNDQDTLMARWTGRNSRSSLQVDWHEEEWEKVWLNVDKSLECIIQRVDKLLQKERLHGEGCEDVFPCAGSCTSKKDCSPPPEESSPGEWSEALYPLLTTLTDCVAMMSDKAKKAMVFLLMQDSAPTIATYLSLQYRRDVVFCQTLTALICGFIIKLRNCLHDDGFLRQLYTIGLLAQFESLLSTYGEELAMLEDMSLGIMDLRNVTFKVTQATSSASADMLPVITGNRDGFNVRVPLPGPLFDALPREIQSGMLLRVQPVLFNVGINEQQTLAERFGDTSLQEVINVESLVRLNSYFEQFKEVLPEDCLPRSRSQTCLPELLRFLGQNVHARKNKNVDILWQAAEICRRLNGVRFTSCKSAKDRTAMSVTLEQCLILQHEHGMAPQVFTQALECMRSIGTREVVTQKNLSGLVPIRDLRLDPSLLCSIPLLALSPNLLIVWLFLSIAYLVTKLRCK

SEQ ID NO: 40407 - protein, 977 aa, Homo sapiens; identical to SEQ ID NO: 40402
  Payload ID: 8224
  Gene Symbol: INPP4A
  Gene Name: inositol polyphosphate-4-phosphatase type I A
  Uniprot ID: Q96PE3
  ENSP ID: ENSP00000427722

SEQ ID NO: 40408 - protein, 924 aa, Homo sapiens
  Payload ID: 8225
  Gene Symbol: INPP4B
  Gene Name: inositol polyphosphate-4-phosphatase type II B
  Uniprot ID: O15327
  ENSP ID: ENSP00000262992
MEIKEEGASEEGQHFLPTAQANDPGDCQFTSIQKTPNEPQLEFILACKDLVAPVRDRKLNTLVQISVIHPVEQSLTRYSSTEIVEGTRDPLFLTGVTFPSEYPIYEETKIKLTVYDVKDKSHDTVRTSVLPEHKDPPPEVGRSFLGYASFKVGELLKSKEQLLVLSLRTSDGGKVVGTIEVSVVKMGEIEDGEADHITTDVQGQKCALVCECTAPESVSGKDNLPFLNSVLKNPVCKLYRFPTSDNKWMRIREQMSESILSFHIPKELISLHIKEDLCRNQEIKELGELSPHWDNLRKNVLTHCDQMVNMYQDILTELSKETGSSFKSSSSKGEKTLEFVPINLHLQRMQVHSPHLKDALYDVITVGAPAAHFQGFKNGGLRKLLHRFETERRNTGYQFIYYSPENTAKAKEVLSNINQLQPLIATHADLLLNSASQHSPDSLKNSLKMLSEKTELFVHAFKDQLVRSALLALYTARPGGILKKPPSPKSSTEESSPQDQPPVMRGQDSIPHHSDYDEEEWDRVWANVGKSLNCIIAMVDKLIERDGGSEGSGGNNDGEKEPSLTDAIPSHPREDWYEQLYPLILTLKDCMGEVVNRAKQSLTFVLLQELAYSLPQCLMLTLRRDIVFSQALAGLVCGFIIKLQTSLYDPGFLQQLHTVGLIVQYEGLLSTYSDEIGMLEDMAVGISDLKKVAFKIIEAKSNDVLPVITGRREHYVVEVKLPARMFESLPLQIKEGQLLHVYPVLFNVGINEQQTLAERFGDVSLQESINQENFELLQEYYKIFMEKMPPDYISHFQEQNDLKALLENLLQNIQSKKRKNVEIMWLAATICRKLNGIRFTCCKSAKDRTSMSVTLEQCSILRDEHQLHKDFFIRALDCMRREGCRIENVLKNIKCRKYAFNMLQLMAFPKYYRPPEGTYGKADT

SEQ ID NO: 40409 - protein, 47 aa, Homo sapiens
  Payload ID: 8225
  Gene Symbol: INPP4B
  Gene Name: inositol polyphosphate-4-phosphatase type II B
  ENSP ID: ENSP00000420888
MEIKEEGASEEGQHFLPTAQANDPGDCQFTSIQKTPNEPQLEFILGN

SEQ ID NO: 40410 - protein, 686 aa, Homo sapiens
  Payload ID: 8225
  Gene Symbol: INPP4B
  Gene Name: inositol polyphosphate-4-phosphatase type II B
  ENSP ID: ENSP00000421065
MIHFHPLILPHERSFLGYASFKVGELLKSKEQLLVLSLRTSDGGKVVGTIEVSVVKMGEIEDGEADHITTDVQGQKCALVCECTAPESVSGKDNLPFLNSVLKNPVCKLYRFPTSDNKWMRIREQMSESILSFHIPKELISLHIKEDLCRNQEIKELGELSPHWDNLRKNVLTHCDQMVNMYQDILTELSKETGSSFKSSSSKGEKTLEFVPINLHLQRMQVHSPHLKDALYDVITVGAPAAHFQGFKNGGLRKLLHRFETERRNTGYQFIYYSPENTAKAKEVLSNINQLQPLIATHADLLLNSASQHSPDSLKNSLKMLSEKTELFVHAFKDQLVRSALLALYTARPGGILKKPPSPKSSTEESSPQDQPPVMRGQDSIPHHSDYDEEEWDRVWANVGKSLNCIIAMVDKLIERDGGSEGSGGNNDGEKEPSLTDAIPSHPREDWYEQLYPLILTLKDCMGEVVNRAKQSLTFVLLQELAYSLPQCLMLTLRRDIVFSQALAGLVCGFIIKLQTSLYDPGFLQQLHTVGLIVQYEGLLSTYSDEIGMLEDMAVGISDLKKVAFKIIEAKSNDVLPVITGRREHYVVEVKLPARMFESLPLQIKEGQLLHVYPVLFNVGINEQQTLAERFGDVSLQESINQENFELLQEYYKIFMEKMPPDYISHFQEQNDLKALLENLLQNIQS

SEQ ID NO: 40411 - protein, 39 aa, Homo sapiens
  Payload ID: 8225
  Gene Symbol: INPP4B
  Gene Name: inositol polyphosphate-4-phosphatase type II B
  ENSP ID: ENSP00000422052
MEIKEEGASEEGQHFLPTAQANDPGDCQFTSIQKTPNEP

SEQ ID NO: 40412 - protein, 938 aa, Homo sapiens
  Payload ID: 8225
  Gene Symbol: INPP4B
  Gene Name: inositol polyphosphate-4-phosphatase type II B
  ENSP ID: ENSP00000422793
MEIKEEGASEEGQHFLPTAQANDPGDCQFTSIQKTPNEPQLEFILACKDLVAPVRDRKLNTLVQISVIHPVEQSLTRYSSTEIVEGTRDPLFLTGVTFPSEYPIYEETKIKLTVYDVKDKSHDTVRTSVLPEHKDPPPEVGRSFLGYASFKVGELLKSKEQLLVLSLRTSDGGKVVGTIEVSVVKMGEIEDGEADHITTDVQGQKCALVCECTAPESVSGKDNLPFLNSVLKNPVCKLYRFPTSDNKWMRIREQMSESILSFHIPKELISLHIKEDLCRNQEIKELGELSPHWDNLRKNVLTHCDQMVNMYQDILTELSKETGSSFKSSSSKGEKTLEFVPINLHLQRMQVHSPHLKDALYDVITVGAPAAHFQGFKNGGLRKLLHRFETERRNTGYQFIYYSPENTAKAKEVLSNINQLQPLIATHADLLLNSASQHSPDSLKNSLKMLSEKTELFVHAFKDQLVRSALLALYTARPGGILKKPPSPKSSTEESSPQDQPPVMRGQDSIPHHSDYDEEEWDRVWANVGKSLNCIIAMVDKLIERDGGSEGSGGNNDGEKEPSLTDAIPSHPREDWYEQLYPLILTLKDCMGEVVNRAKQSLTFVLLQELAYSLPQCLMLTLRRDIVFSQALAGLVCGFIIKLQTSLYDPGFLQQLHTVGLIVQYEGLLSTYSDEIGMLEDMAVGISDLKKVAFKIIEAKSNDVLPVITGRREHYVVEVKLPARMFESLPLQIKEGQLLHVYPVLFNVGINEQQTLAERFGDVSLQESINQENFELLQEYYKIFMEKMPPDYISHFQEQNDLKALLENLLQNIQSKKRKNVEIMWLAATICRKLNGIRFTCCKSAKDRTSMSVTLEQCSILRDEHQLHKDFFIRALDCMRSRQTQGALNESDDPETGCLTDNKPTSRHFYPVALLLVSSHLLVVWLILSLALLLAKYQ

SEQ ID NO: 40413 - protein, 416 aa, Homo sapiens
  Payload ID: 8225
  Gene Symbol: INPP4B
  Gene Name: inositol polyphosphate-4-phosphatase type II B
  ENSP ID: ENSP00000423771
MEIKEEGASEEGQHFLPTAQANDPGDCQFTSIQKTPNEPQLEFILACKDLVAPVRDRKLNTLVQISVIHPVEQSLTRYSSTEIVEGTRDPLFLTGVTFPSEYPIYEETKIKLTVYDVKDKSHDTVRTSVLPEHKDPPPEVGRSFLGYASFKVGELLKSKEQLLVLSLRTSDGGKVVGTIEVSVVKMGEIEDGEADHITTDVQGQKCALVCECTAPESVSGKDNLPFLNSVLKNPVCKLYRFPTSDNKWMRIREQMSESILSFHIPKELISLHIKEDLCRNQEIKELGELSPHWDNLRKNVLTHCDQMVNMYQDILTELSKETGSSFKSSSSKGEKTLEFVPINLHLQRMQMLSTMSSLWEPQLPIFRDLRMVVFGSYSIDLKQKEEIPDTSLFTIHLKTQPKQRKFSATSINYNLL

SEQ ID NO: 40414 - protein, 924 aa, Homo sapiens; identical to SEQ ID NO: 40408
  Payload ID: 8225
  Gene Symbol: INPP4B
  Gene Name: inositol polyphosphate-4-phosphatase type II B
  Uniprot ID: O15327
  ENSP ID: ENSP00000423954

SEQ ID NO: 40415 - protein, 131 aa, Homo sapiens
  Payload ID: 8225
  Gene Symbol: INPP4B
  Gene Name: inositol polyphosphate-4-phosphatase type II B
  Uniprot ID: O15327
  ENSP ID: ENSP00000424057
MEIKEEGASEEGQHFLPTAQANDPGDCQFTSIQKTPNEPQLEFILACKDLVAPVRDRKLNTLVQISVIHPVEQSLTRYSSTEIVEGTRDPLFLTGVTFPSEYPIYEETKIKLTVYDVKDKSHDTIANSSRI

SEQ ID NO: 40416 - protein, 33 aa, Homo sapiens
  Payload ID: 8225
  Gene Symbol: INPP4B
  Gene Name: inositol polyphosphate-4-phosphatase type II B
  ENSP ID: ENSP00000424731
EYPIYEETKIKLTVYDVKDKSHDTFRINRLTSL

SEQ ID NO: 40417 - protein, 924 aa, Homo sapiens; identical to SEQ ID NO: 40408
  Payload ID: 8225
  Gene Symbol: INPP4B
  Gene Name: inositol polyphosphate-4-phosphatase type II B
  Uniprot ID: O15327
  ENSP ID: ENSP00000425487

SEQ ID NO: 40418 - protein, 65 aa, Homo sapiens
  Payload ID: 8225
  Gene Symbol: INPP4B
  Gene Name: inositol polyphosphate-4-phosphatase type II B
  ENSP ID: ENSP00000425764
  MOD_RES (1)..(1): Any amino acid
XIHPVEQSLTRYSSTEIVEGTRDPLFLTGVTFPSEYPIYEETKIKLTVYDVKDKSHDTIANSSRI

SEQ ID NO: 40419 - protein, 688 aa, Homo sapiens
  Payload ID: 8225
  Gene Symbol: INPP4B
  Gene Name: inositol polyphosphate-4-phosphatase type II B
  ENSP ID: ENSP00000426207
MGEIEDGEADHITTDVQGQKCALVCECTAPESVSGKDNLPFLNSVLKNPVCKLYRFPTSDNKWMRIREQMSESILSFHIPKELISLHIKEDLCRNQEIKELGELSPHWDNLRKNVLTHCDQMVNMYQDILTELSKETGSSFKSSSSKGEKTLEFVPINLHLQRMQVHSPHLKDALYDVITVGAPAAHFQGFKNGGLRKLLHRFETERRNTGYQFIYYSPENTAKAKEVLSNINQLQPLIATHADLLLNSASQHSPDSLKNSLKMLSEKTELFVHAFKDQLVRSALLALYTARPGGILKKPPSPKSSTEESSPQDQPPVMRGQDSIPHHSDYDEEEWDRVWANVGKSLNCIIAMVDKLIERDGGSEGSGGNNDGEKEPSLTDAIPSHPREDWYEQLYPLILTLKDCMGEVVNRAKQSLTFVLLQELAYSLPQCLMLTLRRDIVFSQALAGLVCGFIIKLQTSLYDPGFLQQLHTVGLIVQYEGLLSTYSDEIGMLEDMAVGISDLKKVAFKIIEAKSNDVLPVITGRREHYVVEVKLPARMFESLPLQIKEGQLLHVYPVLFNVGINEQQTLAERFGDVSLQESINQENFELLQEYYKIFMEKMPPDYISHFQEQNDLKALLENLLQNIQSKKRKNVEIMWLAATICRKLNGIRFTCCKSAKDRTSMSVTLEQCSILRDEHQLHKDFFI

SEQ ID NO: 40420 - protein, 53 aa, Homo sapiens
  Payload ID: 8225
  Gene Symbol: INPP4B
  Gene Name: inositol polyphosphate-4-phosphatase type II B
  ENSP ID: ENSP00000426897
MEIKEEGASEEGQHFLPTAQANDPGDCQFTSIQKTPNEPQLEFILDLNQELRD

SEQ ID NO: 40421 - protein, 84 aa, Homo sapiens
  Payload ID: 8225
  Gene Symbol: INPP4B
  Gene Name: inositol polyphosphate-4-phosphatase type II B
  ENSP ID: ENSP00000426957
MEIKEEGASEEGQHFLPTAQANDPGDCQFTSIQKTPNEPQLEFILACKDLVAPVRDRKLNTLVQISVIHPVEQSLTRYSSTEIV

SEQ ID NO: 40422 - protein, 817 aa, Homo sapiens
  Payload ID: 8225
  Gene Symbol: INPP4B
  Gene Name: inositol polyphosphate-4-phosphatase type II B
  ENSP ID: ENSP00000427250
MEIKEEGASEEGQHFLPTAQANDPGDCQFTSIQKTPNEPQLEFILACKDLVAPVRDRKLNTLVQISVIHPVEQSLTRYSSTEIVEGTRDPLFLTGVTFPSEYPIYEETKIKLTVYDVKDKSHDTVRTSVLPEHKDPPPEVGRSFLGYASFKVGELLKSKEQLLVLSLRTSDGGKVVGTIEVSVVKMGEIEDGEADHITTDVQGQKCALVCECTAPESVSGKDNLPFLNSVLKNPVCKLYRFPTSDNKWMRIREQMSESILSFHIPKELISLHIKEDLCRNQEIKELGELSPHWDNLRKNVLTHCDQMVNMYQDILTELSKETGSSFKSSSSKGEKTLEFVPINLHLQRMQVHSPHLKDALYDVITVGAPAAHFQGFKNGGLRKLLHRFETERRNTGYQFIYYSPENTAKAKEVLSNINQLQPLIATHADLLLNSASQHSPDSLKNSLKMLSEKTELFVHAFKDQLVRSALLALYTARPGGILKKPPSPKSSTEESSPQDQPPVMRGQDSIPHHSDYDEEEWDRVWANVGKSLNCIIAMVDKLIERDGGSEGSGGNNDGEKEPSLTDAIPSHPREDWYEQLYPLILTLKDCMGEVVNRAKQSLTFVLLQELAYSLPQCLMLTLRRDIVFSQALAGLVCGFIIKLQTSLYDPGFLQQLHTVGLIVQYEGLLSTYSDEIGMLEDMAVGISDLKKVAFKIIEAKSNDVLPVITGRREHYVVEVKLPARMFESLPLQIKEGQLLHVYPVLFNVGINEQQTLAERFGDVSLQESINQENFELLQEYYKIFMEKMPPDYISHFQEQNDLKALLENLLQNIQSKK

SEQ ID NO: 40423 - protein, 53 aa, Homo sapiens; identical to SEQ ID NO: 40420
  Payload ID: 8225
  Gene Symbol: INPP4B
  Gene Name: inositol polyphosphate-4-phosphatase type II B
  ENSP ID: ENSP00000486368

SEQ ID NO: 40424 - protein, 278 aa, Homo sapiens
  Payload ID: 8226
  Gene Symbol: INPP5A
  Gene Name: inositol polyphosphate-5-phosphatase A
  ENSP ID: ENSP00000340707
  MOD_RES (1)..(1): Any amino acid
XQKNWLREFYQVVHTHKPHFMALHCQEFGGKNYEASMSHVDKFVKELLSSDAMKEYNRARVYLDENYKSQEHFTALGSFYFLHESLKNIYQFDFKAKKYRKVAGKEIYSDTLESTPMLEKEKFPQDYFPECKWSRKGFIRTRWCIADCAFDLVNIHLFHDASNLVAWETSPSVYSGIRHKALGYVLDRIIDQRFEKVSYFVFGDFNFRLDSKSVVELLEFDKELSVFKDRLYELDISFPPSYPYSEDARQGEQYMNTRCPAWCDRILMSPSAKELVLR

SEQ ID NO: 40425 - protein, 387 aa, Homo sapiens
  Payload ID: 8226
  Gene Symbol: INPP5A
  Gene Name: inositol polyphosphate-5-phosphatase A
  ENSP ID: ENSP00000357582
MAGKAAAPGTAVLLVTANVGSLFDDPENLQKNWLREFYQVVHTHKPHFMALHCQEFGGKNYEASMSHVDKFVKELLSSDAMKEYNRARVYLDENYKSQEHFTALGSFYFLHESLKNIYQFDFKAKKYRKVAGKEIYSDTLESTPMLEKEKFPQDYFPECKWSRKGFIRTRWCIADCAFDLVNIHLFHDASNLVAWETSPSVYSGIRHKALGYVLDRIIDQRFEKVSYFVFGDFNFRLDSKSVVETLCTKATMQTVRAADTNEVVKLIFRESDNDRKVMLQLEKKLFDYFNQEVFRDNNGTALLEFDKELSVFKDRLYELDISFPPSYPYSEDARQGEQYMNTRCPAWCDRILMSPSAKELVLRVSVCCPSPGHRGMWSAGSGLAQPW

SEQ ID NO: 40426 - protein, 412 aa, Homo sapiens
  Payload ID: 8226
  Gene Symbol: INPP5A
  Gene Name: inositol polyphosphate-5-phosphatase A
  Uniprot ID: Q14642
  ENSP ID: ENSP00000357583
MAGKAAAPGTAVLLVTANVGSLFDDPENLQKNWLREFYQVVHTHKPHFMALHCQEFGGKNYEASMSHVDKFVKELLSSDAMKEYNRARVYLDENYKSQEHFTALGSFYFLHESLKNIYQFDFKAKKYRKVAGKEIYSDTLESTPMLEKEKFPQDYFPECKWSRKGFIRTRWCIADCAFDLVNIHLFHDASNLVAWETSPSVYSGIRHKALGYVLDRIIDQRFEKVSYFVFGDFNFRLDSKSVVETLCTKATMQTVRAADTNEVVKLIFRESDNDRKVMLQLEKKLFDYFNQEVFRDNNGTALLEFDKELSVFKDRLYELDISFPPSYPYSEDARQGEQYMNTRCPAWCDRILMSPSAKELVLRSESEEKVVTYDHIGPNVCMGDHKPVFLAFRIMPGAGKPHAHVHKCCVVQ

SEQ ID NO: 40427 - protein, 104 aa, Homo sapiens
  Payload ID: 8226
  Gene Symbol: INPP5A
  Gene Name: inositol polyphosphate-5-phosphatase A
  ENSP ID: ENSP00000390749
LDISFPPSYPYSEDARQGEQYMNTRCPAWCDRILMSPSAKELVLRSESEEKVVTYDHIGPNVCMGDHKPVFLAFRIMPGAGKRCQRHERTLREPPCSRGPNTHS

SEQ ID NO: 40428 - protein, 138 aa, Homo sapiens
  Payload ID: 8226
  Gene Symbol: INPP5A
  Gene Name: inositol polyphosphate-5-phosphatase A
  ENSP ID: ENSP00000390936
VTANVGSLFDDPENLQKNWLREFYQALGSFYFLHESLKNIYQFDFKAKKYRKVAGKEIYSDTLESTPMLEKEKFPQDYFPECKWSRKGFIRTRWCIADCAFDLVNIHLFHDASNLVAWETSPSVYSGIRHKALGYVLD

SEQ ID NO: 40429 - protein, 319 aa, Homo sapiens
  Payload ID: 8227
  Gene Symbol: INPP5B
  Gene Name: inositol polyphosphate-5-phosphatase B
  ENSP ID: ENSP00000362112
MDQSVAIQETLAEGEYCVIAVQGVLCEGDSRQSRLLGLVRYRLEHGGQEHALFLYTHRRMAITGDDVSLDQIVPVSRDFTLEEVSPDGELYILGSDVTVQLDTAELSLVFQLPFGSQTRMFLHEVARACPGFDSATRDPEFLWLSRYRCAELELEMPTPRGCNSALVTWPGYATIGGGRYPSRKKRWGLEEARPQGAGSVLFWGGAMEKTGFRLMERAHGGGFVWGRSARDGRRDEELEEAGREMSAAAGSRERNTAGSAGGGKLGWGAGPGAAVRPALGWAGSAVWPVDARGEDQSPGGPLEAGTLGQKFCDVLLRRA

SEQ ID NO: 40430 - protein, 993 aa, Homo sapiens
  Payload ID: 8227
  Gene Symbol: INPP5B
  Gene Name: inositol polyphosphate-5-phosphatase B
  Uniprot ID: P32019
  ENSP ID: ENSP00000362114
MDQSVAIQETLAEGEYCVIAVQGVLCEGDSRQSRLLGLVRYRLEHGGQEHALFLYTHRRMAITGDDVSLDQIVPVSRDFTLEEVSPDGELYILGSDVTVQLDTAELSLVFQLPFGSQTRMFLHEVARACPGFDSATRDPEFLWLSRYRCAELELEMPTPRGCNSALVTWPGYATIGGGRYPSRKKRWGLEEARPQGAGSVLFWGGAMEKTGFRLMERAHGGGFVWGRSARDGRRDEELEEAGREMSAAAGSRERNTAGGSNFDGLRPNGKGVPMDQSSRGQDKPESLQPRQNKSKSEITDMVRSSTITVSDKAHILSMQKFGLRDTIVKSHLLQKEEDYTYIQNFRFFAGTYNVNGQSPKECLRLWLSNGIQAPDVYCVGFQELDLSKEAFFFHDTPKEEEWFKAVSEGLHPDAKYAKVKLIRLVGIMLLLYVKQEHAAYISEVEAETVGTGIMGRMGNKGGVAIRFQFHNTSICVVNSHLAAHIEEYERRNQDYKDICSRMQFCQPDPSLPPLTISNHDVILWLGDLNYRIEELDVEKVKKLIEEKDFQMLYAYDQLKIQVAAKTVFEGFTEGELTFQPTYKYDTGSDDWDTSEKCRAPAWCDRILWKGKNITQLSYQSHMALKTSDHKPVSSVFDIGVRVVNDELYRKTLEEIVRSLDKMENANIPSVSLSKREFCFQNVKYMQLKVESFTIHNGQVPCHFEFINKPDEESYCKQWLNANPSRGFLLPDSDVEIDLELFVNKMTATKLNSGEDKIEDILVLHLDRGKDYFLSVSGNYLPSCFGSPIHTLCYMREPILDLPLETISELTLMPVWTGDDGSQLDSPMEIPKELWMMVDYLYRNAVQQEDLFQQPGLRSEFEHIRDCLDTGMIDNLSASNHSVAEALLLFLESLPEPVICYSTYHNCLECSGNYTASKQVISTLPIFHKNVFHYLMAFLRELLKNSAKNHLDENILASIFGSLLLRNPAGHQKLDMTEKKKAQEFIHQFLCNPL

SEQ ID NO: 40431 - protein, 913 aa, Homo sapiens
  Payload ID: 8227
  Gene Symbol: INPP5B
  Gene Name: inositol polyphosphate-5-phosphatase B
  Uniprot ID: P32019
  ENSP ID: ENSP00000362115
MDQSVAIQETLAEGEYCVIAVQGVLCEGDSRQSRLLGLVRYRLEHGGQEHALFLYTHRRMAITGDDVSLDQIVPVSRDFTLEEVSPDGELYILGSDVTVQLDTAELSLVFQLPFGSQTRMFLHEVARACPGFDSATRDPEFLWLSRYRCAELELEMPTPRGCNSALVTWPGYATIGGGGSNFDGLRPNGKGVPMDQSSRGQDKPESLQPRQNKSKSEITDMVRSSTITVSDKAHILSMQKFGLRDTIVKSHLLQKEEDYTYIQNFRFFAGTYNVNGQSPKECLRLWLSNGIQAPDVYCVGFQELDLSKEAFFFHDTPKEEEWFKAVSEGLHPDAKYAKVKLIRLVGIMLLLYVKQEHAAYISEVEAETVGTGIMGRMGNKGGVAIRFQFHNTSICVVNSHLAAHIEEYERRNQDYKDICSRMQFCQPDPSLPPLTISNHDVILWLGDLNYRIEELDVEKVKKLIEEKDFQMLYAYDQLKIQVAAKTVFEGFTEGELTFQPTYKYDTGSDDWDTSEKCRAPAWCDRILWKGKNITQLSYQSHMALKTSDHKPVSSVFDIGVRVVNDELYRKTLEEIVRSLDKMENANIPSVSLSKREFCFQNVKYMQLKVESFTIHNGQVPCHFEFINKPDEESYCKQWLNANPSRGFLLPDSDVEIDLELFVNKMTATKLNSGEDKIEDILVLHLDRGKDYFLSVSGNYLPSCFGSPIHTLCYMREPILDLPLETISELTLMPVWTGDDGSQLDSPMEIPKELWMMVDYLYRNAVQQEDLFQQPGLRSEFEHIRDCLDTGMIDNLSASNHSVAEALLLFLESLPEPVICYSTYHNCLECSGNYTASKQVISTLPIFHKNVFHYLMAFLRELLKNSAKNHLDENILASIFGSLLLRNPAGHQKLDMTEKKKAQEFIHQFLCNPL

SEQ ID NO: 40432 - protein, 993 aa, Homo sapiens; identical to SEQ ID NO: 40430
  Payload ID: 8227
  Gene Symbol: INPP5B
  Gene Name: inositol polyphosphate-5-phosphatase B
  Uniprot ID: P32019
  ENSP ID: ENSP00000362117

SEQ ID NO: 40433 - protein, 749 aa, Homo sapiens
  Payload ID: 8227
  Gene Symbol: INPP5B
  Gene Name: inositol polyphosphate-5-phosphatase B
  Uniprot ID: P32019
  ENSP ID: ENSP00000362118
MSAAAGSRERNTAGGSNFDGLRPNGKGVPMDQSSRGQDKPESLQPRQNKSKSEITDMVRSSTITVSDKAHILSMQKFGLRDTIVKSHLLQKEEDYTYIQNFRFFAGTYNVNGQSPKECLRLWLSNGIQAPDVYCVGFQELDLSKEAFFFHDTPKEEEWFKAVSEGLHPDAKYAKVKLIRLVGIMLLLYVKQEHAAYISEVEAETVGTGIMGRMGNKGGVAIRFQFHNTSICVVNSHLAAHIEEYERRNQDYKDICSRMQFCQPDPSLPPLTISNHDVILWLGDLNYRIEELDVEKVKKLIEEKDFQMLYAYDQLKIQVAAKTVFEGFTEGELTFQPTYKYDTGSDDWDTSEKCRAPAWCDRILWKGKNITQLSYQSHMALKTSDHKPVSSVFDIGVRVVNDELYRKTLEEIVRSLDKMENANIPSVSLSKREFCFQNVKYMQLKVESFTIHNGQVPCHFEFINKPDEESYCKQWLNANPSRGFLLPDSDVEIDLELFVNKMTATKLNSGEDKIEDILVLHLDRGKDYFLSVSGNYLPSCFGSPIHTLCYMREPILDLPLETISELTLMPVWTGDDGSQLDSPMEIPKELWMMVDYLYRNAVQQEDLFQQPGLRSEFEHIRDCLDTGMIDNLSASNHSVAEALLLFLESLPEPVICYSTYHNCLECSGNYTASKQVISTLPIFHKNVFHYLMAFLRELLKNSAKNHLDENILASIFGSLLLRNPAGHQKLDMTEKKKAQEFIHQFLCNPL

SEQ ID NO: 40434 - protein, 748 aa, Homo sapiens [sequence omitted]

SEQ ID NO: 40435 - protein, 1188 aa, Homo sapiens
  Payload ID: 8228
  Gene Symbol: INPP5D
  Gene Name: inositol polyphosphate-5-phosphatase D
  Uniprot ID: Q92835
  ENSP ID: ENSP00000352575
MVPCWNHGNITRSKAEELLSRTGKDGSFLVRASESISRAYALCVLYRNCVYTYRILPNEDDKFTVQASEGVSMRFFTKLDQLIEFYKKENMGLVTHLQYPVPLEEEDTGDDPEEDTESVVSPPELPPRNIPLTASSCEAKEVPFSNENPRATETSRPSLSETLFQRLQSMDTSGLPEEHLKAIQDYLSTQLAQDSEFVKTGSSSLPHLKKLTTLLCKELYGEVIRTLPSLESLQRLFDQQLSPGLRPRPQVPGEANPINMVSKLSQLTSLLSSIEDKVKALLHEGPESPHRPSLIPPVTFEVKAESLGIPQKMQLKVDVESGKLIIKKSKDGSEDKFYSHKKILQLIKSQKFLNKLVILVETEKEKILRKEYVFADSKKREGFCQLLQQMKNKHSEQPEPDMITIFIGTWNMGNAPPPKKITSWFLSKGQGKTRDDSADYIPHDIYVIGTQEDPLSEKEWLEILKHSLQEITSVTFKTVAIHTLWNIRIVVLAKPEHENRISHICTDNVKTGIANTLGNKGAVGVSFMFNGTSLGFVNSHLTSGSEKKLRRNQNYMNILRFLALGDKKLSPFNITHRFTHLFWFGDLNYRVDLPTWEAETIIQKIKQQQYADLLSHDQLLTERREQKVFLHFEEEEITFAPTYRFERLTRDKYAYTKQKATGMKYNLPSWCDRVLWKSYPLVHVVCQSYGSTSDIMTSDHSPVFATFEAGVTSQFVSKNGPGTVDSQGQIEFLRCYATLKTKSQTKFYLEFHSSCLESFVKSQEGENEEGSEGELVVKFGETLPKLKPIISDPEYLLDQHILISIKSSDSDESYGEGCIALRLEATETQLPIYTPLTHHGELTGHFQGEIKLQTSQGKTREKLYDFVKTERDESSGPKTLKSLTSHDPMKQWEVTSRAPPCSGSSITEIINPNYMGVGPFGPPMPLHVKQTLSPDQQPTAWSYDQPPKDSPLGPCRGESPPTPPGQPPISPKKFLPSTANRGLPPRTQESRPSDLGKNAGDTLPQEDLPLTKPEMFENPLYGSLSSFPKPAPRKDQESPKMPRKEPPPCPEPGILSPSIVLTKAQEADRGEGPGKQVPAPRLRSFTCSSSAEGRAAGGDKSQGKPKTPVSSQAPVPAKRPIKPSRSEINQQTPPTPTPRPPLPVKSPAVLHLQHSKGRDYRDNTELPHHGKHRPEEGPPGPLGRTAMQ

SEQ ID NO: 40436 - protein, 810 aa, Homo sapiens
  Payload ID: 8228
  Gene Symbol: INPP5D
  Gene Name: inositol polyphosphate-5-phosphatase D
  ENSP ID: ENSP00000397421
KREGFCQLLQQMKNKHSEQPEPDMITIFIGTWNMGNAPPPKKITSWFLSKGQGKTRDDSADYIPHDIYVIGTQEDPLSEKEWLEILKHSLQEITSVTFKTVAIHTLWNIRIVVLAKPEHENRISHICTDNVKTGIANTLGNKGAVGVSFMFNGTSLGFVNSHLTSGSEKKLRRNQNYMNILRFLALGDKKLSPFNITHRFTHLFWFGDLNYRVDLPTWEAETIIQKIKQQQYADLLSHDQLLTERREQKVFLHFEEEEITFAPTYRFERLTRDKYAYTKQKATGMKYNLPSWCDRVLWKSYPLVHVVCQSYGSTSDIMTSDHSPVFATFEAGVTSQFVSKNGPGTVDSQGQIEFLRCYATLKTKSQTKFYLEFHSSCLESFVKSQEGENEEGSEGELVVKFGETLPKLKPIISDPEYLLDQHILISIKSSDSDESYGEGCIALRLEATETQLPIYTPLTHHGELTGHFQGEIKLQTSQGKTREKLYDFVKTERDESSGPKTLKSLTSHDPMKQWEVTSRAPPCSGSSITEIINPNYMGVGPFGPPMPLHVKQTLSPDQQPTAWSYDQPPKDSPLGPCRGESPPTPPGQPPISPKKFLPSTANRGLPPRTQESRPSDLGKNAGDTLPQEDLPLTKPEMFENPLYGSLSSFPKPAPRKDQESPKMPRKEPPPCPEPGILSPSIVLTKAQEADRGEGPGKQVPAPRLRSFTCSSSAEGRAAGGDKSQGKPKTPVSSQAPVPAKRPIKPSRSEINQQTPPTPTPRPPLPVKSPAVLHLQHSKGRDYRDNTELPHHGKHRPEEGPPGPLGRTAMQ

SEQ ID NO: 40437 - protein, 1189 aa, Homo sapiens
  Payload ID: 8228
  Gene Symbol: INPP5D
  Gene Name: inositol polyphosphate-5-phosphatase D
  Uniprot ID: Q92835
  ENSP ID: ENSP00000405338
MVPCWNHGNITRSKAEELLSRTGKDGSFLVRASESISRAYALCVLYRNCVYTYRILPNEDDKFTVQASEGVSMRFFTKLDQLIEFYKKENMGLVTHLQYPVPLEEEDTGDDPEEDTVESVVSPPELPPRNIPLTASSCEAKEVPFSNENPRATETSRPSLSETLFQRLQSMDTSGLPEEHLKAIQDYLSTQLAQDSEFVKTGSSSLPHLKKLTTLLCKELYGEVIRTLPSLESLQRLFDQQLSPGLRPRPQVPGEANPINMVSKLSQLTSLLSSIEDKVKALLHEGPESPHRPSLIPPVTFEVKAESLGIPQKMQLKVDVESGKLIIKKSKDGSEDKFYSHKKILQLIKSQKFLNKLVILVETEKEKILRKEYVFADSKKREGFCQLLQQMKNKHSEQPEPDMITIFIGTWNMGNAPPPKKITSWFLSKGQGKTRDDSADYIPHDIYVIGTQEDPLSEKEWLEILKHSLQEITSVTFKTVAIHTLWNIRIVVLAKPEHENRISHICTDNVKTGIANTLGNKGAVGVSFMFNGTSLGFVNSHLTSGSEKKLRRNQNYMNILRFLALGDKKLSPFNITHRFTHLFWFGDLNYRVDLPTWEAETIIQKIKQQQYADLLSHDQLLTERREQKVFLHFEEEEITFAPTYRFERLTRDKYAYTKQKATGMKYNLPSWCDRVLWKSYPLVHVVCQSYGSTSDIMTSDHSPVFATFEAGVTSQFVSKNGPGTVDSQGQIEFLRCYATLKTKSQTKFYLEFHSSCLESFVKSQEGENEEGSEGELVVKFGETLPKLKPIISDPEYLLDQHILISIKSSDSDESYGEGCIALRLEATETQLPIYTPLTHHGELTGHFQGEIKLQTSQGKTREKLYDFVKTERDESSGPKTLKSLTSHDPMKQWEVTSRAPPCSGSSITEIINPNYMGVGPFGPPMPLHVKQTLSPDQQPTAWSYDQPPKDSPLGPCRGESPPTPPGQPPISPKKFLPSTANRGLPPRTQESRPSDLGKNAGDTLPQEDLPLTKPEMFENPLYGSLSSFPKPAPRKDQESPKMPRKEPPPCPEPGILSPSIVLTKAQEADRGEGPGKQVPAPRLRSFTCSSSAEGRAAGGDKSQGKPKTPVSSQAPVPAKRPIKPSRSEINQQTPPTPTPRPPLPVKSPAVLHLQHSKGRDYRDNTELPHHGKHRPEEGPPGPLGRTAMQ

SEQ ID NO: 40438 - protein, 130 aa, Homo sapiens
  Payload ID: 8228
  Gene Symbol: INPP5D
  Gene Name: inositol polyphosphate-5-phosphatase D
  ENSP ID: ENSP00000414835
KTLKSLTSHDPMKQWEVTSRAPPCSGSSITEIINPNYMGVGPFGPPMPLHVKQTLSPDQQPTAWSYDQPPKDSPLGPCRGESPPTPPGQPPISPKKFLPSTANRGLPPRTQESSEALSELPLSREPRGTA

SEQ ID NO: 40439 - protein, 43 aa, Homo sapiens
  Payload ID: 8228
  Gene Symbol: INPP5D
  Gene Name: inositol polyphosphate-5-phosphatase D
  ENSP ID: ENSP00000473280
  MOD_RES (1)..(1): Any amino acid
XTELPHHGKHRPEEGPPGPLGRTAMQVRCATRGFVCICVCVHA

SEQ ID NO: 40440 - protein, 43 aa, Homo sapiens; identical to SEQ ID NO: 40439
  Payload ID: 8228
  Gene Symbol: INPP5D
  Gene Name: inositol polyphosphate-5-phosphatase D
  ENSP ID: ENSP00000486018
  MOD_RES (1)..(1): Any amino acid

SEQ ID NO: 40441 - protein, 1188 aa, Homo sapiens; identical to SEQ ID NO: 40435
  Payload ID: 8228
  Gene Symbol: INPP5D
  Gene Name: inositol polyphosphate-5-phosphatase D
  Uniprot ID: Q92835
  ENSP ID: ENSP00000486669

SEQ ID NO: 40442 - protein, 1189 aa, Homo sapiens; identical to SEQ ID NO: 40437
  Payload ID: 8228
  Gene Symbol: INPP5D
  Gene Name: inositol polyphosphate-5-phosphatase D
  Uniprot ID: Q92835
  ENSP ID: ENSP00000487191

SEQ ID NO: 40443 - protein, 130 aa, Homo sapiens; identical to SEQ ID NO: 40438
  Payload ID: 8228
  Gene Symbol: INPP5D
  Gene Name: inositol polyphosphate-5-phosphatase D
  ENSP ID: ENSP00000487335

SEQ ID NO: 40444 - protein, 810 aa, Homo sapiens; identical to SEQ ID NO: 40436
  Payload ID: 8228
  Gene Symbol: INPP5D
  Gene Name: inositol polyphosphate-5-phosphatase D
  ENSP ID: ENSP00000487535

SEQ ID NO: 40445 - protein, 644 aa, Homo sapiens
  Payload ID: 8229
  Gene Symbol: INPP5E
  Gene Name: inositol polyphosphate-5-phosphatase E
  Uniprot ID: Q9NRR6
  ENSP ID: ENSP00000360777
MPSKAENLRPSEPAPQPPEGRTLQGQLPGAPPAQRAGSPPDAPGSESPALACSTPATPSGEDPPARAAPIAPRPPARPRLERALSLDDKGWRRRRFRGSQEDLEARNGTSPSRGSVQSEGPGAPAHSCSPPCLSTSLQEIPKSRGVLSSERGSPSSGGNPLSGVASSSPNLPHRDAAVAGSSPRLPSLLPPRPPPALSLDIASDSLRTANKVDSDLADYKLRAQPLLVRAHSSLGPGRPRSPLACDDCSLRSAKSSFSLLAPIRSKDVRSRSYLEGSLLASGALLGADELARYFPDRNVALFVATWNMQGQKELPPSLDEFLLPAEADYAQDLYVIGVQEGCSDRREWETRLQETLGPHYVLLSSAAHGVLYMSLFIRRDLIWFCSEVECSTVTTRIVSQIKTKGALGISFTFFGTSFLFITSHFTSGDGKVAERLLDYTRTVQALVLPRNVPDTNPYRSSAADVTTRFDEVFWFGDFNFRLSGGRTVVDALLCQGLVVDVPALLQHDQLIREMRKGSIFKGFQEPDIHFLPSYKFDIGKDTYDSTSKQRTPSYTDRVLYRSRHKGDICPVSYSSCPGIKTSDHRPVYGLFRVKVRPGRDNIPLAAGKFDRELYLLGIKRRISKEIQRQQALQSQNSSTICSVS

SEQ ID NO: 40446 - protein, 1132 aa, Homo sapiens
  Payload ID: 8230
  Gene Symbol: INPP5F
  Gene Name: inositol polyphosphate-5-phosphatase F
  Uniprot ID: Q9Y2H2
  ENSP ID: ENSP00000354519
MELFQAKDHYILQQGERALWCSRRDGGLQLRPATDLLLAWNPICLGLVEGVIGKIQLHSDLPWWLILIRQKALVGKLPGDHEVCKVTKIAVLSLSEMEPQDLELELCKKHHFGINKPEKIIPSPDDSKFLLKTFTHIKSNVSAPNKKKVKESKEKEKLERRLLEELLKMFMDSESFYYSLTYDLTNSVQRQSTGERDGRPLWQKVDDRFFWNKYMIQDLTEIGTPDVDFWIIPMIQGFVQIEELVVNYTESSDDEKSSPETPPQESTCVDDIHPRFLVALISRRSRHRAGMRYKRRGVDKNGNVANYVETEQLIHVHNHTLSFVQTRGSVPVFWSQVGYRYNPRPRLDRSEKETVAYFCAHFEEQLNIYKKQVIINLVDQAGREKIIGDAYLKQVLLFNNSHLTYVSFDFHEHCRGMKFENVQTLTDAIYDIILDMKWCWVDEAGVICKQEGIFRVNCMDCLDRTNVVQAAIARVVMEQQLKKLGVMPPEQPLPVKCNRIYQIMWANNGDSISRQYAGTAALKGDFTRTGERKLAGVMKDGVNSANRYYLNRFKDAYRQAVIDLMQGIPVTEDLYSIFTKEKEHEALHKENQRSHQELISQLLQSYMKLLLPDDEKFHGGWALIDCDPSLIDATHRDVDVLLLLSNSAYYVAYYDDEVDKVNQYQRLSLENLEKIEIGPEPTLFGKPKFSCMRLHYRYKEASGYFHTLRAVMRNPEEDGKDTLQCIAEMLQITKQAMGSDLPIIEKKLERKSSKPHEDIIGIRSQNQGSLAQGKNFLMSKFSSLNQKVKQTKSNVNIGNLRKLGNFTKPEMKVNFLKPNLKVNLWKSDSSLETMENTGVMDKVQAESDGDMSSDNDSYHSDEFLTNSKSDEDRQLANSLESVGPIDYVLPSCGIIASAPRLGSRSQSLSSTDSSVHAPSEITVAHGSGLGKGQESPLKKSPSAGDVHILTGFAKPMDIYCHRFVQDAQNKVTHLSETRSVSQQASQERNQMTNQVSNETQSESTEQTPSRPSQLDVSLSATGPQFLSVEPAHSVASQKTPTSASSMLELETGLHVTPSPSESSSSRAVSPFAKIRSSMVQVASITQAGLTHGINFAVSKVQKSPPEPEIINQVQQNELKKMFIQCQTRIIQI

SEQ ID NO: 40447 - protein, 522 aa, Homo sapiens
  Payload ID: 8230
  Gene Symbol: INPP5F
  Gene Name: inositol polyphosphate-5-phosphatase F
  Uniprot ID: Q9Y2H2
  ENSP ID: ENSP00000358076
MCHDVIFMAWLKQQFSECTLIDATHRDVDVLLLLSNSAYYVAYYDDEVDKVNQYQRLSLENLEKIEIGPEPTLFGKPKFSCMRLHYRYKEASGYFHTLRAVMRNPEEDGKDTLQCIAEMLQITKQAMGSDLPIIEKKLERKSSKPHEDIIGIRSQNQGSLAQGKNFLMSKFSSLNQKVKQTKSNVNIGNLRKLGNFTKPEMKVNFLKPNLKVNLWKSDSSLETMENTGVMDKVQAESDGDMSSDNDSYHSDEFLTNSKSDEDRQLANSLESVGPIDYVLPSCGIIASAPRLGSRSQSLSSTDSSVHAPSEITVAHGSGLGKGQESPLKKSPSAGDVHILTGFAKPMDIYCHRFVQDAQNKVTHLSETRSVSQQASQERNQMTNQVSNETQSESTEQTPSRPSQLDVSLSATGPQFLSVEPAHSVASQKTPTSASSMLELETGLHVTPSPSESSSSRAVSPFAKIRSSMVQVASITQAGLTHGINFAVSKVQKSPPEPEIINQVQQNELKKMFIQCQTRIIQI

SEQ ID NO: 40448 - protein, 57 aa, Homo sapiens
  Payload ID: 8230
  Gene Symbol: INPP5F
  Gene Name: inositol polyphosphate-5-phosphatase F
  ENSP ID: ENSP00000487706
MRLHYRYKEASGYFHTLRAVMRNPEEDGKDTLQCIAEMLQITKQAMGSDLPIIEKKL

SEQ ID NO: 40449 - protein, 105 aa, Homo sapiens
  Payload ID: 8230
  Gene Symbol: INPP5F
  Gene Name: inositol polyphosphate-5-phosphatase F
  ENSP ID: ENSP00000488052
MRLHYRYKEASGYFHTLRAVMRNPEEDGKDTLQCIAEMLQITKQAMGSDLPIIEKKLERKSSKPHEDIIGIRSQNQGSLAQGKNFLMSKFSSLNQKVKQTKSNVN

SEQ ID NO: 40450 - protein, 183 aa, Homo sapiens
  Payload ID: 8230
  Gene Symbol: INPP5F
  Gene Name: inositol polyphosphate-5-phosphatase F
  ENSP ID: ENSP00000488726
MPRSHRPPPTAQRAATAAAAEPKSEGVVAMTFKIFLLFAGLMVKVPVGLYFSCKLLLFQSLMLMSPEDSGFYATIVAVVGLHVQQFSECTLIDATHRDVDVLLLLSNSAYYVAYYDDEVDKVNQYQRLSLENLEKIEIGPEPTLFGKPKFSCMRLHYRYKEASGYFHTLRAVMRNPEEDGKDT

SEQ ID NO: 40451 - protein, 82 aa, Homo sapiens
  Payload ID: 8230
  Gene Symbol: INPP5F
  Gene Name: inositol polyphosphate-5-phosphatase F
  ENSP ID: ENSP00000488905
MRLHYRYKEASGYFHTLRAVMRNPEEDGKDTLQCIAEMLQITKQAMGSDLPIIEKKLERKSSKPHEDIIGIRSQNQGSLAQG

SEQ ID NO: 40452 - protein, 1006 aa, Homo sapiens
  Payload ID: 8231
  Gene Symbol: INPP5J
  Gene Name: inositol polyphosphate-5-phosphatase J
  Uniprot ID: Q15735
  ENSP ID: ENSP00000333262
MEGQSSRGSRRPGTRAGLGSLPMPQGVAQTGAPSKVDSSFQLPAKKNAALGPSEPRLALAPVGPRAAMSASSEGPRLALASPRPILAPLCTPEGQKTATAHRSSSLAPTSVGQLVMSASAGPKPPPATTGSVLAPTSLGLVMPASAGPRSPPVTLGPNLAPTSRDQKQEPPASVGPKPTLAASGLSLALASEEQPPELPSTPSPVPSPVLSPTQEQALAPASTASGAASVGQTSARKRDAPAPRPLPASEGHLQPPAQTSGPTGSPPCIQTSPDPRLSPSFRARPEALHSSPEDPVLPRPPQTLPLDVGQGPSEPGTHSPGLLSPTFRPGAPSGQTVPPPLPKPPRSPSRSPSHSPNRSPCVPPAPDMALPRLGTQSTGPGRCLSPNLQAQEAPAPVTTSSSTSTLSSSPWSAQPTWKSDPGFRITVVTWNVGTAMPPDDVTSLLHLGGGDDSDGADMIAIGLQEVNSMLNKRLKDALFTDQWSELFMDALGPFNFVLVSSVRMQGVILLLFAKYYHLPFLRDVQTDCTRTGLGGYWGNKGGVSVRLAAFGHMLCFLNCHLPAHMDKAEQRKDNFQTILSLQQFQGPGAQGILDHDLVFWFGDLNFRIESYDLHFVKFAIDSDQLHQLWEKDQLNMAKNTWPILKGFQEGPLNFAPTFKFDVGTNKYDTSAKKRKPAWTDRILWKVKAPGGGPSPSGRKSHRLQVTQHSYRSHMEYTVSDHKPVAAQFLLQFAFRDDMPLVRLEVADEWVRPEQAVVRYRMETVFARSSWDWIGLYRVGFRHCKDYVAYVWAKHEDVDGNTYQVTFSEESLPKGHGDFILGYYSHNHSILIGITEPFQISLPSSELASSSTDSSGTSSEGEDDSTLELLAPKSRSPSPGKSKRHRSRSPGLARFPGLALRPSSRERRGASRSPSPQSRRLSRVAPDRSSNGSSRGSSEEGPSGLPGPWAFPPAVPRSLGLLPALRLETVDPGGGGSWGPDREALAPNSLSPSPQGHRGLEEGGLGP

SEQ ID NO: 40453 - protein, 639 aa, Homo sapiens
  Payload ID: 8231
  Gene Symbol: INPP5J
  Gene Name: inositol polyphosphate-5-phosphatase J
  Uniprot ID: Q15735
  ENSP ID: ENSP00000383150
MALPRLGTQSTGPGRCLSPNLQAQEAPAPVTTSSSTSTLSSSPWSAQPTWKSDPGFRITVVTWNVGTAMPPDDVTSLLHLGGGDDSDGADMIAIGLQEVNSMLNKRLKDALFTDQWSELFMDALGPFNFVLVSSVRMQGVILLLFAKYYHLPFLRDVQTDCTRTGLGGYWGNKGGVSVRLAAFGHMLCFLNCHLPAHMDKAEQRKDNFQTILSLQQFQGPGAQGILDHDLVFWFGDLNFRIESYDLHFVKFAIDSDQLHQLWEKDQLNMAKNTWPILKGFQEGPLNFAPTFKFDVGTNKYDTSAKKRKPAWTDRILWKVKAPGGGPSPSGRKSHRLQVTQHSYRSHMEYTVSDHKPVAAQFLLQFAFRDDMPLVRLEVADEWVRPEQAVVRYRMETVFARSSWDWIGLYRVGFRHCKDYVAYVWAKHEDVDGNTYQVTFSEESLPKGHGDFILGYYSHNHSILIGITEPFQISLPSSELASSSTDSSGTSSEGEDDSTLELLAPKSRSPSPGKSKRHRSRSPGLARFPGLALRPSSRERRGASRSPSPQSRRLSRVAPDRSSNGSSRGSSEEGPSGLPGPWAFPPAVPRSLGLLPALRLETVDPGGGGSWGPDREALAPNSLSPSPQGHRGLEEGGLGP

SEQ ID NO: 40454 - protein, 638 aa, Homo sapiens
  Payload ID: 8231
  Gene Symbol: INPP5J
  Gene Name: inositol polyphosphate-5-phosphatase J
  Uniprot ID: Q15735
  ENSP ID: ENSP00000384534
MEGQSSRGSRRPGTRAGLGSLPMPQGVAQTGAPSKVDSSFQLPAKKNAALGPSEPRITVVTWNVGTAMPPDDVTSLLHLGGGDDSDGADMIAIGLQEVNSMLNKRLKDALFTDQWSELFMDALGPFNFVLVSSVRMQGVILLLFAKYYHLPFLRDVQTDCTRTGLGGYWGNKGGVSVRLAAFGHMLCFLNCHLPAHMDKAEQRKDNFQTILSLQQFQGPGAQGILDHDLVFWFGDLNFRIESYDLHFVKFAIDSDQLHQLWEKDQLNMAKNTWPILKGFQEGPLNFAPTFKFDVGTNKYDTSAKKRKPAWTDRILWKVKAPGGGPSPSGRKSHRLQVTQHSYRSHMEYTVSDHKPVAAQFLLQFAFRDDMPLVRLEVADEWVRPEQAVVRYRMETVFARSSWDWIGLYRVGFRHCKDYVAYVWAKHEDVDGNTYQVTFSEESLPKGHGDFILGYYSHNHSILIGITEPFQISLPSSELASSSTDSSGTSSEGEDDSTLELLAPKSRSPSPGKSKRHRSRSPGLARFPGLALRPSSRERRGASRSPSPQSRRLSRVAPDRSSNGSSRGSSEEGPSGLPGPWAFPPAVPRSLGLLPALRLETVDPGGGGSWGPDREALAPNSLSPSPQGHRGLEEGGLGP

SEQ ID NO: 40455 - protein, 371 aa, Homo sapiens
  Payload ID: 8231
  Gene Symbol: INPP5J
  Gene Name: inositol polyphosphate-5-phosphatase J
  ENSP ID: ENSP00000384540
MAKNTWPILKGFQEGPLNFAPTFKFDVGTNKYDTSAKKRKPAWTDRILWKVKAPGGGPSPSGRKSHRLQVTQHSYRSHMEYTVSDHKPVAAQFLLQFAFRDDMPLVRLEVADEWVRPEQAVVRYRMETVFARSSWDWIGLYRVGFRHCKDYVAYVWAKHEDVDGNTYQVTFSEESLPKGHGDFILGYYSHNHSILIGITEPFQISLPSSELASSSTDSSGTSSEGEDDSTLELLAPKSRSPSPGKSKRHRSRSPGLARFPGLALRPSSRERRGASRSPSPQSRRLSRVAPDRSSNGSSRGSSEEGPSGLPGPWAFPPAVPRSLGLLPALRLETVDPGGGGSWGPDREALAPNSLSPSPQGHRGLEEGGLGP

SEQ ID NO: 40456 - protein, 639 aa, Homo sapiens; identical to SEQ ID NO: 40453
  Payload ID: 8231
  Gene Symbol: INPP5J
  Gene Name: inositol polyphosphate-5-phosphatase J
  Uniprot ID: Q15735
  ENSP ID: ENSP00000384596

SEQ ID NO: 40457 - protein, 345 aa, Homo sapiens
  Payload ID: 8231
  Gene Symbol: INPP5J
  Gene Name: inositol polyphosphate-5-phosphatase J
  ENSP ID: ENSP00000385264
MAKNTWPILKGFQEGPLNFAPTFKFDVGTNKYDTSAKKRKPAWTDRILWKVKAPGGGPSPSGRKSHRLQVTQHSYRSHMEYTVSDHKPVAAQFLLQFAFRDDMPLVRLEVADEWVRPEQAVVRYRMETVFARSSWDWIGLYRVTFSEESLPKGHGDFILGYYSHNHSILIGITEPFQISLPSSELASSSTDSSGTSSEGEDDSTLELLAPKSRSPSPGKSKRHRSRSPGLARFPGLALRPSSRERRGASRSPSPQSRRLSRVAPDRSSNGSSRGSSEEGPSGLPGPWAFPPAVPRSLGLLPALRLETVDPGGGGSWGPDREALAPNSLSPSPQGHRGLEEGGLGP

SEQ ID NO: 40458 - protein, 371 aa, Homo sapiens; identical to SEQ ID NO: 40455
  Payload ID: 8231
  Gene Symbol: INPP5J
  Gene Name: inositol polyphosphate-5-phosphatase J
  ENSP ID: ENSP00000385343

SEQ ID NO: 40459 - protein, 939 aa, Homo sapiens
  Payload ID: 8231
  Gene Symbol: INPP5J
  Gene Name: inositol polyphosphate-5-phosphatase J
  ENSP ID: ENSP00000392924
MSASSEGPRLALASPRPILAPLCTPEGQKTATAHRSSSLAPTSVGQLVMSASAGPKPPPATTGSVLAPTSLGLVMPASAGPRSPPVTLGPNLAPTSRDQKQEPPASVGPKPTLAASGLSLALASEEQPPELPSTPSPVPSPVLSPTQEQALAPASTASGAASVGQTSARKRDAPAPRPLPASEGHLQPPAQTSGPTGSPPCIQTSPDPRLSPSFRARPEALHSSPEDPVLPRPPQTLPLDVGQGPSEPGTHSPGLLSPTFRPGAPSGQTVPPPLPKPPRSPSRSPSHSPNRSPCVPPAPDMALPRLGTQSTGPGRCLSPNLQAQEAPAPVTTSSSTSTLSSSPWSAQPTWKSDPGFRITVVTWNVGTAMPPDDVTSLLHLGGGDDSDGADMIAIGLQEVNSMLNKRLKDALFTDQWSELFMDALGPFNFVLVSSVRMQGVILLLFAKYYHLPFLRDVQTDCTRTGLGGYWGNKGGVSVRLAAFGHMLCFLNCHLPAHMDKAEQRKDNFQTILSLQQFQGPGAQGILDHDLVFWFGDLNFRIESYDLHFVKFAIDSDQLHQLWEKDQLNMAKNTWPILKGFQEGPLNFAPTFKFDVGTNKYDTSAKKRKPAWTDRILWKVKAPGGGPSPSGRKSHRLQVTQHSYRSHMEYTVSDHKPVAAQFLLQFAFRDDMPLVRLEVADEWVRPEQAVVRYRMETVFARSSWDWIGLYRVGFRHCKDYVAYVWAKHEDVDGNTYQVTFSEESLPKGHGDFILGYYSHNHSILIGITEPFQISLPSSELASSSTDSSGTSSEGEDDSTLELLAPKSRSPSPGKSKRHRSRSPGLARFPGLALRPSSRERRGASRSPSPQSRRLSRVAPDRSSNGSSRGSSEEGPSGLPGPWAFPPAVPRSLGLLPALRLETVDPGGGGSWGPDREALAPNSLSPSPQGHRGLEEGGLGP

SEQ ID NO: 40460 - protein, 144 aa, Homo sapiens
  Payload ID: 8231
  Gene Symbol: INPP5J
  Gene Name: inositol polyphosphate-5-phosphatase J
  ENSP ID: ENSP00000401124
MSASSEGPRLALASPRPILAPLCTPEGQKTATAHRSSSLAPTSVGQLVMSASAGPKPPPATTGSVLAPTSLGLVMPASAGPRSPPVTLGPNLAPTSRDQKQEPPASVGPKPTLAASGLSLALASEEQPPELPSTPSPVPSPVLS

SEQ ID NO: 40461 - protein, 102 aa, Homo sapiens
  Payload ID: 8231
  Gene Symbol: INPP5J
  Gene Name: inositol polyphosphate-5-phosphatase J
  ENSP ID: ENSP00000406570
MPPDDVTSLLHLGGGDDSDGADMIAIGLQEVNSMLNKRLKDALFTDQWSELFMDALGPFNFVLVSSVRMQGVILLLFAKYYHLPFLRDVQTDCTRTGLGGYW

SEQ ID NO: 40462 - protein, 571 aa, Homo sapiens
  Payload ID: 8231
  Gene Symbol: INPP5J
  Gene Name: inositol polyphosphate-5-phosphatase J
  ENSP ID: ENSP00000479645
MPPDDVTSLLHLGGGDDSDGADMIAIGLQEVNSMLNKRLKDALFTDQWSELFMDALGPFNFVLVSSVRMQGVILLLFAKYYHLPFLRDVQTDCTRTGLGGYWGNKGGVSVRLAAFGHMLCFLNCHLPAHMDKAEQRKDNFQTILSLQQFQGPGAQGILDHDLVFWFGDLNFRIESYDLHFVKFAIDSDQLHQLWEKDQLNMAKNTWPILKGFQEGPLNFAPTFKFDVGTNKYDTSAKKRKPAWTDRILWKVKAPGGGPSPSGRKSHRLQVTQHSYRSHMEYTVSDHKPVAAQFLLQFAFRDDMPLVRLEVADEWVRPEQAVVRYRMETVFARSSWDWIGLYRVGFRHCKDYVAYVWAKHEDVDGNTYQVTFSEESLPKGHGDFILGYYSHNHSILIGITEPFQISLPSSELASSSTDSSGTSSEGEDDSTLELLAPKSRSPSPGKSKRHRSRSPGLARFPGLALRPSSRERRGASRSPSPQSRRLSRVAPDRSSNGSSRGSSEEGPSGLPGPWAFPPAVPRSLGLLPALRLETVDPGGGGSWGPDREALAPNSLSPSPQGHRGLEEGGLGP

SEQ ID NO: 40463 - protein, 63 aa, Homo sapiens
  Payload ID: 8232
  Gene Symbol: INPP5K
  Gene Name: inositol polyphosphate-5-phosphatase K
  ENSP ID: ENSP00000254712
MSSRKLSGPKGRRLRSPMSVCRGSSYWSLPSISICPISRFCLLNPPPLACLGTGGTKVESTSA

SEQ ID NO: 40464 - protein, 372 aa, Homo sapiens
  Payload ID: 8232
  Gene Symbol: INPP5K
  Gene Name: inositol polyphosphate-5-phosphatase K
  Uniprot ID: Q9BT40
  ENSP ID: ENSP00000318476
MDVLSPLSFIKVSHVRMQGILLLVFAKYQHLPYIQILSTKSTPTGLFGYWGNKGGVNICLKLYGYYVSIINCHLPPHISNNYQRLEHFDRILEMQNCEGRDIPNILDHDLIIWFGDMNFRIEDFGLHFVRESIKNRCYGGLWEKDQLSIAKKHDPLLREFQEGRLLFPPTYKFDRNSNDYDTSEKKRKPAWTDRILWRLKRQPCAGPDTPIPPASHFSLSLRGYSSHMTYGISDHKPVSGTFDLELKPLVSAPLIVLMPEDLWTVENDMMVSYSSTSDFPSSPWDWIGLYKVGLRDVNDYVSYAWVGDSKVSCSDNLNQVYIDISNIPTTEDEFLLCYYSNSLRSVVGISRPFQIPPGSLREDPLGEAQPQI

SEQ ID NO: 40465 - protein, 372 aa, Homo sapiens; identical to SEQ ID NO: 40464
  Payload ID: 8232
  Gene Symbol: INPP5K
  Gene Name: inositol polyphosphate-5-phosphatase K
  Uniprot ID: Q9BT40
  ENSP ID: ENSP00000385177

SEQ ID NO: 40466 - protein, 52 aa, Homo sapiens
  Payload ID: 8232
  Gene Symbol: INPP5K
  Gene Name: inositol polyphosphate-5-phosphatase K
  ENSP ID: ENSP00000389334
MSSRKLSGPKGRRLSIHVVTWNVASAAPPLDLSDLLQLNNRNLNLDIYVIGN

SEQ ID NO: 40467 - protein, 229 aa, Homo sapiens
  Payload ID: 8232
  Gene Symbol: INPP5K
  Gene Name: inositol polyphosphate-5-phosphatase K
  ENSP ID: ENSP00000413259
MQGILLLVFAKYQHLPYIQILSTKSTPTGLFGYWGNKGGVNICLKLYGYYVSIINCHLPPHISNNYQRLEHFDRILEMQNCEGRDIPNILDHDLIIWFGDMNFRIEDFGLHFVRESIKNRCYGGLWEKDQLSIAKKHDPLLREFQEGRLLFPPTYKFDRNSNDYDTSEKKRKPAWTDRILWRLKRQPCAGPDTPIPPASHFSLSLRGYSSHMTYGISDHKPVSGTFDLE

SEQ ID NO: 40468 - protein, 448 aa, Homo sapiens
  Payload ID: 8232
  Gene Symbol: INPP5K
  Gene Name: inositol polyphosphate-5-phosphatase K
  Uniprot ID: Q9BT40
  ENSP ID: ENSP00000413937
MSSRKLSGPKGRRLSIHVVTWNVASAAPPLDLSDLLQLNNRNLNLDIYVIGLQELNSGIISLLSDAAFNDSWSSFLMDVLSPLSFIKVSHVRMQGILLLVFAKYQHLPYIQILSTKSTPTGLFGYWGNKGGVNICLKLYGYYVSIINCHLPPHISNNYQRLEHFDRILEMQNCEGRDIPNILDHDLIIWFGDMNFRIEDFGLHFVRESIKNRCYGGLWEKDQLSIAKKHDPLLREFQEGRLLFPPTYKFDRNSNDYDTSEKKRKPAWTDRILWRLKRQPCAGPDTPIPPASHFSLSLRGYSSHMTYGISDHKPVSGTFDLELKPLVSAPLIVLMPEDLWTVENDMMVSYSSTSDFPSSPWDWIGLYKVGLRDVNDYVSYAWVGDSKVSCSDNLNQVYIDISNIPTTEDEFLLCYYSNSLRSVVGISRPFQIPPGSLREDPLGEAQPQI

SEQ ID NO: 40469 - protein, 84 aa, Homo sapiens
  Payload ID: 8232
  Gene Symbol: INPP5K
  Gene Name: inositol polyphosphate-5-phosphatase K
  ENSP ID: ENSP00000458413
MDVLSPLSFIKVSHVRMQGILLLVFAKYQHLPYIQILSTKSTPTGLFGYWGNKGGVNICLKLYGYYVSIINCHLPPHISNNYQR

SEQ ID NO: 40470 - protein, 51 aa, Homo sapiens
  Payload ID: 8232
  Gene Symbol: INPP5K
  Gene Name: inositol polyphosphate-5-phosphatase K
  ENSP ID: ENSP00000459029
MSSRKLSGPKGRRLRSPAAAGTPHRVPRTHARLFLVSAGSVAPARSVLRTV

SEQ ID NO: 40471 - protein, 158 aa, Homo sapiens
  Payload ID: 8232
  Gene Symbol: INPP5K
  Gene Name: inositol polyphosphate-5-phosphatase K
  ENSP ID: ENSP00000459758
MSSRKLSGPKGRRLSIHVVTWNVASAAPPLDLSDLLQLNNRNLNLDIYVIGLQELNSGIISLLSDAAFNDSWSSFLMDVLSPLSFIKVSHVRMQGILLLVFAKYQHLPYIQILSTKSTPTGLFGYWLSIAKKHDPLLREFQEGRLLFPPTYKFDRNSN

SEQ ID NO: 40472 - protein, 154 aa, Homo sapiens
  Payload ID: 8232
  Gene Symbol: INPP5K
  Gene Name: inositol polyphosphate-5-phosphatase K
  ENSP ID: ENSP00000461105
MSSRKLSGPKGRRLSEKKRKPAWTDRILWRLKRQPCAGPDTPIPPASHFSLSLRGYSSHMTYGISDHKPVSGTFDLELKPLVSAPLIVLMPEDLWTVENDMMVSYSSTSDFPSSPWDWIGLYKVGLRDVNDYVSYAWVGDSKVSCSDNLNQVYI

SEQ ID NO: 40473 - protein, 99 aa, Homo sapiens
  Payload ID: 8232
  Gene Symbol: INPP5K
  Gene Name: inositol polyphosphate-5-phosphatase K
  ENSP ID: ENSP00000461846
MSSRKLSGPKGRRLSIHVVTWNVASAAPPLDLSDLLQLNNRNLNLDIYVIGSPMSVCRGSSYWSLPSISICPISRFCLLNPPPLACLGTGGTKVESTSA

SEQ ID NO: 40474 - protein, 38 aa, Homo sapiens
  Payload ID: 8232
  Gene Symbol: INPP5K
  Gene Name: inositol polyphosphate-5-phosphatase K
  ENSP ID: ENSP00000466632
  MOD_RES (1)..(1): Any amino acid
XIHVVTWNVASAAPPLDLSDLLQLNNRNLNLDIYVIGN

SEQ ID NO: 40475 - protein, 23 aa, Homo sapiens
  Payload ID: 8232
  Gene Symbol: INPP5K
  Gene Name: inositol polyphosphate-5-phosphatase K
  ENSP ID: ENSP00000466929
MQGILLLVFAKYQHLPYIQILST

SEQ ID NO: 40476 - protein, 50 aa, Homo sapiens
  Payload ID: 8232
  Gene Symbol: INPP5K
  Gene Name: inositol polyphosphate-5-phosphatase K
  ENSP ID: ENSP00000467376
MDVLSPLSFIKVSHVRMQGILLLVFAKYQHLPYIQILSTKSTPTGLFGYW

SEQ ID NO: 40477 - protein, 277 aa, Homo sapiens
  Payload ID: 8233
  Gene Symbol: IMPA1
  Gene Name: inositol(myo)-1(or 4)-monophosphatase 1
  Uniprot ID: P29218
  ENSP ID: ENSP00000256108
MADPWQECMDYAVTLARQAGEVVCEAIKNEMNVMLKSSPVDLVTATDQKVEKMLISSIKEKYPSHSFIGEESVAAGEKSILTDNPTWIIDPIDGTTNFVHRFPFVAVSIGFAVNKKIEFGVVYSCVEGKMYTARKGKGAFCNGQKLQVSQQEDITKSLLVTELGSSRTPETVRMVLSNMEKLFCIPVHGIRSVGTAAVNMCLVATGGADAYYEMGIHCWDVAGAGIIVTEAGGVLMDVTGGPFDLMSRRVIAANNRILAERIAKEIQVIPLQRDDED

SEQ ID NO: 40478 - protein, 198 aa, Homo sapiens
  Payload ID: 8233
  Gene Symbol: IMPA1
  Gene Name: inositol(myo)-1(or 4)-monophosphatase 1
  Uniprot ID: P29218
  ENSP ID: ENSP00000311803
MADPWQECMDYAVTLARQAGEVVCEAIKNEMNVMLKSSPVDLVTATDQKVEKMLISSIKEKYPSHSFIGEESVAAGEKSILTDNPTWIIDPIDGTTNFVHRFPFVAVSIGFAVNKKIEFGVVYSCVEGKMYTARKGKGAFCNGQKLQVSQQEGSGVLEQQLLICALWQLAEQMHIMKWEFTAGMLQELALLLLKLVAC

SEQ ID NO: 40479 - protein, 336 aa, Homo sapiens
  Payload ID: 8233
  Gene Symbol: IMPA1
  Gene Name: inositol(myo)-1(or 4)-monophosphatase 1
  Uniprot ID: P29218
  ENSP ID: ENSP00000408526
MGQRPGPVLPAVAVLGQVAKRKVAWLLRWKAVTRTETAGNSSGVYGFGKMKIFVKYFQKMADPWQECMDYAVTLARQAGEVVCEAIKNEMNVMLKSSPVDLVTATDQKVEKMLISSIKEKYPSHSFIGEESVAAGEKSILTDNPTWIIDPIDGTTNFVHRFPFVAVSIGFAVNKKIEFGVVYSCVEGKMYTARKGKGAFCNGQKLQVSQQEDITKSLLVTELGSSRTPETVRMVLSNMEKLFCIPVHGIRSVGTAAVNMCLVATGGADAYYEMGIHCWDVAGAGIIVTEAGGVLMDVTGGPFDLMSRRVIAANNRILAERIAKEIQVIPLQRDDED

SEQ ID NO: 40480 - protein, 109 aa, Homo sapiens
  Payload ID: 8233
  Gene Symbol: IMPA1
  Gene Name: inositol(myo)-1(or 4)-monophosphatase 1
  ENSP ID: ENSP00000428425
MADPWQECMDYAVTLARQAGEVVCEAIKNEMNVMLKSSPVDLVTATDQKVEKMLISSIKEKYPSHSFIGEESVAAGEKSILTDNPTWIIDPIDGTTNFVHSCFNWLCCK

SEQ ID NO: 40481 - protein, 126 aa, Homo sapiens
  Payload ID: 8233
  Gene Symbol: IMPA1
  Gene Name: inositol(myo)-1(or 4)-monophosphatase 1
  ENSP ID: ENSP00000428594
MADPWQECMDYAVTLARQAGEVVCEAIKNEMNVMLKSSPVDLVTATDQKVEKMLISSIKEKYPSHSFIGEESVAAGEKSILTDNPTWIIDPIDGTTNFVHRFPFVAVSIGFAVNKKVWNRRFFPRL

SEQ ID NO: 40482 - protein, 101 aa, Homo sapiens
  Payload ID: 8233
  Gene Symbol: IMPA1
  Gene Name: inositol(myo)-1(or 4)-monophosphatase 1
  ENSP ID: ENSP00000428812
MADPWQECMDYAVTLARQAGEVVCEAIKNEMNVMLKSSPVDLVTATDQKVEKMLISSIKEKYPSHSFIGEESVAAGEKSILTDNPTWIIDPIDGTTNFVHR

SEQ ID NO: 40483 - protein, 180 aa, Homo sapiens
  Payload ID: 8233
  Gene Symbol: IMPA1
  Gene Name: inositol(myo)-1(or 4)-monophosphatase 1
  ENSP ID: ENSP00000429322
MHGLCSNSSKTSWRVCEAIKNEMNVMLKSSPVDLVTATDQKVEKMLISSIKEKYPSHSFIGEESVAAGEKSILTDNPTWIIDPIDGTTNFVHRFPFVAVSIGFAVNKKIEFGVVYSCVEGKMYTARKGKGAFCNGQKLQVSQQEDITKSLLVTELGSSRTPETVRMVLSNMEKLFCIPVH

SEQ ID NO: 40484 - protein, 174 aa, Homo sapiens
  Payload ID: 8233
  Gene Symbol: IMPA1
  Gene Name: inositol(myo)-1(or 4)-monophosphatase 1
  ENSP ID: ENSP00000429516
MADPWQECMDYAVTLARQAGEVVCEAIKNEMNVMLKSSPVDLVTATDQKVEKMLISSIKEKYPSHSFIGEESVAAGEKSILTDNPTWIIDPIDGTTNFVHRWSFPLVGQAEMQWRSLGSLQPPPPGFKRFFCLSLPTVSIGFAVNKKIEFGVVYSCVEGKMYTARKGKGAFCNG

SEQ ID NO: 40485 - protein, 265 aa, Homo sapiens
  Payload ID: 8233
  Gene Symbol: IMPA1
  Gene Name: inositol(myo)-1(or 4)-monophosphatase 1
  ENSP ID: ENSP00000429735
  MOD_RES (1)..(1): Any amino acid
XWKAVTRTETAGNSSGVYGFGKMKKMADPWQECMDYAVTLARQAGEVVCEAIKNEMNVMLKSSPVDLVTATDQKVEKMLISSIKEKYPSHSFIGEESVAAGEKSILTDNPTWIIDPIDGTTNFVHRFPFVAVSIGFAVNKKIEFGVVYSCVEGKMYTARKGKGAFCNGQKLQVSQQEDITKSLLVTELGSSRTPETVRMVLSNMEKLFCIPVHGIRSVGTAAVNMCLVATGGADAYYEMGIHCWDVAGAGIIVTEAGGVLMDVTG

SEQ ID NO: 40486 - protein, 211 aa, Homo sapiens
  Payload ID: 8233
  Gene Symbol: IMPA1
  Gene Name: inositol(myo)-1(or 4)-monophosphatase 1
  ENSP ID: ENSP00000430081
MGQRPGPVLPAVAVLGQVAKRKVAWLLRWKAVTRTETAGNSSGVYGFGKMKIFVKYFQKMADPWQECMDYAVTLARQAGEVVCEAIKNEMNVMLKSSPVDLVTATDQKVEKMLISSIKEKYPSHSFIGEESVAAGEKSILTDNPTWIIDPIDGTTNFVHRFPFVAVSIGFAVNKKIEFGVVYSCVEGKMYTARKGKGAFCNGQKLQVSQQE

SEQ ID NO: 40487 - protein, 153 aa, Homo sapiens
  Payload ID: 8233
  Gene Symbol: IMPA1
  Gene Name: inositol(myo)-1(or 4)-monophosphatase 1
  ENSP ID: ENSP00000430283
MADPWQECMDYAVTLARQAGEVVCEAIKNEMNVMLKSSPVDLVTATDQKVEKMLISSIKEKYPSHRFPFVAVSIGFAVNKKIEFGVVYSCVEGKMYTARKGKGAFCNGQKLQVSQQEDITKSLLVTELGSSRTPETVRMVLSNMEKLFCIPVH

SEQ ID NO: 40488 - protein, 288 aa, Homo sapiens
  Payload ID: 8234
  Gene Symbol: IMPA2
  Gene Name: inositol(myo)-1(or 4)-monophosphatase 2
  Uniprot ID: O14732
  ENSP ID: ENSP00000269159
MKPSGEDQAALAAGPWEECFQAAVQLALRAGQIIRKALTEEKRVSTKTSAADLVTETDHLVEDLIISELRERFPSHRFIAEEAAASGAKCVLTHSPTWIIDPIDGTCNFVHRFPTVAVSIGFAVRQELEFGVIYHCTEERLYTGRRGRGAFCNGQRLRVSGETDLSKALVLTEIGPKRDPATLKLFLSNMERLLHAKAHGVRVIGSSTLALCHLASGAADAYYQFGLHCWDLAAATVIIREAGGIVIDTSGGPLDLMACRVVAASTREMAMLIAQALQTINYGRDDEK

SEQ ID NO: 40489 - protein, 85 aa, Homo sapiens
  Payload ID: 8234
  Gene Symbol: IMPA2
  Gene Name: inositol(myo)-1(or 4)-monophosphatase 2
  ENSP ID: ENSP00000372867
MKPSGEDQAALAAGPWEECFQAAVQLALRAGQIIRKALTEEKRVSTKTSAADLVTETDHLVEDLIISELRERFPSHRSPFSLVHM

SEQ ID NO: 40490 - protein, 126 aa, Homo sapiens
  Payload ID: 8234
  Gene Symbol: IMPA2
  Gene Name: inositol(myo)-1(or 4)-monophosphatase 2
  ENSP ID: ENSP00000464754
  MOD_RES (1)..(1): Any amino acid
XHSPTWIIDPIDGTCNFVHRFPTVAVSIGFAVRQELEFGVIYHCTEERLYTGRRGRGAFCNGQRLRVSGETEMGLRHAAQAGLEVLTSKRSAHLSLAKCWDYRHEPPRPAHESLKGLGSDRNWPQT

SEQ ID NO: 40491 - protein, 99 aa, Homo sapiens
  Payload ID: 8234
  Gene Symbol: IMPA2
  Gene Name: inositol(myo)-1(or 4)-monophosphatase 2
  ENSP ID: ENSP00000464767
MERLLHAKAHGVRVIGSSTLALCHLASGAADAYYQFGLHCWDLAAATVIIREAGGIVIDTSGGPLDLMACRVVAASTREMAMLIAQALQTINYGRDDEK

SEQ ID NO: 40492 - protein, 99 aa, Homo sapiens; identical to SEQ ID NO: 40491
  Payload ID: 8234
  Gene Symbol: IMPA2
  Gene Name: inositol(myo)-1(or 4)-monophosphatase 2
  ENSP ID: ENSP00000465416

SEQ ID NO: 40493 - protein, 116 aa, Homo sapiens
  Payload ID: 8234
  Gene Symbol: IMPA2
  Gene Name: inositol(myo)-1(or 4)-monophosphatase 2
  ENSP ID: ENSP00000465938
MKPSGEDQAALAAGPWEECFQAAVQLALRAGQIIRKALTEEKRVSTKTSAADLVTETDHLVEDLIISELRERFPSHRFIAEEAAASGAKCVLTHSPTWIIDPIDGTCNFVHSLNSE

SEQ ID NO: 40494 - protein, 163 aa, Homo sapiens
  Payload ID: 8234
  Gene Symbol: IMPA2
  Gene Name: inositol(myo)-1(or 4)-monophosphatase 2
  ENSP ID: ENSP00000466059
MKPSGEDQAALAAGPWEECFQAAVQLALRAGQIIRKALTEEKRVSTKTSAADLVTETDHLVEDLIISELRERFPSHRFIAEEAAASGAKCVLTHSPTWIIDPIDGTCNFVHRFPTVAVSIGFAVRQEVRVWPRSPGPLPGLPLAILPFWLQPLCAWFAVCPVP

SEQ ID NO: 40495 - protein, 85 aa, Homo sapiens; identical to SEQ ID NO: 40489
  Payload ID: 8234
  Gene Symbol: IMPA2
  Gene Name: inositol(myo)-1(or 4)-monophosphatase 2
  ENSP ID: ENSP00000486461

SEQ ID NO: 40496 - protein, 558 aa, Homo sapiens
  Payload ID: 8235
  Gene Symbol: ISYNA1
  Gene Name: inositol-3-phosphate synthase 1
  Uniprot ID: Q9NPH2
  ENSP ID: ENSP00000337746
MEAAAQFFVESPDVVYGPEAIEAQYEYRTTRVSREGGVLKVHPTSTRFTFRTARQVPRLGVMLVGWGGNNGSTLTAAVLANRLRLSWPTRSGRKEANYYGSLTQAGTVSLGLDAEGQEVFVPFSAVLPMVAPNDLVFDGWDISSLNLAEAMRRAKVLDWGLQEQLWPHMEALRPRPSVYIPEFIAANQSARADNLIPGSRAQQLEQIRRDIRDFRSSAGLDKVIVLWTANTERFCEVIPGLNDTAENLLRTIELGLEVSPSTLFAVASILEGCAFLNGSPQNTLVPGALELAWQHRVFVGGDDFKSGQTKVKSVLVDFLIGSGLKTMSIVSYNHLGNNDGENLSAPLQFRSKEVSKSNVVDDMVQSNPVLYTPGEEPDHCVVIKYVPYVGDSKRALDEYTSELMLGGTNTLVLHNTCEDSLLAAPIMLDLALLTELCQRVSFCTDMDPEPQTFHPVLSLLSFLFKAPLVPPGSPVVNALFRQRSCIENILRACVGLPPQNHMLLEHKMERPGPSLKRVGPVAATYPMLNKKGPVPAATNGCTGDANGHLQEEPPMPTT

SEQ ID NO: 40497 - protein, 504 aa, Homo sapiens
  Payload ID: 8235
  Gene Symbol: ISYNA1
  Gene Name: inositol-3-phosphate synthase 1
  Uniprot ID: Q9NPH2
  ENSP ID: ENSP00000415458
MEAAAQFFVESPDVVYGPEAIEAQYEYRTTRVSREGGVLKEANYYGSLTQAGTVSLGLDAEGQEVFVPFSAVLPMVAPNDLVFDGWDISSLNLAEAMRRAKVLDWGLQEQLWPHMEALRPRPSVYIPEFIAANQSARADNLIPGSRAQQLEQIRRDIRDFRSSAGLDKVIVLWTANTERFCEVIPGLNDTAENLLRTIELGLEVSPSTLFAVASILEGCAFLNGSPQNTLVPGALELAWQHRVFVGGDDFKSGQTKVKSVLVDFLIGSGLKTMSIVSYNHLGNNDGENLSAPLQFRSKEVSKSNVVDDMVQSNPVLYTPGEEPDHCVVIKYVPYVGDSKRALDEYTSELMLGGTNTLVLHNTCEDSLLAAPIMLDLALLTELCQRVSFCTDMDPEPQTFHPVLSLLSFLFKAPLVPPGSPVVNALFRQRSCIENILRACVGLPPQNHMLLEHKMERPGPSLKRVGPVAATYPMLNKKGPVPAATNGCTGDANGHLQEEPPMPTT

SEQ ID NO: 40498 - protein, 177 aa, Homo sapiens
  Payload ID: 8235
  Gene Symbol: ISYNA1
  Gene Name: inositol-3-phosphate synthase 1
  ENSP ID: ENSP00000462001
MEAAAQFFVESPDVVYGPEAIEAQYEYRTTRVSREGGVLKVHPTSTRFTFRTARQVPRLGVMLVGWGGNNGSTLTAAVLANRLRLSWPTRSGRKLEQIRRDIRDFRSSAGLDKVIVLWTANTERFCEVIPGLNDTAENLLRTIELGLEVSPSTLFAVASILEGCAFLNGSPQNTLVP

SEQ ID NO: 40499 - protein, 46 aa, Homo sapiens
  Payload ID: 8235
  Gene Symbol: ISYNA1
  Gene Name: inositol-3-phosphate synthase 1
  ENSP ID: ENSP00000463271
MEAAAQFFVESPDVVYGPEAIEAQYEYRTTRVSREGGVLKAGTSRR

SEQ ID NO: 40500 - protein, 182 aa, Homo sapiens
  Payload ID: 8235
  Gene Symbol: ISYNA1
  Gene Name: inositol-3-phosphate synthase 1
  ENSP ID: ENSP00000463500
MEAAAQFFVESPDVVYGPEAIEAQYEYRTTRVSREGGVLKVDQGAEEGGVLGRAGRLGEKGTGPGIHCAACLQVHPTSTRFTFRTARQVPRLGVMLVGWGGNNGSTLTAAVLANRLRLSWPTRSGRKEANYYGSLTQAGTVSLGLDAEGQEVFVPFSAVLPMVAPNDLVFDGWDISSLNLAE

SEQ ID NO: 40501 - protein, 46 aa, Homo sapiens; identical to SEQ ID NO: 40499
  Payload ID: 8235
  Gene Symbol: ISYNA1
  Gene Name: inositol-3-phosphate synthase 1
  ENSP ID: ENSP00000463628

SEQ ID NO: 40502 - protein, 151 aa, Homo sapiens
  Payload ID: 8235
  Gene Symbol: ISYNA1
  Gene Name: inositol-3-phosphate synthase 1
  ENSP ID: ENSP00000464209
MEAAAQFFVESPDVVYGPEAIEAQYEYRTTRVSREGGVLKVHPTSTRFTFRTARQVPRLGVMLVGWGGNNGSTLTAAVLANRLRLSWPTRSGRKEANYYGSLTQAGTVSLGLDAEGQEVFVPFSAVLPMVAPNDLVFDAGADPQGHPRLPV

SEQ ID NO: 40503 - protein, 148 aa, Homo sapiens
  Payload ID: 8235
  Gene Symbol: ISYNA1
  Gene Name: inositol-3-phosphate synthase 1
  ENSP ID: ENSP00000464430
MEAAAQFFVESPDVVYGPEAIEAQYEYRTTRVSREGGVLKVHPTSTRFTFRTARQVPRLGVMLVGWGGNNGSTLTAAVLANRLRLSWPTRSGRKEANYYGSLTQAGTVSLGLDAEGQEVFVPFSAVLPMVAPNDLVFDGWDISSLNLA

SEQ ID NO: 40504 - protein, 233 aa, Homo sapiens
  Payload ID: 8235
  Gene Symbol: ISYNA1
  Gene Name: inositol-3-phosphate synthase 1
  ENSP ID: ENSP00000464528
  MOD_RES (1)..(1): Any amino acid
XNHLGNNDGENLSAPLQFRSKEVSKSNVVDDMVQSNPVLYTPGEEPDHCVVIKYVPYVGDSKRALDEYTSELMLGGTNTLVLHNTCEDSLLAAPIMLDLALLTELCQRVSFCTDMDPEPQTFHPVLSLLSFLFKAPLVPPGSPVVNALFRQRSCIENILRCTPASRACVGLPPQNHMLLEHKMERPGPSLKRVGPVAATYPMLNKKGPVPAATNGCTGDANGHLQEEPPMPTT

SEQ ID NO: 40505 - protein, 430 aa, Homo sapiens
  Payload ID: 8235
  Gene Symbol: ISYNA1
  Gene Name: inositol-3-phosphate synthase 1
  Uniprot ID: Q9NPH2
  ENSP ID: ENSP00000475677
MVAPNDLVFDGWDISSLNLAEAMRRAKVLDWGLQEQLWPHMEALRPRPSVYIPEFIAANQSARADNLIPGSRAQQLEQIRRDIRDFRSSAGLDKVIVLWTANTERFCEVIPGLNDTAENLLRTIELGLEVSPSTLFAVASILEGCAFLNGSPQNTLVPGALELAWQHRVFVGGDDFKSGQTKVKSVLVDFLIGSGLKTMSIVSYNHLGNNDGENLSAPLQFRSKEVSKSNVVDDMVQSNPVLYTPGEEPDHCVVIKYVPYVGDSKRALDEYTSELMLGGTNTLVLHNTCEDSLLAAPIMLDLALLTELCQRVSFCTDMDPEPQTFHPVLSLLSFLFKAPLVPPGSPVVNALFRQRSCIENILRACVGLPPQNHMLLEHKMERPGPSLKRVGPVAATYPMLNKKGPVPAATNGCTGDANGHLQEEPPMPTT

SEQ ID NO: 40506 - protein, 414 aa, Homo sapiens
  Payload ID: 8236
  Gene Symbol: ITPK1
  Gene Name: inositol-tetrakisphosphate 1-kinase
  Uniprot ID: Q13572
  ENSP ID: ENSP00000267615
MQTFLKGKRVGYWLSEKKIKKLNFQAFAELCRKRGMEVVQLNLSRPIEEQGPLDVIIHKLTDVILEADQNDSQSLELVHRFQEYIDAHPETIVLDPLPAIRTLLDRSKSYELIRKIEAYMEDDRICSPPFMELTSLCGDDTMRLLEKNGLTFPFICKTRVAHGTNSHEMAIVFNQEGLNAIQPPCVVQNFINHNAVLYKVFVVGESYTVVQRPSLKNFSAGTSDRESIFFNSHNVSKPESSSVLTELDKIEGVFERPSDEVIRELSRALRQALGVSLFGIDIIINNQTGQHAVIDINAFPGYEGVSEFFTDLLNHIATVLQGQSTAMAATGDVALLRHSKLLAEPAGGLVGERTCSASPGCCGSMMGQDAPWKAEADAGGTAKLPHQRLGCNAGVSPSFQQHCVASLATKASSQ

SEQ ID NO: 40507 - protein, 314 aa, Homo sapiens
  Payload ID: 8236
  Gene Symbol: ITPK1
  Gene Name: inositol-tetrakisphosphate 1-kinase
  Uniprot ID: Q13572
  ENSP ID: ENSP00000346272
MQTFLKGKRVGYWLSEKKIKKLNFQAFAELCRKRGMEVVQLNLSRPIEEQGPLDVIIHKLTDVILEADQNDSQSLELVHRFQEYIDAHPETIVLDPLPAIRTLLDRSKSYELIRKIEAYMEDDRICSPPFMELTSLCGDDTMRLLEKNGLTFPFICKTRVAHGTNSHEMAIVFNQEGLNAIQPPCVVQNFINHNAVLYKVFVVGESYTVVQRPSLKNFSAGTSDRESIFFNSHNVSKPESSSVLTELDKIEGVFERPSDEVIRELSRALRQALGVSLFGIDIIINNQTGQHAVIDINAFPGDCQVCFIEGWKTD

SEQ ID NO: 40508 - protein, 168 aa, Homo sapiens
  Payload ID: 8236
  Gene Symbol: ITPK1
  Gene Name: inositol-tetrakisphosphate 1-kinase
  ENSP ID: ENSP00000450421
MQTFLKGKRVGYWLSEKKIKKLNFQAFAELCRKRGMEVVQLNLSRPIEEQGPLDVIIHKLTDVILEADQNDSQSLELVHRFQEYIDAHPETIVLDPLPAIRTLLDRSKSYELIRKIEAYMEDDRICSPPFMELTSLCGDDTMRLLEKNGLTFPFICKTRVAHGTNSHE

SEQ ID NO: 40509 - protein, 414 aa, Homo sapiens; identical to SEQ ID NO: 40506
  Payload ID: 8236
  Gene Symbol: ITPK1
  Gene Name: inositol-tetrakisphosphate 1-kinase
  Uniprot ID: Q13572
  ENSP ID: ENSP00000451091

SEQ ID NO: 40510 - protein, 181 aa, Homo sapiens
  Payload ID: 8236
  Gene Symbol: ITPK1
  Gene Name: inositol-tetrakisphosphate 1-kinase
  ENSP ID: ENSP00000451154
MQTFLKGKRVGYWLSEKKIKKLNFQAFAELCRKRGMEVVQEYIDAHPETIVLDPLPAIRTLLDRSKSYELIRKIEAYMEDDRICSPPFMELTSLCGDDTMRLLEKNGLTFPFICKTRVAHGTNSHEMAIVFNQEGLNAIQPPCVVQNFINHNAVLYKVFVVGESYTVVQRPSLKNFSAGTS

SEQ ID NO: 40511 - protein, 295 aa, Homo sapiens
  Payload ID: 8236
  Gene Symbol: ITPK1
  Gene Name: inositol-tetrakisphosphate 1-kinase
  ENSP ID: ENSP00000451893
MEDDRICSPPFMELTSLCGDDTMRLLEKNGLTFPFICKTRVAHGTNSHEMAIVFNQEGLNAIQPPCVVQNFINHNAVLYKVFVVGESYTVVQRPSLKNFSAGTSDRESIFFNSHNVSKPESSSVLTELDKIEGVFERPSDEVIRELSRALRQALGVSLFGIDIIINNQTGQHAVIDINAFPGYEGVSEFFTDLLNHIATVLQGQSTAMAATGDVALLRHSKLLAEPAGGLVGERTCSASPGCCGSMMGQDAPWKAEADAGGTAKLPHQRLGCNAGVSPSFQQHCVASLATKASSQ

SEQ ID NO: 40512 - protein, 168 aa, Homo sapiens; identical to SEQ ID NO: 40508
  Payload ID: 8236
  Gene Symbol: ITPK1
  Gene Name: inositol-tetrakisphosphate 1-kinase
  ENSP ID: ENSP00000452230

SEQ ID NO: 40513 - protein, 206 aa, Homo sapiens
  Payload ID: 8236
  Gene Symbol: ITPK1
  Gene Name: inositol-tetrakisphosphate 1-kinase
  ENSP ID: ENSP00000452258
MQTFLKGKRVGYWLSEKKIKKLNFQAFAELCRKRGMEVVQLNLSRPIEEQGPLDVIIHKLTDVILEADQNDSQSLELVHRFQEYIDAHPETIVLDPLPAIRTLLDRSKSYELIRKIEAYMEGLPSALDDRICSPPFMELTSLCGDDTMRLLEKNGLTFPFICKTRVAHGTNSHEMAIVFNQEGLNAIQPPCVVQNFINHNAVLYKV

SEQ ID NO: 40514 - protein, 314 aa, Homo sapiens; identical to SEQ ID NO: 40507
  Payload ID: 8236
  Gene Symbol: ITPK1
  Gene Name: inositol-tetrakisphosphate 1-kinase
  Uniprot ID: Q13572
  ENSP ID: ENSP00000480918

SEQ ID NO: 40515 - protein, 414 aa, Homo sapiens; identical to SEQ ID NO: 40506
  Payload ID: 8236
  Gene Symbol: ITPK1
  Gene Name: inositol-tetrakisphosphate 1-kinase
  Uniprot ID: Q13572
  ENSP ID: ENSP00000483767

SEQ ID NO: 40516 - protein, 206 aa, Homo sapiens; identical to SEQ ID NO: 40513
  Payload ID: 8236
  Gene Symbol: ITPK1
  Gene Name: inositol-tetrakisphosphate 1-kinase
  ENSP ID: ENSP00000486255

SEQ ID NO: 40517 - protein, 168 aa, Homo sapiens; identical to SEQ ID NO: 40508
  Payload ID: 8236
  Gene Symbol: ITPK1
  Gene Name: inositol-tetrakisphosphate 1-kinase
  ENSP ID: ENSP00000486438

SEQ ID NO: 40518 - protein, 181 aa, Homo sapiens; identical to SEQ ID NO: 40510
  Payload ID: 8236
  Gene Symbol: ITPK1
  Gene Name: inositol-tetrakisphosphate 1-kinase
  ENSP ID: ENSP00000486466

SEQ ID NO: 40519 - protein, 295 aa, Homo sapiens; identical to SEQ ID NO: 40511
  Payload ID: 8236
  Gene Symbol: ITPK1
  Gene Name: inositol-tetrakisphosphate 1-kinase
  ENSP ID: ENSP00000486579

SEQ ID NO: 40520 - protein, 168 aa, Homo sapiens; identical to SEQ ID NO: 40508
  Payload ID: 8236
  Gene Symbol: ITPK1
  Gene Name: inositol-tetrakisphosphate 1-kinase
  ENSP ID: ENSP00000486971

SEQ ID NO: 40521 - protein, 414 aa, Homo sapiens; identical to SEQ ID NO: 40506
  Payload ID: 8236
  Gene Symbol: ITPK1
  Gene Name: inositol-tetrakisphosphate 1-kinase
  Uniprot ID: Q13572
  ENSP ID: ENSP00000486991

SEQ ID NO: 40522 - protein, 461 aa, Homo sapiens
  Payload ID: 8237
  Gene Symbol: ITPKA
  Gene Name: inositol-trisphosphate 3-kinase A
  Uniprot ID: P23677
  ENSP ID: ENSP00000260386
MTLPGGPTGMARPGGARPCSPGLERAPRRSVGELRLLFEARCAAVAAAAAAGEPRARGAKRRGGQVPNGLPRAPPAPVIPQLTVTAEEPDVPPTSPGPPERERDCLPAAGSSHLQQPRRLSTSSVSSTGSSSLLEDSEDDLLSDSESRSRGNVQLEAGEDVGQKNHWQKIRTMVNLPVISPFKKRYAWVQLAGHTGSFKAAGTSGLILKRCSEPERYCLARLMADALRGCVPAFHGVVERDGESYLQLQDLLDGFDGPCVLDCKMGVRTYLEEELTKARERPKLRKDMYKKMLAVDPEAPTEEEHAQRAVTKPRYMQWREGISSSTTLGFRIEGIKKADGSCSTDFKTTRSREQVLRVFEEFVQGDEEVLRRYLNRLQQIRDTLEVSEFFRRHEVIGSSLLFVHDHCHRAGVWLIDFGKTTPLPDGQILDHRRPWEEGNREDGYLLGLDNLIGILASLAER

SEQ ID NO: 40523 - protein, 260 aa, Homo sapiens
  Payload ID: 8237
  Gene Symbol: ITPKA
  Gene Name: inositol-trisphosphate 3-kinase A
  ENSP ID: ENSP00000396560
MNTQRNPRNGQPRRLSTSSVSSTGSSSLLEDSEDDLLSDSESRSRGNVQLEAGEDVGQKNHWQKIRTMVNLPVISPFKKRYAWVQLAGHTGSFKAAGTSGLILKRCSEPERYCLARLMADALRGCVPAFHGVVERDGESYLQLQDLLDGFDGPCVLDCKMGVRTYLEEELTKARERPKLRKDMYKKMLAVDPEAPTEEEHAQRAVTKPRYMQWREGISSSTTLGFRIEGIKKADGSCSTDFKTTRSREQVLRVFEEFVQG

SEQ ID NO: 40524 - protein, 946 aa, Homo sapiens
  Payload ID: 8238
  Gene Symbol: ITPKB
  Gene Name: inositol-trisphosphate 3-kinase B
  Uniprot ID: P27987
  ENSP ID: ENSP00000272117
MAVYCYALNSLVIMNSANEMKSGGGPGPSGSETPPPPRRAVLSPGSVFSPGRGASFLFPPAESLSPEEPRSPGGWRSGRRRLNSSSGSGSGSSGSSVSSPSWAGRLRGDRQQVVAAGTLSPPGPEEAKRKLRILQRELQNVQVNQKVGMFEAHIQAQSSAIQAPRSPRLGRARSPSPCPFRSSSQPPGRVLVQGARSEERRTKSWGEQCPETSGTDSGRKGGPSLCSSQVKKGMPPLPGRAAPTGSEAQGPSAFVRMEKGIPASPRCGSPTAMEIDKRGSPTPGTRSCLAPSLGLFGASLTMATEVAARVTSTGPHRPQDLALTEPSGRARELEDLQPPEALVERQGQFLGSETSPAPERGGPRDGEPPGKMGKGYLPCGMPGSGEPEVGKRPEETTVSVQSAESSDSLSWSRLPRALASVGPEEARSGAPVGGGRWQLSDRVEGGSPTLGLLGGSPSAQPGTGNVEAGIPSGRMLEPLPCWDAAKDLKEPQCPPGDRVGVQPGNSRVWQGTMEKAGLAWTRGTGVQSEGTWESQRQDSDALPSPELLPQDPDKPFLRKACSPSNIPAVIITDMGTQEDGALEETQGSPRGNLPLRKLSSSSASSTGFSSSYEDSEEDISSDPERTLDPNSAFLHTLDQQKPRVSKSWRKIKNMVHWSPFVMSFKKKYPWIQLAGHAGSFKAAANGRILKKHCESEQRCLDRLMVDVLRPFVPAYHGDVVKDGERYNQMDDLLADFDSPCVMDCKMGIRTYLEEELTKARKKPSLRKDMYQKMIEVDPEAPTEEEKAQRAVTKPRYMQWRETISSTATLGFRIEGIKKEDGTVNRDFKKTKTREQVTEAFREFTKGNHNILIAYRDRLKAIRTTLEVSPFFKCHEVIGSSLLFIHDKKEQAKVWMIDFGKTTPLPEGQTLQHDVPWQEGNREDGYLSGLNNLVDILTEMSQDAPLA

SEQ ID NO: 40525 - protein, 644 aa, Homo sapiens
  Payload ID: 8238
  Gene Symbol: ITPKB
  Gene Name: inositol-trisphosphate 3-kinase B
  Uniprot ID: P27987
  ENSP ID: ENSP00000355748
MAVYCYALNSLVIMNSANEMKSGGGPGPSGSETPPPPRRAVLSPGSVFSPGRGASFLFPPAESLSPEEPRSPGGWRSGRRRLNSSSGSGSGSSGSSVSSPSWAGRLRGDRQQVVAAGTLSPPGPEEAKRKLRILQRELQNVQVNQKVGMFEAHIQAQSSAIQAPRSPRLGRARSPSPCPFRSSSQPPGRVLVQGARSEERRTKSWGEQCPETSGTDSGRKGGPSLCSSQVKKGMPPLPGRAAPTGSEAQGPSAFVRMEKGIPASPRCGSPTAMEIDKRGSPTPGTRSCLAPSLGLFGASLTMATEVAARVTSTGPHRPQDLALTEPSGRARELEDLQPPEALVERQGQFLGSETSPAPERGGPRDGEPPGKMGKGYLPCGMPGSGEPEVGKRPEETTVSVQSAESSDSLSWSRLPRALASVGPEEARSGAPVGGGRWQLSDRVEGGSPTLGLLGGSPSAQPGTGNVEAGIPSGRMLEPLPCWDAAKDLKEPQCPPGDRVGVQPGNSRVWQGTMEKAGLAWTRGTGVQSEGTWESQRQDSDALPSPELLPQDPDKPFLRKACSPSNIPAVIITDMGTQEDGALEETQGSPRGNLPLRKLSSSSASSTGFSSSYEDSEEDISSDPERTLDPNSAFLHTLDQQKPRV

SEQ ID NO: 40526 - protein, 946 aa, Homo sapiens; identical to SEQ ID NO: 40524
  Payload ID: 8238
  Gene Symbol: ITPKB
  Gene Name: inositol-trisphosphate 3-kinase B
  Uniprot ID: P27987
  ENSP ID: ENSP00000411152

SEQ ID NO: 40527 - protein, 683 aa, Homo sapiens
  Payload ID: 8239
  Gene Symbol: ITPKC
  Gene Name: inositol-trisphosphate 3-kinase C
  Uniprot ID: Q96DU7
  ENSP ID: ENSP00000263370
MRRCPCRGSLNEAEAGALPAAARMGLEAPRGGRRRQPGQQRPGPGAGAPAGRPEGGGPWARTEGSSLHSEPERAGLGPAPGTESPQAEFWTDGQTEPAAAGLGVETERPKQKTEPDRSSLRTHLEWSWSELETTCLWTETGTDGLWTDPHRSDLQFQPEEASPWTQPGVHGPWTELETHGSQTQPERVKSWADNLWTHQNSSSLQTHPEGACPSKEPSADGSWKELYTDGSRTQQDIEGPWTEPYTDGSQKKQDTEAARKQPGTGGFQIQQDTDGSWTQPSTDGSQTAPGTDCLLGEPEDGPLEEPEPGELLTHLYSHLKCSPLCPVPRLIITPETPEPEAQPVGPPSRVEGGSGGFSSASSFDESEDDVVAGGGGASDPEDRSGSKPWKKLKTVLKYSPFVVSFRKHYPWVQLSGHAGNFQAGEDGRILKRFCQCEQRSLEQLMKDPLRPFVPAYYGMVLQDGQTFNQMEDLLADFEGPSIMDCKMGSRTYLEEELVKARERPRPRKDMYEKMVAVDPGAPTPEEHAQGAVTKPRYMQWRETMSSTSTLGFRIEGIKKADGTCNTNFKKTQALEQVTKVLEDFVDGDHVILQKYVACLEELREALEISPFFKTHEVVGSSLLFVHDHTGLAKVWMIDFGKTVALPDHQTLSHRLPWAEGNREDGYLWGLDNMICLLQGLAQS

SEQ ID NO: 40528 - protein, 50 aa, Homo sapiens
  Payload ID: 8239
  Gene Symbol: ITPKC
  Gene Name: inositol-trisphosphate 3-kinase C
  ENSP ID: ENSP00000472655
MVLQDGQTFNQMEDLLADFEGPSIMDCKMGSRRQMGPVTPTSRRRRHWSR

SEQ ID NO: 40529 - protein, 579 aa, Homo sapiens
  Payload ID: 8240
  Gene Symbol: INSC
  Gene Name: inscuteable homolog (Drosophila)
  Uniprot ID: Q1MX18
  ENSP ID: ENSP00000368872
MRRPPGNGEAASEGPGGWGLWGVQESRRLCCAGHDRCKQALLQIGINMMALPGGRHLDSVTLPGQRLHLMQVDSVQRWMEDLKLMTECECMCVLQAKPISLEEDAQGDLILAGGPGPGDPLQLLLKRGWVISTELRRIGQKLAQDRWARVHSMSVRLTCHARSMVSEYSAVSRNSLKEMGEIEKLLMEKCSELSAVTERCLQVENEHVLKSMKACVSETLSMLGQHFGQLLELALTREVQALVRKIDASDNIYTTESTTGNLFSLTQEGAPLCRIIAKEGGVVALFKVCRQDSFRCLYPQALRTLASICCVEEGVHQLEKVDGVLCLADILTDNSHSEATRAEAAAVVAQVTSPHLPVTQHLSSFLESMEEIVTALVKLCQEASSGEVFLLASAALANITFFDTMACEMLLQLNAIRVLLEACSDKQRVDTPYTRDQIVTILANMSVLEQCASDIIQENGVQLIMGMLSEKPRSGTPAEVAACERVQQKAAVTLARLSRDPDVAREAVRLSCMSRLIELCRSPSERNSSDAVLVACLAALRRLAGVCPEGLQDSDFQQLVQPRLVDSFLLCSNMEESFV

SEQ ID NO: 40530 - protein, 532 aa, Homo sapiens
  Payload ID: 8240
  Gene Symbol: INSC
  Gene Name: inscuteable homolog (Drosophila)
  Uniprot ID: Q1MX18
  ENSP ID: ENSP00000368874
MMALPGGRHLDSVTLPGQRLHLMQVDSVQRWMEDLKLMTECECMCVLQAKPISLEEDAQGDLILAGGPGPGDPLQLLLKRGWVISTELRRIGQKLAQDRWARVHSMSVRLTCHARSMVSEYSAVSRNSLKEMGEIEKLLMEKCSELSAVTERCLQVENEHVLKSMKACVSETLSMLGQHFGQLLELALTREVQALVRKIDASDNIYTTESTTGNLFSLTQEGAPLCRIIAKEGGVVALFKVCRQDSFRCLYPQALRTLASICCVEEGVHQLEKVDGVLCLADILTDNSHSEATRAEAAAVVAQVTSPHLPVTQHLSSFLESMEEIVTALVKLCQEASSGEVFLLASAALANITFFDTMACEMLLQLNAIRVLLEACSDKQRVDTPYTRDQIVTILANMSVLEQCASDIIQENGVQLIMGMLSEKPRSGTPAEVAACERVQQKAAVTLARLSRDPDVAREAVRLSCMSRLIELCRSPSERNSSDAVLVACLAALRRLAGVCPEGLQDSDFQQLVQPRLVDSFLLCSNMEESFV

SEQ ID NO: 40531 - protein, 566 aa, Homo sapiens
  Payload ID: 8240
  Gene Symbol: INSC
  Gene Name: inscuteable homolog (Drosophila)
  ENSP ID: ENSP00000389161
MALPGGRHLDSVTLPGQRLHLMQVDSVQRWMEDLKLMTECECMCVLQAKPISLEEDAQGDLILAGGPGPGDPLQLLLKRGWVISTELRRIGQKLAQDRWARVHSMSVRLTCHARSMVSEYSAVSRNSLKEMGEIEKLLMEKCSELSAVTERCLQVENEHVLKSMKACVSETLSMLGQHFGQLLELALTREVQVESHSVTRLECSGAISAQCNLRLLGSSDSPASASQALVRKIDASDNIYTTESTTGNLFSLTQEGAPLCRIIAKEGGVVALFKVCRQDSFRCLYPQALRTLASICCVEEGVHQLEKVDGVLCLADILTDNSHSEATRAEAAAVVAQVTSPHLPVTQHLSSFLESMEEIVTALVKLCQEASSGEVFLLASAALANITFFDTMACEMLLQLNAIRVLLEACSDKQRVDTPYTRDQIVTILANMSVLEQCASDIIQENGVQLIMGMLSEKPRSGTPAEVAACERVQQKAAVTLARLSRDPDVAREAVRLSCMSRLIELCRSPSERNSSDAVLVACLAALRRLAGVCPEGLQDSDFQQLVQPRLVDSFLLCSNMEESFV

SEQ ID NO: 40532 - protein, 520 aa, Homo sapiens
  Payload ID: 8240
  Gene Symbol: INSC
  Gene Name: inscuteable homolog (Drosophila)
  Uniprot ID: Q1MX18
  ENSP ID: ENSP00000435022
MMALPGGRHLDSVTLPGQRLHLMQVDSVQRWMEDLKLMTECECMCVLQAKPISLEEDAQGDLILAGGPGPGDPLQLLLKRGWVISTELRRIGQKLAQDRWARVHSMSVRLTCHARSMVSEYSAVSRNSLKEMGEIEKLLMEKCSELSAVTERCLQVENEHVLKSMKACVSETLSMLGQHFGQLLELALTREVQALVRKIDASDNIYTTESTTGNLFSLTQEGAPLCRIIAKEGGVVALFKVCRQDSFRCLYPQALRTLASICCVEEGVHQLEKVDGVLCLADILTDNSHSEATRAEAAAVVAQVTSPHLPVTQHLSSFLESMEEIVTALVKLCQEASSGEVFLLASAALANITFFDTMACEMLLQLNAIRVLLEACSDKQRVDTPYTRDQIVTILANMSVLEQCASDIIQENGVQLIMGMLSEKPRSGTPAEVAACERVQQKAAVTLARLSRDPDVAREAVRLSCMSRLIELCRSPSERNSSDAVLVACLAMGIQLQVKKTNISALLLWFLFWHIQGCSA

SEQ ID NO: 40533 - protein, 490 aa, Homo sapiens
  Payload ID: 8240
  Gene Symbol: INSC
  Gene Name: inscuteable homolog (Drosophila)
  Uniprot ID: Q1MX18
  ENSP ID: ENSP00000436113
MMALPGGRHLDSVTLPGQRLHLMQVDSVQRWMEDLKLMTECECMCVLQAKPISLEEDAQGDLILAGGPGPGDPLQLLLKRGWVISTELRRIGQKLAQDRWARVHSMSVRLTCHARSMVSEYSAVSRNSLKEMGEIEKLLMEKCSELSAVTERCLQVENEHVLKSMKACVSETLSMLGQHFGQLLELALTREVQALVRKIDASDNIYTTESTTGNLFSLTQEGAPLCRIIAKVDGVLCLADILTDNSHSEATRAEAAAVVAQVTSPHLPVTQHLSSFLESMEEIVTALVKLCQEASSGEVFLLASAALANITFFDTMACEMLLQLNAIRVLLEACSDKQRVDTPYTRDQIVTILANMSVLEQCASDIIQENGVQLIMGMLSEKPRSGTPAEVAACERVQQKAAVTLARLSRDPDVAREAVRLSCMSRLIELCRSPSERNSSDAVLVACLAALRRLAGVCPEGLQDSDFQQLVQPRLVDSFLLCSNMEESFV

SEQ ID NO: 40534 - protein, 532 aa, Homo sapiens; identical to SEQ ID NO: 40530
  Payload ID: 8240
  Gene Symbol: INSC
  Gene Name: inscuteable homolog (Drosophila)
  Uniprot ID: Q1MX18
  ENSP ID: ENSP00000436194

SEQ ID NO: 40535 - protein, 200 aa, Homo sapiens
  Payload ID: 8241
  Gene Symbol: INS-IGF2
  Gene Name: INS-IGF2 readthrough
  Uniprot ID: F8WCM5
  ENSP ID: ENSP00000348986
MALWMRLLPLLALLALWGPDPAAAFVNQHLCGSHLVEALYLVCGERGFFYTPKTRREAEDLQASALSLSSSTSTWPEGLDATARAPPALVVTANIGQAGGSSSRQFRQRALGTSDSPVLFIHCPGAAGTAQGLEYRGRRVTTELVWEEVDSSPQPQGSESLPAQPPAQPAPQPEPQQAREPSPEVSCCGLWPRRPQRSQN

SEQ ID NO: 40536 - protein, 200 aa, Homo sapiens; identical to SEQ ID NO: 40535
  Payload ID: 8241
  Gene Symbol: INS-IGF2
  Gene Name: INS-IGF2 readthrough
  Uniprot ID: F8WCM5
  ENSP ID: ENSP00000380440

SEQ ID NO: 40537 - protein, 110 aa, Homo sapiens
  Payload ID: 8242
  Gene Symbol: INS
  Gene Name: insulin
  Uniprot ID: P01308
  ENSP ID: ENSP00000250971
MALWMRLLPLLALLALWGPDPAAAFVNQHLCGSHLVEALYLVCGERGFFYTPKTRREAEDLQVGQVELGGGPGAGSLQPLALEGSLQKRGIVEQCCTSICSLYQLENYCN

SEQ ID NO: 40538 - protein, 110 aa, Homo sapiens; identical to SEQ ID NO: 40537
  Payload ID: 8242
  Gene Symbol: INS
  Gene Name: insulin
  Uniprot ID: P01308
  ENSP ID: ENSP00000370731

SEQ ID NO: 40539 - protein, 110 aa, Homo sapiens; identical to SEQ ID NO: 40537
  Payload ID: 8242
  Gene Symbol: INS
  Gene Name: insulin
  Uniprot ID: P01308
  ENSP ID: ENSP00000380432

SEQ ID NO: 40540 - protein, 92 aa, Homo sapiens
  Payload ID: 8242
  Gene Symbol: INS
  Gene Name: insulin
  ENSP ID: ENSP00000408400
MALWMRLLPLLALLALWGPDPAAAFVNQHLCGSHLVEALYLVCGERGFFYTPKTRREAEDLQAGELLQLDAARRQPHTRRLLHRERWNKALE

SEQ ID NO: 40541 - protein, 98 aa, Homo sapiens
  Payload ID: 8242
  Gene Symbol: INS
  Gene Name: insulin
  ENSP ID: ENSP00000424008
MALWMRLLPLLALLALWGPDPAAAFVNQHLCGSHLVEALYLVCGERGFFYTPKTRREAEDLQGSLQPLALEGSLQKRGIVEQCCTSICSLYQLENYCN

SEQ ID NO: 40542 - protein, 178 aa, Homo sapiens
  Payload ID: 8243
  Gene Symbol: INSIG1
  Gene Name: insulin induced gene 1
  ENSP ID: ENSP00000340010
MPRLHDHFWSCSCAHSARRRGPPRASAKLDFANNVQLSLTLAALSLGLWWTFDRSRSGLGLGITIAFLATLITQFLVYNGVYQYTSPDFLYIRSWLPCIFFSGGVTVGNIGRQLAMLIPFCEELNLKTTWLFHKTRSNYRVFLKSPIVIESSKPPILRARKILEENLTVDYDKDYLFS

SEQ ID NO: 40543 - protein, 164 aa, Homo sapiens
  Payload ID: 8243
  Gene Symbol: INSIG1
  Gene Name: insulin induced gene 1
  Uniprot ID: O15503
  ENSP ID: ENSP00000344035
MPRLHDHFWSCSCAHSARRRGPPRASAAGLAAKVGEMINVSVSGPSLLAAHGAPDADPAPRGRSAAMSGPEPGSPYPNTWHHRLLQRSLVLFSVGVVLALVLNLLQIQRNVTLFPEEVIATIFSSAWWVPPCCGTAAGIHPQISSIFVLGSLVYFSQEASRWGT

SEQ ID NO: 40544 - protein, 277 aa, Homo sapiens
  Payload ID: 8243
  Gene Symbol: INSIG1
  Gene Name: insulin induced gene 1
  Uniprot ID: O15503
  ENSP ID: ENSP00000344741
MPRLHDHFWSCSCAHSARRRGPPRASAAGLAAKVGEMINVSVSGPSLLAAHGAPDADPAPRGRSAAMSGPEPGSPYPNTWHHRLLQRSLVLFSVGVVLALVLNLLQIQRNVTLFPEEVIATIFSSAWWVPPCCGTAAAVVGLLYPCIDSHLGEPHKFKREWASVMRCIAVFVGINHASAKLDFANNVQLSLTLAALSLGLWWTFDRSRSGLGLGITIAFLATLITQFLVYNGVYQYTSPDFLYIRSWLPCIFFSGGVTVGNIGRQLAMGVPEKPHSD

SEQ ID NO: 40545 - protein, 123 aa, Homo sapiens
  Payload ID: 8243
  Gene Symbol: INSIG1
  Gene Name: insulin induced gene 1
  ENSP ID: ENSP00000414691
MPRLHDHFWSCSCAHSARRRGPPRASAAGLAAKVGEMINVSVSGPSLLAAHGAPDADPAPRGRSAAMSGPEPGSPYPNTWHHRLLQRSLVLFSVGVVLALVLNLLQIQRNVTLFPEEVIATIF

SEQ ID NO: 40546 - protein, 239 aa, Homo sapiens
  Payload ID: 8243
  Gene Symbol: INSIG1
  Gene Name: insulin induced gene 1
  ENSP ID: ENSP00000420198
  MOD_RES (1)..(1): Any amino acid
XSVGVVLALVLNLLQIQRNVTLFPEEVIATIFSSAWWVPPCCGTAAAVVGLLYPCIDSHLGEPHKFKREWASVMRCIAVFVGINHASAKLDFANNVQLSLTLAALSLGLWWTFDRSRSGLGLGITIAFLATLITQFLVYNGVYQYTSPDFLYIRSWLPCIFFSGGVTVGNIGRQLAMLIPFCEELNLKTTWLFHKTRSNYRVFLKSPIVIESSKPPILRARKILEENLTVDYDKDYLFS

SEQ ID NO: 40547 - protein, 225 aa, Homo sapiens
  Payload ID: 8244
  Gene Symbol: INSIG2
  Gene Name: insulin induced gene 2
  Uniprot ID: Q9Y5U4
  ENSP ID: ENSP00000245787
MAEGETESPGPKKCGPYISSVTSQSVNLMIRGVVLFFIGVFLALVLNLLQIQRNVTLFPPDVIASIFSSAWWVPPCCGTASAVIGLLYPCIDRHLGEPHKFKREWSSVMRCVAVFVGINHASAKVDFDNNIQLSLTLAALSIGLWWTFDRSRSGFGLGVGIAFLATVVTQLLVYNGVYQYTSPDFLYVRSWLPCIFFAGGITMGNIGRQLAMYECKVIAEKSHQE

SEQ ID NO: 40548 - protein, 39 aa, Homo sapiens
  Payload ID: 8244
  Gene Symbol: INSIG2
  Gene Name: insulin induced gene 2
  ENSP ID: ENSP00000400126
MPVLKWISITTYSCLSHWLHYPLDCGGLLIDLEVVLALE

SEQ ID NO: 40549 - protein, 238 aa, Homo sapiens
  Payload ID: 8244
  Gene Symbol: INSIG2
  Gene Name: insulin induced gene 2
  ENSP ID: ENSP00000484179
MAEGETESPGPKKCGPYISSVTSQSVNLMIRGVVLFFIGVFLALVLNLLQIQRNVTLFPPDVIASIFSSAWWVPPCCGTASAVIGLLYPCIDRHLGEPHKFKREWSSVMRCVAVFVGINHASAKVDFDNNIQLSLTLAALSIGLWWTFDRSRSGFGLGVGIAFLATVVTQLLVYNGVYQYTSPDFLYVRSWLPCIFFAGGITMGNIGRQLAMYECKVIAENLIRNEEGKKYLLYRKAR

SEQ ID NO: 40550 - protein, 1382 aa, Homo sapiens
  Payload ID: 8245
  Gene Symbol: INSR
  Gene Name: insulin receptor
  Uniprot ID: P06213
  ENSP ID: ENSP00000303830
MATGGRRGAAAAPLLVAVAALLLGAAGHLYPGEVCPGMDIRNNLTRLHELENCSVIEGHLQILLMFKTRPEDFRDLSFPKLIMITDYLLLFRVYGLESLKDLFPNLTVIRGSRLFFNYALVIFEMVHLKELGLYNLMNITRGSVRIEKNNELCYLATIDWSRILDSVEDNYIVLNKDDNEECGDICPGTAKGKTNCPATVINGQFVERCWTHSHCQKVCPTICKSHGCTAEGLCCHSECLGNCSQPDDPTKCVACRNFYLDGRCVETCPPPYYHFQDWRCVNFSFCQDLHHKCKNSRRQGCHQYVIHNNKCIPECPSGYTMNSSNLLCTPCLGPCPKVCHLLEGEKTIDSVTSAQELRGCTVINGSLIINIRGGNNLAAELEANLGLIEEISGYLKIRRSYALVSLSFFRKLRLIRGETLEIGNYSFYALDNQNLRQLWDWSKHNLTITQGKLFFHYNPKLCLSEIHKMEEVSGTKGRQERNDIALKTNGDQASCENELLKFSYIRTSFDKILLRWEPYWPPDFRDLLGFMLFYKEAPYQNVTEFDGQDACGSNSWTVVDIDPPLRSNDPKSQNHPGWLMRGLKPWTQYAIFVKTLVTFSDERRTYGAKSDIIYVQTDATNPSVPLDPISVSNSSSQIILKWKPPSDPNGNITHYLVFWERQAEDSELFELDYCLKGLKLPSRTWSPPFESEDSQKHNQSEYEDSAGECCSCPKTDSQILKELEESSFRKTFEDYLHNVVFVPRKTSSGTGAEDPRPSRKRRSLGDVGNVTVAVPTVAAFPNTSSTSVPTSPEEHRPFEKVVNKESLVISGLRHFTGYRIELQACNQDTPEERCSVAAYVSARTMPEAKADDIVGPVTHEIFENNVVHLMWQEPKEPNGLIVLYEVSYRRYGDEELHLCVSRKHFALERGCRLRGLSPGNYSVRIRATSLAGNGSWTEPTYFYVTDYLDVPSNIAKIIIGPLIFVFLFSVVIGSIYLFLRKRQPDGPLGPLYASSNPEYLSASDVFPCSVYVPDEWEVSREKITLLRELGQGSFGMVYEGNARDIIKGEAETRVAVKTVNESASLRERIEFLNEASVMKGFTCHHVVRLLGVVSKGQPTLVVMELMAHGDLKSYLRSLRPEAENNPGRPPPTLQEMIQMAAEIADGMAYLNAKKFVHRDLAARNCMVAHDFTVKIGDFGMTRDIYETDYYRKGGKGLLPVRWMAPESLKDGVFTTSSDMWSFGVVLWEITSLAEQPYQGLSNEQVLKFVMDGGYLDQPDNCPERVTDLMRMCWQFNPKMRPTFLEIVNLLKDDLHPSFPEVSFFHSEENKAPESEELEMEFEDMENVPLDRSSHCQREEAGGRDGGSSLGFKRSYEEHIPYTHMNGGKKNGRILTLPRSNPS

SEQ ID NO: 40551 - protein, 1370 aa, Homo sapiens
  Payload ID: 8245
  Gene Symbol: INSR
  Gene Name: insulin receptor
  Uniprot ID: P06213
  ENSP ID: ENSP00000342838
MATGGRRGAAAAPLLVAVAALLLGAAGHLYPGEVCPGMDIRNNLTRLHELENCSVIEGHLQILLMFKTRPEDFRDLSFPKLIMITDYLLLFRVYGLESLKDLFPNLTVIRGSRLFFNYALVIFEMVHLKELGLYNLMNITRGSVRIEKNNELCYLATIDWSRILDSVEDNYIVLNKDDNEECGDICPGTAKGKTNCPATVINGQFVERCWTHSHCQKVCPTICKSHGCTAEGLCCHSECLGNCSQPDDPTKCVACRNFYLDGRCVETCPPPYYHFQDWRCVNFSFCQDLHHKCKNSRRQGCHQYVIHNNKCIPECPSGYTMNSSNLLCTPCLGPCPKVCHLLEGEKTIDSVTSAQELRGCTVINGSLIINIRGGNNLAAELEANLGLIEEISGYLKIRRSYALVSLSFFRKLRLIRGETLEIGNYSFYALDNQNLRQLWDWSKHNLTITQGKLFFHYNPKLCLSEIHKMEEVSGTKGRQERNDIALKTNGDQASCENELLKFSYIRTSFDKILLRWEPYWPPDFRDLLGFMLFYKEAPYQNVTEFDGQDACGSNSWTVVDIDPPLRSNDPKSQNHPGWLMRGLKPWTQYAIFVKTLVTFSDERRTYGAKSDIIYVQTDATNPSVPLDPISVSNSSSQIILKWKPPSDPNGNITHYLVFWERQAEDSELFELDYCLKGLKLPSRTWSPPFESEDSQKHNQSEYEDSAGECCSCPKTDSQILKELEESSFRKTFEDYLHNVVFVPRPSRKRRSLGDVGNVTVAVPTVAAFPNTSSTSVPTSPEEHRPFEKVVNKESLVISGLRHFTGYRIELQACNQDTPEERCSVAAYVSARTMPEAKADDIVGPVTHEIFENNVVHLMWQEPKEPNGLIVLYEVSYRRYGDEELHLCVSRKHFALERGCRLRGLSPGNYSVRIRATSLAGNGSWTEPTYFYVTDYLDVPSNIAKIIIGPLIFVFLFSVVIGSIYLFLRKRQPDGPLGPLYASSNPEYLSASDVFPCSVYVPDEWEVSREKITLLRELGQGSFGMVYEGNARDIIKGEAETRVAVKTVNESASLRERIEFLNEASVMKGFTCHHVVRLLGVVSKGQPTLVVMELMAHGDLKSYLRSLRPEAENNPGRPPPTLQEMIQMAAEIADGMAYLNAKKFVHRDLAARNCMVAHDFTVKIGDFGMTRDIYETDYYRKGGKGLLPVRWMAPESLKDGVFTTSSDMWSFGVVLWEITSLAEQPYQGLSNEQVLKFVMDGGYLDQPDNCPERVTDLMRMCWQFNPKMRPTFLEIVNLLKDDLHPSFPEVSFFHSEENKAPESEELEMEFEDMENVPLDRSSHCQREEAGGRDGGSSLGFKRSYEEHIPYTHMNGGKKNGRILTLPRSNPS

SEQ ID NO: 40552 - protein, 152 aa, Homo sapiens
  Payload ID: 8245
  Gene Symbol: INSR
  Gene Name: insulin receptor
  ENSP ID: ENSP00000473170
YKEAPYQNVTEFDGQDACGSNSWTVVDIDPPLRSNDPKSQNHPGWLMRGLKPWTQYAIFVKTLVTFSDERRTYGAKSDIIYVQTDATNPSVPLDPISVSNSSSQIILKWKPPSDPNGNITHYLVFWERQAEDSELFELDYCLKGRVQSSAPL

SEQ ID NO: 40553 - protein, 1242 aa, Homo sapiens
  Payload ID: 8246
  Gene Symbol: IRS1
  Gene Name: insulin receptor substrate 1
  Uniprot ID: P35568
  ENSP ID: ENSP00000304895
MASPPESDGFSDVRKVGYLRKPKSMHKRFFVLRAASEAGGPARLEYYENEKKWRHKSSAPKRSIPLESCFNINKRADSKNKHLVALYTRDEHFAIAADSEAEQDSWYQALLQLHNRAKGHHDGAAALGAGGGGGSCSGSSGLGEAGEDLSYGDVPPGPAFKEVWQVILKPKGLGQTKNLIGIYRLCLTSKTISFVKLNSEAAAVVLQLMNIRRCGHSENFFFIEVGRSAVTGPGEFWMQVDDSVVAQNMHETILEAMRAMSDEFRPRSKSQSSSNCSNPISVPLRRHHLNNPPPSQVGLTRRSRTESITATSPASMVGGKPGSFRVRASSDGEGTMSRPASVDGSPVSPSTNRTHAHRHRGSARLHPPLNHSRSIPMPASRCSPSATSPVSLSSSSTSGHGSTSDCLFPRRSSASVSGSPSDGGFISSDEYGSSPCDFRSSFRSVTPDSLGHTPPARGEEELSNYICMGGKGPSTLTAPNGHYILSRGGNGHRCTPGTGLGTSPALAGDEAASAADLDNRFRKRTHSAGTSPTITHQKTPSQSSVASIEEYTEMMPAYPPGGGSGGRLPGHRHSAFVPTRSYPEEGLEMHPLERRGGHHRPDSSTLHTDDGYMPMSPGVAPVPSGRKGSGDYMPMSPKSVSAPQQIINPIRRHPQRVDPNGYMMMSPSGGCSPDIGGGPSSSSSSSNAVPSGTSYGKLWTNGVGGHHSHVLPHPKPPVESSGGKLLPCTGDYMNMSPVGDSNTSSPSDCYYGPEDPQHKPVLSYYSLPRSFKHTQRPGEPEEGARHQHLRLSTSSGRLLYAATADDSSSSTSSDSLGGGYCGARLEPSLPHPHHQVLQPHLPRKVDTAAQTNSRLARPTRLSLGDPKASTLPRAREQQQQQQPLLHPPEPKSPGEYVNIEFGSDQSGYLSGPVAFHSSPSVRCPSQLQPAPREEETGTEEYMKMDLGPGRRAAWQESTGVEMGRLGPAPPGAASICRPTRAVPSSRGDYMTMQMSCPRQSYVDTSPAAPVSYADMRTGIAAEEVSLPRATMAAASSSSAASASPTGPQGAAELAAHSSLLGGPQGPGGMSAFTRVNLSPNRNQSAKVIRADPQGCRRRHSSETFSSTPSATRVGNTVPFGAGAAVGGGGGSSSSSEDVKRHSSASFENVWLRPGELGGAPKEPAKLCGAAGGLENGLNYIDLDLVKDFKQCPQECTPEPQPPPPPPPHQPLGSGESSSTRRSSEDLSAYASISFQKQPEDRQ

SEQ ID NO: 40554 - protein, 1338 aa, Homo sapiens
  Payload ID: 8247
  Gene Symbol: IRS2
  Gene Name: insulin receptor substrate 2
  Uniprot ID: Q9Y4H2
  ENSP ID: ENSP00000365016
MASPPRHGPPGPASGDGPNLNNNNNNNNHSVRKCGYLRKQKHGHKRFFVLRGPGAGGDEATAGGGSAPQPPRLEYYESEKKWRSKAGAPKRVIALDCCLNINKRADAKHKYLIALYTKDEYFAVAAENEQEQEGWYRALTDLVSEGRAAAGDAPPAAAPAASCSASLPGALGGSAGAAGAEDSYGLVAPATAAYREVWQVNLKPKGLGQSKNLTGVYRLCLSARTIGFVKLNCEQPSVTLQLMNIRRCGHSDSFFFIEVGRSAVTGPGELWMQADDSVVAQNIHETILEAMKALKELFEFRPRSKSQSSGSSATHPISVPGARRHHHLVNLPPSQTGLVRRSRTDSLAATPPAAKCSSCRVRTASEGDGGAAAGAAAAGARPVSVAGSPLSPGPVRAPLSRSHTLSGGCGGRGSKVALLPAGGALQHSRSMSMPVAHSPPAATSPGSLSSSSGHGSGSYPPPPGPHPPLPHPLHHGPGQRPSSGSASASGSPSDPGFMSLDEYGSSPGDLRAFCSHRSNTPESIAETPPARDGGGGGEFYGYMTMDRPLSHCGRSYRRVSGDAAQDLDRGLRKRTYSLTTPARQRPVPQPSSASLDEYTLMRATFSGSAGRLCPSCPASSPKVAYHPYPEDYGDIEIGSHRSSSSNLGADDGYMPMTPGAALAGSGSGSCRSDDYMPMSPASVSAPKQILQPRAAAAAAAAVPSAGPAGPAPTSAAGRTFPASGGGYKASSPAESSPEDSGYMRMWCGSKLSMEHADGKLLPNGDYLNVSPSDAVTTGTPPDFFSAALHPGGEPLRGVPGCCYSSLPRSYKAPYTCGGDSDQYVLMSSPVGRILEEERLEPQATPGPSQAASAFGAGPTQPPHPVVPSPVRPSGGRPEGFLGQRGRAVRPTRLSLEGLPSLPSMHEYPLPPEPKSPGEYINIDFGEPGARLSPPAPPLLASAASSSSLLSASSPASSLGSGTPGTSSDSRQRSPLSDYMNLDFSSPKSPKPGAPSGHPVGSLDGLLSPEASSPYPPLPPRPSASPSSSLQPPPPPPAPGELYRLPPASAVATAQGPGAASSLSSDTGDNGDYTEMAFGVAATPPQPIAAPPKPEAARVASPTSGVKRLSLMEQVSGVEAFLQASQPPDPHRGAKVIRADPQGGRRRHSSETFSSTTTVTPVSPSFAHNPKRHNSASVENVSLRKSSEGGVGVGPGGGDEPPTSPRQLQPAPPLAPQGRPWTPGQPGGLVGCPGSGGSPMRRETSAGFQNGLNYIAIDVREEPGLPPQPQPPPPPLPQPGDKSSWGRTRSLGGLISAVGVGSTGGGCGGPGPGALPPANTYASIDFLSHHLKEATIVKE

SEQ ID NO: 40555 - protein, 1257 aa, Homo sapiens
  Payload ID: 8248
  Gene Symbol: IRS4
  Gene Name: insulin receptor substrate 4
  Uniprot ID: O14654
  ENSP ID: ENSP00000361202
MASCSFTRDQATRRLRGAAAAAAAALAAVVTTPLLSSGTPTALIGTGSSCPGAMWLSTATGSRSDSESEEEDLPVGEEVCKRGYLRKQKHGHRRYFVLKLETADAPARLEYYENARKFRHSVRAAAAAAAAAASGAAIPPLIPPRRVITLYQCFSVSQRADARYRHLIALFTQDEYFAMVAENESEQESWYLLLSRLILESKRRRCGTLGAQPDGEPAALAAAAAAEPPFYKDVWQVIVKPRGLGHRKELSGVFRLCLTDEEVVFVRLNTEVASVVVQLLSIRRCGHSEQYFFLEVGRSTVIGPGELWMQVDDCVVAQNMHELFLEKMRALCADEYRARCRSYSISIGAHLLTLLSARRHLGLVPLEPGGWLRRSRFEQFCHLRAIGDGEDEMLFTRRFVTPSEPVAHSRRGRLHLPRGRRSRRAVSVPASFFRRLAPSPARPRHPAEAPNNGARLSSEVSGSGSGNFGEEGNPQGKEDQEGSGGDYMPMNNWGSGNGRGSGGGQGSNGQGSSSHSSGGNQCSGEGQGSRGGQGSNGQGSGGNQCSRDGQGTAGGHGSGGGQRPGGGHGSGGGQGPGDGHGSGGGKNSGGGKGSGSGKGSDGDGERGKSLKKRSYFGKLTQSKQQQMPPPPPPPPPPPPAGGTGGKGKSGGRFRLYFCVDRGATKECKEAKEVKDAEIPEGAARGPHRARAFDEDEDDPYVPMRPGVATPLVSSSDYMPMAPQNVSASKKRHSRSPFEDSRGYMMMFPRVSPPPAPSPPKAPDTNKEDDSKDNDSESDYMFMAPGAGAIPKNPRNPQGGSSSKSWSSYFSLPNPFRSSPLGQNDNSEYVPMLPGKFLGRGLDKEVSYNWDPKDAASKPSGEGSFSKPGDGGSPSKPSDHEPPKNKAKRPNRLSFITKGYKIKPKPQKPTHEQREADSSSDYVNMDFTKRESNTPAPSTQGLPDSWGIIAEPRQSAFSNYVNVEFGVPFPNPANDLSDLLRAIPRANPLSLDSARWPLPPLPLSATGSNAIEEEGDYIEVIFNSAMTPAMALADSAIRYDAETGRIYVVDPFSECCMDISLSPSRCSEPPPVARLLQEEEQERRRPQSRSQSFFAAARAAVSAFPTDSLERDLSPSSAPAVASAAEPTLALSQVVAAASALAAAPGIGAAAAAAGFDSASARWFQPVANAADAEAVRGAQDVAGGSNPGAHNPSANLARGDNQAGGAAAAAAAPEPPPRSRRVPRPPEREDSDNDDDTHVRMDFARRDNQFDSPKRGR

SEQ ID NO: 40556 - protein, 1297 aa, Homo sapiens
  Payload ID: 8249
  Gene Symbol: INSRR
  Gene Name: insulin receptor-related receptor
  Uniprot ID: P14616
  ENSP ID: ENSP00000357178
MAVPSLWPWGACLPVIFLSLGFGLDTVEVCPSLDIRSEVAELRQLENCSVVEGHLQILLMFTATGEDFRGLSFPRLTQVTDYLLLFRVYGLESLRDLFPNLAVIRGTRLFLGYALVIFEMPHLRDVALPALGAVLRGAVRVEKNQELCHLSTIDWGLLQPAPGANHIVGNKLGEECADVCPGVLGAAGEPCAKTTFSGHTDYRCWTSSHCQRVCPCPHGMACTARGECCHTECLGGCSQPEDPRACVACRHLYFQGACLWACPPGTYQYESWRCVTAERCASLHSVPGRASTFGIHQGSCLAQCPSGFTRNSSSIFCHKCEGLCPKECKVGTKTIDSIQAAQDLVGCTHVEGSLILNLRQGYNLEPQLQHSLGLVETITGFLKIKHSFALVSLGFFKNLKLIRGDAMVDGNYTLYVLDNQNLQQLGSWVAAGLTIPVGKIYFAFNPRLCLEHIYRLEEVTGTRGRQNKAEINPRTNGDRAACQTRTLRFVSNVTEADRILLRWERYEPLEARDLLSFIVYYKESPFQNATEHVGPDACGTQSWNLLDVELPLSRTQEPGVTLASLKPWTQYAVFVRAITLTTEEDSPHQGAQSPIVYLRTLPAAPTVPQDVISTSNSSSHLLVRWKPPTQRNGNLTYYLVLWQRLAEDGDLYLNDYCHRGLRLPTSNNDPRFDGEDGDPEAEMESDCCPCQHPPPGQVLPPLEAQEASFQKKFENFLHNAITIPISPWKVTSINKSPQRDSGRHRRAAGPLRLGGNSSDFEIQEDKVPRERAVLSGLRHFTEYRIDIHACNHAAHTVGCSAATFVFARTMPHREADGIPGKVAWEASSKNSVLLRWLEPPDPNGLILKYEIKYRRLGEEATVLCVSRLRYAKFGGVHLALLPPGNYSARVRATSLAGNGSWTDSVAFYILGPEEEDAGGLHVLLTATPVGLTLLIVLAALGFFYGKKRNRTLYASVNPEYFSASDMYVPDEWEVPREQISIIRELGQGSFGMVYEGLARGLEAGEESTPVALKTVNELASPRECIEFLKEASVMKAFKCHHVVRLLGVVSQGQPTLVIMELMTRGDLKSHLRSLRPEAENNPGLPQPALGEMIQMAGEIADGMAYLAANKFVHRDLAARNCMVSQDFTVKIGDFGMTRDVYETDYYRKGGKGLLPVRWMAPESLKDGIFTTHSDVWSFGVVLWEIVTLAEQPYQGLSNEQVLKFVMDGGVLEELEGCPLQLQELMSRCWQPNPRLRPSFTHILDSIQEELRPSFRLLSFYYSPECRGARGSLPTTDAEPDSSPTPRDCSPQNGGPGH

SEQ ID NO: 40557 - protein, 1019 aa, Homo sapiens [sequence omitted]

SEQ ID NO: 40558 - protein, 464 aa, Homo sapiens
  Payload ID: 8250
  Gene Symbol: IDE
  Gene Name: insulin-degrading enzyme
  Uniprot ID: P14735
  ENSP ID: ENSP00000360637
MSKLWFKQDDKFFLPKACLNFEFFSPFAYVDPLHCNMAYLYLELLKDSLNEYAYAAELAGLSYDLQNTIYGMYLSVKGYNDKQPILLKKIIEKMATFEIDEKRFEIIKEAYMRSLNNFRAEQPHQHAMYYLRLLMTEVAWTKDELKEALDDVTLPRLKAFIPQLLSRLHIEALLHGNITKQAALGIMQMVEDTLIEHAHTKPLLPSQLVRYREVQLPDRGWFVYQQRNEVHNNCGIEIYYQTDMQSTSENMFLELFCQIISEPCFNTLRTKEQLGYIVFSGPRRANGIQGLRFIIQSEKPPHYLESRVEAFLITMEKSIEDMTEEAFQKHIQALAIRRLDKPKKLSAECAKYWGEIISQQYNFDRDNTEVAYLKTLTKEDIIKFYKEMLAVDAPRRHKVSVHVLAREMDSCPVVGEFPCQNDINLSQAPALPQPEVIQNMTEFKRGLPLFPLVKPHINFMAAKL

SEQ ID NO: 40559 - protein, 257 aa, Homo sapiens
  Payload ID: 8250
  Gene Symbol: IDE
  Gene Name: insulin-degrading enzyme
  ENSP ID: ENSP00000408850
EFIIRGGRVPSHCLHFSRSFQKKTYSKMNNPAIKRIGNHITKSPEDKREYRGLELANGIKVLLISDPTTDKSSAALDVHIGSLSDPPNIAGLSHFCEHMLFLGTKKYPKENEYSQFLSEHAGSSNAFTSGEHTNYYFDVSHEHLEGALDRFAQFFLCPLFDESCKDREVNAVDSEHEKNVMNDAWRLFQLEKATGNPKHPFSKFGTGNKYTLETRPNQEGIDVRQELLKFHSAYYSSNLMAVCVLGRESLDDLTNLV

SEQ ID NO: 40560 - protein, 61 aa, Homo sapiens
  Payload ID: 8250
  Gene Symbol: IDE
  Gene Name: insulin-degrading enzyme
  ENSP ID: ENSP00000473506
MRYRLAWLLHPALPSTFRSVLGARLPPPERLCGNYQVVFQSSGTILHFHQQCVKIPISLYP

SEQ ID NO: 40561 - protein, 131 aa, Homo sapiens
  Payload ID: 8251
  Gene Symbol: INSL3
  Gene Name: insulin-like 3 (Leydig cell)
  Uniprot ID: P51460
  ENSP ID: ENSP00000321724
MDPRLPAWALVLLGPALVFALGPAPTPEMREKLCGHHFVRALVRVCGGPRWSTEARRPATGGDRELLQWLERRHLLHGLVADSNLTLGPGLQPLPQTSHHHRHHRAAATNPARYCCLSGCTQQDLLTLCPY

SEQ ID NO: 40562 - protein, 157 aa, Homo sapiens
  Payload ID: 8251
  Gene Symbol: INSL3
  Gene Name: insulin-like 3 (Leydig cell)
  Uniprot ID: P51460
  ENSP ID: ENSP00000369017
MDPRLPAWALVLLGPALVFALGPAPTPEMREKLCGHHFVRALVRVCGGPRWSTEARRPATGGDQRESHSVSQAGLKLLSSSNPPTLTFQSVGISDVSCYSGWRDDICSMGWWPTVISRWDLACSPCPRPLTITATTVQLPPTLHATAASVAVPNKTC

SEQ ID NO: 40563 - protein, 71 aa, Homo sapiens
  Payload ID: 8251
  Gene Symbol: INSL3
  Gene Name: insulin-like 3 (Leydig cell)
  ENSP ID: ENSP00000469309
  MOD_RES (1)..(1): Any amino acid
XDPRLPAWALVLLGPALVFALGPAPTPEMREKLCGHHFVRALVRVCGGPRWSTEARRPATGGDPEFHSVPR

SEQ ID NO: 40564 - protein, 139 aa, Homo sapiens
  Payload ID: 8252
  Gene Symbol: INSL4
  Gene Name: insulin-like 4 (placenta)
  Uniprot ID: Q14641
  ENSP ID: ENSP00000239316
MASLFRSYLPAIWLLLSQLLRESLAAELRGCGPRFGKHLLSYCPMPEKTFTTTPGGWLLESGRPKEMVSTSNNKDGQALGTTSEFIPNLSPELKKPLSEGQPSLKKIILSRKKRSGRHRFDPFCCEVICDDGTSVKLCT

SEQ ID NO: 40565 - protein, 135 aa, Homo sapiens
  Payload ID: 8253
  Gene Symbol: INSL5
  Gene Name: insulin-like 5
  Uniprot ID: Q9Y5Q6
  ENSP ID: ENSP00000302724
MKGSIFTLFLFSVLFAISEVRSKESVRLCGLEYIRTVIYICASSRWRRHQEGIPQAQQAETGNSFQLPHKREFSEENPAQNLPKVDASGEDRLWGGQMPTEELWKSKKHSVMSRQDLQTLCCTDGCSMTDLSALC

SEQ ID NO: 40566 - protein, 213 aa, Homo sapiens
  Payload ID: 8254
  Gene Symbol: INSL6
  Gene Name: insulin-like 6
  Uniprot ID: Q9Y581
  ENSP ID: ENSP00000371054
MPRLLRLSLLWLGLLLVRFSRELSDISSARKLCGRYLVKEIEKLCGHANWSQFRFEEETPFSRLIAQASEKVEAYSPYQFESPQTASPARGRGTNPVSTSWEEAVNSWEMQSLPEYKDKKGYSPLGKTREFSSSHNINVYIHENAKFQKKRRNKIKTLSNLFWGHHPQRKRRGYSEKCCLTGCTKEELSIACLPYIDFKRLKEKRSSLVTKIY

SEQ ID NO: 40567 - protein, 195 aa, Homo sapiens
  Payload ID: 8255
  Gene Symbol: IGF1
  Gene Name: insulin-like growth factor 1 (somatomedin C)
  Uniprot ID: P05019
  ENSP ID: ENSP00000302665
MGKISSLPTQLFKCCFCDFLKVKMHTMSSSHLFYLALCLLTFTSSATAGPETLCGAELVDALQFVCGDRGFYFNKPTGYGSSSRRAPQTGIVDECCFRSCDLRRLEMYCAPLKPAKSARSVRAQRHTDMPKTQKYQPPSTNKNTKSQRRKGWPKTHPGGEQKEGTEASLQIRGKKKEQRREIGSRNAECRGKKGK

SEQ ID NO: 40568 - protein, 153 aa, Homo sapiens
  Payload ID: 8255
  Gene Symbol: IGF1
  Gene Name: insulin-like growth factor 1 (somatomedin C)
  Uniprot ID: P05019
  ENSP ID: ENSP00000337612
MGKISSLPTQLFKCCFCDFLKVKMHTMSSSHLFYLALCLLTFTSSATAGPETLCGAELVDALQFVCGDRGFYFNKPTGYGSSSRRAPQTGIVDECCFRSCDLRRLEMYCAPLKPAKSARSVRAQRHTDMPKTQKEVHLKNASRGSAGNKNYRM

SEQ ID NO: 40569 - protein, 158 aa, Homo sapiens
  Payload ID: 8255
  Gene Symbol: IGF1
  Gene Name: insulin-like growth factor 1 (somatomedin C)
  Uniprot ID: P05019
  ENSP ID: ENSP00000376637
MGKISSLPTQLFKCCFCDFLKVKMHTMSSSHLFYLALCLLTFTSSATAGPETLCGAELVDALQFVCGDRGFYFNKPTGYGSSSRRAPQTGIVDECCFRSCDLRRLEMYCAPLKPAKSARSVRAQRHTDMPKTQKYQPPSTNKNTKSQRRKGSTFEERK

SEQ ID NO: 40570 - protein, 139 aa, Homo sapiens
  Payload ID: 8255
  Gene Symbol: IGF1
  Gene Name: insulin-like growth factor 1 (somatomedin C)
  ENSP ID: ENSP00000376638
LKVKMHTMSSSHLFYLALCLLTFTSSATAGPETLCGAELVDALQFVCGDRGFYFNKPTGYGSSSRRAPQTGIVDECCFRSCDLRRLEMYCAPLKPAKSARSVRAQRHTDMPKTQKYQPPSTNKNTKSQRRKGSTFEERK

SEQ ID NO: 40571 - protein, 158 aa, Homo sapiens; identical to SEQ ID NO: 40569
  Payload ID: 8255
  Gene Symbol: IGF1
  Gene Name: insulin-like growth factor 1 (somatomedin C)
  Uniprot ID: P05019
  ENSP ID: ENSP00000394999

SEQ ID NO: 40572 - protein, 137 aa, Homo sapiens
  Payload ID: 8255
  Gene Symbol: IGF1
  Gene Name: insulin-like growth factor 1 (somatomedin C)
  Uniprot ID: P05019
  ENSP ID: ENSP00000416811
MITPTVKMHTMSSSHLFYLALCLLTFTSSATAGPETLCGAELVDALQFVCGDRGFYFNKPTGYGSSSRRAPQTGIVDECCFRSCDLRRLEMYCAPLKPAKSARSVRAQRHTDMPKTQKEVHLKNASRGSAGNKNYRM

SEQ ID NO: 40573 - protein, 1367 aa, Homo sapiens
  Payload ID: 8256
  Gene Symbol: IGF1R
  Gene Name: insulin-like growth factor 1 receptor
  Uniprot ID: P08069
  ENSP ID: ENSP00000268035
MKSGSGGGSPTSLWGLLFLSAALSLWPTSGEICGPGIDIRNDYQQLKRLENCTVIEGYLHILLISKAEDYRSYRFPKLTVITEYLLLFRVAGLESLGDLFPNLTVIRGWKLFYNYALVIFEMTNLKDIGLYNLRNITRGAIRIEKNADLCYLSTVDWSLILDAVSNNYIVGNKPPKECGDLCPGTMEEKPMCEKTTINNEYNYRCWTTNRCQKMCPSTCGKRACTENNECCHPECLGSCSAPDNDTACVACRHYYYAGVCVPACPPNTYRFEGWRCVDRDFCANILSAESSDSEGFVIHDGECMQECPSGFIRNGSQSMYCIPCEGPCPKVCEEEKKTKTIDSVTSAQMLQGCTIFKGNLLINIRRGNNIASELENFMGLIEVVTGYVKIRHSHALVSLSFLKNLRLILGEEQLEGNYSFYVLDNQNLQQLWDWDHRNLTIKAGKMYFAFNPKLCVSEIYRMEEVTGTKGRQSKGDINTRNNGERASCESDVLHFTSTTTSKNRIIITWHRYRPPDYRDLISFTVYYKEAPFKNVTEYDGQDACGSNSWNMVDVDLPPNKDVEPGILLHGLKPWTQYAVYVKAVTLTMVENDHIRGAKSEILYIRTNASVPSIPLDVLSASNSSSQLIVKWNPPSLPNGNLSYYIVRWQRQPQDGYLYRHNYCSKDKIPIRKYADGTIDIEEVTENPKTEVCGGEKGPCCACPKTEAEKQAEKEEAEYRKVFENFLHNSIFVPRPERKRRDVMQVANTTMSSRSRNTTAADTYNITDPEELETEYPFFESRVDNKERTVISNLRPFTLYRIDIHSCNHEAEKLGCSASNFVFARTMPAEGADDIPGPVTWEPRPENSIFLKWPEPENPNGLILMYEIKYGSQVEDQRECVSRQEYRKYGGAKLNRLNPGNYTARIQATSLSGNGSWTDPVFFYVQAKTGYENFIHLIIALPVAVLLIVGGLVIMLYVFHRKRNNSRLGNGVLYASVNPEYFSAADVYVPDEWEVAREKITMSRELGQGSFGMVYEGVAKGVVKDEPETRVAIKTVNEAASMRERIEFLNEASVMKEFNCHHVVRLLGVVSQGQPTLVIMELMTRGDLKSYLRSLRPEMENNPVLAPPSLSKMIQMAGEIADGMAYLNANKFVHRDLAARNCMVAEDFTVKIGDFGMTRDIYETDYYRKGGKGLLPVRWMSPESLKDGVFTTYSDVWSFGVVLWEIATLAEQPYQGLSNEQVLRFVMEGGLLDKPDNCPDMLFELMRMCWQYNPKMRPSFLEIISSIKEEMEPGFREVSFYYSEENKLPEPEELDLEPENMESVPLDPSASSSSLPLPDRHSGHKAENGPGPGVLVLRASFDERQPYAHMNGGRKNERALPLPQSSTC

SEQ ID NO: 40574 - protein, 1366 aa, Homo sapiens
  Payload ID: 8256
  Gene Symbol: IGF1R
  Gene Name: insulin-like growth factor 1 receptor
  ENSP ID: ENSP00000453007
MKSGSGGGSPTSLWGLLFLSAALSLWPTSGEICGPGIDIRNDYQQLKRLENCTVIEGYLHILLISKAEDYRSYRFPKLTVITEYLLLFRVAGLESLGDLFPNLTVIRGWKLFYNYALVIFEMTNLKDIGLYNLRNITRGAIRIEKNADLCYLSTVDWSLILDAVSNNYIVGNKPPKECGDLCPGTMEEKPMCEKTTINNEYNYRCWTTNRCQKMCPSTCGKRACTENNECCHPECLGSCSAPDNDTACVACRHYYYAGVCVPACPPNTYRFEGWRCVDRDFCANILSAESSDSEGFVIHDGECMQECPSGFIRNGSQSMYCIPCEGPCPKVCEEEKKTKTIDSVTSAQMLQGCTIFKGNLLINIRRGNNIASELENFMGLIEVVTGYVKIRHSHALVSLSFLKNLRLILGEEQLEGNYSFYVLDNQNLQQLWDWDHRNLTIKAGKMYFAFNPKLCVSEIYRMEEVTGTKGRQSKGDINTRNNGERASCESDVLHFTSTTTSKNRIIITWHRYRPPDYRDLISFTVYYKEAPFKNVTEYDGQDACGSNSWNMVDVDLPPNKDVEPGILLHGLKPWTQYAVYVKAVTLTMVENDHIRGAKSEILYIRTNASVPSIPLDVLSASNSSSQLIVKWNPPSLPNGNLSYYIVRWQRQPQDGYLYRHNYCSKDKIPIRKYADGTIDIEEVTENPKTEVCGGEKGPCCACPKTEAEKQAEKEEAEYRKVFENFLHNSIFVPRPERKRRDVMQVANTTMSSRSRNTTAADTYNITDPEELETEYPFFESRVDNKERTVISNLRPFTLYRIDIHSCNHEAEKLGCSASNFVFARTMPAEGADDIPGPVTWEPRPENSIFLKWPEPENPNGLILMYEIKYGSQVEDQRECVSRQEYRKYGGAKLNRLNPGNYTARIQATSLSGNGSWTDPVFFYVQAKRYENFIHLIIALPVAVLLIVGGLVIMLYVFHRKRNNSRLGNGVLYASVNPEYFSAADVYVPDEWEVAREKITMSRELGQGSFGMVYEGVAKGVVKDEPETRVAIKTVNEAASMRERIEFLNEASVMKEFNCHHVVRLLGVVSQGQPTLVIMELMTRGDLKSYLRSLRPEMENNPVLAPPSLSKMIQMAGEIADGMAYLNANKFVHRDLAARNCMVAEDFTVKIGDFGMTRDIYETDYYRKGGKGLLPVRWMSPESLKDGVFTTYSDVWSFGVVLWEIATLAEQPYQGLSNEQVLRFVMEGGLLDKPDNCPDMLFELMRMCWQYNPKMRPSFLEIISSIKEEMEPGFREVSFYYSEENKLPEPEELDLEPENMESVPLDPSASSSSLPLPDRHSGHKAENGPGPGVLVLRASFDERQPYAHMNGGRKNERALPLPQSSTC

SEQ ID NO: 40575 - protein, 103 aa, Homo sapiens
  Payload ID: 8256
  Gene Symbol: IGF1R
  Gene Name: insulin-like growth factor 1 receptor
  ENSP ID: ENSP00000453180
NYTARIQATSLSGNGSWTDPVFFYVQAKTGYENFIHLIIALPVAVLLIVGGLVIMLYVFHRKRNNSRLGNGVLYASVNPEYFSAADGAIAGCGVPRPANTGHH

SEQ ID NO: 40576 - protein, 190 aa, Homo sapiens
  Payload ID: 8256
  Gene Symbol: IGF1R
  Gene Name: insulin-like growth factor 1 receptor
  ENSP ID: ENSP00000453630
MTNLKDIGLYNLRNITRGAIRIEKNADLCYLSTVDWSLILDAVSNNYIVGNKPPKECGDLCPGTMEEKPMCEKTTINNEYNYRCWTTNRCQKMCPSTCGKRACTENNECCHPECLGSCSAPDNDTACVACRHYYYAGVCVPACPPNTYRFEGWRCVDRDFCANILSAESSDSEGFVIHDGECMQECPSGF

SEQ ID NO: 40577 - protein, 212 aa, Homo sapiens
  Payload ID: 8256
  Gene Symbol: IGF1R
  Gene Name: insulin-like growth factor 1 receptor
  ENSP ID: ENSP00000454115
MQECPSGFIRNGSQSMYCIPCEGPCPKVCEEEKKTKTIDSVTSAQMLQGCTIFKGNLLINIRRGNNIASELENFMGLIEVVTGYVKIRHSHALVSLSFLKNLRLILGEEQLEGNYSFYVLDNQNLQQLWDWDHRNLTIKAGKMYFAFNPKLCVSEIYRMEEVTGTKGRQSKGDINTRNNGERASCESDVLHFTSTTTSKNRIIITWHRYRPP

SEQ ID NO: 40578 - protein, 90 aa, Homo sapiens
  Payload ID: 8256
  Gene Symbol: IGF1R
  Gene Name: insulin-like growth factor 1 receptor
  ENSP ID: ENSP00000456950
  MOD_RES (1)..(1): Any amino acid
XTQYAVYVKAVTLTMVENDHIRGAKSEILYIRTNASVNREVEPSLSAQRQPELLHCALAAAASGRLPLPAQLLLQRQNPHQEVCRRHHRH

SEQ ID NO: 40579 - protein, 180 aa, Homo sapiens
  Payload ID: 8257
  Gene Symbol: IGF2
  Gene Name: insulin-like growth factor 2
  Uniprot ID: P01344
  ENSP ID: ENSP00000370796
MGIPMGKSMLVLLTFLAFASCCIAAYRPSETLCGGELVDTLQFVCGDRGFYFSRPASRVSRRSRGIVEECCFRSCDLALLETYCATPAKSERDVSTPPTVLPDNFPRYPVGKFFQYDTWKQSTQRLRRGLPALLRARRGHVLAKELEAFREAKRHRPLIALPTQDPAHGGAPPEMASNRK

SEQ ID NO: 40580 - protein, 183 aa, Homo sapiens
  Payload ID: 8257
  Gene Symbol: IGF2
  Gene Name: insulin-like growth factor 2
  Uniprot ID: P01344
  ENSP ID: ENSP00000370799
MGIPMGKSMLVLLTFLAFASCCIAAYRPSETLCGGELVDTLQFVCGDRGFYFRLPGRPASRVSRRSRGIVEECCFRSCDLALLETYCATPAKSERDVSTPPTVLPDNFPRYPVGKFFQYDTWKQSTQRLRRGLPALLRARRGHVLAKELEAFREAKRHRPLIALPTQDPAHGGAPPEMASNRK

SEQ ID NO: 40581 - protein, 180 aa, Homo sapiens; identical to SEQ ID NO: 40579
  Payload ID: 8257
  Gene Symbol: IGF2
  Gene Name: insulin-like growth factor 2
  Uniprot ID: P01344
  ENSP ID: ENSP00000370802

SEQ ID NO: 40582 - protein, 183 aa, Homo sapiens; identical to SEQ ID NO: 40580
  Payload ID: 8257
  Gene Symbol: IGF2
  Gene Name: insulin-like growth factor 2
  Uniprot ID: P01344
  ENSP ID: ENSP00000370813

SEQ ID NO: 40583 - protein, 236 aa, Homo sapiens
  Payload ID: 8257
  Gene Symbol: IGF2
  Gene Name: insulin-like growth factor 2
  Uniprot ID: P01344
  ENSP ID: ENSP00000391826
MVSPDPQIIVVAPETELASMQVQRTEDGVTIIQIFWVGRKGELLRRTPVSSAMQTPMGIPMGKSMLVLLTFLAFASCCIAAYRPSETLCGGELVDTLQFVCGDRGFYFSRPASRVSRRSRGIVEECCFRSCDLALLETYCATPAKSERDVSTPPTVLPDNFPRYPVGKFFQYDTWKQSTQRLRRGLPALLRARRGHVLAKELEAFREAKRHRPLIALPTQDPAHGGAPPEMASNRK

SEQ ID NO: 40584 - protein, 180 aa, Homo sapiens; identical to SEQ ID NO: 40579
  Payload ID: 8257
  Gene Symbol: IGF2
  Gene Name: insulin-like growth factor 2
  Uniprot ID: P01344
  ENSP ID: ENSP00000402047

SEQ ID NO: 40585 - protein, 180 aa, Homo sapiens; identical to SEQ ID NO: 40579
  Payload ID: 8257
  Gene Symbol: IGF2
  Gene Name: insulin-like growth factor 2
  Uniprot ID: P01344
  ENSP ID: ENSP00000414497

SEQ ID NO: 40586 - protein, 577 aa, Homo sapiens
  Payload ID: 8258
  Gene Symbol: IGF2BP1
  Gene Name: insulin-like growth factor 2 mRNA binding protein 1
  Uniprot ID: Q9NZI8
  ENSP ID: ENSP00000290341
MNKLYIGNLNESVTPADLEKVFAEHKISYSGQFLVKSGYAFVDCPDEHWAMKAIETFSGKVELQGKRLEIEHSVPKKQRSRKIQIRNIPPQLRWEVLDSLLAQYGTVENCEQVNTESETAVVNVTYSNREQTRQAIMKLNGHQLENHALKVSYIPDEQIAQGPENGRRGGFGSRGQPRQGSPVAAGAPAKQQQVDIPLRLLVPTQYVGAIIGKEGATIRNITKQTQSKIDVHRKENAGAAEKAISVHSTPEGCSSACKMILEIMHKEAKDTKTADEVPLKILAHNNFVGRLIGKEGRNLKKVEQDTETKITISSLQDLTLYNPERTITVKGAIENCCRAEQEIMKKVREAYENDVAAMSLQSHLIPGLNLAAVGLFPASSSAVPPPPSSVTGAAPYSSFMQAPEQEMVQVFIPAQAVGAIIGKKGQHIKQLSRFASASIKIAPPETPDSKVRMVIITGPPEAQFKAQGRIYGKLKEENFFGPKEEVKLETHIRVPASAAGRVIGKGGKTVNELQNLTAAEVVVPRDQTPDENDQVIVKIIGHFYASQMAQRKIRDILAQVKQQHQKGQSNQAQARRK

SEQ ID NO: 40587 - protein, 438 aa, Homo sapiens
  Payload ID: 8258
  Gene Symbol: IGF2BP1
  Gene Name: insulin-like growth factor 2 mRNA binding protein 1
  Uniprot ID: Q9NZI8
  ENSP ID: ENSP00000389135
MNKLYIGNLNESVTPADLEKVFAEHKISYSGQFLVKSGYAFVDCPDEHWAMKAIETFSGKVELQGKRLEIEHSVPKKQRSRKIQIRNIPPQLRWEVLDSLLAQYGTVENCEQVNTESETAVVNVTYSNREQTRQADEVPLKILAHNNFVGRLIGKEGRNLKKVEQDTETKITISSLQDLTLYNPERTITVKGAIENCCRAEQEIMKKVREAYENDVAAMSLQSHLIPGLNLAAVGLFPASSSAVPPPPSSVTGAAPYSSFMQAPEQEMVQVFIPAQAVGAIIGKKGQHIKQLSRFASASIKIAPPETPDSKVRMVIITGPPEAQFKAQGRIYGKLKEENFFGPKEEVKLETHIRVPASAAGRVIGKGGKTVNELQNLTAAEVVVPRDQTPDENDQVIVKIIGHFYASQMAQRKIRDILAQVKQQHQKGQSNQAQARRK

SEQ ID NO: 40588 - protein, 556 aa, Homo sapiens
  Payload ID: 8259
  Gene Symbol: IGF2BP2
  Gene Name: insulin-like growth factor 2 mRNA binding protein 2
  Uniprot ID: Q9Y6M1
  ENSP ID: ENSP00000320204
MMNKLYIGNLSPAVTADDLRQLFGDRKLPLAGQVLLKSGYAFVDYPDQNWAIRAIETLSGKVELHGKIMEVDYSVSKKLRSRKIQIRNIPPHLQWEVLDGLLAQYGTVENVEQVNTDTETAVVNVTYATREEAKIAMEKLSGHQFENYSFKISYIPDEEVSSPSPPQRAQRGDHSSREQGHAPGGTSQARQIDFPLRILVPTQFVGAIIGKEGLTIKNITKQTQSRVDIHRKENSGAAEKPVTIHATPEGTSEACRMILEIMQKEADETKLAEEIPLKILAHNGLVGRLIGKEGRNLKKIEHETGTKITISSLQDLSIYNPERTITVKGTVEACASAEIEIMKKLREAFENDMLAVNTHSGYFSSLYPHHQFGPFPHHHSYPEQEIVNLFIPTQAVGAIIGKKGAHIKQLARFAGASIKIAPAEGPDVSERMVIITGPPEAQFKAQGRIFGKLKEENFFNPKEEVKLEAHIRVPSSTAGRVIGKGGKTVNELQNLTSAEVIVPRDQTPDENEEVIVRIIGHFFASQTAQRKIREIVQQVKQQEQKYPQGVASQRSK

SEQ ID NO: 40589 - protein, 599 aa, Homo sapiens
  Payload ID: 8259
  Gene Symbol: IGF2BP2
  Gene Name: insulin-like growth factor 2 mRNA binding protein 2
  Uniprot ID: Q9Y6M1
  ENSP ID: ENSP00000371634
MMNKLYIGNLSPAVTADDLRQLFGDRKLPLAGQVLLKSGYAFVDYPDQNWAIRAIETLSGKVELHGKIMEVDYSVSKKLRSRKIQIRNIPPHLQWEVLDGLLAQYGTVENVEQVNTDTETAVVNVTYATREEAKIAMEKLSGHQFENYSFKISYIPDEEVSSPSPPQRAQRGDHSSREQGHAPGGTSQARQIDFPLRILVPTQFVGAIIGKEGLTIKNITKQTQSRVDIHRKENSGAAEKPVTIHATPEGTSEACRMILEIMQKEADETKLAEEIPLKILAHNGLVGRLIGKEGRNLKKIEHETGTKITISSLQDLSIYNPERTITVKGTVEACASAEIEIMKKLREAFENDMLAVNQQANLIPGLNLSALGIFSTGLSVLSPPAGPRGAPPAAPYHPFTTHSGYFSSLYPHHQFGPFPHHHSYPEQEIVNLFIPTQAVGAIIGKKGAHIKQLARFAGASIKIAPAEGPDVSERMVIITGPPEAQFKAQGRIFGKLKEENFFNPKEEVKLEAHIRVPSSTAGRVIGKGGKTVNELQNLTSAEVIVPRDQTPDENEEVIVRIIGHFFASQTAQRKIREIVQQVKQQEQKYPQGVASQRSK

SEQ ID NO: 40590 - protein, 605 aa, Homo sapiens
  Payload ID: 8259
  Gene Symbol: IGF2BP2
  Gene Name: insulin-like growth factor 2 mRNA binding protein 2
  ENSP ID: ENSP00000410242
MMNKLYIGNLSPAVTADDLRQLFGDRKLPLAGQVLLKSGYAFVDYPDQNWAIRAIETLSGKVELHGKIMEVDYSVSKKLRSRKIQIRNIPPHLQWEVLDGLLAQYGTVENVEQVFAFSLVNTDTETAVVNVTYATREEAKIAMEKLSGHQFENYSFKISYIPDEEVSSPSPPQRAQRGDHSSREQGHAPGGTSQARQIDFPLRILVPTQFVGAIIGKEGLTIKNITKQTQSRVDIHRKENSGAAEKPVTIHATPEGTSEACRMILEIMQKEADETKLAEEIPLKILAHNGLVGRLIGKEGRNLKKIEHETGTKITISSLQDLSIYNPERTITVKGTVEACASAEIEIMKKLREAFENDMLAVNQQANLIPGLNLSALGIFSTGLSVLSPPAGPRGAPPAAPYHPFTTHSGYFSSLYPHHQFGPFPHHHSYPEQEIVNLFIPTQAVGAIIGKKGAHIKQLARFAGASIKIAPAEGPDVSERMVIITGPPEAQFKAQGRIFGKLKEENFFNPKEEVKLEAHIRVPSSTAGRVIGKGGKTVNELQNLTSAEVIVPRDQTPDENEEVIVRIIGHFFASQTAQRKIREIVQQVKQQEQKYPQGVASQRSK

SEQ ID NO: 40591 - protein, 536 aa, Homo sapiens
  Payload ID: 8259
  Gene Symbol: IGF2BP2
  Gene Name: insulin-like growth factor 2 mRNA binding protein 2
  Uniprot ID: Q9Y6M1
  ENSP ID: ENSP00000413787
MFSCPGHYHVDGFLNPGSRKIQIRNIPPHLQWEVLDGLLAQYGTVENVEQVNTDTETAVVNVTYATREEAKIAMEKLSGHQFENYSFKISYIPDEEVSSPSPPQRAQRGDHSSREQGHAPGGTSQARQIDFPLRILVPTQFVGAIIGKEGLTIKNITKQTQSRVDIHRKENSGAAEKPVTIHATPEGTSEACRMILEIMQKEADETKLAEEIPLKILAHNGLVGRLIGKEGRNLKKIEHETGTKITISSLQDLSIYNPERTITVKGTVEACASAEIEIMKKLREAFENDMLAVNQQANLIPGLNLSALGIFSTGLSVLSPPAGPRGAPPAAPYHPFTTHSGYFSSLYPHHQFGPFPHHHSYPEQEIVNLFIPTQAVGAIIGKKGAHIKQLARFAGASIKIAPAEGPDVSERMVIITGPPEAQFKAQGRIFGKLKEENFFNPKEEVKLEAHIRVPSSTAGRVIGKGGKTVNELQNLTSAEVIVPRDQTPDENEEVIVRIIGHFFASQTAQRKIREIVQQVKQQEQKYPQGVASQRSK

SEQ ID NO: 40592 - protein, 579 aa, Homo sapiens
  Payload ID: 8260
  Gene Symbol: IGF2BP3
  Gene Name: insulin-like growth factor 2 mRNA binding protein 3
  Uniprot ID: O00425
  ENSP ID: ENSP00000258729
MNKLYIGNLSENAAPSDLESIFKDAKIPVSGPFLVKTGYAFVDCPDESWALKAIEALSGKIELHGKPIEVEHSVPKRQRIRKLQIRNIPPHLQWEVLDSLLVQYGVVESCEQVNTDSETAVVNVTYSSKDQARQALDKLNGFQLENFTLKVAYIPDEMAAQQNPLQQPRGRRGLGQRGSSRQGSPGSVSKQKPCDLPLRLLVPTQFVGAIIGKEGATIRNITKQTQSKIDVHRKENAGAAEKSITILSTPEGTSAACKSILEIMHKEAQDIKFTEEIPLKILAHNNFVGRLIGKEGRNLKKIEQDTDTKITISPLQELTLYNPERTITVKGNVETCAKAEEEIMKKIRESYENDIASMNLQAHLIPGLNLNALGLFPPTSGMPPPTSGPPSAMTPPYPQFEQSETETVHLFIPALSVGAIIGKQGQHIKQLSRFAGASIKIAPAEAPDAKVRMVIITGPPEAQFKAQGRIYGKIKEENFVSPKEEVKLEAHIRVPSFAAGRVIGKGGKTVNELQNLSSAEVVVPRDQTPDENDQVVVKITGHFYACQVAQRKIQEILTQVKQHQQQKALQSGPPQSRRK

SEQ ID NO: 40593 - protein, 81 aa, Homo sapiens
  Payload ID: 8260
  Gene Symbol: IGF2BP3
  Gene Name: insulin-like growth factor 2 mRNA binding protein 3
  ENSP ID: ENSP00000395936
MNKLYIGNLSENAAPSDLESIFKDAKIPVSGPFLVKTGYAFVDCPDESWALKAIEALSGKIELHGKPIEVEHSVPKRQSEH

SEQ ID NO: 40594 - protein, 198 aa, Homo sapiens
  Payload ID: 8260
  Gene Symbol: IGF2BP3
  Gene Name: insulin-like growth factor 2 mRNA binding protein 3
  Uniprot ID: O00425
  ENSP ID: ENSP00000480267
MPPPTSGPPSAMTPPYPQFEQSETETVHLFIPALSVGAIIGKQGQHIKQLSRFAGASIKIAPAEAPDAKVRMVIITGPPEAQFKAQGRIYGKIKEENFVSPKEEVKLEAHIRVPSFAAGRVIGKGGKTVNELQNLSSAEVVVPRDQTPDENDQVVVKITGHFYACQVAQRKIQEILTQVKQHQQQKALQSGPPQSRRK

SEQ ID NO: 40595 - protein, 2491 aa, Homo sapiens
  Payload ID: 8261
  Gene Symbol: IGF2R
  Gene Name: insulin-like growth factor 2 receptor
  Uniprot ID: P11717
  ENSP ID: ENSP00000349437
MGAAAGRSPHLGPAPARRPQRSLLLLQLLLLVAAPGSTQAQAAPFPELCSYTWEAVDTKNNVLYKINICGSVDIVQCGPSSAVCMHDLKTRTYHSVGDSVLRSATRSLLEFNTTVSCDQQGTNHRVQSSIAFLCGKTLGTPEFVTATECVHYFEWRTTAACKKDIFKANKEVPCYVFDEELRKHDLNPLIKLSGAYLVDDSDPDTSLFINVCRDIDTLRDPGSQLRACPPGTAACLVRGHQAFDVGQPRDGLKLVRKDRLVLSYVREEAGKLDFCDGHSPAVTITFVCPSERREGTIPKLTAKSNCRYEIEWITEYACHRDYLESKTCSLSGEQQDVSIDLTPLAQSGGSSYISDGKEYLFYLNVCGETEIQFCNKKQAAVCQVKKSDTSQVKAAGRYHNQTLRYSDGDLTLIYFGGDECSSGFQRMSVINFECNKTAGNDGKGTPVFTGEVDCTYFFTWDTEYACVKEKEDLLCGATDGKKRYDLSALVRHAEPEQNWEAVDGSQTETEKKHFFINICHRVLQEGKARGCPEDAAVCAVDKNGSKNLGKFISSPMKEKGNIQLSYSDGDDCGHGKKIKTNITLVCKPGDLESAPVLRTSGEGGCFYEFEWHTAAACVLSKTEGENCTVFDSQAGFSFDLSPLTKKNGAYKVETKKYDFYINVCGPVSVSPCQPDSGACQVAKSDEKTWNLGLSNAKLSYYDGMIQLNYRGGTPYNNERHTPRATLITFLCDRDAGVGFPEYQEEDNSTYNFRWYTSYACPEEPLECVVTDPSTLEQYDLSSLAKSEGGLGGNWYAMDNSGEHVTWRKYYINVCRPLNPVPGCNRYASACQMKYEKDQGSFTEVVSISNLGMAKTGPVVEDSGSLLLEYVNGSACTTSDGRQTTYTTRIHLVCSRGRLNSHPIFSLNWECVVSFLWNTEAACPIQTTTDTDQACSIRDPNSGFVFNLNPLNSSQGYNVSGIGKIFMFNVCGTMPVCGTILGKPASGCEAETQTEELKNWKPARPVGIEKSLQLSTEGFITLTYKGPLSAKGTADAFIVRFVCNDDVYSGPLKFLHQDIDSGQGIRNTYFEFETALACVPSPVDCQVTDLAGNEYDLTGLSTVRKPWTAVDTSVDGRKRTFYLSVCNPLPYIPGCQGSAVGSCLVSEGNSWNLGVVQMSPQAAANGSLSIMYVNGDKCGNQRFSTRITFECAQISGSPAFQLQDGCEYVFIWRTVEACPVVRVEGDNCEVKDPRHGNLYDLKPLGLNDTIVSAGEYTYYFRVCGKLSSDVCPTSDKSKVVSSCQEKREPQGFHKVAGLLTQKLTYENGLLKMNFTGGDTCHKVYQRSTAIFFYCDRGTQRPVFLKETSDCSYLFEWRTQYACPPFDLTECSFKDGAGNSFDLSSLSRYSDNWEAITGTGDPEHYLINVCKSLAPQAGTEPCPPEAAACLLGGSKPVNLGRVRDGPQWRDGIIVLKYVDGDLCPDGIRKKSTTIRFTCSESQVNSRPMFISAVEDCEYTFAWPTATACPMKSNEHDDCQVTNPSTGHLFDLSSLSGRAGFTAAYSEKGLVYMSICGENENCPPGVGACFGQTRISVGKANKRLRYVDQVLQLVYKDGSPCPSKSGLSYKSVISFVCRPEARPTNRPMLISLDKQTCTLFFSWHTPLACEQATECSVRNGSSIVDLSPLIHRTGGYEAYDESEDDASDTNPDFYINICQPLNPMHGVPCPAGAAVCKVPIDGPPIDIGRVAGPPILNPIANEIYLNFESSTPCLADKHFNYTSLIAFHCKRGVSMGTPKLLRTSECDFVFEWETPVVCPDEVRMDGCTLTDEQLLYSFNLSSLSTSTFKVTRDSRTYSVGVCTFAVGPEQGGCKDGGVCLLSGTKGASFGRLQSMKLDYRHQDEAVVLSYVNGDRCPPETDDGVPCVFPFIFNGKSYEECIIESRAKLWCSTTADYDRDHEWGFCRHSNSYRTSSIIFKCDEDEDIGRPQVFSEVRGCDVTFEWKTKVVCPPKKLECKFVQKHKTYDLRLLSSLTGSWSLVHNGVSYYINLCQKIYKGPLGCSERASICRRTTTGDVQVLGLVHTQKLGVIGDKVVVTYSKGYPCGGNKTASSVIELTCTKTVGRPAFKRFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGVGFDSENPGDDGQMHKGLSERSQAVGAVLSLLLVALTCCLLALLLYKKERRETVISKLTTCCRRSSNVSYKYSKVNKEEETDENETEWLMEEIQLPPPRQGKEGQENGHITTKSVKALSSLHGDDQDSEDEVLTIPEVKVHSGRGAGAESSHPVRNAQSNALQEREDDRVGLVRGEKARKGKSSSAQQKTVSSTKLVSFHDDSDEDLLHI

SEQ ID NO: 40596 - protein, 185 aa, Homo sapiens
  Payload ID: 8261
  Gene Symbol: IGF2R
  Gene Name: insulin-like growth factor 2 receptor
  ENSP ID: ENSP00000473880
  MOD_RES (1)..(1): Any amino acid
XCRRTTTGDVQVLGLVHTQKLGVIGDKVVVTYSKGYPCGGNKTASSVIELTCTKTVGRPAFKRFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQGNPWLPTKFHI

SEQ ID NO: 40597 - protein, 259 aa, Homo sapiens
  Payload ID: 8262
  Gene Symbol: IGFBP1
  Gene Name: insulin-like growth factor binding protein 1
  Uniprot ID: P08833
  ENSP ID: ENSP00000275525
MSEVPVARVWLVLLLLTVQVGVTAGAPWQCAPCSAEKLALCPPVSASCSEVTRSAGCGCCPMCALPLGAACGVATARCARGLSCRALPGEQQPLHALTRGQGACVQESDASAPHAAEAGSPESPESTEITEEELLDNFHLMAPSEEDHSILWDAISTYDGSKALHVTNIKKWKEPCRIELYRVVESLAKAQETSGEEISKFYLPNCNKNGFYHSRQCETSMDGEAGLCWCVYPWNGKRIPGSPEIRGDPNCQIYFNVQN

SEQ ID NO: 40598 - protein, 257 aa, Homo sapiens
  Payload ID: 8262
  Gene Symbol: IGFBP1
  Gene Name: insulin-like growth factor binding protein 1
  ENSP ID: ENSP00000413511
MSEVPVARVWLVLLLLTVQVGVTAGAPWQCAPCSAEKLALCPPVSASCSEVTRSAGCGCCPMCALPLGAACGVATARCARGLSCRALPGEQQPLHALTRGQGACVQESDASAPHAAEAGSPESPESTEITEEELLDNFHLMAPSEEDHSILWDAISTYDGSKALHVTNIKKWKEPCRIELYRVVESLAKAQETSGEEISKFYLPNCNKNGFYHSRQTSMDGEAGLCWCVYPWNGKRIPGSPEIRGDPNCQIYFNVQN

SEQ ID NO: 40599 - protein, 216 aa, Homo sapiens
  Payload ID: 8262
  Gene Symbol: IGFBP1
  Gene Name: insulin-like growth factor binding protein 1
  ENSP ID: ENSP00000417069
MSEVPVARVWLVLLLLTVQVGVTAGAPWQCAPCSAEKLALCPPVSASCSEVTRSAGCGCCPMCALPLGAACGVATARCARGLSCRALPGEQQPLHALTRGQGACVQESDASAPHAAEAGSPESPESTEITEEELLDNFHLMAPSEEDHSILWDAISTYDGSKALHVTNIKKWKCETSMDGEAGLCWCVYPWNGKRIPGSPEIRGDPNCQIYFNVQN

SEQ ID NO: 40600 - protein, 325 aa, Homo sapiens
  Payload ID: 8263
  Gene Symbol: IGFBP2
  Gene Name: insulin-like growth factor binding protein 2, 36kDa
  Uniprot ID: P18065
  ENSP ID: ENSP00000233809
MLPRVGCPALPLPPPPLLPLLLLLLGASGGGGGARAEVLFRCPPCTPERLAACGPPPVAPPAAVAAVAGGARMPCAELVREPGCGCCSVCARLEGEACGVYTPRCGQGLRCYPHPGSELPLQALVMGEGTCEKRRDAEYGASPEQVADNGDDHSEGGLVENHVDSTMNMLGGGGSAGRKPLKSGMKELAVFREKVTEQHRQMGKGGKHHLGLEEPKKLRPPPARTPCQQELDQVLERISTMRLPDERGPLEHLYSLHIPNCDKHGLYNLKQCKMSLNGQRGECWCVNPNTGKLIQGAPTIRGDPECHLFYNEQQEARGVHTQRMQ

SEQ ID NO: 40601 - protein, 181 aa, Homo sapiens
  Payload ID: 8263
  Gene Symbol: IGFBP2
  Gene Name: insulin-like growth factor binding protein 2, 36kDa
  ENSP ID: ENSP00000389646
MPCNNGDDHSEGGLVENHVDSTMNMLGGGGSAGRKPLKSGMKELAVFREKVTEQHRQMGKGGKHHLGLEEPKKLRPPPARTPCQQELDQVLERISTMRLPDERGPLEHLYSLHIPNCDKHGLYNLKQCKMSLNGQRGECWCVNPNTGKLIQGAPTIRGDPECHLFYNEQQEARGVHTQRMQ

SEQ ID NO: 40602 - protein, 98 aa, Homo sapiens
  Payload ID: 8263
  Gene Symbol: IGFBP2
  Gene Name: insulin-like growth factor binding protein 2, 36kDa
  ENSP ID: ENSP00000400308
KHHLGLEEPKKLRPPPARQLLAELASGACFVGLLSSLRASPAVCACRLPANRNWTRSWSGSPPCAFRMSGALWSTSTPCTSPTVTSMACTTSNSARCL

SEQ ID NO: 40603 - protein, 78 aa, Homo sapiens
  Payload ID: 8263
  Gene Symbol: IGFBP2
  Gene Name: insulin-like growth factor binding protein 2, 36kDa
  ENSP ID: ENSP00000401698
MNMLGGGGSAGRKPLKSGMKELAVFREKVTEQHRQMGKGGKHHLGLEEPKKLRPPPARTPCQQELDQVLERISTMRLP

SEQ ID NO: 40604 - protein, 291 aa, Homo sapiens
  Payload ID: 8264
  Gene Symbol: IGFBP3
  Gene Name: insulin-like growth factor binding protein 3
  Uniprot ID: P17936
  ENSP ID: ENSP00000275521
MQRARPTLWAAALTLLVLLRGPPVARAGASSAGLGPVVRCEPCDARALAQCAPPPAVCAELVREPGCGCCLTCALSEGQPCGIYTERCGSGLRCQPSPDEARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 40605 - protein, 297 aa, Homo sapiens
  Payload ID: 8264
  Gene Symbol: IGFBP3
  Gene Name: insulin-like growth factor binding protein 3
  Uniprot ID: P17936
  ENSP ID: ENSP00000370473
MQRARPTLWAAALTLLVLLRGPPVARAGASSAGLGPVVRCEPCDARALAQCAPPPAVCAELVREPGCGCCLTCALSEGQPCGIYTERCGSGLRCQPSPDEARPLQALLDGRGLCVNASAVSRLRAYLLPAPPAPGEPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 40606 - protein, 194 aa, Homo sapiens
  Payload ID: 8264
  Gene Symbol: IGFBP3
  Gene Name: insulin-like growth factor binding protein 3
  ENSP ID: ENSP00000370476
MQRARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 40607 - protein, 132 aa, Homo sapiens
  Payload ID: 8264
  Gene Symbol: IGFBP3
  Gene Name: insulin-like growth factor binding protein 3
  ENSP ID: ENSP00000389668
MRSAVCQFPRHRLAAGRPHPESGRGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDK

SEQ ID NO: 40608 - protein, 143 aa, Homo sapiens
  Payload ID: 8264
  Gene Symbol: IGFBP3
  Gene Name: insulin-like growth factor binding protein 3
  ENSP ID: ENSP00000390298
  MOD_RES (1)..(1): Any amino acid
XESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 40609 - protein, 153 aa, Homo sapiens
  Payload ID: 8264
  Gene Symbol: IGFBP3
  Gene Name: insulin-like growth factor binding protein 3
  ENSP ID: ENSP00000399116
  MOD_RES (1)..(1): Any amino acid
XSEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 40610 - protein, 270 aa, Homo sapiens
  Payload ID: 8264
  Gene Symbol: IGFBP3
  Gene Name: insulin-like growth factor binding protein 3
  ENSP ID: ENSP00000477772
MQRARPTLWAAALTLLVRCEPCDARALAQCAPPPAVCAELVREPGCGCCLTCALSEGQPCGIYTERCGSGLRCQPSPDEARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK
